United States Patent 7,365,185 (GENOMIC PLANT SEQUENCES AND USES THEREOF) - sequence listing, part 70

SEQ ID NO: 74118 - DNA, 36388 bp, Oryza sativa
tacagttttgaaatcctgtaggcgtaagtgggtccactcatgcgttgccttttggagaagagtagatttatgctgttcatatcgatttttgggagatgtccacaaagcacgtgggtcctccttatacatgtactccattttcaaatcctgacggatatgattcctcgttactttcaaggcggagtatttagacacgttagagggggcaacgttcccttcagctgtttcatctatacatctgtatagtccattggtcgacagatttactttgacatctatcgcccaagcagggattttggaaccatcaagagtgaggatatcaaactctttggttgctatctcacctacattgtgatagccaaaatttttgagaaattatggcatatttatgccattttatgtgaatttgtaaaaaataaagtgcgtgtaaaaataaaggacatggaaatgcatagagtgctgaatcaaactcatatttataataacagagagttacggggtgctgaaagcaaatgtatagtctctgattatttgcggaaagtaaattgaccaaagatcaggagctagaatgaaaattctggaaaaataaaaataaatgggcgatgagccgatacaatctcggtttcgacccgccgctgctttcggtccaggaagtcgggaggggaggcgcgggcgcataggggccattagttggcgccaccccatcctcccacttgaactgctgctgccgacagtacaccgttgctgccgatttgtgttgccgccactcgtctctgcagggacatgtccggtcttgatgatgcggtggaggccggggcgcgcgtttgctgccgcggctacagtcgggcggccggggaacgaaggggcctgtggtggagatggaggtgcgagcacggaaccgctggagccacctactgctatgtagaaggaaggggctccgcaacgcgcgacgatggtgcctctaaggaggagcttcggcggttcagcccgtattggagtgtacagcggcgtcgttggtgagtactccggtgaaggtgacggtgatatgatgtggcgagcgtggtttgtccagccgtggtgaggacagtatgacgtcaccatgtctggcacctcctgcggtagcccgtcgggctgtagccgcacccttgccatccatcgatgggacttgcagtggcgcggcgactccaccagaatgtgttatggcgtggtgcaggtgtcaggcatcactggaggcccatagcgagtcgcgagggtgctggagttagggctatcagctctggtggttctgcaggcagttggtccatcgtcgcggcgtttcctccatgtctggcgaagccagagggaggagaccgggggccacggccggcaaagccagcaccacagcccctgtcacgtcgagaacggcgcacaagagcccgaagaagcttgtcgagttgttgatgcatgaggcaacgtagatggcgagcacgaaggttgcgatgaagaggagatccagcgtcaagaggaatgggaaaatggcgagcaatcttaccctttgagttaccggtgagttcttcacctttgttgctcagtatcttagagctgctgacaacgtgttagaaaactaaaagtagaaacagtgattcatgaatttgcccatattctcgttgatcttaaggtctctttataaatagggagattacaaacctagttaattctaggcattagtgtaatacatcaattcttattctaaaggtagcaataaggttgattcatttccttgcaataaggttgattaatggttttaaccatggctattacaatggatttaaaaccatgatggctgcattgactaggtcaaataatgtccttttgtaacaatactgatagtgtttagtggtaggacaagtgagaatattcagatttgagagttaatagaactgtgggccgtgcaaaattagtcgttgagaatttagatgtttctacggttcgcaatggtgcgcaccctatcgggtaacaataagcatgttgtagcagacaaaagaatttatattttcacttgttgacaaaattagaatgaactataggaaaaaaatcattgcttacatggggcattgtactcgatgcagaacaacattaaggagagcgagtgccattgggggcagaagaacatgttgtatgaagactgatttccctgaaaaatactgggaatgacagattggttcttatacatggcatttgggctttttctgtgtttcgacttaattaattagggcttgttcaattttctaccattttcaaacttactaacattgggtaataccaaattttggtagtattagatgcgtttagtttaaaatcttacttttatgttggtagagtttttgagagtggaagtttctggatttttcaaattttggtatggtagcaatggtaaggatgtgtttggtttgttgctctaataaaatttgacgatgataaaatttggtagggttgaaaatagcaataaagaaaagtgagcagggtactcctaatgatgttgtactgttctattactgttctattaactcaatgttggtgattgttgtcatcatttaccttgcatgaacaggttgtacaaactggaccattaattaatattatatatgtagtatcatttagatgcagtaaatattcattcagtatgaactagccactttgtcacgcattgcgtgactttgatggccccctatgatatgtaaaagttctatgatgaatgtctgctagatatatgtgcggaatttcaatttttatatgaagaacttgataaagaattgctatggattttatttcattatataattttttttatttttttgtttaactagaaaaattgcccgtgcgttgcaacgggcgaaggttattttaatcttattattgttatacggtttagttaaggtgaaattcagtatgggaattcgcttgaatatataatttttttagaaaatcatgagctgcagttaggagtatgatcatctcaagttagcatgtgagtttttttaaaaagatttattatacgacttcttttgtatttaaaaaacaaacgaccttaaaaaccaactcaaatacggatatatatttcaaaagcgaataaaattaaaaaccgactcatacacagatggcgtaccaaagtaccgacaaaaacatctttattttcatttttataatagtagagatgtacctctggttagcttgcttccgtcagcggcgcaatgccgaaactctagatcatataggtttcatatgttgactcgaaatcaacctgccatgttaccaaaccaccgctgagaaagagtcgattagtacctgtttttaattattggaggagacgtacattgtatcaggttttacgttttgagaccttattaagagaaaagcaatatgtgagggaggcaaaatagacttactgttagttggacctgtgagtagaggcccagcccatttagctcctcctctcttcctcgcagtgcccgtgcccgccgccctcgcaacaacatctgtgagggtttcgactcggcagcaatggcgagggatgagatccaagccggcatccccaagctcaactcgacaactcccccgagaagaatggatcatccaagaagaagaagaagaagaagaagaagaagaaggcacaagcacaagcacaagcccgacgaggtgaaagaggagatggtggtggacgccttacccaaggaggaagaggaggaggagcgcgggaagaggaggaagaagaagaggaagaagctggtgacggtgaagctgagcgacgagctgatgggatacctgcggaccaaggaggttatggcctacctcgcgcgcgagacgcctcgcccgctcccgatcgatcccagcatcgcgcagcacatgttcgtcggccaagaactcaggcaggaaatcgctgcccaagttcacgagaacagagaattcgacgccttcgtcctctaccagtaccgcaccaagggctacgccgagatccagcaggaggtcaccgatgacgacgacgacgacggctagaatctgtatggtatgtttttgcagggatcgataagggactacctatatatttgtcgacaaattttctagtaaaaatttgacagatgtaattatagtacaatcatagtgtaattacactgtaacttgtatgtaattacactgtaacttgcatgtaactatagtgtaacttgtatgtaagtttcacgtaattttgaatcgttagatctattacaagatttgttctggtgaagaagaaaaaaatcatagcacacacatatgtgaaaggatttgttcccacgatctctattttactgaaataacatgttaccgagagattcttgaaagttacatacaagttacattatagttacagtgtaattacatgcaagttacagtgtaattacactacgattgtactgtaattacatctgacaaatattagggggagaaatttgatgacaaatatctagcaaaatcgtgtcttcatctattcatttgattaatcttcaaacaactcacaagtgtgaatcttctgcggtattgttcttttgttcatgtgccaatgcagtgtgatttggtgcgctctttttttcatattttagtagatagcactctcccttggttatacaatcaagggctttttagtggatggaaagaataaagaattccatgcttttgtacatttgtttagagaaacaatatacatgtgtttgcaaaactgtgagctttatgcatcgtactgctgactaaaagattatcttctcactctgttgagttggtttcacaaccctatcgaaccactttgaaaaaagtctgaaacaacggattgggtttgcaccagccaattcacctgcatctgttgcttaaacagaaataaaataaaataaattctcatgcatcttcatgacgattattggccagagctaatcatagatctttttcagtgatctcagtgacagaaaagatagcagggatttgtatgcccgtggttcgagggaggggtccatatatttattgggccgtaactgaattctgacctacgtgcagcccatattagttcggcctgaaaggacattccgatttattgcagcccattttgttgtcgggctggaacggcggtatcaccctagttgggctggacgtgaggcccaataactgatgcttaccagttgggccgacccgagatggatgaccccgttattgggcctcgtatcgccgccggcccatcccatcgctagtgctcgcggaggccggagcggaggaggagacggacgcggcggcggcgccaccggcgacggcctctccttcgtctcgttctccgctctgcttgacgggaggcggctcctccgcgcgtccccctctccgccgcggtgaccggccgaggggtgctccgccctccgcttctcccaaccccggacggggcgccgccgagccagtgctccccgacggcggcggcggcggcgaggaacccgtccccgacagccgaaactcggatcccaactaggaggagctgcagaaagccggcgtctcctacctccaacggtgggaaatctcaaatctctcaagtctcatctactgatttagttttgttcattctctatttctgctatttctgttgttattagttctcaaatgcctagatggatagattgaagaaattacagactaattgaaaatcatcaaaactttagctactgaatgagatgggtgatgaaatggctcaaccatcacatggtgagccaaagacatgtgcaacagccaacagtgcaagcattgaaaaaaagggaagatattttttcttctaacatgtaagaacccgaaagatgaagcttcctctcactattttaatttctcgttaagatgcgattttgtgattcatttatatccgtaggatcaagatggtgacagtgaagaagaagaaatctttgcctgctctggctcacaatacttattttcgtactgaagcttgttcattattgttaaattgagcaatcatttcctgactctcattcaggcttcgacttgactgcaaaatatggatctttctcctttcaagttggatattgatgagctactagcggattataccgaggtaattttgactatcctgcaatctctctaggtgtgtcacatttatatcagcttgacgttgctgtttttcttattggtaggcaaattgcactgcattcgctgatttcaagagattgtggatggcaaagaaattttcttatatctatgaaggaagacctaagacaaactctggcgctttcatgcagtcgctctttttgcattgtattggtaggctggcttcctggaaatttgcactgacatacccacaaataatctttggagtcatttctgatcaattttcacttttttactattacaggtcatatgacatctcagagttgtatgcctcaaagattggctggactttactgcctttactgtctttacgaatcgcaaccatacaagccacatttcaagatctatttgtctcttggtaatgcacttgctttcggtcactaatttggtgcttctgatatcactagccaaatgcccatgcgttgcaacggattactgaaatagtaaaaattaaatccttgttgaaaaataatgatcttttatttggttgaaacaagatctttcatctttaaaaaagaaatgaaaaatgccatacttaggattgtggttctcaatgtgagacataaacataagtagtttccagtacttgaatataaatcggtgactccaaccattttaactaaatgtcttttttcatatgataatgaaatatatattttgattaaagttcgaaatatgtactcgttaataaatatgcaaagcaatataagctgcagactgcatagtagtatagactatacatacaacatgggccacatgtcagtgatcgtggtggtggtggcaccgctactgtcttttagaagtagtatagacatactaatatgctcagtatttgtatgcaacagaggagttgaagaaactcaaggattttgttgttgaggctaagcaaaatggaatggctgttgtaccgtcacttgtcaaaagaatgctggacaaaggaatgattttgtttggattcatcaatctacttggtgactcaggggtgaagcaggtcaatgagttaactgcatctcagaataagagagtgaaattcgcatgtgacaagtatgtgttaaactgattctcattagtatttgtgatccattccatttactattgtcctattcaaacaagaacacgtaataaattattgcatgctaatattttgttgttatcctccaggttgtttatgaatactcagatagacagttatatgcacatggatttggtaaggtttagcctgttgacttaaataacttctttttgtttctttcatgcctttttacattataacaaatgacaatacatcaacatgaccacaagcccatactagaaatcctttcatttagtttctcaaaatattacatacccttctgttactgacaaattgatctacgtctagggttcggagcttgaacttgataagatcaagaaatcatcgttggattatgccaaagccaaggaattggcatttgcaggtgctcttagttgtttccattgcattatatagctttcagtttctgtgtgtactcactgagaactttattatcagtaacgatgattttgatcctcctcctactggttttatcctttttctgcttcacagaggcaagcaatattatcgatgttgaagatgctaggcacattgttcagaatgacaaactgctgggcgacagggtagatgaaatcgtcaaagaatgggatgcacagaaggaggccttctacgagaagacgggagtacgtcgcgatgaactagcagtagttgaacatgacgaatcaggagtactccctcatgaaaacgatgaattcgatgagattagacagctgctgctagagtgaaagtagtgtacaacagcatcctcctaaaaaaacagatgaaatcattcattggcttactggagtctctcagtttttttttccttttgtcactcatatgctctttttgagtgttttactgccctgctgtacgttgcaaacaaaaacaacttgtacatagtagtgatatgttggatgaatgttactattaccatattgcgtagttgtacattgcaagattcatttataagacatggatttcataaaaattttgcagaaatctcaacagaaagagtttgaattcccgtgttccaaatgagcctgtgatatgtttgatatttttttctccattatttgtgcagcaagttgatatcactcgatgttctgattggttcctgaacttatcagctcgaaccaaaatttatattttaaatattaattttagagttgatttcgatttttaacatagtttattttcaagcaaatgacttggaagttggaacaaatatataaacattttactttcaattttttttctagtaaccgttgtgggttttgattagctcgaggtgattttttttggactgtcagtctcccagagtccagaagaggatagtggaaaaaaatgtgtgaaagagagacacgtggcgcgcgcaaaagatccacgtccctcgactcgcccgcacccccgccactccccctctcccctctcgccgccgtctctcgccgccgccgcggcgctcgtcgaacacctaccgcccgccgcccgcctcgtcgccggtgcggagcgcaccggcgagcgagatgtggcccgccgcagccgcgtccctccacgtgctcgtcctcccgccactccctcctcccggttgcaggacgcgccgagccgcccctgtcctcgcgcgccgcggccgtggcgtgcgacatgccgcgcgccgcgacacgccgcctaacccggtggacgcggtcgactgcgtcggcacgggcgccgacgtcgagtgctacgtcgacgaccgcccaggcgcggaagtggggcccatccgccgcgaggcgacgccgccgccctccccgcaggacgcggtcgactgcgtcggcacgggcacggacgtcgagtgcttcgtcgacggcccaggcgcaggcgcaggcgtaggcgcggagcccctcctcgcgcgggtctccgaggaggaggaggatggcgtctcggcctcggcggcggcgctcgtggggagggagtggtgggagtgggcgtcgctggtgtcgcccttcttcttctggggcacggccatggtggcgatgaagggggtcatacccaagacgggccccttcttcgtcgccgcgctccgcctcctccccgccggcgcgctgctcgtcgccttcgccgccgcgcgcggcaggaggcagccctccggctgggccgcctgggtcgccgtcgccgccttcggcctcgtcgacgccgcctgcttccaggtgctcccccccgccatagctgcaaggtgttcgcttcttagctctagcgtgtggctgtgctgttcctgagctaaaagcattcgtctcatctcgcagggatttctcgcggagggattgcagaagacatcggctgggctcggaagcgtaagctgaattctcactgctgttcttcacctcctcatacctcgagcaagccattgatactgcccccattttttgtcaattgaactgatggccatgttttcaactgaaatctccattgcaggttatcattgattctcagccattaacggtagctgtccttgcagcgctgctctttggagaatcgattggcgcgataggagttggagggctcgtgctgggtgtcgtcgggcttttgcttctcgaggtttgcctttgtatgcagcatacatgatatcagtattgaacctaggcagataatgttgattacggtaacaggttgtgttaatataatattttctcgacggccattgcatagttatagcatttcgaaggcataagttccttgtagaaatatttgaaccaaacccacttatttgatttgtcttaattcccatagcaattcttacaggttacaacaattgccttctgaattattctattactgatatgtggcaactaattattcagtacatacatgctgtgttatccataaaatggtgtaagtggcgatcttagcttttccaagttatgctgtattttatcgaaatcaaacatgtgctgtgtgaatttaatgccttcttgtattgtgtgcttactcattgattgtgtatatctgtgctaggttccagcactatcagttgaagggaatgacacagcgatctggggaagtggggaatggtggatgttcctctcggcccaaagcatggctgtcggaactatcatggtccgttgggtgtcaaagtattctgatccaatcatggcaacaggatgggtatgttattgcagatgaataaatagttttttttttagtataagaacaaagtgatgcatgctctagagcacaattgatattctttagttttcttgctacaaatgtacctttttaccatgatatgttttgtgcaaatgattctgtatgcatcttggaagtgctaatttggtcatttttattatgaggaactcaatgtgtatacctatgcttttctgcattgtggatcttaatgcatatttctgataaattgtgagaggaatcatgtattggaaatgcattcatagtgcaagtctgcaacatcaactggaatatgaatgctcagatcaacctataactttcaactctgtaatggttctatcagattatgtatgttgatgtgattacagctgattgtcattccccctgttctttggatagttttgtttgtttttgcaattctgaaaagcctggcattacaccatgtaaaatgctaatattcacataattacagcacatgataattggtggccttcctttgttggttatatctgttctcaatcatgatcctgcgctgaatgggcatcttcaagaacttacactgaatgatgtattagcacttctctatacatctatatttggcagtgctatcagctatggtgtgtacttctacaatgctacaagaggtaagatcacttcccactcatgtttagcatttactggtattgtccacaaatatattcttttaggattcccatatgattatgttctttgcaggtagcttgaccacacttagttctctcactttcttaactcctatgtttgcttccatttttgggtaagattctttccccaacatgtcaagctaaacatacatgacaattgacaaacatgtagcacttgttttctaattgctcttctgcctcacctttccttctcaggttcctctatctgggagagaccttctcgcctgtacagcttggtggcgcgcttctaacattggtcgccatctatatggttaactacaaaagcatcgtaggcgagaagtaaaaggccgttgcaagattcttctggagacactggcacagatgaatgctgtactgaagcacctgtaacatttcattggcgcaaaacagcaatgtgaagatttaaagtacatcccacggtcccaacatctcacacagcttgaactgtgaaagaagacagggatatggtggtataacctctgaacatagttagactggtaatttgggcatcagtgcatacttccgaggttcccaagttagtcatctacttcatttcggcttgcattctgaaatggataaaacttgagtgtcatcagatggttaaaacatagttgctatgaactgtgttgtggatatcaaattgagggaagttgcccctttgtacaagtagtttggagcataaaaaaatagttgatcgaaaggaagcagctgtatatgttgagcacaagcttcgtctatcgatctaagttcagacactttccctgataaatacgaagcatgtcccttttgtgagaaaaaagggaactgtgaaactgtagttgatggtgcatgtatatatacgtgtatatgttttccaactgtgatatattttacaattattttatattttaattttttttaaaataaacattttatattttgcattttgagaactagtaatattgtcgtttgaaacatagttttccaaataccaaaacggctaaaagcagtaccaccaccaaatcgagattatcaaaatctactgcaattccaaattcatcaactttaactacaaggcaggtaaaatacagtatgaatccaattccaaccacgacatatattggatatcaaaatagttccaaaactttctgtacacggtcggtttacatcttcagccaagaaaaacacaaaacctataagtcctgatatattcggtatatattcagctgcaggtaaactctcaagtctcaagtctcaagcggtataaaactctatccggcaaatgtcagtgtcattttgacaaaacggtaaaacgtttgctaccattgtcgctggggtaagtaaaaatctgatgcctcctctccaaagtctgcagccatggggtttctttgcaagttgcaacctactcttctcagatgacacagatcagctgttcagatcacatggggtgagtgatgaagtagttgtagtcatggtgctggactccgagctgcttgagccaggaatccgcggcgccgaagagggagaccatcctgtcacggtcccctgttctcgggttggtccagagagaaccctgcagcttgtgcgccgcgagcccgaacggagcaagatgagtcttgctgaccttcttctccgtctcgtcgtttcgcttcccgttggccatgctctcgagcgcgtaatctgtggatgaggcggaaaatacaggtcagcacggttcaaaattagtgccaagaacatcattaccgcaacgcgttgcagttcaaaaacagaactaaggtgatcatcggtgaagtttaataaaggaaaacagtgcataatatttttcttcttaatatgcatatcactatcaagcacactgggatggctcagtttagactcaagtaccattacccactgattttttatatatttgaaatggacagctggggtgcctaagtgctgttgcactcattgcaatccaagcaaccttgcaccaatattttatataagtatacaaagagctcctaccactgtggtagaacatagatatttctagtttttaagaaacagctgcatgcctaagactaagcactaaaagtcatggcatgtggcaagacagtctccttcctccgctttatcgggcaaccaaacttctgccacttatcctcttttttaagtgacatccttatatatgcacttaaaagctaaggcatgagaccttttgaagctgaagttggaagcttggatgcaaaatagaaagctgtacaatcccttgaagaaaacttacaaactcttgcaagctaagcctgtgttttaagctaacatagcatgctaatgtgcagtaaaaaacatatcttgacattaacacaaaataataagagtaaatatattttctaaatttagcatctaaaatgaagaggataaaagcatcaatgtgcttggtctgaactctgaactgtaaagaccaatcaatcgatcagtcgcaagcaaggcgactgttttctagctacataagtccacagtctgaacactaaagaccactcatctgaccagtctcaagcaaagcaactattttctatatatatagttcattttctgaacattaaagaccacttgatcaaacagtcccaagcaacactactgcgaaagctacactgctacagttttgagtgtcttagtcctgggatagcatgttgccatttaagcatagtttaaacatatactgatcctgaggtttttttccccacaggaactgattattcttgtgtaatgtatatcatcatgagatgtaacaaagaaaaaacatatagtaagctataatatttttgaattgatatgcctgcctatggcaacactgtaagcacacaaaggggcaatatcatatccattattttcatccagtaatagaatagtaccctagaatatatatatttttcgactctatcacaagattcaatcaaactagtacttgttaatgtccctaatgcaacaaatagcataccttgaaatgaagaggaaatggtatgataagttaggaagcatgcagataagtccttcacattgcgctggtagggaatatggtagatgggatacctaaatatagcaatataagttaatgataatgtttagcgtaattgtctctgggaacagaattaacaaccaataatggattcaagctcctggagacatcagctactatttagaaacaaaagaattataaagtgccaaaattaacagaaatgcttcaatcaactaccaaaccaagcaacaaggcgattagaacaaccatgaatgcagaaacaccagatttactatagctgtttataagccagattttatgctaattgccaaaaaaacagcattaatagaggtaagcttgatcaataccaggcaactgacatccaactagcaggcgaaaggtcaacacttctcagggatgtcaacccaggatagctctgggatagttcatacacctgtagaaaaacgatataagcataggaaaaagaaacagctggtctaaactactatcacataggacataaaaatttaccttgtcaatgagtggaatccttccataaggagagcaaacctcgaagaactcaaaatacatgtgcccgtggcgttttctattgccacttattgcatcacagttaaataatgagtcttcagatgttgaactccaagatcttgacatcttctcattgtcctcatcatcgctccaatagtccatgccattatcttcaccaaaactcctacagaaaaaaaaaacagagagagaaccgattcacaatgcatccagaaatcggcacagactcaaaattcacgcacaagaacggatcttttgtgcagacctggatgcagtctgggctttgttggtatatagctgtatccctgacaagtagggaacatagtattggactactctttcccctccatacagctgcaccgtagttccagccccgtacgcgctccactcatagtactgctcccataggtccgcgaggttgaagtactcgacgctgtccatctcggcgtggtgccaagaatcgctcgaaaaccggccattcgcctggatcaaaacgagcaacatctcactttcagtcttaagttgacaaaataagcacagctagtggtagcccagcttagctaacccagatcgaaaaggcactcatatacagcagctgatcaacatgcggaaatagaattgacaatagcaaccgggaatttaagatggcaaccgtatatcgccacaggccgcagctactttcgtcccaattaggcagcacggcagcaagcacagagcttgatggtacaattgtccttataatcgtaccaaggaaaagctatatacaagcatggacgcactatcaattaatcaatcaatctaccattacccacaccccccatccttttcacggatgcattttgcaatcaggaaacacgcagcagcatgatcaatctctgacagaaaaaaaaataaaaagaaataaacagagagcagtaactagaataatcgagtaatgggcaacagatcatgtcagccacatccacaccaaaaatctcgcaaagaacacgaagctttaatcaatcgatcaatgagagagagagagaggaggaggaggagggggtgaccttggggaggaggtgcgtgtcgacggcgggggtggtgcagtccaagaagcactgcaggttggacgacggcgacgacgaacgcccgtactcctccacccacctcccgcccgcgcccatggcggcctcctcctcctcaccactcacactcaccgccaccgccgccgctccaaacgccaacgcaaccaacaaacacacgaagaaaccgaaatccgcccgagagagagagacaaagaacccaccgcccctttgctgctgctgctgccaagattggagaggaggaggaggagggggaaggggaggagactttatgcggactgatgcgaggaggaagaggaggaggagagagaaactgggcttcggtttgctttggcttctgtgtttctctctctaggtgaggtgaggtgaggtgaggttagttttctctctctaggcgtcgggggaggggttgccttgtcgggcgcagcaacaacgcaatctcatccccacgtcacgcacccacgggggaggaaggagggaatgggggagaagagaaagctacgggtactgacccggtagcccgataaggcattgttcgcctgttcagttaatccctctggtaatggactgataatttgatttttaatctcaatatcttgtttggtagaggggatggaaattgatagggagtttagttagagattagatcattaataaaaacggatggttgagatttgattagacaaagtaaaggaggaattccctcccaattacctgcccctacccaggtattgaaaaagagggagttccttccttaattcctcatcccatcccactaaaattctcatatcttctaaccaaacaaaacacttaatagcatcatccctctaaactcccaatcccttctaaaaactccctccaaccaaacgggctgtaagaggatttgaaaggaatgtatttcatgtctattgtagtatgtactccctccctttcaggttataagccgttttgactttaagtttgaccaagtttgtaggaaaaaatagtagcatttttaaccaagacaaatttattatgaaaatatgttcaattattgatttgatgaaactaatttagtataataaatattactgtaaatttagttaaacttgaaacagtttgactataacctaaaacggagggagtaattattttttaaaaaacatctctattttttttcctactcggaattaatcgaataaggcctacgggagtagatcgcctgactcaccaaactaagatggtgttggtatgaaaattggaatgtgagtttgattttgtttttttttcctttagatttgttttgtagtttcttcattcatgaaattattctttgtatctgtgtaatcttcttcttaaatgaatgtatttttttcttcacttgttattgtttcaacattatattaggctgaaaacatatggttactactcgtatttacggttatttattctttcgatgctatatgatgtgcctacgatggtgagacatgtatgactttatatttactttatcaatctcaatatattttcttcaagatataggatagggcgtgcgtgcacgttttaagggtaactgctcgcacgtgcatacgtgtttatattgtttttaaaaagataaaacaaaagggacgcgccataggataccaacgtgcacacaagaaagactacttacgaaaaaactagttacttggttacactaactaacgaatttagagtgccacataataaaaacataattttacacataatctatgtgagctaaacactctgttctactcatattttttttacatgtaaagttctttttttccctaaaagataaagggggcagacattctctcactacactcctacaaactcaccaaacccgttaacccgcaaaaacagaattggatcagttaaatattgctttccatcttttggaagcctttgactctttttttccaccttgtcatgcagccgggcccactctcctgtatatccaaagccaagccacgaaagtgtaaagccacagcaatttttcttttctatgagccctttaaataaaaaggcaaaaatattttttgtggatccgatagcccggtagatggtgcacgccctcccatcatacgtttttatgcaaaaatctttgtcctgttttgtgagtcacactggccttcactttgtgccttccatgctcttggccctactgtgccacaccctctagcatgcaaccaatttaagccccatctggccattgcaaagttgcttggcttttcttgcaactaattttgtagccttttttttttgctattatatgttgcttcttatcttatcctttctctttttgatgtacatttcgtagggttatttcggttacactttatccttttgctttattggtcatactttggtgttatgtattgggtagaagttttctatcttttttttagttttcttcatggatgtgttttaaggtttagtaatgggcttcaggatccatgtgaaaaaaaaagtgaagcttgtggattagaattcgagacaatatcaatttgactgcttttacataaatattttgcatgggtacaatgtaattaatttatatgatactttgaagatatggatcttaattaaattgattgaacatctattttttgtggatctttcagatatagtttgttaataagtgattctcattcgcatatggctttatctaattattttgtcttgcaatcataaacagtgaacatatccagcttcttctatttcgggttataaagatcatgctccattcagacatgagtggtctctcctaaattcaaatactatagcgaattcaaatatggcacaaataggatacaagcataaccgtgcgaatttagacaatgttttgcttttatagatgacaatgagaagatgtggattttaattaaaacaataggacatccatttttgtgcatctttaagatagtaatttgttaataaccgattattccatttaaccatttcattgcgtgttcatgagcatctatttttattttatgaaatctgtacatcattctagcatgagttggctttcttaaatccaagtacttcagcaaaatcaggcacaaactagatacaaccgtaaccatgtgacatgagttggtcgatgtaagttgccacctggccatggtccacataattagcttgaacatataagttttgttactcttcatttaaaggtccaaaactattagctgtctcaaccataattcgatagaattttttttggttggatggtttaggttggggcatgcatgagtccctcaattagttggcagtacactggccctattctaagcttacctagctggaacttgaatcttgtccaaaagaaagcacaagaaagtattgtcttgtgggtagaattggaattcttttttctgtggaagtcaagtggaacctggcccacccattaatttgatcattccaactatgagagatgatgtgatattggacaagggtatcttcattggggaacacttgtttcattttctttgagaaaggcatttgatcctgaattcctcctagcctacatttgcaaagtgtagcagagatgctgccatccacaataaatatagtggtggtagtgtattgtagcatctttgtttgcatgctctgcgtatttggttattgttttccgccgtgtttagttccaaagtttttcttcaaacttctaactttttcatcacatcaaaatttttctacacacacaaactttcaccttttccatcacattgttccgatttcaaccaaactttcaattttggtgtgaactaaacacagccttcatctcactgcctattttgtgtgtgcctttctggcattccttttctgtgagagcttgcttggagaatgatttaaatagtgtctgccattagtccaatatatagaacaataatccaatcaccaatgtgatgtgtgtacttagggttacacatataagccactaaagcagcatcttgataatactagctagtttctagttttgtagctgcatatatagcacgatggtgcaataaatatagtgcatatccatttttattatgatggaaagatataaaccataagggcatgtttggttcgacgtatcagcttgtcgtgggtcacgcagtccaatgacgtcctagacgaggcaatccaccaaaatcacatcatatgaagtgatggaaaaaaaaattgcgaggttttagcacgaacaacagacgatacaaacccatgacacaaatcaaacatgattgttaggggatcgaatgaacctagcatagaccggtttcatcaaaccagacaacatctaaatttctttcttgtaaaacatgcaagacatggataaccgtagttctcttttgtcaaataccgatgcctacaattgattatttgtatgggcttcattttcatattaattttataagcttcatggatttatttatgacatccctctattcgtcatatgttaaaagagtgtgttactgggtgtggtgtcactactgaagaactgatctttactcggatgcaaaaaaaaaatacatttatcctggttcgaataggaaccagaactaaagatcatttctagccacggttcaatagttgtcaagccccaacgatctttagtcctaattggtgttaccaatccagactaaatatactttcacggtcagatgtgtgcagtaggtgggatgataatgcatgtgagggccgaggtgagagatcttgagtccgaatcccacatcccacatatttttttacttggtatgcatctttagtcccgattatttcaaccggaaaatccctttctccagtaatgtgtgtgtgttaggtacatgtgcataggtgtgtagtgtaggtcttcctcataaccgaacaaactaacagttcgcaataatcggtttcatccaacggttaattactcaattttccaacatatccttacatttctatttcagttatgtacaaattaactcatgcaaatctgtggaatttgcattttttttccattgcaatcccctcccaattcagtttcaaatctgtggaattcacattgtgcctaactctgcttctagaactcttgctaagctcgagcttagctaccatccaattccaattactgtccagcatccacaacaattgacctgtcgtttgaatcatcttcgaattccgtgccacttgacagcgagcatccgatgctaagctagcttaaagataaattctactactactcctcgataaaaagaattagcttacacggctaatgcacctctggttaggcagctgattaagctaagctctgagagtgacatgttttacagtgacgtggcactgagtgatccccatcctaatccggattatgcgaagaatagaccatggccgccccccgtgatcctgtccatgtcatcacagctatgcactgacagtggatcactaattatttgcttttttaaaaaaaaattgtggggattggtttagtttaattttccgccattccacaggggttggtggaatatttaaaaaggatacttgtttgtgggaaatccgtatgaagtcgacttggatatatgtttggtacatagctttagatccaagatttttttagagctatgttatttaactcatgaaatatatggatctagatatatgattatattgatagcatttcaatgaaatattttgttcatattttataaaaacacagaattttaaactaatagtataatttaattttctagtaagaatataaaatatgtagagttgtgccaaataggtttgggccaggcgattttggttgagagagtgcgcgctttgtaattttagtggatttggattgtttccatgtagtaaggttgtggtttttaatgattgtgtgttttcttttcgtgtgtgaaatggttggtgtcttttttaaaaagtggcgaaaatttctagcgtacatacgaagagatgatgggattacaagaggaggggcaatggagaggccgaaagtgaccacactaagaaatctgagaagaaatgactaatgagactgatggctttagtcatttcattaatgaaacgtaggtgataattattgatatcttggcacgcaattgactgcccctcatcttggtaactactgtctccgtcccaaaataagtgcagctgtggatatccgtgcccaacatttgaccgtccgtcttatttaaaaattttgtaaaaaaattgaaaatatttagtcacacataaagtactattcatgttttatcatctaatagcaataaaaatactaatcataaaaaattttcaaataagacgaacgatcaaacgttgaacgtgaatagtgcaaaactgcacttattttgggacggagggagtagtccatttcttcacaatatcaattgttagagtttagttcatgagaatatgaagtataatctttttaattagatctaggtagtcgtctaaaattttaattattcctccttgtttgtgctctggtttgatctcatattgctaaatcttgcatcatatacgactaacatgaactgtcacttacacacaattaataacataggaattaaatcgattgttagcaatggacaagtaaggctgaaagtaacgtaacataaccatttgacacactccacgactcccatatataacaggacatctcttcccttttcatcgtcgtgttttctcgtaactacattaaatagaggataagaattatcgttgttgtacactgtgccaatattcaaaacgtacccaatggtcgaaagctccgaactccaaaacaaatataggaatcttagtcttaaaagaaaaacataaagatgcatggtgctgaagttataagtacatagctttcacccactaagaattaaaatcaaatcctagtgcaaacaaatattacacatatacgagtatattttcaacaaaaattcaacaaagtcaatggtaaattgttgccttcgcccctttgagagtgcattagataacacatgtattcatgggatataagcgtaatgtgtttgtgtaccgatgtataaatctacgtgtgcgcgtctttcgtgtaataaaagaatacgacatcgcatgtttggaaccgcaactcgatgccgtgagagcatgcttcgatcggtgttaatattacaacgtcttcagacacgcgtagcacggctgcacattcgagccatatgtatcaccagtttagccatgcatccggccggcatccgaggccaatggaagcagaggaggaattgaagaaagggacagtgggcagtgtgcatcgctacttccctagctttagcatgctatgaattgtgatgtgtgtggccatcgttatcgttatcaggatctaattagctagctattccctctgtctcgtattataagggcacctgtagtcctggttcgattagtattgtcgagcaaaattttgattcgtcggcggcaatgtgtgacatcgatcgtgggacccacgtataaaaagaatctctaatcacatgcgtccatccctctcttatgcagccaaccaacggctacagatcatcttttcatcgctgagttcgactcttcttctttggtcgattttttgctctgaaacatctaaatcaagtcactgtgtagtgtgttgtattcaattttttcaaacatggttcggttttacttatacacgggagatgctctaagtcgttttgatttttttcctagtcaaatttctttaattttgaccaaatttatagaaaaataaagtagtattttcaacaccaaataaacatattatcaaaatatatttaatgttagatttaagtttaactaggaaaaaatcaaacgacttataatatgaaacggagggagtagcacacaagatgacttcactggactatttgaaacagattatttgtgtcacgctccaaacaatatatattttttacaaactttttcttagtaaattatttagacaactttttatgctatttattaagtttattttcaaaataattaatttatccataagtcaaatacataacctacgtacaacaacagtgcactcaataatttgtttcaaagctatttgttagatgaggcaggaacgaaggttaggttggtgtcatgtgtggattcggttagtgatgactgatgagagggatagtatttagtgccatgtcattagctttgccaactttgcacgtccctcggggacatggcaaggcacagtagaagtgtgatttctgtggatgcatggatttcaaggggttgcataaattttcttgtgtatttagtttttttttcctctcgtggggaagacgtgtttggtttgcagccaaggagtgaaatgcgttgtcggtcgatttttttctatgttattagttttgtggtagtggaaaacaatatgatagacatgttttgtttgaaaaaaatgcagtggtcttttctatgatgtgtggactaggttaggaagaatttggcacaccggtggcaatgaaatattttattaaacaagtagaatttgcttatgagaattacattaattgtgggagacattcttttaaaaaaatggaattggccatgaaccctatggtaggctaaaagaaggaaaacagacacgtccaagtcagtcctaggacatcaacctatggatgccaaagttaaacaacctccccactgctatatgcagcttgcctattcccatgtactccaaagttttaatattattctcaagtactacaaagtttgcatattaaagttaacaaaataagctagtatgccatccttgaccttttggtaggaactaaacaaacgctcctacagctgttatgctccttatcccctatcctacccatacagtcaaaatcaatctagatatttttaagagaaagccaagtactagatatctagacaaaattagtcacctttgaccttttgaacttgcctgatccactcaagctgcctagttgttaatttggcaataccctacctttgtcggttacaaacatttcatgtttacgatcatattcagtcaaaaatataaaatttagcactcaattttacatcaaataaatttataaaacctaataagtttgtgacgttactagtatttttctaagcatatctatttatagttttttaaactaagtgtctaaaaaattattgattattagtactataaaattatatctgaatcttatcataaacgttaaatatttttgaccgaaaagattaccactaccccttaatattgttaggcattccatgagatgagtttctatcttttaacatggttcactgaaatgtgaatcatttggtcgtagggttcatatactagccacctaagggcatgttcagatcccctatcaaaattttacaccctgtcacatcaaatatttagacacatgagtaaagtattaaatacaaacgaaaaaaataactaattatatagattgcgtgtaaattgcgagatgaattttttaagcctaattgcaccatgatttgataatatggtgctacagtaaacatttgataatgatgaattaattaagcttaataatttcatatcgcggtttacagtcggattctgtaatttgtttcatgattagactatgtttaatacttcaaatgtgtgtccgtatatctgatgtgacacgccaaaactttacacccctagatctaaacacaacctaaagtttagataggatcggtttcccgttccatgggcagtactgcccatactgtgcagccggccggcacagctaacctatccagctgcctgaatcacctggtcaaaaatcatcaactgcttgttattgttagctgggagtctgggacagcttctgcttctccctttccatgtatctagtgtgccatgcttgcaagtaattgtaaatatgcaaattgcaatatatgcagtgtgtgtgttgatcttgatctagctgaccttttctttgtcaaacccgcagcaatagctagctagcccatgtgattggtcctgactaattagtcagctcacagtaattaacacggttggttgattgattaatcggtttattaatttgtgttaacacgtttgctgacctgtgttgtgtgactgacctagctaagccttgcacatgtgatgtgttgatcacttctaggctctagctagctacccattcctgtgttgtagcacattggtttttggtagtttattagtactttgattaggttggttgatgagttgatttgggctttgtgatgaaggatgggttatgactgattaagctggctgaatgcttttaggagttcaggtttagaactgttcaaagattgatttgggggtttctttttttctttttgtttaagaaaagaggactcaagttgttcaaagatatgagagggcatgtgcaattggggaagcattcctatggtttctattttctttgaaatttggatgtcctgtagagaagaattgaaatcttctattgcttggaacatttctgttccattatcaggtaagcacacggtaattttatcactagccatggtaaccgtgtaaataagtaatgaggtctgaaaattgggagtgtatctttcctacattgatgtagtaattgtgtacgatttcctacacaacaaatggttaaggcaccgtttgattcagcttattgactgagctacttcctactcctacttgctaaattgtcgtaagcatatttctccgcctgttaattgattttgtcctttataaaactttatgtatttaagtttcttaaaaaaaatcaaataaatcttttatgctagtgatctgccatattttcaagacacctatcactctatcagctcagcctaccagctgaatccaaatatgcttaaatccttctgcaaatagaggggtgtattctggtaaaaacacatttgtgttcgttcgtcttaacaacttttaatagttcagattcataactataactataaatgcttatatcttatgacagagagagtgtatattagtatatcactacttgttacaaattatacatgccatgtgtgtattagtcatattatatttttcatagtacttcattatttgcatatctgcacatgaagttgactaaaacaagacatgttatatatttatgggtccctatatttatttatatatgtaagatccctagaagtactgtgtcggcacaatgctgataacaagagaccatccatgcagcttgagcatgaacatgagcaattgacccatacagaaattagaaatagagaaaaggaagcggcaattatttaggaaaataaaaggggaataattgaaggtttggaaattgtgatgcgggcctttctgggactggcccatctcgtggagggagctctcccttacattgtgcatttgagcccaactattctattccggcccagaatattttcccacctctaaaaaaacgattttggacaaattttctcctctaattgctaaatgtaaatagattataattgcattataacttgtatgtaactataatataatttatgtgtaacttttacataattttaaaccattggatttatttcaagattcgtgcaagttgggaagaaaaaaaattatagcgtacgtacaattaaggagattcggtctcacaacctgcttcgtgaaaatggagtgttacagtcggattttttttcaaagttacatacaaattttttttcaaagttacatacaaattatattaccgttacatgcaagttataatataattatactatatttataagaaattttgtctgtcaaatgtatatagctataaaaaagggtgaattggatttgtgtgattgcaaatgtacatattcagataaatgtcattacaattcgtctattcgtagctaaaccactgaaattttacaaaattggggatcgtgtcactgctgtcacatcatccatctccttcctttttcgtcttcttctttatctcttcatctttttcctccttgtgggaaaaatggtgacggagctcgccattgtctgataatctcgccactgccatcagaaaaaacaggaggacaaatatggcgatggagcacacctccgtctcctagacaggacgagattgttgtcgccagaaaaatcacaaggaggaaaacaaattgacgatggagcactccgccgtctgagacctcatcaccgccacaacgagcttgccatcatcgtcgccacctggggccacggaggaggtggtacactctagggtggtgcgggcttgccgggggtagatagaggaggaagaggatgaggacgagcatctcgctgcaccaagcaaagaggagaggtgagggaagaagacgagagagaatgtagaaaatggaaaataaaggatatgggtggaaaatgtggcgtcactagcacagttttgattttataaaatttcagtggcacgactacaaatataaacgaattattatgacatctatttgaataatcacatttacaatgggatccaatttacaatggggtagatagaaaagggaaagtcactggctcgatctaggccgtcggttttgatcgatcggacggtgaagaactgcgtctcctccgacgcttcactcctctcctcgcttcgccggcggcagcttcccgtgcgccgtgcccgccggcgccgccagccaccctcgcctcgccgacggcgcgatgggatgttagagacccactcaacaatataatttcagaaatagcagtgccaaatccaacacagggaacaaccaagtctgttacaatagtggagtggttttgaggtggaagatggaaggatacaagggctagaaggttctagtagcttctagactagtagagaagaagggagatagaggagagatcgacaaagagaccagccagcctctaggtcgccgccgccgctattcgccgccttggtcaaatgaatctgttcgatcgatctcctgtaagctgctgctgctcatatatttttcagcttgggcttgcttgggcttcttggcaatgggctgaccaacccgtggtgtagccagcggcccatgtgcagcccacccgagtccctgacaatcccctcttcttgaaatttggcttgtccccaagccgatgaagaaaacctcctggatcccatggtacctgtagctcttgtatttccttggaattgctcacctgtagcttgataacttgctctgtatttgtctgtcttgtactgaatgtctcacattgcagcaattgttctttcttgatatcacctagtaacaagtggcgtattgggcacccctcttttatgaccaccaataatttaacagaccaataatccctgtttgcaattgatgcatatatcatctctgaatctgtcccgatatcaatggaaaaccttgctgcagcactaccatcactaggattgttctcacagaaatcaaaaatggaatcataaccacatgtcttgaccttcctgttctgattctcagcagcacctctagcaataatcccagaaatccttctgaccccaaaatgtatccccgctggacagttaaacaactgaccattgtataatatgtttgttgggttctgtagccagctctcaacatgattaagtgtcatgcgcatggacttacaaattttgtaagttcttcccttagctatatcatttaacccttcttgagcctccaaccaacaagctccatatatattttgagtagaagatggaactgacagaaatgttgttgtcattgtagcagcaggaatgatcaagtagttgcagcttattgtacttaggccatataacattccctctgtaactttttcctcaccacccacataatggaactgttccaagttaaatattgccaccaatgtatccttatgagctcgattagatttttcatgatttaaatctcctttaggtgcacaatatagtgcaacagaaggtgtttggtctcttatgcaatttgcactgcaaaaatcatatcccatcaaatgtgcaaaaactggtgcaggccatgggacttgctcaccccacatcacgcctccgttatattgacttggttgtgggtcaggccacggtttcagctctacttccgtcaaccatgtgtttaccaacagccaaagtattatggttccaatttgatttggtggtggccatggtggcatgaaataaaatattatccccaaataattgcccgcagcccagggcacataccactccttccatcttctaaccactccacctgagcaaggaggtggccatgggtttctcttgggatgactcatcaacagcttcttgtagcccttggagcatttggtcgaacacctgttgagcgccacccattttaggcagaaattggagtttagcttttgtgccatgactagtgtggcctttcccgaggatgctattccttctggcgcgccaagcaatagtgagtacgcaaccccagcctggacagtaccggtgttgacgttggggcccaacatcaaatggcttgggtgcatcaccttgggaaggtgagtggtgtcagtgcaagttgctttctcgtcaaccatcaactccatggactgacttgatatcggaacgaccttgaacacacccatcctactttggaacgcaatcacacctctatcagtgacaccgttgacatcggggccgaacaacaaacacttggtgtgcgtctccttggaacaaacacgggggtcaatgatggtggtgccggttgcgccatcggtggctaccaactctttggagtccacggcagtgttggaacatgtaaccaccgcagccacggtgaaatcaggctcgacgtcgaggcttgagcattttgtcaaacacatgataggcgtcaactcgggaaggtccttgctaatgatgaagggcatgcgatccttcccctcaccatccccaacctccaggatgatcgtcggagtagccccctcgtcgtcgtagatggatctcgctattgtgctcgggctgctgccattggagcactccatcgaacaggtggtgggcgtcaccttggactgctcatcctcaacaaaaaactgaaggtcttcagctttcttctattcttggggcatccacgagtctattgctgccttgagagacaggaaatctgctctccttctttggtctgcctcctcccgccttcgctcgcactcctcgagcatcctcaaaaagcatgtcaaacttgtcctcacttcccatggcagcttgcttgatgagcttcgtggggattggctctgataccaaattgttagagacccactcaacaatataatttcagaaatagcagtgccaaatccaacacagggaacaaccaagtctgttacaatagtggagtggttttgaggtggaagatggaaggatacaagggctagaaggttctagtagcttctagactagtagagaagaagggagatagaggagagatcgacaaagaggccagccagcctctaggtcgccgccgctgctgttcgccgccttggccaaatgaatctgttcgatcgatctcctgtaagctgctgctgctcatatatcttttagcttgggcttgcttgggcttcttggcgatgggctgaccaacccgtggtgtagccagcggcccatgtgcagcccacccgagtccctgacatgggacagcggccgttatgtctccgcggctcacgccggacctgcatggggtggtcgacggcgctcggtggcggcgccgcggctccggcccccaaggtggtggtgacgatgctctttctttcttctttcttggtttctttgtccccgcgagacccctccatgggtgtccctcgagatggtgatctcatggttgtctatgtggagctttacctctttcttcttcttcttttttgtttcctgttcggggatcgtggagcatctacctaattggctaaccaggctattagcgtgtataatggggttgagttgattcgttgaattgattgctcttagtgcgattgtgcgaatttgaaatgtaatatgacagctgaaacgaaaaggaagaatagaatcgagattttagcaatgctgattaatttcttaggcagtgtgtggttacaacttacaagcagtgctgaatttgccgaggtgtggattcttacgaacgttggtgtttggcattctacacgattagattgatgtatcagtaatttggtttttacatgttgctatattttgatataaacttggttgaacttgaagaagtttgacttagtaatctgccaccaccactgcatcttgcatctggttggtcataaagagtcatccttgttccaacttatacgtgccatttcttcattacatatgttttaattataatcaaatgagttttttttcctgtcattctgtagaagggagtctgtgggcttaatttgaagtcatgcagtggtttcatgctcaaaacgactccaaaggtgatatgtttttcatcccatttttcaaaataataagtgtagtgccctgaatactaatacaaatggttctgcaatgtaggtcggatgcccttcgctccgtgtgagggcatctgtctcttcaccacagaaactatactcttctaagacaacacaagttaaatcaggggaggaggtgcagattgcggttctaggggccagtggttatactggagctgaggtagttccattttatcgtgttatttccaattgcgtttgttgttgttatcttatacaagtgggttcctttcaacgaatgtacttgtaattctgttcttatgtttcttctatccggctccgcatttattttctatgactatatcctatatggagatcttcgacttcttttttgtttctgtttgttaattattgaagtacgcttgcattgacagattgttcggcttctggcaaaccaccctcagtttcatatcaaagtgatgaccgcagatagaaaagctagcgaacagttcggatctgtatttcctcatttgataacgcaggtaagattttttcttgatccatgctccttggtacccgagattgcctacacttgtttcttcaaaaaattaaaaggaagaaatgacctgagttttttttatccttggcacatcaagaatcggttgaaccttttggtagtacatttatttttattagaatttctgggccatattgtagtcattttgctgatcaaaattgtaagactctgctggttatcttttgatatgcaggacctcccaaatttagttgcaataaaagatgcagatttttcaaatgttgatgcggttttttgttgcttgccacatggaacaacccaggttgtctattattgccatgcccttctctgaaattcttcctaccaattcctgaatcatttagaggtcacaattacactattctgcatattggaggaatttttaaagcgatacctgcttgcaatatttttatcaggaaattattaaaggtttaccgaagcaactgaagattgttgatctttctgcggtatgcttcacaaggctaacagtttatttgcatagatattgtctttcatgctatctaatatccattcttactacgtctaattgaccatctttacaggatttccgtttgcgtgatatcaatgagtacgctgagtggtatggtcatgcacatagggcaccagaacttcaggttttcctggctacctgtccctacatacttgtttagttattggtgttggttatgcacttctactatttataagatctttagttctcagcgttgtttatgagcatttgcttttagtaagatcttaagttatgtatcattaaattatgtttgtttatgaactcatactctgtggcttgcttctctgtttattcagcaagaggctgtgtatggtttaactgaagttcttcgagatgaaataagaaatgcacgacttgttgcaaatccaggatgttatcccacatctattcagcttcctcttgttcctctgataaaggtgatgagggaagattaacagaagttattagtcatatatggttctctgatttctaatgaaaccaacaaaatataatcacattgagtgtacaaaactaaccaattttggtagcatataaaggatagttgccatagtgtaaagtttgttggccatgctcctctaaacccttaactctatgcaaaattttaaaatgttatcagttgaatttacatggcattgatgtatcttttaccatttgtttttaccatgcaggcaaaactgatcaagctgagcaacattatcattgatgcaaaatctggggtttgtggagcaggcatgtaacttgagatactgacgtactgtactactatggctacaaatttagtggttgtatatctgccatgattactagtcaatctttctctctaatgcatgcatttgtgtaggacgtggagcgaaggaggcgaatctttacactgagatagctgaaggcatccatgcttatggaataaaaggccaccgtcatggtaacccttgttttgccattttccaaaaagctggaatcaacatcagtgttgtagttactgtgttatagctctttaacgaaattgtttattctcccttggacaaacaaatagtcgataaagtggttacagaatgtttacttatatctggctatctgccctccaagtgcttttaaactggccctactgacacattgcaataaaaccgtgttagctcccgagattgaacaaggactttcagaggctgctaaatctaaagtcactatcagttttactccaaatctgatctgtatggtaagcacttactttctcatttttgttgacttaataactccaggttctgcagttttgtactgtattgaacgcacctggagtgtgtgcattagttaaatcaaattcttcatatttacgttgaacagaaacgtggaatgcaatctaccatgtttgttgaaatggcacctggagtgactgccggtgatttgtaccagcatctcaagtctacttatgaggtttgtttgtctgaccagtggctaaattatctgtctgactatttgaatacagacgttttctactgaaatgaattcatcaaaatgttttgagattatgtaatgttgtgagtgagagcatctcctcttgttagcatcacaattttatctacctgtatcttccccagggcgaagagtttgtcaagcttttacatggcagcactgttcctcacacgcgccatgtcgtgggatcaaattactgcttcatgaatgtcttcgaggacaggattcctggaagggccatcatcatctctgttgtatgcgtcttcaaccatctttatgcccattgtcaaactagtttcttcagacttaaagatgcgaaattcttattttcttgttcttcaactccacagatagataatcttgtgaagggagcgtctggtcaggctgtccagaacctcaatctgatgatgggcctgcctgagaacagagggctgcaatatcagcccctatttccatgatcctttgcatcggtacgtttccatttcatatgaaattctgtcaagatggtgcttctgagttcattgagccatgttatcatcggagtgtgaaaaaaccaagcttgctcaaatgcattgctcagtttgtgctgttgtttttgtagagattagctacagttggcagttcagtagtgagagcattagctgagtggctttctgccatggaaaatcctaaggctatataccatgtgctctcgtgttgtcatcagatcaaataaaattcaataaagcaaggcctttgtttgtcatttttacacctcaacaaaactttcttttttgaaagtaacctcagcaaaatatgcatttgtacacatagcccttgcttaattggcaaagcagaacaactacatcaatctcacttgtacatggctcctacccaaatatgtcggcctgagcatttacttatcaaccataatctgacttaatttcctcagtctataaatatatctttttttaacgaaccggtacttagaccacaccaatttcattgaataaagtaggagaaaactataaaaagggagttttacaaaggaaaaggaaaattgaggcaaagtttgtctaaaaatataagagatttatattcacactctccaaccatctcttgtctaataaagggtatcatagtctttacttttgatccttaatttgtcaaaaaaaaactataaccttttatatttgtggatagagagagtatatcatacttgaatctagcttggttaattaatccaaaattacatcgaaacataacactaacccttttgtcctaattactccaacatccaatcgatctcttcctctgatatgagtgatatcatctcatctgatgtactatccgcccaatgaaatgatcaacgtgtgatcaaggagggagagggacatataaaaggcattactacgtacctagatagcgagtgtggcagcacatcaaatgtacggatgagatctgagccgttcgatgatgagaacggacggccggatggcgcctgtccgcggtccacccccacacacgcctcgcctgctggcagttggagtggcatccttgtgccattgctgtgtttttgcatgcatggtcctctgctcccttctaggttctagctactcaaatttatttgtttggtccctgatggtgtctgtccattttgtgcaacattgaccattaccattttcctagtaactatgtttagtgaaaaaaaatgtttgagaaaatagtacaagagttttttagatgttttgtgatggac

SEQ ID NO: 74119 - DNA, 34172 bp, Oryza sativa
aggttgtatcccagtcagcagcagattccacgtagcaaggatgagttgcttgtcagcattgagaggatgcgcaaggaggctgaggtgaagctctccatatttgaggatgcaaaatcagcgtttgatacgacagagatgggggggaggccggatcggaggtggagaggacgaggatggccactcttgctgctggcaaccaattcatagatgctaaaaggattctcaaagaccttgagcaggcgggcgaggttgcactatccctgatagagtccctcaagcacaaagctacatctgtggttggtgccaccactaagtcaatgttcatgggatgtggttcggtgccaggtaacgctaggagtcagaatcttgatgatgtgacttgttatagagtctcttttgatcaattttcttggttgattcttgttatagagcattaaccatatgcaactattttctgtttaattcaattccagctccggggggccaacaggatgacaacaacgctggtgaagatcagaagctagataatggtcatcttcatacccgtgcttctggacctacccatgctgttggacctaccgaccagcagtagaaccactagcaactctagtactatgttaatatccagctactggaagtagctattttgctgtaagccttttccatctgggactagactcagtataagactagctattaacctttatatgcacccatgttctattcaacatatcttttacgatattttgcagatctctagcacccttggttgctgtatttatgggaaagggttcccaaaaataaattagcttgaaagcaattaaagagtttgctaacgataacgatatgatgtgagatgtagttcctagggagatggagccatcaaagaatacgaactgttccggttgccagaaccgaccaagacaccttggcaaccagaacatttcgtcattttttgataactaaggaactttaaatatatgagttagggtaatcaagatatacatgtttagtattgtcttttaactttcttgccgtacaccagttatttaggaaatgtctcagcaaggtgagcccacgtcagcgagaactagtgggacaacatcgagccggaaccctaggatccagaataaaattcctaaggaaagatacacctgcatctcctcatttagttcctaggttatcaaaccatcacataatacgaagtgcatggggaattatgttggtttggtcggggtagtccatagatggaaccgaccaagacaccatagttctccatgcacttcgaaatctgtcattttttttttgataattaaggaacttaggggttaagtgcaattgtctatttatttttagtttgtaggttatcaaaccatcacagaaaataattatattgcacatctaataaaaattcaccttcaaaggatatcaatggaaaaacccatagaagcgcaacccacgggtgacaagggtaaggaaactcaggccgtcgtcgaggaagatatttgcacgcaagtagtcgcggaggaatcgtcgttgtcaagcttcagtgaagcagagagtggatcgtatcactcaccgagtgacccccatccttctcttgcaaggaagagaaagggcgggagcaacaatgaagaagttgactccgactacagccctcgcgaaccggtggtacgtaatatattatatatgtttagttccaatcctattaaggacatactatggattttaactgaagtcacgtgaaatgcaaatatagaagaatgctccacgttgctctaaaaggaaagcccaagtcgcacccgaagctgaagctgaaactagagctgtcatgctcatcacaacttcaagtaaaccaaagaaaagaaggggcgagcgagggaagaacatgttgaaagaagtcagcgtgctgaggcggatgtgagacaggggaacccctatcaccagaagactcatgttccaagtatagcaaccaatgtggggcagtagtcagggatatcgtggagatcacattgaaggattggaagaaagttcccgacaatagaaagaacagctgttggatgtcgctgcaaagcaagtttgaatattcgaagggacagacgatgataaagggaagcactattgttggtatttcttaatgactttactagaaatataattcccagcaatggcacagaaatattcatggtatattatggttacaaaattttgggctcatttggtcgtgtcaatttagtgttctcagctcacttgtccacaagttcgattctcgacaacgttcgattgattgatcgtctgttttgctgtcggttctcctccattttttactgtattctctgcaagaagttaggatccaagtgctagtggaaaatagtttattctaacataaatatgcattgcaagcataactagttctcctttattttagtaatattgatgggcgaaactgatcgataacgactgtcaacaactatgcgctgaagactatgggcaagctgtggcgaaattggaaaacagacctgaataggaaatatgtccagaagggactcacgccgtataaggactacgtaaggataatacaggcccagagggatgagttcgttgccctgaagacattggccgaagaaaaggagaagagccagaagatggctgaactagcaagaaggaatgaacatcctcatcatttgggatcgaccggttaccgtcaagcgatgaagaaatggaaaaaacaagatgaaaatatggagaaggcttggaaagaggttcctatgaaaaaacacaacccacgaagcaggaaatgggtgcgtgcaagaacaccggccttcaccccgaaggggttgtagtcttcaaggatcaaaagctccaggaggtatctgtcaagattaagaacatcgtcacgcagcaacaggccgggacattcttgccagatagagactgggacgagcccacatatgcgttgggcaaactgaagcacttaggctgtgtgcggggagtatcctcgaagactagctggaaggatggattcaaagatgatgctcatacctacaagaagcgtgatcgctataaggaagagagactgtcaggctagggcagcagctcgtgaggaatgtcgtagatattggagcgagaaagtgatgcactgtggtgcggtttcggagcccgacccgagctatccggtcgacgatgtaacgaaggatactccgtgtaagaaaacaccggttggaactaggaggttcataccgggccgtagatttcattgccaagacattccaaacgattatgccaaggtagagctccagacggtcaatgaggctcaccggatgcacgagatcgacattccaacacccgaggggattgtgtaccttgtagatgtcgtcgaccactttatactccggcacaagactaatattcaagtagggtcaacggatggaacagatcgagcactaaggttaccagtgtcaccgtctcgtccaccaagggaccaagaaccgagggatcctccagttgcatcacctccaagattagagcaagctgttggatcgccggaaatatcagagcctcctattacatcacctccaagatcagagcctcatgttgcatcacctccaagatcagatcctgcagatgcatcacctccaggatcagaagaacaatgagggcttttctagcaacaatcagagctagcaattcaagaagtgtctcccacacaacaattagagactgcacaatcagagcctaaaaagcaagcggagggtgaaattgaagaggtgcctgaacaggcaatgcccaatcaaccaaagccatcgcaactagagcaatcgcaaccagaggaacctaagggtgccaatgtgccagtgatggtaaggacgcacaagcacaaagaaaaaagtgcgacgaagaaaaaatatatgttaacgacattccgcggaagggacaaagatatcatagatgttgattttgataacaaaaaattaaaagggttcaaacatacgattatctcaactccccggatgtgccacatgagtttcagaatggcaaaccattcatgtacgactggcaaccaacagaaggaccgtggcaattaaaaaggtggcatgaatggtacatcagggcaagcaccatcaaaggcattacatcatttacagttgccgtgcaggagaacatcttctggagtgggccatgcctattccaagtccatttctccgatatgcattccctcttccgtcggaagaggctggacaccaatttgatcggcatctggtgtctgtaagtgcatgacttgaacgtgttaataaatcgttatatctatttgcgtagctgatttggtcatccattgttgacagaatgaattatgtggaagccgaagtgatgagaaagcctgtcggctacctaaacccgtgcaggataagtaagtcgaaccacacctacacgctagacgagaagaagctaccggcgcacattaaggcgatgactcccaaagagaggaaagaatacataggacaaaggcatcaggaaaagattctcaatgtggctacttgcgtagctatagtgcttgaatctatgcaggacaaggagtgcgtttatgccccatatgcctttgagtaagttttcatatccactacgagtatatacatataatcacggctcaactaacaatttcattttcagcaaccattggatagtatttcttctctatccaaagtacaatgaagtcatcatcttggaatctctcgacaaagatagcaatacatacccggaaatgctacgaattattgatatataaattataccaggaaatgctaagaattattgatctgtaagttatatattctcatgacgtgtttttatctttgaggaatctaaattaattatatcttcaaacagtgcatttaaaaggtattaccagaaaggcagacaatggaaaaactcaagagaacgcatactcatccgcaataagtggccggtaagtacatttggatgccaaacagtgctacttaattttcataaatgcatgtgtgtatccatttaataaactaatataccttataattgatgttgaaagtgtcacaagcaaccgatgggaccgtactaggcggatattacatctgtgagtacctaagggttaatgggagatattgcgcgaattacgacgaggtaagtacaaactgccaatacacttgttaaattaatcgctagcttgtattattgcgaataattgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaactctaaaaagtcccctttccctccctctccctcttgggccggctcggcccatctccctccccctccgtctcctctccccgcgcgcgcgccgctgacgggcgggcccgcccgccaacctcgctgacgggtggggcccacccgtcatccccttcctcccgccgctcccgccgcctcgcccgcgccctagcgccgccgccgccgcgaatcccgccgcctcccgccgtccccgcgtgcaataaagagggggaaatcactccccgtgatcccctctccctttccccccatttttccctctctctctcgcgttcaaacgggcggatttgcccccgcaaatttcgccggcgccattgatggcggccggacctcccgcgcctattccttccccgccggccactctctcccccttccaaccctatttaaaccctccccgcacctcctccgtccgtttccgcctctcgccgcccttcctcctcgccggaatcgagctcgcgccgtcgctctctctctccgccgtcgccgccgagctccggtccaccaccgtcgtcgccccaaaccacctcccacctcggcgccgcctccttcggcttcgctgcatgctcgccgacctcgtccacccctccgtttcgctcgtcgaccgccggagcgccgccgtccccgtcgacccgagccgctccgccgccttcctccgctccggctgccttttcgtcgtcgccgtcgacctagggtgagccgtggaccgccgcctcgtttccctctttccctcccctctctcggccgccgctccgatgtgcccatggccgccgccgacgaccataggggcgcgggcgcgccgcctcccgccggccgcgccgacgtggccgccttcgggcgcaccgagcggctgccgcgtggggcccggccgtcagccgcccgcgcccttgggtgcggctgacgcgtgggacccacggcgccggccggtgtgagcccgagtgcacccggtccaccgtggaccgtgaggctgccgcgtgggccccactcccgtggacccggtccgcgcgccccttcccctcggctgacgcaataaacccttttaaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaggccttttcttttccgttggttgtgtagacgctgcagcttcggaagatccgctcttcgtggaagttgaagccgacgtttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggttggattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacagatggagatggacgaagtcgggggtcgatggacatctctaggacaaatgaaggctacacgagctgtggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagcgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctggaatcgtgtttacaaaatagctttgagcaactaagtgtcttttaatgctgtttactgcaaaccctaaccctttatattataacccccttgtactcccttgcatttatcctgcacttgtgggtgtgtcttgttgagtacggtggttgtacttagtcttgctcaattttttccaaacccagaagaggagcccctggaagatgaaggctttggtgtttagctcgtgcctgccgtcaagcgcctgtggtcgtcgccctagtcttccgctgtttcccgtttgtctttgtgtgtgctgggccttcgccgcccatgtaataaattaactatttacgcttccgcttgataaactctgaaatgtatcaacttttggtgtaccttgcctcttgggacaaggaataatacacgcacgtaaggaacgcccgttgggttaattccggtcgtgacaataatttccttaatttgtcgtgatctggatgcagcttccaaaatttcccaagtttgaaagagagctcgatgataaatccatggagaacatacaacgggacatgtgctacttcatccactatgagtgcgcacatcagcttgggaggtttttcgacaaggacggagttttggacctgccggagaacgaatccctatctaactagagcaggagtttaatatagctatggtttgtcatgatctggatgcagcttgtatatgtcatcggtaggttttgtaagacattcaaatatttgtatatgtcgtcgatcgaattttgtcaacgtacatatataggtgcttcgaaattatatatgtatattattctgcttcatactccacgtgttgctctaaaatacgtgaaagataacatactctatcgatagctcgattagttatatcatccacgtgtgactctgaaatacacgaacaaacaaaagaaaaaaaatataatattgtttcaatttgttttacaaaaatattacatcttcacaggtaggccacatgtcagaagtcggacggttcctatcttcgctgtcgggccacgtgtcctttcccagaaccctttgggcatttttcctagcgggccaagtgtcaaaaaaaatcaataagccactagcgaagaaatatcttcgctggcggctgtcctaagactaccacaagcgaatatatttctttgctagcggctggcctatgtcctccgctagcgaagaaatatcttcgttggcggccgtcctaagactaccgccagtgaagatatgtctttgctagaagctgtgccttagtcggccgccagcgaatatatttatttgctggcggtagataactgctagtgaagatctacatcttcactggtctttactttgtggcggctgcaatttctgccagcgaaaacccaaaatggcttccacgaaagatggtttcatcgtaatgacggattaattaggcttaataaattcatttcgcagtttcctagcggaatctgtaatttgttttgttattagactatgtttaatatttcaaatgtgtgtcgatatatccgatgtgacaaccaaacccaaaaattttccccaactaaacaaggcctaactcaattgttgaattatatatacattggtacacagatactagctaatggacaagtagatgtcagatatttctgtctctatttaatttagattaatgaatggatatttgattatagagatagaataaatatttttaaaaattacccgtatatatagtttaaaaaagtggtctattactagaaagatgctttttgattattttttttcacaacatataacaaatgattcgtttcaataatctgaattgggcccaagtcagttagctgtgtttatttcctgaaattggggagaagtttagggaaagttggtagtttggaaaaaaaagttaggagtttatgtgagtaggaaaattttggatgtgatgtgatgtgatggaaagttgggagttcgggggaagtttggtatgaactaaacagggccttaaggcttcatcgaaatgcagcattctcaatttatagtaatagcaaaaatatagaattgaagtgccatcgcacttcacaaccaatggattgaaaaagatacagaaaaacatcagtaatcactaatacgagaaagattttcgcgtgcggtcaaaaccggttttcgtgtgggtgggccgcccgcacgcacccaagggtctgcaaatatcgcaatttttgtgtgcgggtgcttatgtcacctacacggaaaaacaaaaatccaaaaaaaaaaaaatttcaaaaaaataaaaaccctagaatcggcgctgccgccgcacctcccggccgctgcctcctcctcctcctcctcctcctcctcgtcggccgaggacatcgctcccaccctcattgtcatcgctggccgaggacaatgctcccgtcctcgttgtcatcggtggcggcctccgcgccgcccgccgccggatcctcactccggccggcctccacgctgcctgctgctggatccgcgctcccctccggccacaccgccaccgacgcccctcccctccgccggatctggggagggaaggaaggggaggggaggggaggggagccggatcctgcgcgtggggagggcggccggctgccggatccgtgcgggggttggccgccgcccgctggatcccgcgcctccactgccgccgcgtggtggaggccgcgcgtgccgtcgcctacgcccaccgctgtcgccgtcgccgcgcgccgccgtcgcctacgtctaccaccgccgtcggtaggagaggagaggagtgaggagaggataggccgcgcggagaggagaggagaggcgccgcgcgtagagagaggagtgaggagaaaaagagatagatagactcattttattgtgggtaagagggaaaagagggagtgggtatttttgcgtgcggccctcttgataggtccacactgaaaatagactcattttcgtgtgcggtccatttaagaggactacactgaaaataggctcattttcgtgtgaggtcctcttaaatggaccgcatgcgaaaatgagcccatttcccagatgcgactagttatggtctgtctgcaatctaaatggtccctgtataggaaaatcgtttttagtggtgaatgattgtttggatggagcacagtaaaaacacataaatcacaagagatatatacgccaatgattttttcttcaagatgttggaccttatgtgaatatttatccaaaatacctattttttcagtcggttcaatagaatttcataggattttttcagtcctttaatacaaaggaccacataagaaaaaaaaatccatggaattgaatccctccaaaccttcaaaccctttgttgcaaaggatccattaaaatttgaagattgtacctttatgaaatggacaagcacttattggtgagaagtatccatcctcaaggaaattcagaatagtgtgtacggaataaaattgcaatatttggtagaatatgtggatttaatatatattattccaataaaataaaatacatgcaacatatcatcattcacaagctaggaagtaagcctgcacgtcctgatcacctcattttatttgtgcattaaataacattatccaacacacactaatattttttatcatatcatctcgatctttgttcgtgcgtgcatcacattagacaaattatttatttatagtagtagctagcacatgcatgcattaagccacaagatttgcagcgtgctataaaccggtgttggcggtggaagcaaagtggagcgagtagttaggaggtgggtaacgctgatgtctccggcgatggtaagctgtcgaagataaggaagactgtatggacaaggctactgctagcttgatgggggtggagagacaagaaggaaggaggtctggcgggcctcgctggctgctttcaacactggcaagactaggtgacaaaggaggtgggggatcggggtgaaggatggacggagaagtgttggccatagcgaggaatcgaagggtgacggagagatagcgaggaatcgaagggtgacggagagttaaagttcaggggttgtacgaatttcaaagcatatttaacggtctaaaaaacgtaagatgtgtggtgagattttcaatttgttaattaactttgcaatattgtttcttgattttcaatagtcaacagtgaccgatcaaatttgcattaggccattcccaatgagagtttcatactcattaaatagggtggcatgtcaccatttttttatgatgtggcagggaattaatgacgtgagagaaataagtttcatgtagatggaactatgtctacactgtttctaatacaatttatctcttgcatgcactacttatgaaacaacaaaaataacactatgtattgtacgaactattttaatataatgaattaaatgccttgttatttatgtggcactcttagaagcataaaaatgatacctcccacgtggtcttatttggctgatacttactctccaaaaacaaaatatattggtccaattgaactgatatcaaaatatcgttttcctcattcctcaagaataaggttctcaaagatacaagtcatgtcttagtaaaatgcaatgttcatttggtcttgttacagtacttaactcgatcatagaattatatagtggcgtgcataaattagctaacgtcgacaagtagacatgaaacatgtccgtctaattaaattagctagccatgtagcaacagaccagtttcgatcggcttacaatttgaagattgtgcctttacgaaatggacaagatagcacttgtcggtgacaagcatccatcctcgaggaaatccacaatagtatacacggaattaataaaattttggatttgggagaatatatatctggcgatgaaatatatatatatatatatatatttattccaatccaataaaacaaaatacatacaacatatcacccagaagaaagtaagcctgcccgtcctgatcacctcactttatttgtgcattacattacattatccaacacacacacacacacataccccaatcttttatcatatcatttccatctttatttgtgcatgcacgtcacatgacattacttactttatttgtgcacgtactagtagtagctcgtgcatgaatccagtgaagtgatcagtgatcaaagtgaaaatggatcaaggtctggttaattaccagccgtccatcacagaacctgatccaggagaccaggctcattaccagccgtccatccggtcttcttgtcccagtacctgttccagaccatgatgcccccatagttgggcagcttgttgatgaactgcagcacgtcgtagtagagatccttgtgcgacacgtagccgtccctgtcagcctccggcgacgcgacgacgccgacgaggacgcggctctgcgggtacgccgccatccacttctccagctcctccctcctcgacgcgcaccgcccgtcgccgaacaccttgacgtggatccgcgagaagagccccgtggacagcgccgcctgcagccgctggtccgggaacacgcacctcgccgtcgccgtcagcatcaccccgagcctccccttgtagtccttgttgtgcgcgtacagccgccgcgccagctcgtcgtagtgctccgtggcgccctggtcgatgaagaagtcgatgccgtcgacgacggcgtcgccgaaggggcgggcgacgccggggcggccgccgccgaggaaggcgttccagaggtagtcctcgaggtcgacggccgcctgggaggtcggcagggagtactcgccgccctggccgccgatggcgaggaggacgaggatgcccctggactggcagtgcttgatgtcggggccgacggcggagacggtgtggccggagatgtccagcttgtaggtgcccgggatgtagccgaaggcgctgaggaaggagatgatgacggtggtgtagaggccggtgtcgcacgcctcacggagggacccctcgagctggtccgtgttccggccccagaacacgacggtgtcgccggtgctctggccggcggcgaggctggacgagagcagtaggaccagcagcggggcaaggcgtcgggacgccattgatcttgactactatacactacgggtcttagctagatggagtagttagctacctatcgattgtgatgcggagaatggggaggggtgtgtatgggtatatatagggatgtcgcgcgtgttctcagctggatcgtcgatgtttggacgtctcttcctagcttctcgcgcgccgccggcgacgtggcagcttgcgtggcgatcagacgatgagcagggaaggaaaccagcttcaccaggaagcaggatgggtggggagtggggacagctagcgctgtcgcgcgcgtgcaactacagttcgaatcaatggaaattaagcatttccaagattactaccgccatattattttaatatattattttaacatggggaaaactgcaaaaacctctcctaagtcacttgaagtttgacattccaccctataagttattttgttgcaaatatccacccacctattcaattttgttgcaaaaaccactctagtaaacacatgtttaatcgaatcaacgtgtttttataaaataggagtcatcaatatgttctttaccaaaactatatacttctagagtattcttgacactttttttaatgagattccataaataaaattgttacgaaagcttaaacattgtcatactgagttttgctatatgcaataaggaaaataagcctgatgcaatcacttgacaagattgatttggctagcttagcctgtggtaaacctacatcagcaataacgaacttattcggttaagcacgtgcgcattgggtggtttttgtaataaaacttagtagaggatgggtatttgcaacaaaatgacttatggggtggaatgtcaaacttcaagtgacctatgggatggtttttgcaattttccctttaatattttacattgttgatttttaaatacttgtttcaccgttctttttatttaaaattacaaaattatgatttattttattgtgagttattttagaactaaaaatactttaagcatgatttatatcatacgtatttgcacaaaattttaaataagacaattgatccaacgtgtgttcaaaagttaacgacaacatcaatagacaccactactttactatacttataatttaacccttaacgctgactagtctagtatgatgaactatgtttttgttttttagacgaacggcgctaggcgatacaatgtttcatatttcatattgagatagtaaaacaaaaggtaattaaccatacaacatttaacagttcttttttcaaaaaaaaaatcaaatctagatataataaatttaaagtgtaattacattgtatatatataattggtcaaatcatacgtggccaattcgctagctaccactactacagaaaatgttataggcgtcggtttgaaaaccctcatgtgtcagtttggaagccgggaactattggtcagcaccaatgactcaagtcatcattggtgccatttgcttaactgacacctatgggtattatattataggtgctagttctccacacaaaccgacacctatagtggtttcggggacgacgtggatgccttatataggtgccggcacctataatagttctgatgcataaaaaatatatttcctagagtaccgaatattaatttcctgaaaacatgtatagaaatcacagaatataacaaaaatcacacacatcctccacatttacatcgacattcacatcctccacattattgttattgttattgtttttgttataattattgttagtagtagtagtactactactacatcgacatggtagtctatctagcctatgttttctgaacttgagagatttatctaatattatttttactaattcttttaaattattttcattgacggtcgttatctatatggttgtgcaatcatctatatggttgtgcaatcactttcgtaccagttgtgtggaattgatctgtggaggtttgtaaaatcccgatttttgctcaagtttaaaacctattttgaatacatattttaatttataaattttatctcttatttgaatgttggtttggttccattctagatctcaaatcaatcatccaaagtccatctaaaagatcctagaataatgagttccaaagtccatttacaattacaacaacatctctaaaaaaatcaatctctgaaattcctataaattctaaaacattatttttccagttggctaccttttcttttccctaggccaacttattcccctctatctctttctccccggtccagacacccctaccctcttccctctgcaggatggcccatcccttccccctcctcccttggtccaattgacccggcccagctagtggagttgagcttgccctagaaaggcagctcactcgcccgtgtgaccgcactgccatccctgtcgttgtggctggctgccaaccacctaaccacgtcgcacaacacagagccattgtgccccatccccgcattgcaccacgccacacagtgccatgccgtgtcactctgcgatagattgtggacgtgcctccccgcctggccacctccaccttcctcctcatcaaacccgccaaccatgcgggccccaagccgaggacctcctcgccgccctatatgccacactatcgcaggcatcatcacgcggtcccacgccgacgccgtccaagctatagccacatgacacctcacctcgccccgtctttattagccttgacgtccacgccgtgtcaacgcccctgcgcctagtccactgtctcgccttctcttgctccagctaccgcggccgtgcgttcaagatgaaggggtgagctcgtactgtcgttgtccatgctcccttgtgccatcatgcctccttcctttaccccgaagccatcgcagctcctgcatccactagccctggctataaaagcctctataccttgccgtcttcctcctttcgcccttcccgtcgccgctgccaacttcacacatcaccagctagcccaagatgctcctggacaagcgccttaggtgcgctctgagtcacgctgccatacccgctcattgctcggttgaacgccatcgatgcgccatcccttcctgagccagctagccaccagcaccgccaccacctcctggcaaggcaacttgccacctctgccatcccaactaggttggcaccgcgctcagccaccccgcaccggatctgcaaccgcctgctcgctggtcgccctgaacctagggctccatcagcggagctgctactgtcgcccccccctgtttggaaagccaccagagctaccactattgactttgcctcgatccgggccgcagtcgcgccaggttgagcaccgcccgtgtgaccgcctcctccccgctaccccagtagcgacctcctcgctccaactgctcagctccgccgtcctccgcccttgtcgcgcctggatctctctcgctcgggcagggagagtgtgagcactgaggagaggagtgttgaaatcgaaaagaagagaggagaaaagaaaaggagaagaggcaatgataggtgggatccatggtctctcatcatgctgtacacagtaattgttctcctaatcccctccaatgtctctatgacatatgggtccagtttttataatttctaaataaacttccttttaatccttgagttacttatgagtgggacccattgttcccatccgacgcgcgctcagtccaccgttccagagtcactaacacgtgggcccattcatggggtccaccaccaggtccataacggtagaccttgtccacttaccgttctctgtgaacaagtgtgcacatagtctgcatgagccgggtcaatggtcgtcgggccccacacgctgacccgtgaaccatgagccctgtccaccacttaagggcaagtactataagcccttaagcacttgcccctagatgccatgtagactcatttcctgatgtggaagagggaaggaaggagagagtgaaggagccacctctcatgcaaggggtgacctctacacacttcaataaaaaagtgagagcattaaagttattggggtttgtgtgctagaggtaacttattgtatagattacctcttaattaatagaaaggtgatagagatgaaattagaagtgacaaccacctctattataaaacttgtcctaacagcaccaggtgctcggttgaccatgcgcatgcggcggctcctcgaagcctatgaaagtggaccccacaaggtatatccctccagaatattcttttccataatagaaactcttttccctttgtgcaaaaaatcaattaaacttcgaatattaatatcttgaaaacattagctctgttttactccgttctactttcacaatttttctaacaatgagatctacctaatggcaaccttattttgcattgttgtagcaaacttagtagcttttgtgttgatttactctatctcacgctaccggaagataatctagaagctgttcttgacaaggaagaaccaccgcaggaccaaggcaagccacctttgaccatgtttcctcctatatgtgcaaaataatgttttgttgtaaatatgcatgcttaggtcacacgttaaactgtttggcctcggtttgtgagagcaaccaatggaactacctagtagtagcacttatatattgtagggtattggagtatcaatccttgatagcccaacaaatgatgcgttggcgtcttaccctatgggtatgatcgctgaggtagcttgcttatccctactgtgattgtattgccgcataggaagcatggatttccaaccaaataatattcaatacctgatgttctatgtttgtgtgtttgtgaaataaatctagattgtgaactttgatccggctggaggaggggagccggctgttgttggcggtggcgttggacggaggaggggccagaggggaagggggaggagagccggcggccggagggaggggccggtgggggagggcggcagtgggtcggggtggtggcagggggatttttttttatttggtgaggttgttttctcaggcgggtgggtgtagctcttgcgaggctgcgtaagatatagtggcccgcctgcgtaatcatctatttttgcaggcctttaagtataggcggggtggagctccatctggtaaaatctttttggcccatgagcataaatcatttttctagtagtgctacatagagccatgaccgaactgcccaccactatctccatgcagccgaaacactcatgggctcttgaacataaccgaggcaaaaaggttctagaaggagaggatgagagagaagaaaaattcattcgtcccttgcacagaatctgcatgccgccattcaagggcactgagcctagacactctgcatgcgagtttaggaaattacaggatctcctagctaggcgacacatccaaggaagaaggaagtcagaagcactatcgatgtccatccatggaattggatataattttcacctacaggatcccactagggagggagagaggcacatcgacaatgtccattgagagatcgtaatgcatcaaagtgtcggcatgctgcacccaccgccatcgctttgtattatggtaggatgtgctcatgagcttgccactagctgctacctgcacaactcaatgcagttgtcgcacggctaatcaggatgtcgaggccccaaatcctgcggtgcctcatcgccttgctgaaatctcgatcgtcgcatcacgccaccctgctagtctgctaccttggacgctggcctctgagctcccattgagcagatttggctagatctggcctcgatggtcaccgccgtgtttgatagtgcgcctacaagtatgtgtatagtttcctcttcactaaacaacaatcatggcataaaatataagatattattgttttattaattaaaattaaaaaggtctattatatattgtcttcagtattttctttatgacgcagagggtgtaaaagattgcaatcttgtgtcaatttttatacatgtccttatgctctcttcatcctcaaatataatactttttagtatgtacaaatcatttataaaaagggatgttaagaaataatagtacccgggataagtatttgaaagtagaaattgttcgatgagcctgacgtcatcatcttcaatcccactattctatttcattagttgtttgcaaacaattgtttggaccttaagcggttatcaccaccattttgtctcactgtatagccatccacagtgagttccatccctcctttcttccttttctttgagagcatctccaatagaattagactcttcaaatacccatatagccagtttttcaactgatttgggtagtcaaactaggtgctcaccctttgaatcgcaaggtttaacaaacggaggaataggaaaaacacatgattctaaccggaatcaaagtgtaaaatagagcattgcaaacaaaggaaaaaacacaggaatgcctaaaacgtttgattggactataggaaaaacgcaggaatcagatgagagagatagacttaaaggaaattttcctaagtttcctccaaaatctacatgcaatgtgtcatttcataagaatttcatcggatttggaaagcttcaatcctttgaatcaaagggccaaataagaaaaatttctatagtatttgaatcctatgaaatatctacataaatcctttgattcaaaggggccctattaaatatctctaaaatgaggacccatatgtcaactctaccaccccttgttcttcctcctctttctccccctctccctcttatcctgctggggaatggggccctatccatgagctcctccctgacccactccctctgttgtggcaatgatgtctgtgcacgccactgctccgcgggggagggaaaggaggtagtgacagaggatccgtgcgcgcgaggtaggctcatgggtgtgacggaggatatctgtgcgagcgaggggggggggaggtgttggcgggaggcgatggcaactgtggatccgtgcatgcgaggcgggctcgggagtgcggcggcggatccgagcgtgcaaggcaacagcgatggcggttccccaccttgccggcctgtccttctccacaaccattcatgtgcggcaggctcggccagtgagccgttgagcctccctccctctctcactatcctctcgccccgccgccgcatcctctctccctcgctaatgcccagccactgcaccctccctccctcgctgcttagatgcagagaatgcgtggaaatgagcatgccaggtgtggggtccataattggtgagccagtttggtcagtgaagggaggagttggcaagccatcaagctttgccatccagatagagatgctgttggagtgagattttttttgctagaatcactaaaatttggcttagagagttatgatagatggagctggatgagtactaggccttttcatctcacatagttttctttcttgaatatatatttttgttgttcaggaactactcgctgtcaaatttgttgtttttttctctaagctagtgtacatcaaatttaattatgcttatttgtacatgaattctatattatgaaatactcctagttgtattttggctttacaactatttcaatcacatgtaagcactaagcagcgggtgcatacgcacctgaccgggtataaaaaaatcttggaccgttttcatctactctccattaggaaaagatgacaattctaagagggcgtaggggaaattagtacgaaagacaaattacctatatgtctcatatttaggccctttttgtttagacttataaaccaacttataagtcaaaaagtctaaacctaaacaaacaagtagctttttcgtttggcttttttaatgccataagccactctaacactattaaaccaaaagctaggttggagaagctttttttggcttatatgaggtagatgtatgtctccacaactaaacgtaggacattaaattcactgacttataaatcatataagccaataagctgacttaaaagtctaagccaataagtctaagcctaaacaaagaggaccttaataaggacggttgaggataaaatatggaaaacaaataaatggaggtgattgtttaattgatgggataagtagtactttataattataattatagttcttttataaaatttgaatgctaattaactgcaatcttcttatgagtatattgtactgctgcagcaagcaaagctgtcggaggaagcaacatgatgccaacatgcacctgtataatcgagaattactgtccataatgcgacccgatatggacgggtcggagtctcagagatgatgtgtatcgaccacagagcttgttcagtcatgttagctctaccctggaagatactgatctgatcaacgtggacgtttggactaattgaattaaatggtgaaaaggacatgcaaatcacattcaagcatgtgttgagaaatactggatggaaaatgaatgatgacacatatatcacattcatatattataatatacggagtatatgcgacaaatagagattgttgcatccttcacgcatggccgcacaatgtgtgataatgttgataactcgatattatattattatttggagacaacccaactaatctgcgtggggtcgaagcttatgatctcttgcagaagtgtgcacgctcctgcatatatgctacctttgccttatccaccagctcatggcacattggcatcaggggtagtacggttccaagctcactaattcagcgaaatgttcctggcgcctgaaaagtatgtatacagacagctactgaaataccgttaaatttccgtcatatttttatgactttagatcaaatcaagcttcgtgtgttattcacaccttatcttaattatttactctttctgtttcaaactgctcattgttctaagtttatcttaagccaaacatgcctatctttcactctaaatttttagaaatgtagttttaacaatatgattgtaaatcgcatgataatctaaaaaatataaatcttagtaggatgttaactacatgtgtttgtagaaattaatggcaaaaaaaatgaaatatttaatttaatacaaactaaattgataagtaatttgaaacggtagagagtattagttctctccacctctcccatgatgaaaagcatgagccgcgttcttcgcttcagccgctagatcctccatctctcctctaccttccccatcgtctcgcctccataaggcgagcaatacaagagacccgcaccccaccactttcgtgcgttccacttccatctagatactctagatgtgccacttcaaaaagcattagcgactctgaatcatttggttctgcttgtgttgaaagatataataggtatcatttggatcatgctctcgataaatgtttgaccattattgttagttccacttgtggagatatattggaatgagactggcgtggaacatttccctcaaaagtctgacattgtttcatctctcgtacggaactgtcaaaactagaggaaaaaaatggttcaataatttaaacggtgaaacacaatcgaaccacacttcgaatcattttgttctaacatttgaaaaaaatgaaatgccataaatataccactccagtattttgattcaacacaaatgaacattaaaattgattgtctgaaacataaaaaaaaaagagtatattgcacccacggtataacaacttggcgggtgtgtgagatatagtgcaagaacttaagaattaaacgttcgagtgcaacaacttgacaagtgagttctagtataagaacttgacaatttagtttttggtgcatcaatttaactaagcatatgctaggtgagtttttctcacgatatcaatatgacattacatagcaatcctacggatattacctaataatattgaatttaatctttaagaattatactgcacatctaatttacatcaactacctttaagaatttttgttttcttcaccttccaaaatctcaaccgaaattaaatttctacatccagtttaattgactttcaaatattagttattcggataaaaatataaatatgcttatatacaaatcgacgctagtatatcgtcaaaataagtacttaaaaattgaatatgtataaaaaaagtgctctaaataattaagttgccgcgtaacttcttaacttattgtatcaaaatcgtatatatcttgcaagttgttgtatttatgcgatcacttatacagttcttgtactaaattacacctacttgccaagttgttacactggaacaatcatttcttaagttcttgaaccaaattacacctacctgccaagttgatgcaccgtgggtgcaatttactctaaaaaaatcataaaaaatctacttctttctgctcgatctgtcgctattggtgctataggtgggtccttgcccgagatcctatgggaccgtcgtaccacgccaccattgaggttgccaaggccaagctcatcatgctgccatcgaggatgagaggctatcactactatgagaaaggttttttcgggcggtcaaaaccagttttcgcgtgtgggtgggcggcccacacacaccaggggtctgcaaaaatcgctattttttttgcgtgtggcgcacccgcacggaaaaacaaaaatccaataaaataaaattaaaaaaaaattgaaaacctagaatccggcggcgccaccgctcccggccaccatgtcctcgtcgtcgtcgtcctcctcctcctcctcctcctcatcgtcgtcatcggccgaggacgccgctcttgcccttgtggtcatggacagcagcctccgcgcatcccgtcgccggatccgccctcccaccggcctctgcgcccccctccggccacgctgctaacgcccctcccctccggaggggagccggatcctgcgggggaaggtggctgacctccggatccgtgcggggacagctgccgccgccggatccgtgctggggttggccgccgctcgctggatcccgcgtgtcgtcgccgtgccgccgctgccgctgcgctgcctatgcctgtcgtggccgtcgggactcaatcaggaggagaggagaggagaggacggggaaaaagagatagagaggagagaggagaggagaaaaagaggagaggagagaagaaaaggagatggagaggagagaggagaggagacgaagaggggaaaatttaaagtgggtaggagggaaagagagagtgggtatttttgtgtgcggctctcttaatatgtccgcatgcaaaaaataggcttattttcgtgtgcggttcatttaagaggaccgcatggaaaaatcaaatttttagtgctgtcctcttaaatgaaccgcacgtgaaaatgagcttagtttctcatacgcgaccagttatggtccgcctacaatctaaataggaaaatcatttttgtagtagtgtattcttgtcataagtgagagaagtatagacaaatagggagagtggagagagtgacagttcgagaggtttgaagagaggataagatagaatcaaggttgagtggtggagaaatcgtgggatgaggggtgtgtccgatatttgacctcgcgtcaaacacttgatttataactttttcagatatactggaaacttaaccatcaaataggaatcaaaatatattaatatctttgtaaaattatggaaaatatttaatatattatatattcatgtagaactaatggttatgtacatcgaatttaaatttatggtttcatcatgtgatagattaaaccatagtcatatcggattttcccttaacatacttttaattttgatcgtacacattaattagagaaacaaagtgacaaatttttcatgaaaggtagccgtgcctgtgctattagtcgtttagaggctatttagattgtagctgaagtaaattttggtaagttggcaatattatcaaaattttggcaggatttcttatgtatttacttaagtttgccaataaactaaaactaaatgtaagcacttttatgacaacttgccaaaaaatgatatggttgaaaaataacatcaatatgaatagcccattaatttctcctttatctcaatttgaattctaattttgtgaagatagaggtcgcaacacccatacactgttaattatttcttttgtataaaagaaagttttataatcatttttttcaccaaatgaacatttatactctctttagataagtccaattcgaatatttactatgtcctgtcccaaaataaagtgcatttttagtatactactttttttccctgtaaaatgtactttatcgggcttattcatggatggagataatatatatttttagatgatactccacgttttatatgaaatacggtagaaatgatgaattaatataagttaagatattaaaaaatgatgtggtacattgagctctaaaacgaaaaaaatatagatgatgtatcatgtttatatttaacatataataattgttaatgatgtgatatattgtacgttaaatatggtaggatctgtagtagctactcggttgtactcccttcgtttcataatataaaattttttagcatcgtctacattcatatagatactatctagatttattagtatctgtgaaaaggaggaagtagtttagtatagatcaggagatacttgtgggtgtcaaaagagtttccccgtaatatttgtcccgtacgtgtatgctgtgccaatacaagtataggtacatgcatctgctccttctgggcggctagctagtgcctagtagtacgtgcaacgtgcggtggtgttggatcgatcgaatcgtgcagggggctgtgtgttggtgaaggaaggttggccgttggggaaaaagacagacgaacgagctgatcctgccgccgcgcgcgtagcgctgccgcacgcgcgttcgtcagccgtcggccgggggtaggtagatggtcaaatgccagcgccgatggatcggacaaaactagcataatcacgcgtgtgcgccataattagcaaggaaaagtaattaagtacgtgtgcaagattaattagataagatcagcacgacatcgaccaaatctagttagtcttatcacatcatgtcaaagcttaatcgatcaccatatatatagcttgaaaagcgcgatggtacaaacattttattcgtctagaggattaaatatccctcaaagataatatactcctcttaatttatccttgctttgcactaccatattttacttgtatcggtgctcgtcatcatcgtgatagaatacagtggtggatcaaggaatttaactttagagtgaatcagatctattaattgccaccgttgcagcttaaactaggtttattcctacgttttattttggaataggtgaattaacgtgtactttgcctcaattttagctagctttgttccatgtcactattgcctgtcatatctcatatgtttcctctgggtcaggctgctgaaaatggggacgaccccactaccctgctactcctccagaacatctgcaactctctattgccttttttttttaataatggaatagaaatccatcctagcccttgctcaaactagttacactcaaaacgagtgcaccatttatcgccttactctgattactcctctctagataagataatgccaatgatcactatgttaagatgccttcttcttcccctaaaccatgtttctcctcgatctccactataccttcgcgttagctcagtctctgcctttgcaattgcatcaccactgtctagctccaccgtgtttcatcgatctccgccttttgcttgtcctctttccttttctggacttacccattgcccccatagctcttcctccgcctagttgctccaaagctcagcctccacccaccggtgccattatgcgccttcattctcgccatagtcacactagtgcagacagtgttgaagaggattttgttatgggagctcgtcatcgagagatatttgatagcagctgttttttttatggtcgggctcacaggtaggtcattggtccaaactgttcaaactgagtaaaatggctagtctaagattaaaactttgacattgacaaagaaaagaacttctatttcaatgtgcaatttactctttttttttagatttattgattgaaggggccgggcaatagtactaatttaattaaaatttatttatatttgaactttttagtgctgatttttgcatcctactcgggaggccttggcttgccagagtatgaaatagggatagtccccaaaactgaagttatatgttttgatttttgcgtattggatgctctctgatacatgtcaggtatatgtttacttaaaaaatgacttttgaaacacaccctcttttttttttctaagccaaattgaaagaaggcccgtatataaaaagagttgaaagatacgggccctcttttaatttcaaaaatgtgaaatccattttcgcaagcgtctaagaggttcgtctaagaattttcgtacccgaccagctccatctcctttagggagaatctagcctatgttctctgaactttgagagatttatctattattagtttaactaattaattaattcttcaaagttatttggattgtcggtagttatctatatggttgttcaatcgctttcgtgccggtgaatctgtgaaggtttgtaacgtcctgattttggctcaagtttaaaacctattttgaatacaaattctattttttaaattttatctcttatttgaattttggtttggtgccattaaagatctcaaatcaatcattcaaagtccatctaaaacatcctaaaataattagagttcctaagcccatttacaattacaacaacacccctaaaaaattcaatatctgaaattcctataaattctgaaacattattatttcagtgggctaccgtttcttttccctagcccaactccttcccctctatctctttctctcccagtctagacacccctatcctcttccctgtgggggaggggcgccgccaccaggagcacagggacgaccgccggcttgaatccgccgctgctcctaaccaccgcgctgcgcctgctcccacccgtctcactattgccacccaccccagcgggcacctgcgagtgagagaagaggaggtgagagggatgagaggaaaggagatgataaggatgaaataatgagtagaagctcatttcaaaaagataatgagtggaaatgagagatggagagaggataaggatggaaaattttgaagcgttggaggaggagaggaggtaacttagactttaggcggatccttaagaggcccacctgtgaaaatcgattttcgcgtgcagtcctcttaaggagccgtatgcgaaaatagggattgatttttgcagacgcgatcagttatggtccatctgcaactaaaagagggtctcgtccaaaaaaatcatttctgtagtagtgcgcgccgcgcgcactactccactgtgcccaatccaccgtctcgccttctcgtgctccagctgcagcggtcgcccatcaaagatgaaaggtgtgagctcacactgctactgtccctattcccttttgccaccatgcctcctcccttcgtcccgaagccattgcagctcctgcatctacttgctgcggctataaaagccttcgcggtctgccatcttcctcctttcgcccttcccatcaccgctgccaccttcaaacatcatcagccagcccgaggcgcatcgacgagcatcttgggtgcacacggagccgcgccgttggactcgtgcattgctcgaccaaacaccatcggctgccgtcccttcccgagctagctcgccactagcaccgccaccaccccaaacaaccgtgctaccgcctcctggccaggcagctcgctacctccgccgttgttaacgatcaaatttggtaatccaaggatcggagatgaagaagaaatcgagacggagttcgagatggagatagtctcagaaacagagtgaggatcggctggagtccgaatcggctgcgatcaggatcagcagagtccgagttggacggggttagccgattgaaccgaattcggcagtatgacatggtacacgttgtcgggttaggttgatgtacttcatgaggattgccacgcatgggtagagtcctaagaaggcaattgtatctattaattaggatacaaaccagggtgccaccgcgctcggccaagcctaaccaatataagcgccgcatccacgaccttctgctcgccggtcgccctatacgtagggctccatctgcagagataccactgccgcccctatcgccgcctgtctggaaagccagtagagccatcaccactgtctttgcctcgatccaggctgccattgcgctaggtcgagcaccgctcgcgtggccgcctactccccaccgccctatcagtgacctccgcactccaactcctttgctccaccgccctccgtcgtcgccgtgcgtagctctctctcactcgggtggggagagtgtgaggactgaggagaggatgagaaattgaaaagaagagaggagaaaagaaaaggagaagaggcactggttaggtggaccccacggtccctaatcaagctttacaagtaattgttctcctaatcccgtccgatgtctctatgacatgtgggtctagtctttataatttctaaataaacttccttttaggcagtggcataattccatggttgagtatttgtcatggtttgtggatgcatggatggttgccaaacatgcaagtaattttggttggtatcttggttgggcttcccaaattaaaaatatggtgaagaattgttgcgacaggcaaataggaccagcaattttgacacttctataattgagattaacacacatgttcagaaacattcagcttatactcaagtgcatagcaaagctgaggtagttactgttaaacctgaaacaaaagagctaatgaaccctgaactccggtcctttgctctgcttgtcagcaacaagattgaggaaaatgattttgtcttgctgcttccgaaacatctcacttccttaagattgatagctaagattgcattgatcatgcaatgggatctagctgaaagcgaaggacaaatttataaagcttttgggacagtacaagtgtgcaatataaatcaagagtggagctttgcaagttcagaagtttatttgatatcgacttgcggacaagtcgaatttcaaggaaagaggattgttagaatccacgggctatacatgggccgattcagctgctactctaacaaaagcccagttatgcctatgagattaatacaaaaaggcagcagcagcaagcttctaggatcgatcgatcaatcaaccaaggcggcgaaatgcggcggtgtcctggtggctaggcttggcaccttggcgatcttcttcctccctatcttcctcctaccttcaaccctctactttagtttctagaaacttccataacattgtattactttgtttcctcctctccttttccccaaaaacactttgttccagttgtttatcatagcaatcgagttgagagatttaggtctctaacaatagcatgcctctatagtaacaatgaacttagaaaaaacaaatatggtggtcacagcccacttcatgttagaataattgggctaggcccaatttataatattaaatctcaaaggcccataataaatattgaggataataataccacctcaggatttaagcgagaaatatctcaacctaaatagggagttattggaggctccctattgaccagttgaggtgggggtcggaatgccacacgcgcgcgcgcgcgcgtcgggccgggccgtgggcgtgggcgtggcgtggctggcgtcttgcgtgcgtcacgtcacgtcgctatccttttgcagccactaacccacgttcccacgattccctccgcaacagcgcgtccacgttctttctcctgatagataaggaggccgcgagtccgatccgagtttgtcgcttctttcccggtgttagtttctccttctccgcgcctgagttgctctcgcttgcccacttctgatctcttgcgcgcacgagagattggaaggagcagtgcctccgaaaccacaccttcgcctgagatctgcaccgggtaggcaggtgatcaggtttttagggagtgcctcccgcgcacgacagctcatcgccatgtctggagttgccgccgccactgctggcggaggtggtgcgccgccgccgacaggagctagatctggatctggagctggtgcgccaggaggtgccgtgaacgacaacaacaacggaggcaattctgcctcaccatccagcggagggccattctcggggtataatcttctcctcctgctactgttgttagcgctatcgctatactatgtgcgctatgttcttgttcctgttctacatgatgcctctagcatgttatcgcgttactggtatgttcctgttcctgacatttatgatgcgcatagtatgctactggttatgttaagatcaccttacactgcttatgtcatgatcattgtttcaatttcttggattaaaatatgccgattaatgactatatttccaacaatccaaaaacctgataggtcattttcggttgttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtatgtcatggagcagttctatgactacaagatggtcgatgaccgttctgtagtagaacaagctcatgagattcagatgctggctaaggaacttgagaacaacaactatgagttgccggacaagtttgtggcgggtggcattattgccaaactaccacattcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaagggagactgctttgtgtgtggcaagtctgggcattgggctaaggactgtcctgagcgcaaagacaggaagtctgccaacatgatcattagcgagggcggaggaacatcggggtacggtaaaatattacctacagttctctctgtttttcattcacctgattggtgggtggatactggtgctaatattcatgtatgtgctgacatttttctgttttcttcttatcaggtcgggagaggttcctccttgttgatgggaaacaggtcgcttgcggctgttcatggtgttggtacggtcgatctgaagtttacttcgggaaagaccgtgcagctgaagaacgtgcatcatgtcccttcaataaagaagaatctagttagcggctctgtattgtgtagagaaggttttagacttgtgtttgagtccaataaatgtgtcgtatctaaatatgggacttttgttggaaaaggttatgacaacggaggcttgttccgcttttctttgaatgacatgtgtaataatcataatgctgtgaaccatattagcgagaatgatgagtctaatgtgtggcattcgcgactctgtcatgtgaatttcgattgtatgacgcgcttagctaacatgagtttaattccaaaattcactttggtcaaaggttccaagtgccatacttgtgttcaatcgaaacaacctcgcaagcctcacaaggcatctaaggcgaggaatttggcacctctagaacttgttcattccgatttgtgcgaaatgaacgg

SEQ ID NO: 74120 - DNA, 11266 bp, Oryza sativa
  unsure (1)..(11266): unsure at all n locations
tctctcaactttgttcagatgcatagttgcagcaatgaactccccataatctattgaaccactattatcaatatcagcctgcaagtcgaagaacatatgcatttattatatcttggcccaaaaatatatcatatattacagctaacgtgcctcacaacaatactttcttagaacataaaaggtccattctcacgtactgttaaacttatcagaaccacaaaatttggatgagatacaatagatttacaaataaccactaccaacgtcagaaaatctttgcaagctgctaaaaaaggatgtcaaatacacatattttaacaactatcgtcaagtttggtatttgaatacactagcttaacagagtgtttcaagatagtggactcagaaacaaaaaacaaaggtttgttttagcatatattgaactggaaatagaaggggcatagtcatgttagaaaattcaccgcttccattagggttgtaatttccgaatccttcaaattagcaccaactctccgcaagccagtttttagttcctccaatgtgatctgaccactattatcagtgtccaacattttgaacatttctctcaatcccgcaatttcatcttccgataaattttcagcaatgacctacagatgccacacagaagtgcatcagtatggaacgtaacttgtactttggtagaaaatcaagcaaaaatatactcaatattcaccctaagggccatcttctttagcttgttcattgctgaaaattgcttcaatctagttaagacagcagaatcaagaggtttatcaggagcaactccatcaacacaaacccaaggatgacctgccaacataaagatgggtcactagagaaggctctgacatgatgctctgcaatgtgatatttatgcttacatagagcttcatgtgcagtcaatctctttctgggatcacggtttaacattttcctcaccaaatcctttgcactgtctgagatagcaggccagggatcagatgaaaaatcaagatctcctttcaaaactttttcaaatatcccttgttcagattctgtgcaagcaggccagcatccaaaagaacaaaaaacagaggaaaactgtcagcatcaagcagaagcatgggtttgaaaaggcagcataaagggtagacatatcccaccatcccaaaatggaggaactccactaagcaagatataaatgattacaccagcactccatacatccacctcgcggccataatgcttcatcagaacctcaggtgcaacatagtaaggacttccaacaacatccgaataattttcgcctgtaaagtcaatcttaatgcattagagtttggaaaagatgcacaatcagtagtatttcagtgttctaaaagaaggggacagcagtgtattagagttcatattacagtactagttaagtacattaaggctctgtcacatcaatgcattaattgacaaacaaaatgaaaaggaaagatggaatgacatcccattcccttggcattttaagcaacatgaatttcaggatcaccgcaagtacagcatgcattcaattaagaagcatatatcatagtgaatggatatgaaagttatgtgcacaagagtttgattgcagattttggcaatttgtgataaaaaaaatcagtctctttctttgtaatccaggaaataaaaaaaacagtttcacaatactactgggaccaaaaaagggtttaacagatagtcaaatacacatctatctgaaaaacaaacgtatccattgcaacatatgtgcagttatgcaagaagtccatctagttgtaactagaactcaatcgagaaatcaaagctatagggggtcgcaatgcaccaccattacctcgctaagcttgcaaaatcaacttaactagcattgcctatggtgggggtaaaatccgcaattgccaacaaaatcttgcatcttacaagacaacacagcagcaaggatcgagaccggacctggcttgaagaaaatggaaagcccaaaatcgatcgtcttgagtggcgagtcctccttatggttgacaaacaagaagttctccggcttgaggtctctgtgcatcaccccgagcgaatggcacgcctcgacgacaccgatgatcacccgcgccagctgcgcggccgccttctcggagtagtgcccgcgctgcacgatcctatcaaacagctccccgccagcgcagagctccatgacgaggtgcacggcgacggcgtcctcgtacgcgccgacgatggagaccacgctcgggtggccggcgaggtggtgcatgatctggatctcccggcgcacgtcctccacgtcctcctcgctgaccagcttccgcttggcgatggacttgcaggcgagcaccttccccgtggccttctccacgcactggtacgtggtcccgaactgcccctgcccgagcttcttccccagggtgtagaggtccttgagccgctcggagtcgcgcttgaggacggagtcggcgaggagccccgcgctctggacgcgcctcaccttgggcttattcccgcccttgttgggggtggaggaggagaggtcggagtcggcgatggtgacgcgctcgggcgccgtggacgaggtgacggaggagtggctcgactcccgaggcgggtaacccggcggctgcgacggctcggcgcggccaccggggcgccagagcacggcgagggagacggagtggaagaagccgtggcggtccgccgcggagctggggccgacgcaggtgttccccatcgcgccggcgaagtgggggggagctgcggccgccgtaaccctaggcagccggcgacggcggcggcggcataggcggcggtggcggcggcggcgagggttggtggatttggatcggaggaggattttggtggaggagaggggagatggccggagggggacgaggtgagctgggccacgtcccactgacatgtgggccacctcagccttgctggcccacttgtcagtgggagcagcggcgcccgcgggagaggcgatgcgatgcgcgccagatcggacgcttacgtgaaacggtaagtgattggataatttctttttgaaaaataatacacctacaaaaaaatatttacaaacagttttagaaactgatagtatgatttttcataacaacagtacctattagtaattaaatccaacggttaagatttttattggtaagagtttagtgaagattttttttttgcaaaaaaaaatgacacgtacgatactgatgtccgcaacaagtcatctcgtctataattttgtgcagaattttcttctctaccgaagcgatctcccttgtccgatctctcttcatttttaagccacttggcatgcaatttgcgatgcgatgcggccgcgggacaggcgatgcgatgcgtgccagatcggacgcttacgtgaaacgtaagtgattggacaattccttattgaaaaatactaatacacctaacagaattatttaaaatattttagaaattgatatgatttttcataacaagagtacctattactcactctatcgtaaattataaggtttataattttttttacacggtcttcaataatatactttgataactaatttattttatattgtgttatcaataactataaagttaacataagtgaaagtattttaaagtactaaaatagtgatataacactcataatacttagcatagttattgttagtataatgattagtaaaaaaaattactagtttttccttaaaacaaaggtttcttataatttggacggaaaaagtagttaagatttttattagtaagtaagagtttcgtgaatattttttttgtttgagaaaaatggtacgtacgaaaaaatgagattaggaggaagagttatccatacaaacaatttttaagaaaagattatgagcatgctgacatcggtgccatactaccaagatatgtacgatactgacggctacaacaagtctataattttgtgcagaattttcttctctactgaggcgatcctttgtccgatctctcttaatttttaagccacttgacatgcaatctgcttcatgatttgacatttttgactgggtttttgtattttgcgtatcatcgtgaatgtgatgattcaagtgggtctgtgggtgtaaatcttggacgtggtcgtatcaattttactacgtgcattaacttaattttgtaaactagttcctacgttaagcaaagctcgctcgtcattcgttgaggtgagaattgtatcgcagaacgccaatgctaatggggtaaggattatttctacggctaatccttttatgtgtttgcgaaaaaaattatactgctaataattgacagaatcacattaaaacgcaattgaatctgggccgcgcgcacgccattgttaccgttccgcacttatgggctgatggcccaactagtttatgggctgcgcgtgttccgcagcgacgttacagcccatgttggcacgtgctccgcgatactggtccggcccaactgaaatggctttcaagtaaggagcggggcccacttgccagtcatagagaaatcgaagaaaaggccatgcacaccaaaaccggaccggtagacgacccggtcaccctgctggttcaccggtttgacggtccaaccgtgaaccggctggtcgaaccacggttcactaactacatgtagcatatgtgtttgcatacaagcacaaagatctgtatggtaggatggctacgggaattggcttgcaaacaatcgaccaggggtcgactccccacaagcgcgcgcatttccttcaatttgtgctaaaaatatcaagcccgcggacaagtctaacacaagtccggtccgaccgaaagcagtttattgcccgattcaacacaaaaccagccggttcaggttgaacagttgcatgtccggtctttctatttgaccaaaccgtgccaacctctagttccggttgaacagccggacttcaggttgaacagttgcatgtccggtctttctatttgaccgaaccgtgccaacctctagttccggttgaacagccggtccggtccggttttttacactaggcaccaaaccaacgaggattcctgccgttaatttataaactgtgtccaaattttctactccctccatctcatatttaagtagtgtttgcaacacaaaacaaacatattatcaaattatattcaatgttagattaataaaaactattttcatattttagatggtgttaaatttttatatgaagttgatcaaacttaaaaaagtttgactagaagagaatatcacacgacttataatgtgaaatagataaagtatattatatgtccaattctatcaaaatatgttttaaaaaaaatgtcttctggtacttgcatatctgccatacttcatatactccttgtaggactataatcttacagtttttttctctactatatcaatatataatacttcaattggtaaaaagaaaattctacgcgaataatccaatcaggatcgatgttcttgcctttttcttttgtctccttttacaacatatatacatatatacacacgtgtatgcattatcttttatgaactgctgctatatattagatttttctcaccacaaatccacaatagtatggtcaaatataactatcttgagctacctggctatctccttcctccggccggccgatgcatggacgtatatgcatcatctgcgacgcanaagctcacgtggcttgacgacttcctatttttattagcatctatcgcaaattaattcaaagtttgtcgttgtgaattcgtgtgtttaaacacgcatgcataccgaagcagagaattgcggctgcaactgatcaatttgagatttgtgaccacctgaaacgaagcacccatgcagctgcgtgtgtccgggaagcatgcatgtatgcactgtaattaacaagtatttagatcattaaactaatactaactatatctaacgatagatcttgttaaggttagcagtagtgcttactccctccgtcccaaaatacttgtcagttttttttaacgtttgattatttgtcttatttaaaaaattatagaattattatttattttgtttgtgacttgctctattataaaaagtacttcaagtgtgacttatcttttttatatatttatactaatttttttaataagacaaatgatcaaacgttataagaaaaaatcaaaacgatatctaatttggaatggaggtaataattagttgtgcaggaatacatgtgatatgtatgatgatttgatctgcataataaatacgcagcagattaattaggagaaggctgcttggaacaatatttaaatttagtcagaaaagaaaactccatgtctgaccttttcgcgcgccttttgacattatataagcgtatcttcgtgtgttggtttctactactccacgcagcaaaaacatctgacaagaacaacgtctcgggcacgcagcgatcgatcgaaccatgtcgtccacgtcatcgtcgccgccgccgccgtcgaaggcaaagaggcgaggctgcatccatggcgcaaggccgcagccgctgatcgtgtcgtcggcgccggcggaggcgagccggccgtccaagaaaccccgtgtcagcggcggcggcggcgacacggggccggtgatcgtgtacgagctcacgcccagggtcgtccacgtcgagcaggaggagttcatggccgtcgtgcagaagctcaccggcggcaagcagcagccggcggcggcttcaaccttgacgacattgccggcggctgatcaggtggccggaggtgatcacgccgctgcagcggcggccgccgccgacccactggtgctcacgcttgggcagcagcgtcagcctgctccggcgccggcgatcgacggcgaccatccggcggcgccgcctcattctccaccggcggatgcttttcttctgtcgcccagtagtttcttcttgtcgccaaccacgatgcatgcgttacaagagttggctgctttgttctaattagctctgaacttctaatttttggatcagaatcacaacagtttgtgcaaaaaattttcctgtaattagggaaaaattagcacgaacaggtgctctgcgctcagctcgccgactgtatgcattccttccgttcttcagcatctgtacatttcttgatctcattctgataattaacaaaaccaatacaatttatttgttgattttgtttgattaaccaatcagctttgctcgttaattagtcgttactactgtattgctaagtagtgcaatcaaataattaacccaagcacacaacctcatgcgcaaagagaggcacgatccttcactctagatcgtctccctattgctgctccatgtttgtcaatacaggatggacggcatttgaaggggtttttgttgaaggcatcttttccaaaacaacctcaaaatattcctccctaaggcgattttgataaacatctttttaggcgtttttaaaaagagtcgtgcatcactttttcctgacgcaagtaaatatagtgtttctcaaactgcctctgaaaactattcatgttttttccttatcaaagcattccaaatcgcctcctaaattatatcatttcgtactatatattactgtcaacaacagcggacggtgatatacaatggagaagttttcactgttagctttcatcgagcaaatatatgggcccaaactttagcctggaaattctgagagttagagctaaaaggttgacctaaatcttgtaaatgtactttaggataaaacaaaaaatgacttaattaggctgtgaaagggcatgtggactatggttcattaccaccctagctagcgacatgtgttctacagtactatcccggcccactgctatgtaggtcgtacgtactctacgctatatatggttccgatcaaatagtgtatgggctatattgaccacattgtcatactggtccaactgaaatagacactgaccaagtagttgtgttggacatgttatgtaatcgacatagccataatcacttcgtcgcggacaacgacaaggaatgtgactggcggcgaaagcaacccagcgatgaacagttggagcatgttgcacactaggtgtgcctcatgacatgttgacgcctgcagccatgcgcgaaggctccatagcttattgtcacacaccatcgtggcgcccacgccgctagcgccaacgcttctttttgttgtttttgttcttcttcttcttcttcttcttcttcggaaccgagccaacattgttgctatttatattagggaaaagtccattttacacccttgaactcttatgcttgtctaaagtacacccccgaactacaaaaccggatataatacactctcaaactggcaataccggacacttaacgcccccgggctgtttttaccgtggtttttgacacgtcggctgccacgtcggatgccacgtcaaccctcgccacgacagcgcacaacataatatgggccaagcccatattctctccccctctctctttctctccctgccctgttcgctctcctgtctctcacgaccgttggcggcggcggcggcacggagctgcaagggtgacggctacggcggcggcgtcaaactgcgagggccgcggcggcggcggcgtcgacgacggcgtggagctgcgagggctgcggctgccgcgtcggtgtggagctgcgaggcggcggcggcggggagctactgcgagggcggcggcgctgtcccgattgcgcggacggtcgccggttgaagcctctgcgcgtagtcgtcagcggaaggttcgggcgtcgtcgtcgccgcatgcgcctttggatttggcttagcagggaagaagcagctcgacgcgtggtggaagcaacgacgagcactggtcttggtgtacaatctgggaagtcttcacaagatacagtcaatgtaggttaattacatcatctgaatctgatacctgaatttgtgcatactaacattttgctcttctctttttgcttgacatcgataagaggagagtgataaggacttctccccgccaccaccgccgcctcgcagctccacgccgatgccaacgccgcagccgccgcggccctggcagctcgacacagcagccgtggccctcgcagctcgacgcagccaccgtagccgttgccctcgcaactccgcgccgacgccgccgatgcagccaccgccaccagtcgtgggagagaggagaacaaacacggcaaggagagagagggagagagaggggggagagaatatgggcttggcccatgttatgttgtgcgctgacgtggcgagggctgacgtggcatccgacgtggcagccgatgtggcaaaaaccacggtgaaaacagcccggggggttaagtgtccggtattgacagttcgagggtgtattatatccggttttgtagttcgggggtgtattttagacaagcataagagtttgagggtgtaaaatggacttttccctttatattactaggagtggcgggtatgtagttgtttggagttagcgtaaggcagttcggttgtggctcctttgtaggtcttgcgtcgtccagttttgcctcatggccgtcagccgggtgctagttccttcgacgatgtgtacagtttggcattttgttgatgtatggtggcttgttttttttttcatgtacggctgtacaacctctgatgctataatcttttttccctactacatcaatatgaaactttgtgctgtttgtgcgaattgtttttttgaaaaatatcatgagtgaaaaaaccgtaattcgtggtttttaagggaaagggaaatgcacgatcaaggagcagtgcccacttggcaacgacagagagatggagcaacgggatgagaggcaaagccgccaaggatcctgattttcttcttgctccttattatccactaattgcatccagattttccaaattatatccaattttattagtatcagtaaaaacaaatgtgcctcctgcaatcctgcatgcatgccttacattatatatttagggattgtttaggttaatgtcatttcaaatcatatataccattttttaaagctattaaatatacatatcaatttagttttttttaccaaactctggtaaatacataagaaattttgctaaaacttgataatattatcaaattgtcaaaattttagcattgctaaaatttaataaaatttattttggctacaatgccttagcattcgtatacatataaagtgtaaacacaaatttaccatacgacaagtacatatgtttattgcctttgtttctctcttttgcagcgtataaacacatatctgcatgcgttgtttgacctgcctacatatatttaccagcgtattagcatagtcaaataggagtaacaccttgcagatattatctgcctccttcctccggcctccggcccgtctatgtacgtccgtgcgtgcatcatccaatacgcatagcccgctcagtctctctctctctctcgttgattaatcgctggttaattttaatcaagcgtctcattttgaaactcattttaaacaagcaaactcagttactagtagtactcctagatgcagctgttgacgatcaaattaaactgactttctgatcacctgaaacgaagcagcaatgcaggcagcaggcagcaggcagcagctagcgtagacgtggtagcgtttatcctggaaggaagcaaccatccagaaaagtaatacggataggcggatagctagtctatacaaatgcccccttcattccaaataaattcaatcatagctacaaacattgacatatatttatctagattcataactaagatttatctttttttatgacggagtagtactcctaagtaattaaatcactaaactaacaccaaccacatctaagtgacggatctttgttaatgttaaggttagtatacgtagttggtgcattattatattgcacaagtttgataattaatttggtctgcgtatagtcaaatgcgcagcaggcagattaattggagcaatatattcaaaccttttcgcgcgcttttgacatcatccttttgcttggcgccattatataagcatctgccttcctgctggcttctgccacacgcagcgagcgaaccatgtcgtccacgtcatcgtcgtcgccgccgccgtcgtcgaaggggaagaggaggccaggcggcatcatccggggcccgaggccgcagccgctgatcgtgtcgcc

SEQ ID NO: 74121 - DNA, 5308 bp, Oryza sativa
aacataatttccttgcaaattctacaggaacaatgtatgaagaatagataaaatatgtataatactataacttcgatttgaaggatggaataacagcgacttcacgctccacgtattgctgagaaaagaaaattagaaacgttgttccttcatgaacagaaatgcacaatcccctcgatgaaaaaattgagcaaaagaaaccgaggttaccttcaggtcgatctggatggtgtgcttgtgtgtgtcagactcacacacatcaactatattgattgacaagaaaatatctggcagtcggccgccgccggctggggcggatggggcgaggtcgtggggatttgatgcggagtcgacggcggcggcgttggtggcgaggtgaggaggcaacgcggggatctggagcggagtcgacggcagcggcgttggcggcgaggtgaggaggcgacgcagccgcgagatgagttgtgggtgggcagcggcagcgtcgccggctggggcgggtgggcagcggcaacgtcgacggcggcggcgttggcggcgaggtgaggaggcgacgcggggatctggcagtcggccgccgccggctggggcggatggggcgaggtcgcggggatttgatgcggagtcgacggcggcggcgccggcgaggtgaggaggcgacgcagccgcgagatgaggaggcgatgcggcgctgccgcgatgcagggaggagggcgaagaaggcggcgagaaggcggcgtgggagaaggagtgggcgtggggagcgatctcttggatcgagagaggagcgagcgtggggaggagatcgatcgttggatacggcaaacggatggttgagattaggcgtgtctgtcagatgcgtctgctgtgtcaggaatcaagaccaccactacgaactttttaagtagtagagattatttttattctggtttgagtaaaaaaaatacagttaaagttttattaactgactacttagtactacggagaaaaagtgaaaacgcagcatgtgagatgggccttttgatgggccaccatggtgagatggcacgcgcgcacgtgggctgccgataaaggggaaggagatcaagagggttggacccaccgacatgtagctctatatatctttatatactacttaaaaaattcgtaggggtggtggtgagtcctgaacgatcgaatggttaacattcatcagaggatcctctcacaggcatcagcggatgagattttctcccacgatccacccgtcgcaccacttctcatctccctgatccgcattgcgctccctctctctccgatccgtaatttcgcatcgcactccccagccccccatccttcctcctcggggcgccacctcctcaccccaccgacgcgccgccttcccatcccgcccaacccgcgccttcttctccggttgtcctccctctgtattgtgccgtccctcgctccgccccctccctctccatcacgccaccgccccctccataaaccataacctccctcaaatcccgatcatctgcgcagccgtcgttatcgtcggaccgagctcttcgatcatcaccctccgttgccgccgctgcatcagacccatcggaatggtggataggaatgcggacctaagtatgggtgaggggtaggacgagatgatggcggtggctgcaggcacgcccaccagcacgctcgctggagtgtggagaggcgcgcgcccgctgctgcgagtcaccggcggtgtcgtcggcatcatcgtcagctagctctgcatattaaaactataacatgagttgtcaagtaaagttagtgcaatgtaataagatgtttttaatttacctatgagaatcactattagtatttccttttgcatcaatttagtggaagatatcaaaaaacaacagaagatattcaaaaaggaactatttggatggaaatatgcatatattgatggattatcaacacctggaagctaatggtaaatacaatttatttttctcgatagcctagcaacataatttcattaggataaaacctttattcgtacctaatatatttccctcttgctaagatttagctcagggtactcttcattcaatggcctagccagatccatgctgcatgttaattatgacatgggttgtgttgtttcttggtggagaagatcgttaagtatctcctggcatgcatgccactgccatcaacattctttcttgatggctgtgagcatgtcatattttatctggtgttatcccggctgatgagcatcccattcggttttttttctttgtttacattggttaagtttgatgcatttttcagatttgcttccacggatcagtttggtcaggtagtcttgttgcaatgcagagttttagatatgaacggttcatatacttcatatcatagttgtacacagtggtttgttctaatcattcccatctgattcttgggagtagccaaatcagtacatggtcagatattaggaaggaagagcagtataatatctatgtgcagtttagttctaatttactggctattctcacacgttggcttttttattgattgagatatcatttttcttctgttttcactgcagtccaaatgtgctggtcaattcataatcgatcatcaggcctggaatttgtctcaaggtatatacatggaatagtgttccaatatgagtagtgactaaagcagattaatttgaattgtgaactcttttaccaagtgaacagagactgtcaaataatcaggtaagtactaaaatcctattgatcactataaaattacaatctcatttgatgttgcctttttcctggtgatcataggagtgaccctttttttcatgcttcaaaggtatatggtttttgtataaaattccatttctcagtatagaagttaaaactctcatttttgtctgaactaataaactattgttcttctccaagatttgttcactaagttgcaattgatagcacatttttacattttcttggcgcgtccatttgtgcctccacagctgcctcatatgctaccactaacatttcttattattcattcctatttcttagagaattgtatttatctatgcaaaattgcaactcgatgtactgaggattctataagcttttaaagattaccgtgaacacatagtgtactgtccagagaattactcagattcatttatgtctttaatggattggattccatgtaaattcagttgtaatcctttatatatatatatatatatatatatatatatatatatagtctgttcaaggtatataacttgaaatttagcatgtaccagaagatagattattatcagtagaccccaaaaaggtcacactccaattttgatttatcaagtgcatgacccttgataaatttactcatgtgtgtgacgtccgtgactgcttcccgaagcaccaaccaattttgttttgaggaaaacatcaactaactatgtatcacctaagagggtaatattcagaacttgtgatcttagaaaatgaaaccatattcttctatgccaatgcctaatggttagagaaaattcttttcaagtatacctgatagtctgatacattaaccatattcctttgtttagagaggaacattagccacattctatcctcttcatttgccagtcataaataacaggcgagatgctttaatgcatacattttttgccgttgcaacgcacgggcacccaactagttttgttttagttttattttgtgacctcaacgtcacatggaataaggaccaaattaaactagtcatatcatctaaaaccgccgttcaaaccgtcttcatacctcgtttaaattggtttcattgagacgaggaatatgttgcactggttttacgattgagtgacgcgattcaaactccacccttaggttgagttcgtttgcaggggttctcaaccttccctccctcgttttctctcgtgcatgtgtttccaaactgttaaaaggtatacttttttacaaaatttatatatgaaagtttctttaaaaaaaatatattaactcatcttttaagttttttaacctaatagttcctccgtttcatattgtaagactttctagcattgtccatattcatatagatgttaatgaaacggaagaagtacttaattaattgtatgctaatctattgcttcgttttccgtgcatgagatttaatagtttccacaccaaaggacacacccttagagcatcctaaaatttaactcctaaaaatcttggattgggaccatcccataggaaattgggcccaaaaatcacctcatacttaaagagtgcccctaattttgatttccaataactttaaactatgccacatcatctcaagtaaatcttgcttcaactgtttatgtctttccatttttccgataagagagagatcggcgctgggcgctgccaacctatggcgcactagcagcccagctaagttgtgcagcagggtgatctttcgagttcttggcagctgcagcagtggacggcgagggtgtcggcaagtttgcaaggcacgtcgagggggcaggtagggcatggccatctcacggcagggcacgacagggggaagaaaaggcatgagcggcaaaaacctcccgcgatttcatcaattgggagtgtgtggagatgcccaaaattggttcaaatagagtatggttctgggtgtgggtaaatattgggatcagctttaggcatctcttggagacatgattttaggactctatcgttccacttattggcataataagtaaaacgatatatttgcaacttaaaacttttatatacgttttcttagcaatctagaagcgaagcaaaagctgaaaaataaactacggtgaaaaacactaaaatcaactttaaatttaaggttaaaaatttaaattttgacttatataagcataagtataagccaaaagatgaggctttcaaactagattcctaaaatttatcttctggacctagagtcccaatttacttaaattcattcaatctccccgtcttctcggccgccgactcccgtctcctcgcccgccgcctgagccgatctccatcgtgcgagcagcgtcgccggtgtccccttgctgcttccgccgttcttctggtgagcatccatccattaccgacaatctttttttgtcgaatttatgttaaaccctagcgtttcttcctgatctgggatcttttttctttgcccttaacctcagtaaatccagcctaccctgagatttgatttgaacatgacgagaaaaccagaggaatccttggattgcgcagctaagaacagacaaggg

SEQ ID NO: 74122 - DNA, 3073 bp, Oryza sativa
gggactaaagtcccacccctatatatatatatatatatatatatatatgtctttttcctcctccagcccgagcaagcttcaaaatttcttcaaaaaagaggggaggtcatgccaaaatttctagtgaatttattttggtgattatatacaaatcggaggtgcctaaaaggttagcaacttcatcctccaatgttttttttgtcatattacatttggagctatgttttgcacacttttttgtctccaaaattttgttgtaagttgatgagagagaaaatttgtgtggggaagaaagaatatatagaaatttagtttatttgctaaaaaaggttttataaaatagttgagaaggaaaatatagtgaaagttaatcttgaataatagaaaacaaactaaaatgaaaattaaaagaagtacaacacattaatattagtttaaaactttagaaatagtaaataagaattatttggtgcaatatttcataatttttgtatgaataatgatatgtcactattgtgtgactgttgaaagagtttgtaattattttataattattgtatgaataatgatatgtcactattgtgtgactgttgaaagagtttgtaattattttataattattgtatgactgtcattattgtacgaataattatttgtgtacgattttttttcatgtcatgtagatggatcggcaatggatgtacgctgaccggcggtccaaagagtttattgacagcatgcattattttttgagagtggccgaagctaacaggcaaaagggttttatttgttgtccatgcaataagtgtaagaatcagaaggagtattctgcatccaggactattcatttccacttgtttgagtcggggtttatgccaagctataattgttggacatcccacggagagcaaggtgttgaaatggaagaaaatgaagtggaagacgacaatattctggactttgctcagtacgctagatttgaaagaaatcaaacgggcgaggaggaaagggatgctgatggtaacgacgttgtggatgatcttggtcagatgttgcaggacgccaaggaggactgcgaaagtgaaaagggggcccataatttggacaagatgttagaggaccacagaacatcgttgtacccaggttgcgagcaggggcacaaaaagttggataccactctggaattcttgcaatggaaggcaaaaaatggtgttagtgagaaggcatttggcgatttattgaaactcatcgagaacattcttccggagggaaacaaattgcccgagacaacgtacgaggctaagaagatagtctgccctctaggactggaagtttagaagattcatgcatgtccgaatgattgtatcctatatcgcggtgaggagtacgagaacctagaagcatgccctgtttgcaaagcactacgatacaagattagacgagatgatccaggagaagttgacgggcagctaacgaagaagagaattcctgctaaggtgatgtggtatttccctatattaccacggctaaggcgtttgttcaggaacaaggggaatgctagaatgatgcgatggcacgctgaagagcgtcaacaggacgggatgctgagacaccccgccgatggttcgcagtggcgaaacatcgacagaaaatttaaagacattggaaagaacgcacgaaacatacggtttggtttaagtacggatggcatgaatccttttggagagatgagcagcggccatagcacttggcccgttacgatgtgtatctacaacctcccccctcggctatgcatgaagaggaagtacataatgataccgattattattcaaggccccaagcaacctggtaacgacatcgatgtgtaccgaagaccactggtcgaagatcttaaactgttgtggaagaagaaaggtgtccccgtgtgggacgaggacaaacaggaggagtttaacctacaagtgctactgttcgtaaccatcaacgattggcctgcacttagcaacctatccgggcagtccaacaaggggtacaaggcttgcactcactgtatggatgaaacagaaagtacgtatcttaagcactgtaggaaggttgtgtacatgggtcatcgtcgattccttgcagcaaaccactcggtacagaagaaaggcaagcactttgaacataaggtggaccactgtacaaagcctaaacatcgcagcgggaaaacagtgtttgtatggttaaagatcttaaagtagtgtttgaaaggggcctggcagccagcctatagagagcgaagatggtcacgccgcgatgtggaaaaagaactctatattttgggagtactctattgggaattcttggacgtccgccacgcaatcgacgtgatgtacctcactaagaacctttgcgtaaacctttttggcttcctaggtgtatatggaaagttgaaagatacactggaagcacgtaatgatctaaagcatatggaacaacgcggtgaccttcacccggaaccaaaggagaaaggaagccattacttgagtccagccagctacactcttagcaaggcagagaaggaaagtatgtttgaatgcttgtaaagcatcaaggtaccgtctagatactccacgaatataaagcgaataataagcatgaaggagaaaaagttcacaaatctaaagtctcatgactgtcacgtgttgatgacacagctgctaccaattgtaaaaaggggtatcctcccaaacaatgtccgggcaacaataacaaagctatgtgctttcatgaacgcaatttcgcagaaggtcatcgatccgaatagattagaagccctgcagaatgatgtggtgcaatgtcttgtcagttttgagttgatatttccaccttcatttttcaatataatgacgcatctgctttgtcaccttgtcaaagagatcggtattctcgatcctgtgtaccaacacaacatgtttcctttcgagaggtacatgggcgttctgaagaagtatgttcgtaaccgtgctcgtccagaggcaagcatcgccaaggggtatggaacagaggaggtcattgaattctgcgtaga

SEQ ID NO: 74123 - DNA, 6722 bp, Oryza sativa
ggtgtcgtcggcatcatcgtcagctagctctgcatattaaaactataacatgagttgtcaagtaaagttagtgcaatgtaataagatgtttttaatttacctatgagaatcactattagtatttccttttgcatcaatttagtggaagatatcaaaaaacaacagaagatattcaaaaaggaactatttggatggaaatatgcatatattgatggattatcaacacctggaagctaatggtaaatacaatttatttttctcgatagcctagcaacataatttcattaggataaaacctttattcgtacctaatatatttccctcttgctaagatttagctcagggtactcttcattcaatggcctagccagatccatgctgcatgttaattatgacatgggttgtgttgtttcttggtggagaagatcgttaagtatctcctggcatgcatgccactgccatcaacattctttcttgatggctgtgagcatgtcatattttatctggtgttatcccggctgatgagcatcccattcggttttttttctttgtttacattggttaagtttgatgcatttttcagatttgcttccacggatcagtttggtcaggtagtcttgttgcaatgcagagttttagatatgaacggttcatatacttcatatcatagttgtacacagtggtttgttctaatcattcccatctgattcttgggagtagccaaatcagtacatggtcagatattaggaaggaagagcagtataatatctatgtgcagtttagttctaatttactggctattctcacacgttggcttttttattgattgagatatcatttttcttctgttttcactgcagtccaaatgtgctggtcaattcataatcgatcatcaggcctggaatttgtctcaaggtatatacatggaatagtgttccaatatgagtagtgactaaagcagattaatttgaattgtgaactcttttaccaagtgaacagagactgtcaaataatcaggtaagtactaaaatcctattgatcactataaaattacaatctcatttgatgttgcctttttcctggtgatcataggagtgaccctttttttcatgcttcaaaggtatatggtttttgtataaaattccatttctcagtatagaagttaaaactctcatttttgtctgaactaataaactattgttcttctccaagatttgttcactaagttgcaattgatagcacatttttacattttcttggcgcgtccatttgtgcctccacagctgcctcatatgctaccactaacatttcttattattcattcctatttcttagagaattgtatttatctatgcaaaattgcaactcgatgtactgaggattctataagcttttaaagattaccgtgaacacatagtgtactgtccagagaattactcagattcatttatgtctttaatggattggattccatgtaaattcagttgtaatcctttatatatatatatatatatatatatatatatatatatatatatatatatatatatatatatagtctgttcaaggtatataacttgaaatttagcatgtaccagaagatagattattatcagtagaccccaaaaaggtcacactccaattttgatttatcaagtgcatgacccttgataaatttactcatgtgtgtgacgtccgtgactgcttcccgaagcaccaaccaattttgttttgaggaaaacatcaactaactatgtatcacctaagagggtaatattcagaacttgtgatcttagaaaatgaaaccatattcttctatgccaatgcctaatggttagagaaaattcttttcaagtatacctgatagtctgatacattaaccatattcctttgtttagagaggaacattagccacattctatcctcttcatttgccagtcataaataacaggcgagatgctttaatgcatacattttttgccgttgcaacgcacgggcacccaactagttttgttttagttttattttgtgacctcaacgtcacatggaataaggaccaaattaaactagtcatatcatctaaaaccgccgttcaaaccgtcttcatacctcgtttaaattggtttcattgagacgaggaatatgttgcactggttttacgattgagtgacgcgattcaaactccacccttaggttgagttcgtttgcaggggttctcaaccttccctccctcgttttctctcgtgcatgtgtttccaaactgttaaaaggtatacttttttacaaaatttatatatgaaagtttctttaaaaaaaatatattaactcatcttttaagttttttaacctaatagttcctccgtttcatattgtaagactttctagcattgtccatattcatatagatgttaatgaaacggaagaagtacttaattaattgtatgctaatctattgcttcgttttccgtgcatgagatttaatagtttccacaccaaaggacacacccttagagcatcctaaaatttaactcctaaaaatcttggattgggaccatcccataggaaattgggcccaaaaatcacctcatacttaaagagtgcccctaattttgatttccaataactttaaactatgccacatcatctcaagtaaatcttgcttcaactgtttatgtctttccatttttccgataagagagagatcggcgctgggcgctgccaaccaatggcgcactagcagcccagctaagttgtgcagcagggtgatctttcgagttcttggcagctgcagcagtggacggcgagggtgtcggcaagtttgcaaggcacgtcgagggggcaggtagggcatggccatctcacggcagggcacgacagggggaagaaaaggcatgagcggcaaaaacctcccgcgatttcatcaattgggagtgtgtggagatgcccaaaattggttcaaatagagtatggttctgggtgtgggtaaatattgggatcagctttaggcatctcttggagacatgattttaggactctatcgttccacttattggcataataagtaaaacgatatatttgcaacttaaaacttttatatacgttttcttagcaatctagaagcgaagcaaaagctgaaaaataaactacggtgaaaaacactaaaatcaactttaaatttaaggttaaaaatttaaattttgacttatataagcataagtataagccaaaagatgaggctttcaaactagattcctaaaatttatcttctggacctagagtcccaatttacttaaattcattcaatctccccgtcttctcggccgccgactcccgtctcctcgcccgccgcctgagccgatctccatcgtgcgagcagcgtcgccggtgtccccttgctgcttccgccgttcttctggtgagcatccatccattaccgacaatctttttttgtcgaatttatgttaaaccctagcgtttcttcctgatctgggatcttttttctttgcccttaacctcagtaaatccagcctaccctgagatttgatttgaacatgacgagaaaaccagaggaatccttggattgcgcagctaagaacagacaagggagaagatcaggcctccaacttaacgatcttcccatagtacgtgatcgtgctgtcaaactgaaatcaagttacatatatatacatatactccttgtgcttcagcatgatgctgaataattgtgtagtttgctagtgtgatgctttgcattctctgactccaaattatgatgcaggatgttttgggcttgatcatatcgcggctgccaattggagatgctataaggactggacttatatcaaggcaatggaaggatctttggcgtgatcatactatgctaacattcagtcgcgccacatttcctagttgcagaatgcttaaccagcaaaatttcataaggagagttgattcaatcctgcagcaacatagtggtgtaggcgttgagcgcatggagatcaagttcttattgcgcaatgcgcggcgggacatagatagatgggtgaaatttgccgtcgcatccaagacgaaagaactcattcttgatctatcagatcttactaggttcttcatgttgccagttatggtatttcacccatatctagacagagaaggattttatgagtttccttgtcagcttcttgatgccaacaatggtggatctcatttgcagtgtctgcagcttacctctatgtatctgaaaccggctgctgatttcactggatttctgaaccttaaaaggcttaacctgataggtgtaaatatcacagatgaaggggttcagaatttgctgtgcaatcccaatgtcctggagttccttgagatctccttctgcagaatgctcacaaagattcatgcacctcattttctgaaccggctgaagcatctgcaagtggattgttgccctgtacttgagaagatagagatgaactgtgatctggcaacacttgatttcactggttcatcaatgacacctttgatttttgctacaacttccagcctgacaaatgtgcgtttaaaaacgatgcctttttgtactggtcttgactatattgtcacaggattcatcagtaatttgccggttgttcgaatgctcgaatttcatgttgttgaatataaggtttgtgatatgaccacttagtttgtttctgtagcagttcattttttttttcatgcatataaattattgtcaactttctcattagctttttttttttgttctgatgcacgccagaaagctatttctcctcagaggcttcccaaattaatttatcttcgacatttgaagttggaaacgattgtttttggatatggcaggaagactgatatccttgactatgcatatcttttagaaattgctccttttatggaaaaactggaactacatgtaagtttttcacttccaactgacaaataaaagtatatactcatgaattagttttagccaaattttggttctgtttgcttggccgattgattaaatgcgatgtgatgtctattgtgcagtagtagtaatttgtgtttttgaacttaattaaaacacaaaacctgatcctgcattgtgcccgaacgcacgtcatactttgctatattgaagtataacagctaaaatgaaatgaatttttcattcttaattaaaacaattgggtgcacatcttatagacttcctccattttcaataaatgtcgtcattgatcacttcctccatttaagctattcatgtctaatgttcaccttatttaaaaaaatatgtaaatatcatttgttttgttaatttatttaaatttttgcatatttgtattaatttttttaataaggcaaatgggtagacgtaatgcctacagtcaacgacatcatttattagaaaaatagatggagtattttgtttttcattccaggggcactcactaatattctggttttctcatatttatagatgtggatagacgctcctcacaaaccatacagtgaagaggatggtgatctaagaagccttccattacaccatcacaataatctcaaacaggttcagatcactggaattttcggtcagaaagatcaggtagagctggcacttcatatcctttgcagctcaaccgtgctcaagaacatggtgataaatccagaaattgcaatagtgcctcacgatgcttatcgaccgccaaaaagaggggcacacaattttgtggatggtcgtgacgccgctatggagtttgtttgcaaagctgaccatcgaaacgtcgtcgaagttgtatgagcatcatataagatggagtcgattaaaaaatatatatatgtatttaaattttgagtaaatttcacagaactacatgttttatagttcaagttgcagaaaaccacaaacattttgacacttggcacttaagtatatatattttggtagtttagtttcacaaaaccacactatcgatgaatggattcatccatgagacgacgtgtcgttccatctaggatgaggacgtggcatcctattaatttcgtgcgatggctggtaataggatggcatgtccttgtcctagatgaaacagtcacgtcatctcgtgggtgaatctattcattgatagtgtggttttgtgaaactacactaccaaaatatatgtacttaagtgccaagtgtcgaagtgtgtgtggttttctgcaacttggactacaaaacgtgtagttttgtgaaatttactcttaaatttttggtgaaaagaaaaggtttgttctctttgaaacaaaaaggtttaattctgcatgaaatagggaaaaaatgtgtgttctcttgaattggacatggccattgtctaaacagatacttggagattgacaggtgatgtcacatgttcgccttgggtgtatcagttggaccagagacatggaggattagggcctcaattttttttcatattttaatcaattctaatgtgtatcttaataagttctaatgcattccaacatgtttaaaaacctctcattctattttaaatgagttttgcacttttgctcttccccctttacccatttttctagaacggactaattttcttcagctccttgatggtaatcataagcaactcattaggactatggctcatggctatgatgtgaacatatacaggcattaatgagtaggcatttgatatggccattgcctgaacatataattttttttttgc

SEQ ID NO: 74124 - DNA, 10891 bp, Oryza sativa
ggctatcccatactagcacatgtggttgcactgtatacgaaatgaactgacattgagtgaagtccttaggtcggtttgggcacactctccccctatcggtacacaactaatcaccatatgtgcaccacttgaggcccaaacctaaaatccatgtttttccaccattttatttatcaaaatcacaagtattaaagttctgtccagattaattaaaaatttattttcatgtttgtaatgagcccataatgacaaggaagacaattctaagcatggctaagctttatatagtaacctagtgtcaccaaaagtcatatataaagtggtatagtcatattgttcctaaggttaggagtgagggatatggatatatgtggggtcaaggtgaatgcaaacaataggagtttgtccaacaagtttaacaaaattttaatttattagtgtacaatcgacatgcaagatttgcaaacattttcaataacctccaaaacataggttcaaagtgatcaaagagagggaggtgggacttgccttgaatcaggaaaatatcagcacctaaatcacttcttcaccgattaagcaatcatctatacaaagtacacgttatgcaattaaacaccgaaatatgcgaaaaatccaaaatgctctaaaatggatgatttgtgcacagcgaataggtactggtctaaaatgaatttaggtgaaagaatttctattttatctcatttcatttgagaattatgaattttagaagtttcatcggtatagcgtaggatttacttaggtactattgtgaaatgctgttataaggtgattcttattaagtttatgtttgctggggtgaagatatgtgttttctaagactaacacatttggtttcataatttttagagttaatatgaattctttatgtattttacaaattataacgtgttataggtgtatagtgttctataggttcatggctttagaggtttaggtctagaacttgcctcatctagctagtgatgtataaaatgagtattttagttaactaatctaaccttagttcataggcttatggtctttattatcatggttcatattttataaactaggggagctctagtccatgttagcaatttattatatcaacctagaaattattacataagctaagtgccttaagttttggtggatgggaatggaactatgcattcactggtctaacaagttttatttgggtttcattatagctagagtgtatttctatgtacatttatatatatacatattgctcaatcgatactatgtgattagctcctatcctataaatttaaagtttagagctataacctgtacagaaggttccatattttattttactatgttgaagcccactgtttgctggttctatagatatttggttcacttcatttagactaaagatgaattttctacaaattttacattttaaggttgctctatgatggttattacttacataagtaagtatataattttattttataacttggaagtatatgttttggtgattatacagaacttgggtttattcaaaaaggatctaagatgagttttatataaacttctaaagttcatcttatgccaaactagttattttaaagataatagttttagaggcatttgatgtaaagtgtttatatgttttattttaatttatttttagagaacatgttggtggatctgtagaaactaagtttgctctaaaatgagttgaaatgaattttgtatgcattttataaatttgtgcgtgctttatgtgtgatttaacttggataaattttagaggctaaatttgtactgtgagtgcaagtttttattccataacatcaaatttcccaatttggtgagttcacagaaatttgaatcatcttaaaatgagctatatttaattttatatggattttacaagttttagttactgttcttttataattccagattttgtttccaaggggtccactgtcagtgagagatcaatatacaaaaagatccctgaggtttctaagaatcaacccgcagacctaggctcatatgtcagtgaattgaaaagttgcacattaaaccttatagttgtttaaattctcgaaacaaggtccctgacttcttttctcacgcagagaggcagaacagccatggctgagctcgatctcaagcttgccagcggcaaacggtggctcgtttgagggtgcgaccaaaagacaaaatgaagatcatgctattgcgattccattcctcttcttttcttggtcagtggacatcggagtaacgccggcggcgagtccgagcggcggctgtgcttaggctgctactgcatgttgagttggtgctcaattctaagtgaatgaaatgcatgaatgcaatcctatgggctcaagggtgctcaccgaaccttgaacgaggcgccggaaagtctggacagcggcagcggagaagaagatggtccggcgacggtgtagagctccgggaagacggcaacggctcgatccactcatcgaattgacatgcatgtgttttcatggggttagtgaggtcccagggatggtgtatacgcgaagaatcggacaatggctcaccggaggaggcggaatcgacaatggcgacggcgaccggaggtggagaagacggtggacgatctccacactcgtagcaccattcttcaagattcttgaggggaaatggagaggaggttgaggtgaagctggtggcgtggtggctcgctccggcttgatctagattgatggcaacggcgacgatgtcgctgcggcggtgcgcagagcgcgctccagagctccggtgtgcacggcagcgttcccgccgattggctgcaccagagaggatgaaatcaaaaggagaaatattcggcatggtgaggagagtatggaacgcaagagaagaggaaacaaccgcggctcatcaacgattgcggccattgtcttcttcgtggccggcgatggagaaccagtggagaagagcagcgaggatgctctccctcggatggatcggcactggaatggtgggtgaagagtggcgacgcgtctgggagaggcagaaatggagctcggcgtttttagggcgtcgacacgtcgtggccacgcgtcgcgcggcgtccagagccggtcggcgctcgatctctccctctcagtgtttctcggtcggctagggaagttgcacagaggaagggcaagccggagggactgacaagggggcccaggtcgaagtaaactaggtggaagagagatgtgtaggcagagacatgggtgagcttggtttttggacgaatttccggaattattttctcctctaattttgtagcttcaatacttaatgtgttgatcagattaactagtgttgattttactggaggtaggtgtatgtacctagtttccattttctttggttgcactcaaaaattatggatagattactcacagaaattagaggaatatgggttctttggaaactagttcgaatttttaggagacctaaatagagaagataaattctggaaaatttatttttattcattataaatgacctagtatttgaataaattattttacttatacacttttatgcagttaaatgcacttttagacaaagtatggttttagccgattaagaactacagttaatctagtttttattagtttgactgatttatttgaggtaccaaatttagttattaaatcataccaaaattacagtgagttgcatgtgttgattagagcctacatgaattttcccatggttttatcttgcacgaattattttagataattcgcaagacttatgtcttatatatgtttccctttcctaaatgcatgtaaatgtttataaaagttatatttggactctcattaacctgaggtgatgttgatatgttagaattacaatttacattacacaggtcataagctccttacctattatgcacaagtttactttagtattaaattaagagaatgcttatagagatgattaagatagaatataccctatatgatataatttatttggtcacttccatgttcatgactagtcttcagatggatgaccaaaatagttttgtggggcttgacattggccttgttgatatattttaaggtgtatggtttctattttaacttcctctagctagcactaggccctaatggtttagttgtttatctagatcttagttaatattcatgagacctattatgaaatgcaaatcgaaaatccaaatgcaatccaaatccaaatgcatatgaaggactcaagtcaaacatgtctatgagagtatgcatgcttacacataaatttatatttttgtcctaggttagagatgcaaaggttttaatttgttttaaaattttatcatgcaagagttagatcaacttcacctaggtttaaaatggaaatttttggtttacaaaattgaagaactttcctttcaactagttttgatagaaattccttaatcctagaattcgggtatgttacaccaacatgctacctgatcggcatttttggcaacagccatgctatgcctcgcaccatccatccatcccaaaagagaagacacaaagacaatatcaaaatccgatagcaatagagctgaaaggcattgtcgctgccaaggaacccggcttgcttgtactccctatcacctatatagtccatggcaagctctctccatcctccattgtcaacgtcatcatctccatcctcttccttctccaaagaaaacaaagggcgtgccaccgaagtggaagaagtagagggcaagaagatgggggattgagcccagagcgacggcgatgtgggggaggtcgacataaatggtggttgcacggacattcaccagcatgagggggaagggggacagacgagcatgaggggaacaagggagagagagatatagacttggggggagggggggatgagctttacgaaggtccagaggataaggcaatgtgtgtgtggtggcctgatactctgatctgttgaatggatttcgtcattaatttatcccgttaggacaggacaccgttgcgtagattttctgttttttaatgtgcttgatttttttgcttcctaagcttttcttttgcagactgagttgatcgttgagccagagaagttcacacctcagagctgtttaaagcttcagacgattaacaaggaggaaaaactcgcaaaacaagatctggtatgtttctttttttttctctatattgttccttcttttcatgaattggtaggtttttgttgcattagctcacactaaaatgtcttagactatacatatttattgttttagtacatatgcacagagaatctctgacattagttcatttttttctatctcctagctcttcttcccaattgtttgggacgggcactaggtgttgttatgcatgaatattcttcatgaccagatcaattatttcgacccaaaatgcaatgactcaaaatggttccagtactctcagaacctggtaactatgtcagcacgttccattttattatgttcaattgtttcagcacaacatacatttgtatctcgcaactcattaactaatgttcctgcatttgtcaaagcatagtaactatgcatgttccatcttgttttctacaactttttcaacacaacatatattcttgttcgcaatccatgagctaatgtttcaacattttccttatgtaatgtagctgattaacttctccaaggttgcgcttgatgccaaaattgcaataaaagatataacaaagtttcagaaccactccaccacagtacccactacagtccaatgcgtaaattgcttttaaattacttgtttcaccttttttttcattatactgtttttcctatctcatcaccttgtgccatcacttatttttttctcctaggtttgattgtggctttttctgcatgagatacatgaacaattgggatggaacaaagatggactattttgatgacagtacgtcagtaccatgaacatctacaggaagatcatgacttacctgttagccaattcacatttggcgacaaccgacttcagacaactccctccaaagcagttagggattagtctggcctcccacctcctcaatttatccgataactttcgcataacttttgtctagtctttttgtttgatgatattttggttatcctatacatatgcaaggaatatttgtgttggccaaagcaagaaacaagggattatctatgatcactaaatacatgtgaagctagcttgatgcatgggccatgcaaatgtgtggatgtatcagtctggccaaccatatgactcatgtactcaactatatatgtgtgctaaatatatacatatgcatgaaccagccaacaagagagtggagttgcatatatatatatatatatatgtgcgattcatgtgcttgcgcttgtggtcgtttacttagcaaatacgtatacgtataatagatgatctttcatggacttaaagaagcagcaagctgggactagctctgggctgcatatgggctggtgccagtagttgcgctgctcgtgtgtatgtgcagccggatattcacgccaacgggagtgagctactgctgtggggataacgtcggatgactcattcttatctggatgattcaaatgaaggcaatccacagcaattgaacccagaggcatcgaatcgatctgacgcgcggtcgtagcggcgccagagaatgcgcgtctacccgttaggccaccctatgcctataaaacccatcgaaagcaagccaggccaaggggagaaacacacatccatccattgacgagcaacccttcatccgcattcattcatagcaatattcacacacattcctcacacattcaacgacacagccatcgagcaattcactcaccatcaacacacacatatgcagagatcgatatcaaaagcagctcttctattcctcatctgatcgatttgcacaagcggcgcagacgcagcctcatcggagtagccaggcgggaccagctcgacgggaggagacctcaccgacaacaagaggcagcatcagatcatgggcatcaacaacctctgtaccatgggtaatgatcctgtggctttcttattgatttttctttttcagttcatgcatgcatgagatggcgatggtgatgagatgctggagcactgctagttggcgcccgcacgccgtcgtcgagtttgccaagtctcatggaagtgtcatttgtgggaccaggaggcaagccgccgtttttctacgtcgtcatgaccggccgaatgacctcgtcgcgctacctcgccggagcatgttgtcacggcatcgtgaatgtcgtcgagtcgtgcccgactgaggaggtctcgtcggagtcgtcggaaacgtcgccaagtctcccgcgtctacatcaaccaaacacatcattgggcgatggagattgtcgcactgccctcggagccatggtgctgccctcgtcggagtcgccgtgccaatcatctgatcgacatcatccagtcgagtcgctggtgatgacactactcgttgctgtgatctcatcgccgacgtccgccggccatcttcggtggtgttaccatcttcctcacactcgtcgttgagccgcgtgacgagaatgccaatcgaagcgccgctagctgctcggtgcccgcatcgtcacgctggggttgctaagccgttcgtgatgctgtgaagccatcccttcatcacaccggagcaccatcgcttggtgcccgcacaccgtcgtcaagttcatctgcgatgctttcacctcgtcaagccagagtcatcgtgccgtccgtccgtgtctccttttatctatagtaacatgatgagatgccatctgtctacaacgcttccacttcgtcatggcgagatcgatgctgtccgtccatgatgcactctctcttcatcacgccaagatgagatgttgtccgtccgtgattctctccctcttcatcgagatcaatatgccgccgcttgtttgtgtattggagcgtcgctcgtctatatcaacatgaagaaagaatagtgccgtctgtgatgccaatgtaccgttcgtgttagatctacaccaaccaatgtcctcggctattccgccgatgaggcatttacttcttccaaggtcgccgttactatcggcacactcatagagccccttttgcaggctcgtcatcatatcaaccggatcaatagtagattcatcatccgaaggaggtgccaaagccacgtttgttcggttattgtctgcaccaacttcttcatcaacatcttcgttacaagtccctgttgtataagggacatgacgagtcaggaggtgcttagccatggatatccggctgccatctacaccaactgtcatcgtcaactctttgttactttgatcccatcaagtcaggaggtgcccagccatggatattcggctgttgtgtacaccaactgacttgaccaactcctcttccctttaacaccatcctgatgtcgttgctgatccaagcgacacgagatctatgcatgttgaagatcaatccatctactccaccacgttgctcaagactgatgaggcggagcgacgagggtgggcggagcctatatgaaggctacatcaccaacaccggcgcacggaccgatgaggccgcggatgcgttgccggcgcctagatatatatccacaatcttcaccaacattcatcgtgcatggagaacgtgaagcgaagacgacgagacgaccacatgcagcttaatcggaggtgctctgtaggcctaaacctgtggcagtaattaactaggagtctttcgagaccccaggaattagaagaccacttatccaagtttagatttgtccaacgacaggctatggagcgcacatacatatatacatatatattacattgggaatttgtatttatgatccttgagattaataaagcacatgttccctatgttttctgtttattttgtgtccttagttacactggcacgctctcgcatatcgttaccgtttgttatttttttttgtcctaaacacttttttgtgggaaagaacccaaattatgtgtgctcattttactttgaatggcattttttggaatgtacttatttattatggatggtagttggaaaagttgtgcacataaagagttttgagacttatccaatctgtccattctcctttgcacataaagagttttgagacttaaccaatctatccgcttcactgacatcgttagtcaaacacggaggtacaacagcaaagcacggtgccagccgcacgcaacaactgcctccatgacagtcaccacattctcaaccaggagcaaaccgttatttctctgccaatcactatttgtcaaggcatgcggtgttagtgtatctgtataagtggatgtatttaatacaaagattgattctctagttaattctgcatgtcaaaagataggagtcaatgcttaagacacctatacaatgttatggcaaggttttagattatgataaatcactgtcggagtaccctttacactgaacttaattattgagattcgttatcgagaaagagccggacagtgaatattatctatttaaaactgatgttaatttcctttatttatatatgtctataacattgtgttttgctgcatgccaatgacaatcgatcaaaaatgcaatgttagtgatggattattgtactgtactattccattacatccagatatttaagatgttggaatcattgcaccccatgatgcggtttttcttggatttcatcttctacaatattcaaaaggtgttgatgcatgttactagactgcatcgtgaagagttgagctttaatacaacttttattggccagaacaagatttttcttcatggccctacagtgtcatttgatgcaagcccatgtgctagggattatacaagtctttacactatatttcctgtaaggtttgggccaatgtatttactgcatttcgaatatctccttgaattcttaaggacatgtccttatggggtgaactctagagattaagcaatagttgtgtttgttacatatcatcctagtattgaatcatatgttgacaggatgaaacaactgatgattttacacaatttgctaaatgaacaccctagacatcatacggctaatgtagttgctctggaaggatatacttgtagatccaaggagttgtccagaactcaataacgttaccaaccgaacagggttccgtcaacatggttgaattccttgcatattgatgatgcaagaggttgtctgcattttgctaataactttttgaagcatgcaaaaaatatggttcatataattcttactacattattctttcactggtactgtgtttttctctaaatagtttcaagaagaacaaaacgaggtagcattttctctacacatggcaaactttttatcaacgatattacaaaggcttgctcgacttgctcaacgcaaccaaaacaagccatatatcattgacttgtaagtggatctcaagtcttttccaatcgagttcaatctcaaatctctcaatcaagttcaaaagatggagtgtgattatttctgtaggctttcaaactgaatgacggacgtaaggacgggaaattaggtgcaactatgctaacttgatcagaaattgacttatcagaatatcattatattcttcttaccatcattgcattcttctcttgatctgtaggaaacaatctggaggtatttcagttggaaagttgtgaatgaatgttcttgtatctgttgttgctagttgttctggcctcatggagatatgtatggtatcaatctggggacatcctctctatttctttgtccttgttgagacgatgaccaatgttgt

SEQ ID NO: 74125 - DNA, 70087 bp, Oryza sativa
ttgaccttgttacttgattttatttaccctgtctactaacttccgggcatttctacactgttttgacaattctttaatgattatgattagtatatcaagtattattcttactgtttattttaacttttcccatttatatatgttatttgctatcattgttcatttgataaagttttctactgatatgaattttttttaaagacgttcatgtgtaaaacatatcctttaattgcattttactgcatttgtgttacttcaatgcttcatctaattttattttttttaaattatcgttacagaattccccagatatccaatttcttggtgaatcaaaatttgctgactgttgtaagaaactttgttctaaatctgatgaaatttacaattcatccaataatttgtctacaagcacacaagatttcaattccactggtggcaagatacctatacatggccctaggagagttttaattcttgcaagacatgccacatatccatttgtgactgagatacgtcgatttccaataactgatgaagaaatctgttattacattgttttttgtcgtcttgctgatagttccaaatggcagaggtattaatctgatttttatttgtttcctattttttgttacatatgtttatatattttttaaaaaattttgtaattatatttttttcttcagttatgatgctgttgatatagatggtgtgaaggaaaaagtatcttagtttggtcattctctcaagaaaggtggttttgtctccacttttgttatgtcagttttttgtcgagtcttgtttcataatgatcatccctcaagatctaagaagaattactttttcccatctattgttgtaagttatttacttctttttatttttgttaaaatttgaaataaatatattcaatacattttttaaattttgtgatttaaatgtaggaaaaattgccatctaatatgtcttctacaagtgttatggagaaacttgaaaaatcttttgttggagctgggaaagctaggaaattacacttgtgtgatatggtaaggtgttttacttgatttgcttgttggtttttccctgttcatatcaacttttttttttgctcctgtccatgtattgctttgcatagctttctgtttttttattttatgtcccttaaatctaccttttatgctgtaatttgcatattcatgttcatcttcttttagattatactttaatgaattgcatagttaccttgattgatttatggcattttgcaaggaaatatgtgtcttttcgaaatttatgtttgtcaaactttcaagtcaaaaaatatatgaatattattattcatagtgtttatgcctgctgaactttctttatcattgcacatatgaagtttcatgtttattaaacttatagtttgtgatttttgcagcttcattttccagtcaacttcaatcatcattggtttctgtttgttgttgacatcaaggatagaatgcttgtaattttggattcattgcataatgagggtgatgagtattttcgacctattctgtctcagcttgtaagatcatatcatttctacttgtttattatttaattgttgcttaatttttgaggccatatatttctttttttgttattatattccttttttatgtttaatctaattaatttgtaccttgaaaatgtgaattcgtgatgtcgacctgtgactgtatatatgcatgtctgaatttttgatatttcttcaaattattcttttacatgatcatgatctttaatttttttcagttcttggtatgccatggtattagcttgccacttatatatttacttgctgaacatttcttgtgttgatctatgatgcatcatcaaacaatttttttgtttaactttttttttaatttttaaatttggtattcagatagccaatttacaaattgcttgggataaatttgtttgcgtacctatggattttcaaaggttccagattgtttttcctccagtacctcgtcaagatttcaggttataatctttattcttcatttttttattttagttatcttttttttgtttgatatttttaattgttctttttttctgcacatttttttgttcagctgtgattctagaatttatgtgatgaaattcaccgaactttggtcacctaggattatattatccactgtgctttcaaatgaaaacatcaagaatattcgtgtccaatatgccaatcaaatattctttcatccaaagaatagaatgctgcaaactgagattgaagatgttgttctcaattggtttgatcaagtaagttttgcaactaatatttttccctttttatcaaatttatttggtctatgtattattgtcacgcccggaaattcactagtaatttccgaacttatttgtgcatgaaatcctcgtccagaaatcagccgaggtacacaaattgacaatttaatatacagattcatcaaattaactaaaacgataaatacttacttaagaggcactaagtcctcaccaagaagaaaactgcagcggaaaataaaatctagcgaagctccggctccactcccacaggtagctcaactggggtataagccaaacgtcttctccttctgaattctttttcttcaactgaggttgattgattattgtaagaatgagcatatgacatactcaacaagccacacagcaaatatgcaagtgcacaaggataccaaaggatggcataatataggctcatttgcaaaagcagcgtttagcaaaatatttaagagaaataaaacagtagagtagttaatcagaaattttaatcaacactgaacagcacacccatgctgcacaggcccgaccatcctgaacaaccatacccggctgtacagatctaatctccaaaccaggagctaagcaaattattaccagttataacatcaataattattgtgagaggtgtgagactaatcacgaaaaacattgctcaacccgcccataaccgcgggcacggctattcgaatagttttactctggccagaggtgtaccactgtacccacaagacacagcctcaacatcatgtctaacatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattattaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatatatgatcaacatgctcaaaggaatgtgtttaggatctgtgtgacttgccttgtaataatcggtcttcaattaatcttcttgaatactccggcgcactcgcgaaccttcgcaacgacggaaacgacaagctaacacgcaaaacgaagaaaaagactaataaaaaccaaataaacaatacatataaagtaaacaaacatgtagattataattttagatgaattatgagacttgaacggcctcattctgatttcatatgaatttattatgaattttacaagatttaattccaattaaacctattaaacggagactattccaaattaattaaatcatttacaaatgatttataacggagataaaagattaaagcaacctctggaaaagattggatcatatttggtagatgacatatattaaaaagaaataatatgccactgaaaagaggagaggatttatattgattttggacagttgagattaaccttgaccgaatcgactaagatcggatggcttggattgatctggcaagcgagcctcacgagataccgactcaacgagtcaactccacgtgacatgagatcacctaaatgatcaaccgaaaccggcgaacagaaccggcggctctgaacggctctaaactaaaggacgactcaacacggacgaatgaacgaagcacggggaacacctcgttcgaacgaacgagcgaacgactcaacaacggctgtggctaaaccagtcggctagacacgattcacggtaaagccctggtacgacaaacgataggccggtaggaacctagggttgcacctacggctacacaactcgactaaaagcagcggctaggtttaagcggcacacagctgcgacacggcggcactaagacaacttgactcggctaggcggcggctaggcggaaacacgcagctagggttagggtgacggcacagccggtagcgaccatgcacggctagagcagcagggctgcgagcaaaaacgcaaccggcacggctgcggctgtggcaaagcggcaaacagcggcagcggtagtgatgcatgatagcagcgcggtgacggactgcggctgcgctaagtctaggcctctagggcaacagcgcggcaaagcggcaagcagctgcagctaagcggctcagccggcacacgcgcagcagcggcacggcaagcagctgcggggcaacgcggcaaggcgcgacgcggtagcgactaagcagcggtggctaagaggctcggtagagcgacggcaaaccgcagccgcacggcgtgcagcagctacgacacagcgacgacgacacacacggagacgatgatgacgctagggccaaacaagattagattagatggaattaagaccctagggataaactacaccggtgaacgacataagagcggcggttgccggcgaaccacgatacaataatgcaaacggagggcaccgggaggtagagaaggtgacggcgattcttaccaacacttacacgatgacaggcagcgacggaagatggccggcgacgagctccgaagggcggcgaggtactgatcaacggtggcgacggcgtttcagcgacgggagacgacaactgaggggtggacgggcttcaccttgctcctgcgaacccaatggagtagacggcgaccgaaggcgacgacggacgacgacgaacagtgcggctggagacatggcgacgacggcggcgctctggttcacgacgacgggcaacctccggtgggatttggcgcaaaacaaccggtggccgaggtagctctcacccttgcgaagccgagggaggcgacggctcaaggcggcactgaccagaggggcggcgcggcgccgctggagatggtggcggcggtggagagagaagacaagcgtggggagagcgattccggcgaccgcggaggacgggacttgaggggataggtagaggacgacgagggggtcctttatataggcacgggagctcgggaaaaagcccacatcgaggggaaaaacttgggaaagtttaggatcctcgccggaaaaaggaaagattgatccgcgaaattggaaaggatttccatagaaacttttggggatttcttagggaaattgtagaggagattgagaggattccattcccgcaactaatttggaaagaggagcaacgaggaggccggatttggaaggaggagcggcacggttgcacaggctcgggacggctcggctctatccaggggttgaagacaacactgtagcgagagggaggataaacagacttctatgcgggctgagaggaagggagataataggagggaatgggctgaaagggcccaagactaggaagaagattttattgcttttccaaaaaaaataaccaatgagatgatctctcaattgttaaaaatacttccaatgctcaaataattccaagaaaaatcttgaatatacttggacactctaagtatttaaaaatattgaaaccagaccatttaatgattaattcattagttaaataattactgaaatgttctttgtattgttaaaattaggaattgagctccgaaaaaatccgagaaaatttcagagagtataattaatcatggagaatttaataaaaattaaattcagccatgatttatatttaggaaattttatttcccacatttaacttcacttgtaaattaaagaacatttaatataaattctattattaatttattaaataatttataaagcctgaaacaaaaatcaggatgtgacaattatttagtttaaaatttcatttttttttcttcctgtaggagaaatttcctcgtactcgtcagcctacttttacttcagcagctcagaaaaagttctgccagtgacattgaattcttaggatcttttgtagcaaattggacagctattagctgtagttaattctgagaagaacataatactttcgagactaaaatgttgagcatggttttctgtaatagaatttttgctacatttgatagctggttctgatccagtaacatagtatattacaattgtctgttacacaattttttcattctcattgtagcaattgtaactaatctttttttcccttgatctatctgttcatctttgcttcatcttcttgtcctcttctcaattgtttttctttcattgtcttgactagctgacctctttcctgaaaattgaaatttcatttttttatatgtcagcctctaatttttttcctgttcttaggtgaatgttttttgtttcttacttttgcttgacgattctccagtttgatcttctccctgtttctttcttgttccaggcttcctttgcttctcaatagtccctgacaatgttaaatccttataagtacatttttggtaacacataatatttttgtacaagtttaatttatttcaaagaaattgttttttcttacttgtcttggctgttttttgctgactttgcataatgtatgtgtcttccatcaatgggcatgtctctattgtatgatttgttcttccacatcgtgtgcaatgcctttttggaatctctttaagcttctctacaattgcttttgttctagctgatttttttgccttttgtatttgctaaattagggtcttcgatatcttcttgttcattcattgtttcttctgtttcttattccccattactctcttttgttgtactgccttgattattttgttgcagattttcaggtgcctgttcaatcaacaagtccaaatttccatccaacctgtccatctgatctagcatatacaggtaagtgtctttactctttgatgcttttgaagccatgtcagccattcttctagagaggacattgaacctaagaactgaactgttttcatcactagctggtttctctattcttgctatgcattttctctcctttttcttccacctttcaattatgtacttttcaggaattttgcttatttttagaaatagcatcactttcaggatatggctttgcacatatgcacacatagttctattgtgctaagtctgttatgatcacatattttctctgtctgaattcctgttttgttaggttttcagctgcatatacttcatatgttttcccatgttctataactgcaatttcttgattcagtgtttcctgcaactcatcttgaaattttttgaaaattctcaagttgtacatctctgaagcttgtagttcaatcttgtagcttgaccatagtgtcttaggcttctttgttctggactgatgatctttgcaaaattctgtatcaaagattgtgtcattgattatctcaaattctttaaggaaactcattacactgtgtgttgggcccacaccccttttgaaccttgcatttgtcacctcacttagtgctgtactgtgaataaatgggcaaaaatctaatttaaagtacaatggtatatagttttcccttgttctccacattgtctgtaggtatttgatgttttgcaaaccatacttttcaatcatttgaggccacaatgtttcaaactcaactcttgtcaagcagttgtgaacaatatcataaaattcattgtagagatctttatttttcttttctgaaaatgtgtttcctgtcctttctctccacttcttcataatatggaacaagcaattcgtgtgttttgtatccggaaatactttttctattgctgatttcattgccaagtcttggtcagttatgattgtctcaggatgttttcctcccatagctgttaggaatgcctcaaaaacccatttgaaagtttccatagtttcatctcctaaaaatgcacacgcaaaaatgcatatgctgccatgacctgtaaccccaacaaaaggagcaaatggtaggttgtacttgttagttttgtacatggtgtcgaaactaacaaattcaccatactcctcatatagttgagtggatctaccatcagtccaaaacatactcttcaccttattattctcatctagcaacaactcgtagtagaatcctgggttttcggcttctttgttaatagatactccatgagcttcatatcactgttttttgtttctgaattgattgatgttgtcacattgctgacatcttttttgttgtatagcagtgctgacaatcccccttggagaaatgacagtatgactatcatgcttcttgtaggtatgttgcactccttgagagttctgatcaacctcttttcttctactgtcatattcttgtgtgactttaggaattttgcttctctgtttgggcttagtgtgtgattgtgttctaggttcagtcttgatattttccaaatattctgtacctcttttattaccatcacacacttgtagtcagttctgtttatcacatttgtattcctcttttattaccatcacacacttgtagtcagttttctatttatcacatttgtattcctcttttattaccatcacacacttgtagtcagttctgtttatcacatttgtattcctttgttctgttgttttcttctttttcttcccatcttcctcatttttcccatatctgtagcactgatatgtataactagtaatctcaccattcattttcttgcttgttgtcttgtaatggtgtgtatttacaattgagaacccaactaggtatgcataaaagttgaagaatccatgagcctccttatctgatctgaactccattccaacttcaggtatgtgccttttgtcaattacttcattgatttcctattcattatccaagaaattgtttatgtcttcctcatttatgtcccctccagttgtgtggcttcttgaactgcttacttcattactagctgttatagtactttgttcacagttattttggactttttgtgcaccttctgtgtcatttctaacttctgttatttcttcattcacttgtccactgtttatctgaaaaaaatatatgaattgattagtatgaaattttagtaaactaatctattttgtaatctcaatgtcaatatatgaatcactcttgtttacctgtccattctcatttcttgaattttgttgtatatcctcttcgtttggatgctcattactctgcattgccattgtcgtcccattcacctgcaaatttcttatttgttatgtttcaattatactatcacatgtttttatgattttattttatgaatgtttgtcaaaagtaacgtacctgtcttttgaaatggttgtttttggattcatacaactcttttatatctctttctgatgatctctgcataatttttttaaattgtttgtcatttgtaagtaataatccggttagtgtatttatttcactgttcaaaatgttacctcactccatgtagtcatgttgttgttattgtatattgcatcaaattcttgatagatgcgttctgttgtagaaatctgttgttgataaaacccatcttgctgatctgtttcttgtggagaaaacctgcttgttgtcaaaatcatagaattctgcaatggcaaaatataaactgttagtaatgacttataaattttgacatttttgttcttcatttatggttgtaagttaagttctcacatcaaatgcgacgggtgtttgaagtagatttgtatatgcctctattccttcctgcacatttcattttagattgcaattagtttttctttcatttttctttttctagtacaattgaaatctgattaaaatatgcttacctcatttgtttgcatggtcactcttggactctgaattatttgttgcatgagattagtgtagctcatctttcctgcctccatctgtaaatttcccttgttttctgttatatcagaagtattggcattatttttataatattgtgaattttgtacttacaagtcttccatcttcattaagcaatgagtactggttgtatagtatttgtgctccatagcttgttgcatttggtgtttctgttcctcctctagcattttgtcctgattgaatattcttttttgtcaatctcctgcaattgatttgatcctgtaattgaataaataaataagcatcataaggttacagtacacaacaactatagttacagttgtaagttttgcaagttttgactgtaagtcatttttttttctgttaaaattttccttctcaataatataacctgatatttgtatgtctcttttgatttcttcaagcccagttttttgaaattttcttctcattgtctcccctgcatttattcccccttcttcactttcacgcttccttgtacctgcaaaaaaaaatacaatcagttacagttatattttataccacttacagtcagttacagttcaagtactgattaattacagtcgtaattttagtacttttgtattgtaatttataatagaatgttagtttttttagatattttcatcctgtcatcattcatttgttggggcatgcctggagaattaaatttgtttgatgtttttgtaagttcggacttttatgtgccccttagtttgattgctgccctagtcattttttatagctgcaagcagtgtttttcaaaataaattttattctattcttcgtagaatttaattgttacctgtatgttgcttgaaattggtgatttctgtatcaacttgtttctgaaagaatttttttctgactacattctccatctggctttaatcctgcattaatatttaaaaagcattacaatataatatctttgtaatttaaaattttgttgaccataaattacttaccagcaatttctttcattacttgaatctgtgcctgtatttttccttgtttattgatgtctttgtctttttgtgtctcattctttaaccctgcaaaaattaaggcaatgtagttacagtagaaacatgtaatgtgttgtccttactgaattctatattccatacaatccctgtatattcttcatcaattatcacatttacagtggtcttacagtacaattgtataccacttacagtgcagttaaagtggaattaggccatagttacatatgtaattttaggtgttatctactgtaatttttggttttgtgaagtttcctctacgagaattggggcgtatttagatatatctgttctagttccatatttattgcactatagttacagtccaatacattcttcatgaactacagttacagttgtaattttagcaagttttgactgtaagttgtagcaagttttgactgtaagttgtagcaagttttgactgtaagttgtttttttcttttaaactttaacttctgaatagtgctatttttaatatgacctgatgtgatgaatctttttgtctagcatagtatagtatttatgtaactattttgtccatgcagccaacctgaactggttcagcaaattttgttcctgcaacattcaaggaatatgcaccaaattagtatacatgttttttaaaatcatcttactagattgttaagtattagatatttatttacataggacatgcaccaaattttcataatctagtgttctttatgcaatcaactctttttgccaaatgatgataaataatttttgaattaagcaaatcaaatttttgcacgtcatcagacaagaaaattattcactatttgtgaaaaagatttattaaacttcttgtctgatgatgtgcaaagttttgaggtgtttttctttaatatttgatggcaaaagtttttatattattagtgttaatataaatgtgtttattaccttaagtaaatcttgattgtttgtttttgagcattacatgtgttcctatcatgtttgatgtaaaatctgtatatgcattactgtttgatggagaatttatgaaattttgaagttaacatattgaagttatcaaattttacaatgcaattgtactaaacttacagtgcacttacatgccgtatatattgtttttacaaatgtaatttaaggtacaaagcactgtaattttccaatttgaccatatgtgaatgtgaatttgatttggtgcggtgttgtttttagtttctgaacttctttttcatttttaatcccttgtgcaatcttagtattggagtattatttgtgtgttgatttcagttgatttgtgcctaaaataggtgttcatgtttttttttgcctggcatgtttgtagatatggattgagtttttttcatatggattgtgccctactccaattgttatgtgactcagttttaccgtggaatatgtcctaattcatgcttttgttctctttaattttagcttgcttcttactcaagggatctcaactatcctgtctattagccatcatgcaggttagttgtctctgacccatatcaccatgctaataactagtgtggttttctttttcttttttttctgaccaattgatatactattagtgatttacagtggtttgtgcacctagctacatggcatgatatactattagtgattcaaaactgagttgatgtgttcagttttagtgattccctcttagcacaatttggaatgggcatactaaggttattttactttttggtaaatttacagtgcatttgtactaaacttacagtgcacttacatgttatatctattgttcttacaaatgtaattttagtgcaaatgcactgtaattttttgcatacgggttggggccatgtatggtgctagcaaaatataactgtaagtagtcttatagtttcagttacagtacaattcattgacagttacagtgcagttacagtggaattggaccatagttccatatgtaattttagttgttatctagtggaagttttgagttgtcaagttaatatcctgcatgagaattggtatctgttcaattgttcaactgtatgagcattagatagatctgttctagttggtcaactgatggcagaagatgtggtgaaagttttagaggtttaaaatcagaaatgcaaaggtgaagggggaaggggtttcagggttgaaatttacctggtatgttttctcttgtttgcttgatcctcttgatctccatttttttggtgatagtctccttgttctctctttttttttccttctcatcgctgtccatggcgcccctgatctgctctgattgatctagaaccttgaaccttgtttgttgcgtgtgttttcctcttttccttttttgatagctttcttggattccaagttgatggttctgttgtaatgggctacgattttcaatgggctatgttgttgattttcttttctatctagggctcatttcttctattgggcttttttttgtcttttatggtttattttgattatgacgtttgggctagattacagcccatttgatttatatttcatttaattttttgttctattttataattgtttttttattatattttttcctgttcattggatgtagatctaatggtttaaaaaaatctgtgtgattttgggtgaaaaatcacccgttagatgtataggtagtcccatcctttatcaaaaatcgtcgttcgcttcaacttccaccgcgtgtcccatggggtattggcctccccaaaatcgtcggtctattgaggaagagtggaggggcatctataatgtatcgtcggtctattgaggaagagtggaggggcatctatatattttaggcggaattcttaagcaaccaccatcatccgaactatatatgataagataaatcgatcaccttgtttgggtttagcctgttataccttcttccaggtaggctgatgattcccgaaatggatatgtaaaaggccactatagaaaaaaaagtacggaagtgatttcttgacaaatttgttgagcggtttatatgtacttgtatgcatatactccctccgatttttaatatatgacgttgttgacatttgaacacatgtttgatcatttgttttattcaaaaattttatgcaaatgtttaatatataaatcatgcttaaactattttaagtgataaaacaacttacaacaaaataaattataataattacataattttttgaataagatcaatagttcaacatgcggcaaaaaaattaaatacattatctattaaaaaacggaggtagtatatcatcattattagctcacaaattgaaaaagtcattgtatgcaagcattcaagttctggtccttcatcctgcaaagatctctgtaagtccatattatgaattaatcgtccatagagggtaaattcccacggcaattaatctttataccttttaagataaagaaaactttattaatctcaaagctctttatttattttactcgaggtatcatcgtacctcgctttatttattgattacatacattacccaacacacaaatctttatagtatacacaatatgtttatttattattacatgactttatttgtggagtactccacaaaagcttttttattgatctcatagtaaggaattaacgggcttcaaatgtcgcgaccagttacgctcgcaggcgacccgtgaagccggtcttctcgtcgtagaacctgtcccagaccatgacgcctccgaagttgggcagcttgctgaagacgtactgcatcaatttcttgaggtcctctggcgagatgtaggcctccctgtccacctcccgcgaggccacgacgccgaccaggacacggctctgcgggtacatcttcgcccacttctggaacgactgtatccaggacgatgccgggcaccggccatcgctgaatttcttgacgtggatgcggtggaagagccccgtcgccagcgcctcatccagccggtggtccgggtactcgcaccgcgtcgtcgccgtcagcatcaccccgaccgtgccgcggtagtccttgttgtgcgcgtagagcagcttggctagcttgttgtagttctccctgccgccctggtcgatgaagaagtcgatgccgttgacgatggcgtcgccgaacgggcgatagacgccgttgcggtggccgccgaggtaggagtaccagaggtggtcattcagctcaacggccgcctgtggggtcgggagggaatactcgccgccttggccgccgatggcgaggaggatgagtatgcccttggattggcagtacttgatgtcggggccgacggcggagaccgggtggccggagatgtcgaccttgtagtacccgggcttgtagccaaaggcgctgaggaaggaaatgatgacggtggtgtagaggccggtatcgcaggcctccctgagggagccctcgtccttgttccgtccccaaaagatcacggtgtcgccggtgttctgggacgtcggcgacgcggcggcgaggccggcgaacagtagtactactgccaaggagagaagtgccgcgtggcgtcggagcgccattgatcgaatcttagctagcttgcctgcctcgagaaatgaaatgatcgagcgagctaggtgtgaaggatagggaggtgcatgcatggatatataaagcgataggtaggatagatggacagtgcgcgcgtcgtcgatcgctggatggacgcgttgtcttatgttgtgtgcgcgcggcgcccgccgcgtgggcatgcagggatatatccgataatccgaagacaattcgcgcttcacgtaccaccagcaccagaaggttgctaagctggtgcgctacagctagcgtgcgttaagtaagaaaccacgcacgcgaaacagcagaattaaccaaggttcgtcggattatcatgctgaagaaaattaacgaagcaggctgcctagctaaaaatgaagatgctgggcaaagtttgaccgtaaattaacgtacgtgttgaatatatatataacagtccagctagcgaccaattactttgttgatacaaatgtttacttctctagcactctggcaacttaaatatacgtcgtgtgttagatgcagcctgttttgatgaatgatacgagaccaacgccgtgaattcaaggttctgctgccacgtatcaatgggcactgtctcgtaaatgtactgagaccacttattttatcgtaatatactggccacaagtttggtgttgtgtacttctgtaactctcataacatgtttaaagtatatacggggtcaaggtctacggtgcctaccctaaaatccttcaccaaacttagactgttccatgggctttttattcaccgctattgttcgtttgggcccattcatcggatcttgttttgagaactccattcatcggctttattattgcgggttctaccttttgcatcatttctcggttttaatgcctttctccgtgcaataatcgggccttattaacctttttttatgaacagatgtatacatctacgtatcattttcttacgtaaatatgtatgtaacatcctaatcaacacttaaattagcaagattatccttgttttattctgtttgtcttggttcgtacgcaccccgacaagtttatatatattaaaatatgtgttttacaagtttatctactagagatacaaatagaacttttcttaagttccccttctaaaatacaacaacaggattatcagtgaaattttcagagcaaagaagtaagtaataattagaattcagttatcggaattaaataaaatatttttgctatcttttcccctcggtcatgggccgcggtccgccttgcctccccacgcgtgctcgcctcctccgctcgctgacccatggccgtggcccagccgagcctatgcccctctctctctcttcagacaccaacaggtggaccacctgtcggatcaatatctctcctccggccggcgaaatcgaagggagcaaccgcacccagtgccctctccacccacttccccactccttgcccttcctgcaatcgccgccccacttcttgcaagccgcgcccctaaaaatgggcggagattcgattttcaaatctctctgcctctctctctctctccttccccacatcggcgccgttttcgcctcacatgggtcaagtccaaactccctggccctataaaaacaacccccgagatcccctcctccttttccctcatttgatgccctctccggtgccctcttattgccctcacgacgtcgcaccccacgccgctaccttttccaccaactacggccgcctctagctgctactagggtcactgccgctccacgccgtcaccaccaccgtgctcgccaagcttgccctctccccggccgtcgctttgcgccgctgaaacctgcttctcctcggtcgtcggtgagacctccatcttcaccaaactccgaccggcaatgctcgctgccgtggtacctatctgtctaatctctctcctctccttccctagatcatgctatagccccttccgccccttgccactatcgccgtcatcccttcacaccagtcatcatccttcaccggtgaggaatccctcctctctcctcccattttccttcctcttctttgccgcaccatcgccactcgtgcacgcctccgcatcccggcagctgccgccggtggtcacttgcgctgcctcctcccggttgggatggctggccggccaccgcttctccacagacgtccgatctgcttcggagcagatcggggctgttcgttcggccacccacgtggctaccatgtcagcgccacgtgtacgccacgtggtgcgcccgtccctggcccgatggacttggttcaccgtgcgccgcccgacttgcaccactgaccggtggagcccgactatcgtgctggcctccctcccttgagacatcaacccataagctttaatgcacaataattcgttaaggtgttttctattaatcgtaaaaacacagtgactattctaaatttcataactaattcatccgagctccgtttaagtccattcaaattatagtaaattcataagaatgcctagaatccactaaaaatagtgttgtttcatgtttcagtaatcttattgttggtatttcttaacggcattactagaaatataattcccagcaatggcgcagaaatactcctagtatattatggttacagagttcatccgcaagtacatggatataccattgtagcatttcacctgagagtattccaagggtatcgtatttatttaatcccatgggaagatcatggtagagagaacctgactaataatttatatgttacttgtaataatcatagtctaagtaggggttaatataattcaagggtagagtgacacacaagtagggagctactcattctcatactaaaatatctaaactaagtggaaaaaaaagagaaagagaatctattcctatacttctagtatacatagtctacatacatcctagttatctgatgtactagctaataccctctatccgatgtcctcctggtacttcgagaagccacccctgactgccgagttccttacgacagcccgtcatgaccatacaaccgaggctaaatacggaggagtaccctccccaggaaattaacttaggactatatccacgcacggagaaatacccgtactaagttgtcaccatcagcggcccacctctcatccgcagcatataaccccaaataatgataccctgtaatctagacaccacgtctaaactaccagatactactctaatatcatcttcatgacatagagtaattgcataagcaaacattatacccgcaccaaagcatctcccaaataagctagaagtataatcagtataacatgaacataatgtaaagttggcattcatatacttggaaagtattccaataccataaatgtataaagaagagtattctaataatagtacaaagcttacaaaagagaagagaagagctactagagccatacccgaactcttccgaaggcttccggactccgatttctactctattcctattccactagcttgataacactaaactaaacttgagagaatatgagaaagctttgcttgaggtgtgtgtgtggagtgatgatgacagctcctttatagcctcccaatgacggttgtgatggttggaaaggtcggtaatacccaccaaccatcattggggagccatctcagtcgtccaggagaaacctggatcgaacgacgctgcgggggcttcagccgaaccatgggtcaggccaacctggcccaaaattggcaggtggcctcttccgttgctctcctacgcagacttgtaaattttggcccaattaattctaagttcttggcccattcatgcataagtatgagtcacgacatcgttcgattgatttatcatttgatttgatgtcgattctcctccactttatggttattctctacaaaaggttagtgaaccaaatactagtggaatattattattctaacatggatatgcattgcaagcataactagttctcctctattttggtaatattgacggtcgaaactgatcgctaacgaccatctacacttatattctattttacttatatgctttgtttgtcgcgtagattccggcagttccgacgctctggtttactttgaagttgttgcggagttcccagtagcaccggagcaaggcaagtcatgcattacatttgatcatattgtgtatatttcataaatatctcgctttctatttaatattgcgatgttttataatgtcatgtgggatggttcctgttactctgctttatatcgcttaccttgtgccattgttaacctgggaattaatatgattagatggttggttaggaaaatgcttggccatgcttagatcaactagctcactatggggtatcacatagaacttctatcctgttttaatgatgataattatggagatgtaccaccatgttattaattcaactaaaacatatcaaatgggttgtgggcgcatggttttgataaacgcgcccatggcatgtaaggaccggttcacaggaaaccctgtaagaattaccgtgctctccacaagccaatgtgggcaacggctaggcttgtagtatagctctttcctatataactttcctaggtaagggtgggcgtgatggagttgggtcgggccccggttttaaggtttgattggcttatggatataccgcggcacaagagggggctgcctacccctgttttaagggtaggggcgaaacttgcgaaggggttatgcgaagggtcctattacagtccctgtccggtatgtcacggtggcatgccagcacacgaaaatgtattgtggggctatgtcttgtgggtacaattgtgatgccttgcttgtggttgtgggcaaacaaccagattaatattgcttaatggaactggtatagtttaggtggatggttgggcatgtcgcaacgtggtttagcattggatagtgatgattaatattgattagtttacttcaacaatttttactactttcaactactactttaaatacctgctttatgcaaaagaacacctagcctcctttgtaattacttgcatcataccctctcttctggtatgacttgttgagtacagtgggtagtacacaatcttgctctgttcccccacattagagttgaagtgcttcctggatggaggttactcaggggagtaggctttgtcactaccattaaagatgcctatggtgtggagtcgtcgcgctgctagtatcagttatcctatgtttagctagctttatctttccactgcatttgtaatacttttatgatattttgtaagacgtggatctgtatgcaaattttgttgtctgtgtaccttgtccagtgctggacaggggttttaatgcacatttttcttgggaattctggtttgtgaatttctgggcatgacagaggtggaggagcgtggaggtaggagaggtggcggtacgcaacggcagcatggcgtgccttggaggtggtggaaggggggagagtaggagagccaagggggcgaggtgagtgttggtatttcttacgattacagatagaatccgcaagcgcacggatatactgatgtattacttcccctatggagtattccaatggtatcgaattcaagggaacgtgtgtgattaattcttcctccggttcatccaaggacaccaagcaaaaaaaatagggactggcaacctactgttcctagatgatttcctagtgagaaatagtgtctagggaaagcttaattttaatcctaacacaatacttcaggcactggcaacctactgttcctagatatcgctctactatatacccggatatggaggacttaagtgctcttgagggttgtcaccacctctatacctacctcaaacgtactatgggatatgcaacattactggataataattacctaaacaccacgtctaagcaattaatatctattttagtgtttataactcatcaaagcaatcactatagtttagttgattatagtgaacaataatcccatatgctaattaggaactaaccaagaggtaattctcacaagataaatctaaattactcaggaagataatcctatggtattagagtaataaacagaataaaataaacaggagaggattaccgacagctccggaattcctccgacttcttctactctactatcttcctaattctagtatacaaataatacaatagagcctcttgtaattcagctcaagcttggaagtgcgtgtgagagtgaaggagtgaagcttcttaaatagggtaggtatgacggttattgaaaggggaattgtccgaaatgccccgcaaccccatcaggagcacatctggaccgtccttgccaaaccccaggatcaacagtgttgatcaggcccatctggccctcagtttcggcctatggactcctcctattctgccttattcattcctgcgagttttaggctgattcgttgatattttgatgaagtctacagcccaccttttgcatggatatactccttccttactttagtctgattttcctcccaactttggtggtttatgtcctatattggatattcaccaacactcgtggcatatgttagaaataatccctatcactatgttggatgttttattatctgtactttatacagatgttggtggtatatattttgcacttcacagccaccaacagtgagtggaggagcgagaagggaggagaggcggcaagtgaaggagaagcggcgaggccgaggagcgcggaggcgaggcgagggagccagggtttggtgggccatggttgtgggtggtgtgaaattttaatagcgtaattttttttgtggttaattagttaccaccaacaaaaaccaattttcactggagggctcttaggaggcctgccttataaaatagagctatcttttaaggtggcctcctaagagctcgccagcgaaaatcagttatcgctagcagctcatgacatggaatctgccaatacatttttacaagcgtttgtttcattggtccgtcagtaaaaataaaaggggaacaccacaaaaatcgttttagtagttaattcaaagtattttaatttatttccattttccttctttgtatgaattttacaataagtctactaaatttctaattcaatattgaagcttttatgtttttatagaattgcaaatttcatatcaaattaaggaaacattgatgctttccttgttactgtataataatttcctttgatagaatttatatagcaataaatggtgttgtgcaagtcagccttcgccttttatattttagtcctcaaattctgtagatctatatatagatccaaaatttacactaaacacccttaaaatcagaaactattataaaatagcacctttgaccaaatccaaaatcccccacttcacctcaccactggcgactctccttcctcctctcgttgccggtggctcatcacctcctccgacgagatggtgaccacccacagcatcctcctttggttagctctcttcattctcctcccagctgctcactcatccctcgcggctagtgagcttcgggctggtccgacggtgagctcgtaacggacctggcgacgtcagcgtcccactcctctcccctatctggtctcccctcctcgagttagcgagcttctccggtggaaatcgagcgatgcgacagcgggtcgaagcggcaacaaactcagcaccgtgtgcgcgtggatggccatgagctcggggcggatctggcgacatcagcacctcctcctcgccagcatgggaaaggagctcaatgcaaagctggcggcgtcgacagcgatggtgcaggcgacgagctcagggcagatctagcagctcagcatcgatggtgcctcctcctcgccggcgggggagactggagacgggttctgcacctgccgctaccaacgtcgcttcctcgccagtgctggcgttgccctgtcgtcctcatcgatgccggcaagcccctcccctctccggcagtgtcttcctctctctccccccactcttcgagttccactctctgcgcgcttttttctgacaaaactgatgagactctttgtacctggagaggacgcgactatgtgagaaccccatgaaaacatggtccccaccctcttctctcctccacgcaagccattcgcctatgtggattgacgaggccaaacgccatgtagttacattgtgaaggccctaacaaaaactataaagaaaaaatatatatttgtcggaattttgtttttatttttatggtgaaaacataacaaattttctagatgagactttgcatatatgtgtaatgcaattttcagatttttttggtaaaatttattatttaatatttatggagcgtgaacaagtttgtgtgtataagacacaatcttttagtatggaaggttttgtgtgttttatgttacggaagtacggaaccaagactgcaagttcttattgagaaaggaagaaaggaggatgcaaaacgtccccacaaatacccccgccgaccggtttcctcctcccctgccaagcaacgccatgtcgctccacagcctcaaagaaaccctccagtcttcctccttttcacagccccaatccgagtcccaaccccgatcacctcctcctctcctcgccaggaggcccccaaaaacgtccctctcgcagcagctcctccgccttgatgcctcctcctcctcttcctccttttccgtctcgccgccaccgccccctcgcacttccccgacctcggatgcggcggcggatgatgcgccgccgctgccagaggaggaggacgaggtcccctgcatccgcccccgcgcttcccttccgccagcggcctccctcgactcccgcgggccctacgaaccgcttgctctctcgccgcccggagagcgccccgtcgtccaggtaaaatctatgctgccgcctccctcttggctactactgttcgatgttccggtccacagttcttggcgagtggcgactggtcaggttctcgcaccgtgataggttctgaccaatgttttgcacctgccatggctttttttttttgggtgattgatagcatgttgaataataggaggagagattacagcataacctgatgattatattgagcctcagggctggggcaggtgtgtatagtacaagagataaggaagacataatacaaatcaatcatatcctaatatccctttaactaccatataacagatgtggcttccctttccctcctaatatcccttccctctgttcactttagtccctccttcaacagaattttactcactttagcctctcttttatttttagttagagcaattttttagttattacaagcacattcactttgctgtgctttcctctgttttgtttggtacaggtaccctcctcgataaattgcaggctacttgtgcatcagagggatggtgtaagattcttatacaatctgtatagaaacaaccatggcggtgtgcttggagatgacatgtgaggtttggaagttattttgttacagtataagtacactgctaaataacttgtactcttgtatgatataatctcctgattgtggctgaactgaaatgaaactatacaatatccaaaacaatacatatctctttctatccatgtgaaaacattgtggttgataggtttgtgggcttaaatcgtcaaattcaatgaaacttggtaatattactcacaaccaggagattatatcatacaagggatttttttcttaaaaagattttgtaagtgacttattactattgctttattaaagtctaaactccgacatgataactagtttttttttaagtttatttaaagttttacaaaactgtgacagggaaattgtagttagtttgaaaagtatcttaaaattatagtctttaaaagataatacatgtattgcatatgtcctgatgttcctaaacttctatgtaataaccatgcacatagtttgcatggtttatattattttgtgaaaaattaataactaaaccattcccactgtatgtagctttaatccgttggcggtttacttcgtggtcttattctgttcttatcatcaatttatatacatagtttgctcatattctgcatgatgggtaagcatgtggatgattgacaggtacttgcaccggcatcacataagcataccctgtaggtctgttgggaaaaaaaatctcagggtcgatagcaagcttgagcattttatttttggggagcttttttctactcacctattattaaatctcaaaccgaaaacataataatgagatttttcaacacaacatttaaatttgatggacttctgagttctgactcccttgtttctcatgtttttttttctgatttaggggtttgggaaagactatccaaacaattgctttcttatcagctgttattggaaaagataatgaccacggtgatcaattagtggaaggaagaaagattgcccctatactcatcctctgccccacatcagtaattcgaaactgggaaaatgaatttgcagagtgggcaagatgttctgttgctgtctatcatggcccaaatcgtgacctggttcttcaaaaggttgaaactcaaagactagagatagttattaccagttttgacacttttaggattcatggcaagattttgtgtggcatctcgtgggaccttgtggttgttgatgaggcacaccggctgaagaatgaaaaatcaaagttatatacagcttgcttggaaattactactcgaaagcggtttggtctcacaggaaccataatgcaaaataaaataatggaattatttaatctgtttgactggattgtacctggttgcttgggggatcgagaacactttcgagtatattatgacgagcctttaaaacatggccagaggttcagtgctcctgagagatttgtacaagttgctgataagcgcaagaagcaccttgtttcagttcttagcaaatttctgttgagaagaacaaaggaagagaccattgggcatctcatgcttggaaaggaggataatattgttttctgcagaatgagtgacgttcaaaagcgcgtttacagaagaatgctgcaacagcctgacgtgcaaatccttataaacaaggatctcccatgtagctgtggaagtcctttgactcaggtggaatgctgcaagagaactgaaccacatggcattatctggtcttatcttcacagagacaatccagagggttgttctctgtgccccttctgtcttgttcttccttgccttgggaagcttcagcaggttatttcatattcttaaaatattttggaaagatttatgtttttttaataattccccactaattttccatagatcagtaaccatctggagctgataaagccaaacctgaaagacgaaattgagaagcagaagaaagatgctgagcttgcagctgctgtctttgacacagatattgaattagttggtggaggtgctaaaagtgaaaacttcatgggtctcagtgatgcagaacattgtggaaagatgcgtgcgttggaaagactattgtcattatggactctgcagggtgacaaaattcttcttttcagctattcagtcaggtgagtggttatccccaatgtgtccaatgcttcagtaagcatgaagattaaagcaagaataacatatctcacaagtcagaaaatttctttgttttaaaccatatttgatgttgaacaaaaagctcttattgatgtaagaccttggaattgattgttactaaatgttcataaaatatcattacttactgtagtgggtataatttctcacaagcccatcatgctccagtttttgctgaagttgtggtttatatacctttgacagtatagagcgttaaatcattgaatagatgtaaacttccttctacttgcctttctttaaatacacttttagggaatgtgattagacaggttacactgaacacaaactaaacctatttatttagacctgaaagtaagttaaaacaaaacttgcttgtatcgaatagcttatttttctcttaagcatctatcttagttcttgttcactgcgtttgcttcttggaacgtttcttgacagtacttgcgatttagatatgctgcttgatgttatatcttctgcatgtgtaatcacttgttcatgcataaattgacaaccaggatgcttgacatactagagaaatttcttatacggaagggttactgcttttctcgctttgatggaacgactcccatgaatgcacgccaattactaattgatgagttcaatagatgcccaagcaaacaggtaacttcctgttgatgtgcatttcagtactcgctgccaaaagaactttttagattagcatcgtcaaatggtgaattgcttttctacaggttttccttatatctacacgggcaggaaatttaggtgtcaacctggtcagtgctaatcgtgtggtgatttttgacccaagttggaaccctgcgcaagacttgcaagcgcaagacaggtcatttcgatttggacagaggcggcatgtcactgtatttcgcctacttggtgctggttcccttgaagagcttatttattctcgacaaatatataagcaacagctttccaatattgcggtctctggaaaaatagaaaaacgttactttgaaggagtgcaggtaatgttgtaaaactaatgcattttgatgaaattggattgattgtttcaattacttgaagggtggtacaattgtggaccatcctaatatgattcccttttcctgttctaaaatcatttccctgaattacctagtcatttaggtccttatattttttccatttcccaaaatacgtgtttctcccgtgcttgtatttggactgattattacaatcataacattcatattttattcagaaaattattgtatttcgaccatttgattatgcagtttaatatactcaccagagaatttagagtttgtaagttgatgcaaactacctggatgatgtattgttaacaaacaagcgtagacattgtgtaatccacatgatactgatattaatatttgttgttaagagtagcaatttagcagaatcaaacacgtgacacatgaactgccttgcactattcctacattgttgcatacatcaccatatgttaatgtacttcctattttggttcctagcttagcagtcataggcataagagaatggttgcactcataatacacatacagcacttaaggtagattcattattttctgttgcagtgtcctatggcacctgaatagtaaaatgatgtgtcactacatgtattaaatctagggcaatgctgccttttttaactagatagttttctcaccttacctcatgactttccaaattctgtgttaacatgaatacttttttttagaataaggcatctatcaattcactagattacatttcgacagttcagaagtcatgaagttatgcgtcactctcttgaagtttcttagtcatttaccagcacatatacctttcacgttttaagaataatcacacttggctttggtgctttgtttatataaattgtataattatatgattttaggatgacaaaaaatttcaaggtgagctctttgggatatgcaatctgtttcgcgacttgtctgataagcttttcaccagtgagatcattgaaatgcatggagaacatgggaagggtaatacagctgaaacaataggaattcgagaaatagttgatacaaatatatttggtacgcaagatcaaatgaaatcctcaatgacagcaatacataacgagaacaagaatttgtaccattgtggtaagttctactgtcagtctgaatatttctaatttaattttcttgattttggaccttaaatgctttatgaaaagtttcaatttcaaaatgaccaataatatactattactattactattatgggaaactgaataatatactagtggctgaatagttaattgttagattaaattttaatttcaaatactgactctaaatattttgcattgttgtgcattcaatttttgtaacattcatatgtttgtatcgatttatttagccctgctgttcatcctattctagtttatgttcactgtctgccctaagttctcttcatacattttgaagaaaagtttatgtcccatatcccatagagctcaaatgacactaacatttgtagattgatatggttttgcaacattatatatctataatcctatgaacagaaaaatatctggtctgtgaaatgcaatatagaataacttacgttctgaataaaatagaggaaattagtaattatatttgtatcaatctcatcttacaagaatattgaaaatcattcccccccccccaccaccaccaactctactttcttaaggaaaaaaagtgtgggggtaaaagggttcacatgaaactatcagttctctaactttaggatgtgtattgacaggggggcctgacctataataagaataaagtttcagttctatgaaaaaaaaaataaaacaatcaattattattgcatatttctgaaatgttcagttaaatttacagcaaacggatagttctgacaaaacagtagcagtttgaaatttagtctaaaataaataaacacttggtcaagtatgcaagtctttgacatcttgatctatgtaggattctgttattagttgctacgtttactgtttccagtaaaaactgatttgtcaattgcaaaaaactcatattgactaagattgaaacccgaaagttgcttgctaagttgtctaccagaatatctcccctctgtctacgtattggtgcattgattttttcttgtaacaaattctgttccctacaaacaggaatagtttatgctcaccgaaatgaagatgttgtaaacacgaggacaaatgaagcaagcaactgtgcagaagataaaactgtcccaaggcacttagaggagctgcaaagtaagaagaatgaaacaatgcatacaattaaggcaaaatcttactcactggtgcagaaaaagaaggaattcagccgaattgcatctttcatgggtatgaacgaccttgagtttagtaagtggttgctgtctgtctcgcctttgcaacgacatgaagtattggaccgctacaggaatgcaaagtaagccatagggagtatggataatgcttccctcatatagatagccctttcctgctccaccgatgttttccttctattctcctgttctgccccatccactctttctctggcttggcacaggctatcagaaggggaggaacatttcatgttcagatcatcttatttccttcttttctttttcttcatttattgcatttgtaaggtaagatcagacccatagtggtttgtcttttgggtttgacataaatcgctgtttctcctgctggttctctggatttgggcgcttgtatctttgttggtcggctgagtaaagcttttagagttaccacggagttctgagtgcatctcaaacagaaagaagctgtgctggttagtggttacaatgtacaaatgatacgagcatagcaggtcatgtatcatgcatgcaaataattcacccgttatccgacttttcccgagacataatattgtagctgatcgccagcggcacaccaaggtctggcgttgtggcaatgttgtaacagagagtgcaggctgttaatacatcccttgattatgcatctagctcacgacctcacgttactcatcagtatttttcacctcaaattttttatgggactattcgccctgcacatggacgcgcttgcaagacaacttgttcataagatgttccttcttggtacaaccttcgttctaaactataacaacttttagccctttaaaatttatcctaaaatataaatttttttaacttatattattttctcaaccaatcataacctttcatcatttaaattcttcgctttctcttttttttaaccaattacaatattcttttaaataatttaaataatttgatctacttttttaataccagtgtttaaacctaaaatctcttatattctacaatgaaggtactacttatatactaataaaaagattgcgaagattctacctgtaccatccatttgatcttataattcgattgaatatccatgctagaacaagtgaaaacaaatacattaatcaaattgattcatgtaatcggcgaatccaagggtatagaatggatgtgactatacagctactggtagctgatttgtctctaaaccagctaccactccatctattagagatactatccacatacttcaaatacaattttctcttaaactactcattcgatctatgatccgattataccgttgtgttcgtaacaattaaatctttataacaagatcccacataattatattttgatgaaaaatgataaattacttttataatatatctaaattacttttagatttcactaaattactttctagacatatgaaagtaaattcaataaaggctaaaagtaatttacatatattatagaaataactcgtaacaaaaagaaaaagaaagtaactttaatgaataccctttttcattggacgtgactacatagctaaaaataaaaggaaaaaaaacaatcgatgattaaacagatttatagagttatttttaaccatacaaaagttacttccaattaacattgaagttacttttaaaaattgttaaacttacgtgtgttgatatatgctgattaaattttatttctagataaagttatgtttttatctctacaacgaatttacttataatgtcgtgacaaagttacttccgttttgttttaagttacttttataatatatgttaattacttttagtctctattgaatttacttttatatatctaagaagtaatttattcaaatctaaaagtaacttatatatatatatgataaaagtaacttacatatataataaaaataatttataaatataaatattttttcatcgtaatataatcatgtaaaatcttgttgtgaagatttaattgtaacgaacacaataatgtaatcggattgtagatcggataagtaatttgagagaaaactttgtttgaagaagaaaataacatacatgtgatgtagtagacttctaaaaaaaaatgcatgcatgtagtaagctacagttgatttctccgcgcgttccgacgttgctggttaaggcaaaaacgagaggcctctccgaatagattttatggtatagaatagttattctattcccccctctctcccaagggccaaacccaccttccctcctttctaagggttcaaaacccacctgccatctcagtcaaaggtcggtcaaagcatccccacgtcggtcaaatcctggtcaaatcacctactaactccccccaccgcccacctcttctcagctcttatctcgcaaaacggtgcaataacacgacagaccactgtgcagtaacactttgtcttacgtacagtaacaatattcaaatttagttaaaatataatcatgacgggtctacttttaataagcacttttttcctagcatcatggtgcaaacaattaaaaaaatcatacatcacgtgagagatattgttcttcaaagcttgacttttttggaatttgactctctacaagtaagtagtactatagcattattattactcgtcactactatctgttgtgcgttattacaatcccatcacgatattactgtaagtctatacctaattaaaaaatacgcaaggcttccactaaaaaatttcatccatattccttttttcctttttctttcttctttcttttccgttttcttccatccgtccatcttcccttttttttttattttctgttttcttccatccgtcttttttgcgccggtttttctttttccctactctaattaattgcaaaaatcgattccccactacttcatcattttccccatgattttctctttcaacgctgttttaattcaacggatttaatctatatttaaaagtcaccgtttttgtcatgggttttgtggattcgctctgatttttataaaaacggaaagaacagatcgattgtataaaagcagtcaaccaattttgtaagatcgagaaagattcgatcggaattgatgggaggaccgtttctggcattgtatggacatgagatgttttcaccattttccggaggttgaagacggtagtcagctatgcgagctgtaactacaactcctcttgtgggttcggtcaaatagaagcaggctatgggttaagttaaagtgaagcaggccaagcaaggggaggtggcaagaaaggaacaagggaataaccttttggtctgaaaacaaagagtaaatgtatagtgagcttttggtccaaaaccaaagagtaaaatgtatagcgatctgaaaatatttttatccgttgcaacacacgggtattttttttctagtatatagaaaagatcataagttttgtaataacaatgcgtcttactgcaatttttgtatagtgttactccataaacatgtggtaacgtgtacctgccatacagtaacacttccacttgtgcagtaacaagtatatttagcatgtgaatctatatttttttattcctggtttactacaatttcaccacgatattattaccaaaggtgtagtaacgttctatatgttctacattaacaaagtgttttagtacatttcttggatagtgttactgcataaacatgcggtaaggtgtaactgtcatgtgataacgtgtatctgccgtgcagtaacacatttatttttgtgcagtaacaagtatatggttagcatctgagacttttaacccaaatatttttgtttcaattcctgatttactgcaattcactacaatattactgtcaaaattgcagtaacgtcatatacatgcagtaacactatattggagtgatgagaccggttttattgagaagagaggggaagaactgtttctttgaggaggagagtgcgtagatgcattttgaagtttaaccctccacatacagtaacactatagcatcatagtggaaactgttttaaaaaacaatacatatcttgtgagatattgtttttcaaatattggtattttaaactttaaccctccacatgcaataatagaatgtgtagtttgtagtagcaagggcatatacatgcagtaacatggttttaccaaatgtataaaattattcaaaacactcctacatcaatcagacctcgctcaaagccacctacagactttacctatagctcacctattcgattttcatattgtaaaaatgacatagtaaaactacaattaccgtgcagtaacatggctacttggaagtggtaacatgtacctatcatatagtaacacttctacttttgtgcagtaacaactatatatggttagcatgtgaggctttaacctatatatttttgttttattttctagtttattcgtagatttcactagtggtagagagatgaaggctggggcaagaagaaaggagagagagggaaaaacactactacgaaaatcatctttcgtggcggccattttagattttccctggcagaaattgcagcggccacaaagcaaaggccagagaaaatatcaatcttcgctagcggttatcagtcgcccgcaaaaattgattttcactggcggctgtgttataccggccgccagtgataattaattttgagacaaaaaacaaccatatgtagctgtcctccagccgccagcaaaaacccctctccctctccagcctccagcatcccaaatccacatccccaaatctcaaatccataacaattcaaatccacatcaaatccaatcatccaaccttaagagaacactacatcaatttctcacttcattctcaacaaacaaacattaatacatgcatgtatgaaacatcaatacaaacataaaatggagaaattcatcaaaatcgctgtcgcccgcctgccatcgccgtcgcggcggccgccgccccctccctccggctagatctgggagagggagagggaagggaggaggagaccctccggtcgtcgtcaccagtcgccgtggttgtcgtcgtcgtcatggcccagcccatcgtcgtggtggtggtggtggtcgccgtcgtcgtcgtggcccggcctgtcgttgtcgtggtatgacggcggcggatccggcctctccgcggcccggcggcggcggataccacctccctgcggctcggcggcggcggatccggcctccccgcccgcacccgagagccatcgccctgccgcgcctgagcgccaccgcccaccgcgcccgagagccgccgccccgccgcgcccgagcgccgtcgctaggtccgcctgtcgtcgctgccgcggcggccgccgccgcctccctctggctagatctgggagagggagagggactgagggaggggatgggaggggaggggagagaggtgaggtttagatgagaaagagatagagaggagagatgaatgcagtgggtgggtgggtgaaattgcttttaaatgcgtgggtgggtgatgctgtgaaggaatcgatctgtgagctgtgcttttcgctggcagatccgttttttcgctggtggatctctttagtagccgctagcgaaaacgcttatttttgatggtggacatttaagaggtccgcctaaaaaaatatagtatttttatggcggacctcttaatatggtcgctggcggccagtgaccccccaccccccgattttctacgctggcgattttttcttgtagccgccatgaaaaatattttccaaacgctatgaaaaatcatttttctagtagtgaaagagacatacacattcaactagagcgagaggtgttactcacatagatggggatgcaagtcatagttaatacatgacttgagagttattctaataagatgtgattataaacaattggacaaaccattgtacatagttgatgctgttactatacgctatgtatttagttactactccctccgtcccaaaatataataacttttagctctcagaatttatccaaaatataactatttctccattaacattctctttccaaccaatcacaaccctccacgtggcacgtgtgcgacttagagaagtcgcgcgtacacgctaattagcaaaaccgagcaacactagcccttggatcaacgggtaatgggcgaaggtgcaaaaaaaacttgatgtaacattaaaaaaatcgttaagataaaggaagttttatttatctcaaagctctttattatttcacccgaggtaccgtacctcgctttatttattgattacatacattacccaacatacaaatctttatagcagacacaatatatgtttattttcattacatgactttatttgtgtagtacacaagtactgcacacaaagcttttattgatccaatattaaggaattaatggtcttcaaatgtcacgaccagtcacacactcacaggtgagccgtgaagccggtcttcttgtcgtagaacctgtcccaaaccatgacgcctccgaagttgggctgcttgttgatgaactgcagcaggttgttgagggcctccggcggcatgtaggcgtccttgtccacgtccggcgaggccacgacgccgatcaggacacggctctgcgggtacgtctttgcccacttctcgaacgactgcctcctggaccatgccgggcaccggccgtcgctgaacatcttgacgtggatgcggtggaagagccccgtcgccagcgcctcgtccagccggtggtccgggtagccgcaccgcgtcgtcgccgtcaccatcacgccgaccgtggcgcggtagtccttgttgtggtcgtagagcatcttggccagctcgttgtagtgctccctcgcgccctggtcgatgaagaagtcgatgccgttcacgttggcgtcgccgaacgggcggtagacgccattgcggcggccgccgaggtaggagtaccagaggtggtcgtgcagatcgacggccgcctgggaggacgggagggagtactcgccgccctggccgccgatggcgaggaggatgagtttacccttggactggcagtacttgatgtcggggccgacggcggagacctggtggccggagatgtcgagcttgtaggtgcccgggatgtagccgaaggcgctgaggaaggagatgatgacggtggtatagcggccggcgtcgcaggcctccctgagggagccctcgtccttgttccggccccagatgatcacggtgtcgccggtgttctgggacgtcgccgacacggcggcgaggccggcggacagtagtactgccaaggagagaagtgccgcgaggcgtcgaagcgccattgttgatatgttggtcgaatcgatcttacgatggagctactgatcgaggtgtgaaggatacgaacgtggatgcatggatatatatagcgatcgatcgcgctcgctggacggacatacgtgtcgtcttatgttgtgtgcgcgcggcgggcgccgtgggcatgcaggcataagtccaaagataacgacgaagctagctaggccttcaccttcacgcttcaccaccagtagctggtgtgttacagctagcgtgcgcaagtaagaaaccacgagtgcgaaacaacagaaattaaccccgtttcgtccctctcagtttatcatgcagaagagataacaaagccggtgcttagcaaaaaggaagatgctgggataaacttaatttgaccgtgaacgtgttgttgaattaatataacagcccagcacgccaccaattactttattgctgtaatgtttacttctctagcgttctggctacttagaaaatgtatgtcatgtcagatgttgcctgttttgatgagcccaaacccggaactgtgatgagggttgggtgaattgaaggttctcttgcccagggtttccaattttggtaaagaccgaaaatatggcaatttcagtggtcacaggaatttcaataatttcagaaaaaatggtgggttttttcacaaaattatttaaaattttaaataaattttagttgaatttaaataaatgttgatcgaattcaaaaaattgtaaaaaaacaaaaaattgcggacgagatatttgcccggggttccgaaatttcaaaccctactgctgaccatgcatgagtgggcactgataataaatatttacttgaaaccccttcttattttatcatgctatatatactatccacataggttgtggtgttgcatggctctcaagactgtttaaactgtacacgtggattgggcctacggtgcctagtgtcaaacctgggtttgaccccaaatcgtatatgtatgccgtgctagttacacgatcaattgctagcacatacattcaaccttgatactagagttcatacatcatcaaagtacagtacataggagtccaaacttaagtaaataaatgatctagactttaacaattacatcatgggtcatccgccgaatacaagacaatataagagagtaaaacacagcgaaaacataatataaaggcaccaaaacccagcaagtgtgtctctgccctcacacaacaactgaccgttaagtcctagtaagcaccaacatcattgtctccaaaacctgttgtatagaagtacccgattgccaggtcctcctcaatctctaaaaaaaaagaagtcacacaagcgtgtgtgagtacaatacgtactccgcaagacttttagtgtatccaatggtaatccgtaataatgcaaggataacaaggaatggttcaccgagttgtccatgaccatggccacgactatccgaatagatttaaactctgcagaatgtgcacaactgcaccgagatgacacgttaaacctgagctaccatacagaaggctcgttccaatatgacgaagccttttcactagctagcagaggagtgccctccaaggcccgaggctcaaacgttgtgcaggtaaaccttgaacacaatatcgtcaaaggcaccgacaagtatggacaataaccataccggcattaatccaatgtcaacaacaatgacctacaactacaacagacgggtctattgcttggaaccaataattctcttagctagggacttcctatgagccacacgtgatttgcgctagtgtctcagatcaatttggacacagttttccaccaagataataaagattttaccctctgttcatttccataattttgcaaacatttttttctcgaaagcccaataatccgattaaaactagcactaccgatataagccagctaagcatattctacacgactatcctcccagcacatgaacccaattctcagtgataacgtaggtgacaatgaatcatgatactcaagtaacaaagacaaggtatatgcagcaattggcaagctacccatgcataatagttttgcaatgaatacaatttatatatttgaaatatatgagcaattgatcaagggggagcttgccttggtcctggacctcctggtattcctttggtaccacctcagcaggatcgacaacatcgttgtcttcacgaataccgaacgaatgcaataaatacaatggcaaaatttaatagtacaggtaatccaaatatttttgcagagtatgaaagtgcgtgatttcaggaaaaagaatcgcttgaatccgagtttgtatgacggagaaacggctaaaggaagtcttctctgccctaaaatcgaagataaatgaaaaacatcgttttcgctcaaccgagctgctgaaacggctggaaacattctaccgacctaacaggtcatctattaaacattttcttggttctaggggcgtttttatggcgcaaaacctacatatgggttaatgtgaacctattgaaaaacttcagtagttgcaaatgtctcggtccaaaaacaacatcttcatacgagcgaactacacaactcgctaaggatgttaacgatgaccggcgtaaacgtgaagtcatggcagcgactctactcacggtttcagcacgttctaacagtagtgaggccaacctagcatggatggggccgatgggatgttcatggttagctcaaacaagtgtgcacctatggtgttcggtaaaatgccaaggttaagtacggcatgcctacctctgtcctctcattctctagtgcacggctggtgaagacgggcacatggaggctcttggggtactacatgcaaggtactggggttctaacttgtgtggtcttactcctttgagcctcggccatgcatgtagctacagtggtggcacttgggcggctggacaaacgacgacatcgctggtcatggcaaggaaaacacatgcataaacaggagctcagcggttgaggctatcggcaaggtgacggcagatggaagaagttgtcctgtggtggaactcagggcgtcggggactaaaaccaagcatgggaatgaacttagcagggtatatagatgctcccatggggaggaattgggttggaacttactgaggtgaaagttcccaaatcaagtgcatggaggcattcggtcagccccaagagaagaagatcgggcagcagcaagttctaccatggaggaggaggaaaatggattaaggtggggggaggaacacatggtaaagctgcttggatgtcgagatactcaccagggacagagtttagcgcttgttaggtcatggcggcaccgggccagcgttggagaacacgatgcactgcatttgtgctcagcgtcaactgagtgcaaaaacggaatcagtgggtgaagggacgcgaggtgacatggctgggatgagatgatactcaccgatggtattggaacggtggaggtgtgcttgccgctaccacacgtggcacctcgcccagcgaaccaagggacaatcacttgggtcctttggcttcctaagaacaagggcgagttcgggagttaggaggacatggtcttggttaaggaggaagccaaggaagggaggggagagagcgggtgcttgcttaggctgtgttcttccctcaactttcccaactcacctccctcgtgttctacgtgcacgcttttgaaatggctaaacggtgcgtttttttgcaaaaggtttttatacgaaagttgctttaaaaaacatattaatatatttttcaaaaaaattaataaatacttaattaatcataagaaaaggcgttgctccgttttgcgtgcgcaggaggtgagttcctaacctcacctcctgatcacagccttactcccttggcctcgagatggcgtgggcaccggcaagcctgcgacagataaatgggatagggcagggtgttgcagaggctggcaaagggcttctcacgaggtcccgaggtaggcggcctttctctcgtccacattcgagtcaaagacgaggcattcttgggacttgggagcaagaaatcatgggcggcaaaggacagattggccgctgccgcctgccgcgcgtgcaatgcgattgggaggcgtggtggagcactatgatggcgtggcagggcgttggggaggagctgtgacgtggcgtggggtctccagggcagtctagtgggtcgtggctaagctgaaactcacggtcatgcgcgagggctagcctggctcacgcttccagcgcggcaaaaaatggctcgtgtttggctgggttgtgggtcccgaattagaggtggggagtggagaccaacataagaagtatgtcccatggagttgcctatcttaccaaataaactagttgaaaccccacgcattgctgcgagattttgtatcaatacttgggagaaatgaaaataccatattaaaagagaaagaatgatatgatggttgatacttacaaatattgagcaaacacttgttagtaaaacttcagccgaaccaatatagtcgaaaaataaaatagggcatgcaacattaggaactgaattgcagcgtcttcgttattctccaaaagaaatagtcatatagttatttaatcctaaaaaaatgttgcatatttacttcgttaagtgttgtgcttgttctgaactcctttttaagtaccgtacataacataatcttgctaccaactgcaatgattacttgattagtgaaaggagcattgacgacttcataaataaaagtatgagcagatagttccagaccatagaggtaacggatattgtgtaattagcagatcatattcaactctgacatgaaaaacatatacaattgtgtttccaacataagaatgtgaaattaccctaaaactctgaaatgtcacttagtctatgtttggacactctcattggctgaacatgtagctgaatatttcccatcagagcttgtatttgaaaaaagaaaaaactaaagaatacatcataattaatgtcatggaggttagatgaaagtagaagaaaagaacttgagaaaagaacaaaatgaagataaagtcctcaagccatacctaaaattgggggaagacatctacaaccaggaatcggccgcaggacgaagaaatcgatttgcagaaacacaaaattgtcatagacctcaagccataccaaaaattggggaaagatgtctatggccaggaatcagccacaggatgaagaaattgatttgcagaaacacaaaaatgtcatctccttctatgagaatcctttgcttcgaaggtaatccaatggtatgacaattttatccgctgctatgtcaatcctcaggttttcccataagtacaggagccaatatcctagatagcactaataagaatgggtcaaacaatataagcttttcatgagaaactaaagcaatagacaatgcattatggaattaccgcaatagctgttctttttctaagttagcagaaacaattcatcaaaaactcccaccttgttcgtgcgagagcaaattcataggctatgctcaataaataaacagaagcaaatacatatagaattggtaaacaaactgaaataaaatcgttgaaccataaactttagttacgtgaagtatactaaactttcatacttcgattctagccatctggctctagcctttgttgataaattggaggagctcagagacttgaccttggctgagtggaattttagactctttatgaaaagtaaggttcttttgctccttaagtttaaacaagtctattggcaaaaaaggtgcactataaggtgggcaaagtttggtggtgaaaatacaaaattctttcatgctgcggcaactgaaagatatcgcagaaatttaattatgcagctaaagtctgatgatggaagggtgctttctgatcatgcagaaaaggcagaaattatttttcaaacctttcagcaaaggatgggagtttcttcttctccagtcatgcacttcagtttggcagatctcatttctgctgctcctgatcttcagtcattgtctcttggctttacaaccatggaaattgatgaagttgtcaacaaaatgccaattgatagatctccaaggcctgatggattcaatggttgcttcattaaggcctgttggcctataattaaacaggacttctataatctttgtgctcaattttgtgagggttctctggtgcttgagagtattaatagatcctttataactctagtccctaagaagtcttctccagaaaaggtaaatgacttcaggccaatttctttacagagtgtggctctaaaacttcttactaaggtgctggctgataggctacaatctgtcatcattgaattgatccaccaaaaccaatatggtttcattaaggctagaaatattcaggactgtttggcttggtcttttgaatatctgcatcagtgccagcattctaagagggaaatagttcttttaaaattggattttgagaaagcttttgatactattgaacattcggttatattggacatcatgaggcagaaaggctttgatcctaaatggataagctggatttctcatattttttcttcagcctcttcttcagttatcctaaatggtgttcttggcaaatccttctattgcaaaaggggtgtaagacagggtgatccactttcacccttattatttgttcttggagctgacttgttacaatctatagtcaataaagcttgttctcagggagttcttacaatgccaatcccaacacctggtaatgaatttctgattgtccagtatgcagatgatactcttatttttttgactgcttcccaaaaagagcttttctgtctcaaggcaattttgaacacttttgcctcttcaactggccttaagattaactatagtaagtcatgcatgattcctctgaatgtagatttggaaaaggttgatcatctctcaaaattgtttggttgctctattggtaagtaaccttttacttatctgggtcttcctcttggaaccacaagaccaagagttattgattttgctcctctaattgatagagtagcgagaagactctcagcaaccactgctttgttatctcatggggacaaattgaccattgtgaatgaagttctttcctcccttcccacttactacatgtgctctctttcactttcaaagacagtcatagaaagtattgatagagctaggagacattgcccgtggaggggatctggtattaattctagtaagaagtctttggttctctgggaaagagtttgtcagccgaaagatagaggtggtttgggtgtaatagaccttagattgcaaaataatgcccttctcttgaagaatctgcataagttctataatagatatcctgttccctaggtcagtttgatttggaatacttactacactgcagaacctcctcatgctgttactcctaaaggatctttttggtggagggatgttttgcaatttgtggaaatttttagaggcatctcggcctgtactgtgcaagatggaaaatcttgtttgttttgggaagatttgtggaacaataaagtcagggcattggtttatcccagaatatattcttttgccaggaattcaaatctctcagttctgatgttctctacttctgatctaccttagctctttgccttgccactttcagagcaagcttttcaagaatatttagcaatgtcagctgcagataccttggagcatcttaatgataagtgatcgctggacatatgtttggggcaacggtattttttcttcacagaaaatttatgccatgaatttttctcatgtccatgtgcctgtttatattaaatggatttggaagagtagttgtactatgaaagtcaaggtgtttggttggctcctcttgattgatcggttaaatacttatgacatgttagacagaaggcattgctcccctcaaaatgcttccttgctctgtgtactttgttcaacaggatcaagggaaacaactctccacttatttttccagtgtccttttagtactcaatgttgggcgcaatttggtgtggtttggaatctttctttaagctttggtgaaatgttggtcacggccagaaattcatataactctacccattttgttgagaaggtgctttatgctgcttggaacatttggaagcagaggaatagtttaatttttgaaaacattgttccctctgttccctcttggagagttctctttaggaatgatctctcccttttagttcatagagtcaaaaattctgagagagatacattgttatagtggttaaatttgttgtaattttttcccccttattaatataaaatcttaacggtgggggcttcccctaccgtggttctttcaaagaaaaaatcaacgaatatggttcacggattggatgagttcagaggatggtggaaggtatttgtggtctgttatgaatgctgaagggatgttaagaggctcataaagggatgctatgagacttgtgaaagctccttgtggcttaattaattgtgttagttttcctgtaatttctcaagtagaaatagaaaggagaggaaatggattggggcaaggtgatgagatggcaatatgtgccatcaataatcaatcctatgttgagaaaataaatcgatgatgtggcttcttctaagcacaactaatggtcttaactttctagaaagaagggatagtattaggtcaacaggtcaacgataagagacaatgagtggaggagagaaaggtctccagttgggtgaacagtgccctaaattttccaatttcgactgagggtttgaatggttagatgggtaaacttgcttcaatccaaacataacttggaggcaaggctagtagtaaggtatggaatatttaggaatttatccagaatttttggacaatattgaaaactcagagtcggttatggcagtgggaaccatttagagcaatcgtacaaacattattttgctcagctgggattttttatgcacgaaataattcatgcagtgcagtgcacatgaaaaacatttttacgaaccaaagaacaaaagtggattgttacaaaacctacaccctcataccatggcggaccggccaccaagatgatgcccatgtaacatagacatcgtcagagtgcgagtatggtcctagccgcttcacttttgcccacatgaccaaatagaggggaaacccgaccaaacccaactatataataaacttgtggcatccgcatatctctgtgatataaccatatatcacattccatcatcctcatggctcgagaacgctaggtgagtcctcatgggttcacggcttgagaacgctggggtcataacgtcaatgccgagacatgccactgagccccacgtccagcctcctccttttagcctaccatcgtgccagcgtgaaccccaacttaccctagttctattccaagcagacccaagaggagaccacttctaggtcaccgcgaacacactactacaaaaataatttttccgtgcggtcaaaaaggattttcgcgtgagatatggaacacctgcacgcgaaaatcgggttttcgcgtgcgggtgctttatgtggcccgcacggaaaaacaaaaataaaaaaaatcaaaaaaaagaaaaccctaaatgaaaccctaaatctggcggcgccgctcctggccgccgtctcctcctcgtcgtcgtcggcggggccggctgccgccgtagctcgtcgttgtcatagctgtcgccgccactcgtctcgtcgtcgtcgtcgacgtcgcgcaggagaaggcgggagaggggcaccgccactggatctaggcggtagagaggcgccgcgccacagggagagcatggggacgaccgtcgtccgcctccgctccatccaccttcacaattatatttgttactttttgttacaacttatagaagttaaattttaacttgcatattcgtagagtgatatatttcatattaatctatcttgtcaatttatttcaattttttatggctttttatataatatgcataaaacgatgggatatcctttcaagggatgaatactctttccgaggtaagaaaccacatcatccacgaaatccggaaaatatacaaattggaattacaaattacaatcaccaccagttagtaattcactgtacgtgagatctgcacatactgacctcactttatttgtacattgttcaacatattacacatttaacatatcatattcatcttggtaatatatgtttagcttaataaggaattagaacacgtcaccgttgatgtagccggtcttcttgtcccagtacctgttccagaccatgatgcctccgtagttggggagcttgttgatgaactgcagcacatcgaagtagagatccttgtgcgacatgtaggcgtccctgtccgcctccggcgaagccacaatgctgacgtagatccggctgtccgggtacgccgccgcccacttctccagcgactctctccggccccaggtgcaccgcccgtcgttgaacagcttcacgtggatgcggctgaagagccccgtcgccagcgccgcctgctgccgctggtccgggaacacgcaccgcgccgtcgccgtcagcatcacgccgccattgctgtggccgtggagcagcctggccagctcgtcgtagtgctccgtcgcgccctggtcgatgaagaagtcgatgccgttgacgacggcgtcgccgaatgggcgggcgacgccgctgcggccgccgccgaggaaggcgttccagaggtagtcgtccaggtcggcggcggcctgggaggacgggaggtagtactcgccgccctgcccgccgatggcgaggaggactgtcttgcccttggactggcagtacttgatgtcgccgccgacggggacgacggggtggccggagaggtcgagcttgtagctgccgcggccgaacgcgctgaggaaggagatgatgacggtgttgtagaggccggtgtcgcaggcctcacggagggagccctcggccttgttccggccccagaacaccacggtgtcgccgatgctgctgctctgctgcgccgtcgccggagcggcggcgaggcaggaggagagcagcagcagcacggccaggggtgcaagagcagccaggcatcgcggcgccattgatcgatcttacgcttaattggctttgcaaacctctcgagattacacgacggagctagccgcgatggatgattgatgcgaggtgtattgcatggatatatatagggagatgggtattatggtatgtgcacgcgcgtcggcgcggacgtattgtgttgtgttgggtgcgcgccgtcggcggcgtggcgtgcaggcatggatgcgtcaatgcgtggcgatacatccaacgacaacgacgaattaccttttcaccttcaccgtacaactggccgtgctatacgtacagcgccattagcatgcacgcgatgctagctatatgctggagacctggagtacgacagtacgtacgggtagctagaacgcgttagcaagcacgcgattgcacgtgcgtcaagtaagaaaccacgagcgcgaaacaatggaattaaccaattaactgttcgtcggattatcacgctgaagtcctgaagataacgatgctggtatgtttagaaagagaaagatatacttgacacaaactttgtcaaactactttgtttgttacgatttttactttactttacttctctagcatatattccggccggctaccttgaaaataaatataccaagtcgtgttcggcgtcgtctgttttgaagagactggaagtaacaagggctagcggggtacggtgaattcaattaatggttctgcgagcaaccgttcaccaattagttcttgtatctttaaaaaaggttctttgtctcctcaataattatagggccggggatccaaaaatcaggcattgttttatcactttagagaaatataatattgcatcacgttcttaaatgtttaaacttacttttattttttttaaaacaatgtaacattaaaaatatattgactacagtatcaattactagtacatgatacattgagaaacatagaaaaattaataaagttaaaattttgaatatgcaacacaatcaaattaaaattaaattcttcttacacgtgaaactttgaatttcaatggcattagaaatatgtataatagtgtgacatcttgttataaaaatttaattgttcaatcaagattgtgattaatagatttatattgctaatgatcataatcacaaacttcgcgaatattgataagctttaattaatatctcagtgcatcggcctacattcaggatcaacatatataattgtcgaaagacacattgaaatggaagctctcgaacctatttcgaagtaagtttaggatgaggtttctgatccggttggtgtttcgacatatcaactcaggtttgcctacctctctagttgcagagagaggagaggggcttctatctttttaggtctctgaaaagctagttgacatgagatccaatcaaggaggtagtactttaatttgcctgagttcctctagatccaactaatcggtattacagtactcccgcgggttgttcaccatgcgttccatagcatttacctatttgcctttgtgtttttgcgcctctagaagcttcatcgttttttcacagtcaaagttcaagaaataaggtttctgatcagcaaaaagaatactttcaatcttatactatctcggtttggtttgatctatcaagatttacatatactactagcataatgcttgtgcattgcaacggattataaataacatttattgacataaactaaatcctaaaccatatatcacaattgggcataaatgatgaaggaaatataataatcgaaataacaatatgaaactacaaataactttggccagaatgataattcaatatcagtaaaattatataactaaatcctgttttttcttttagctataaataattcaacacagagaaaaattataagttaaaacaatttttaatatattaaatagtgctaaaactaatactgtaaatgtgaaaacaattgaaattagctagaatttttttaaaaaaacttattttagcccatagatgaaaatccgatgcaataattctgaactggtaccgtttcttcgtcatatatttgaaatttatagttatgttcatttatatggtctatattatgtgtgtggtccaggagcatggttgggctggaccaggaaggaatagtacccaactggctctgcttatcgtcttccctagctgaaggcaagaaacaaaagagggaagatgggtgtcggtgctttggcgaccaaacggcggtgaataagatggtaggatatgtcatacgatatgactcgcccatagatggtggaggtgggcaaccaaaaaaaaacagagcagtagaaacgcagcaggcaacgacgtgatcctgatagagagagaaacaatggcaacgagttctggtggtgaacatgaccggatgagtgcgtcaaaacacgttccttacgagggggttccattttccttgaacgcgcaggaagaacaaaagatggaaaaacaatactaacactgttcattatcttccctagctgaaacaagaaacaaacgaggagggaagatgggcgccaatgctcctatgactaaatggtggtgaggaaggtggttggacgtgtcccacaatgtgactcgtccatagatggtggcacttggtaatgaaaaaaaccagaacaatgggaacgtggccaacaatgacgtggtcctggtagagagagaaatggcaacaacgagctctaatggttaacaccaccgggtgagtgcatcaaaatgtgtttccaaacgaggaggttctgttttccttgaacgtgcgggaggagggagcgtagtggagaagaggggcgctaggaggaggggtgccaagaaggagaggggctgcagggggaggtcacgagggagagatttggggcgcctagagggagggatcacaagggagagttgtggggcgctggaaaagagccggaggggcgcgggaaagagggaggagtcgtgcgaggaggaaggagtgcggccatgcgggatggggaggtggatggacgaaaaatagtcggaagccttacgtattttataattattaggtatagatatagatatattacatctaaactccgaccaatgtctctttaatccttcatattcatatctatcggttatatatccgatcgatccaaaattccatcggtatcggttggacacagaatactatatcacccctgtggtcgattggccccgtgatctaatcttctcgtttttaccttgttagttgcaagatcaaactaactagcatgttcctaacccgattttgataggacctatactagagtgaagcaaatatcttaggccttcgtgtgtgcgacaaattttgcgtcaatgaatctcagagcatattcaacggtacgtatatgggtgtattatgcaaccgcttgcacaaaacttgctattagcagaatgcattatgcagtcatgaacttggctttaggactgcataattgcatttattatgaagtaaaactagtgttattccggttattctgcttatgtgctgatgcttcgatgatccttcggtgattttacctagttttctgatgattgttttaaaatttacatcaatattgttattctgcttgtgtgctgagtcccatatgattatttggttttttccccagttttctggtgctttgttttaaaaattgcaacaaattcggtcaagatttgtccgatatttctgaaattcgtccatttcagttgtgccgaaatttttatgcaattgaatcccagaacttgtagaaaagttcaatctttaggagacagggagtagaggttagggagtatgtattggttgggcgatcagaatcgaaccagaatccaatgccgatcttccaaaatattgggttctatagttactactattttggattccgatcgtaattcccagtccgtctggctatatggctattggcttgtagtagtacctaccgactacgatgatccgatccggtatttgatcaatctcctcctccctcacactgtatctatataaataaattgctagggttggggaattactaccgagaagcaaagtgcgtgcattccatcaagacgcccaaagacgcaacgcagtaaggaaaagaaaagaaaacaaagagaaatcatgtcggcggcggcggcgagattgagagcggtgtttggttcaatggcggcggcgcgtcctctcgtccgccgtcggctttcttgtcgcccttttacctcctcattagcgcctcccaactaccaccaacaagactgctagtatgagcaaaccaactaccaccaacaagactgctagtatgagcaaaccacatgccatcgccaccaccagaccaacaacaacaacgccgcacgcggctgaaaaccaatctgacatgacttgtcgtcaacaagctggtgattcctcctcctgctcatgctcaaggtacgtgcgtgtaatcctcctcctcatctatatatattactccagtacatattgtttacacccatataggtttcctccgagtgggccggtctgaccgccggttgagggccggtcagatcggtggtgtgtggccggtctgaccggcagggtccgagtctgactgtgtttcgtcgggtttcgagatttccttactcgggaaggcatgtttcgggttttctttggtttctatcccgagttggacgtagaggaaggcatgtagagggtaataccaacccctatataagggacatggccggttccattgtaactaaccaatctataatcaatcaatcgaatcgtttttcatattgcttttagttttctcttagtctgtccatctttgtcggtttgcgccgtaaaccgtccgccgccgctgcgagagtgcgacacctctttgtaggtttgtcctgaaaaccttccgttttgcccacgagacgggtagctatctagaaatcggctctgctagccggtttagttatcaaaacccatctaggtttagctttttgctagatcgagatagttggcgactctaggatcaccgtaaggcataaggtgctatgatcgtgcttgtcaacttgtcacaaaagttgacaacacgatttttggtgactccactggggagatccgttcagcgtcaactcaacttcgacttcgccatgacgaagcagtcgtcatcaaaggtagaggtggagcctatcaatgtgataccaattacattggatgacttcgaggaggaagatcgcaagtccatagaggagtacattaaggagatcacataggaggcgttgatgagggcgtgcactaggactcgtcaaggcgtgatcatcaaacccgggccacgtcctaagctcactcccgatttggtaagcaatgaagaggtaacacaatctatccaacaacaagttgtatctacaaaagattcatccatgattatttttaaaaataagttagatgcaactattaaaggtcgatttgataagtttttaagaactaaattcggccctctcatggccgattttatgttaaaagataaagcctctaccagtgctagccaagttcctatagatcaaacaagtagtggaaccgatggagcggcgcagacagccggtccgatcgggcctgatggccagtcagaccgcgacttcgccgtcggtccgaccagccaaacggccggtcagaccgggtattatcacggcggtcagaccgggactcaggccggtctgaccgcgcctctggacgttggtcagaccgggccctggactggtcagaccggcgcaattattccgattcaggggatatatccaatgactaatgctagttatttgtatcatcttagaacatttgatcctcctatatctactgctgcaactaatccccaagttcccccacatgttcctaatgcttataatgatgttgctaatgggtatcctcccgatactaggtaaggccaatataatcatattgcgccgcaaacacatcctattaggccaccaaatccaccaccaaatcaacataggcctaataatgtggaggaaataattagtgggattattagggataaattcgggattgaagctaggaatcgtgctaaggtttaccaaaagccgtatcctgactattatgataatgtgccattccctcgtggttatagagttcccgaatttgccaagtttagtggtgaagatattaggaccacatgagagcatgtaggtcaatttttagcgcaatgtggtgaggctaatagtgatacttttaaattgcgcttattttctttgtctttgtccggtaccgcttttacatggtttacttctttaccggcaaattatattcatacttggactcaattagaacaaagatttcatgattatttctatactggagaaactgagcttaggttatgtgatttgacatcggttaagcaaaaatataatgagcctgtcattgattatattaagagatttagggatgttagaaaccgatgttatagcttgaatataactgatagagatttggctggtcttgcttttaatggtttaatttctcatcttagagaaagattagatgaccaacaatttcttgatgttagtcaacttatgcaaaaggctctggctcaggaaagccgggttaaggataataaaaaaattgttagaccatataagaaaaagcctaatattaatttgattgattaccctgaggctagtgatagttaagatgagggtaatcatgatatgtatattgctgagtggtcatggactaactaaaataagccttttgtttgttctaatctaatgccaactcctcgtaaagatcggcaaagtgagattaaatatagttttgatgtggccaagtgtgataagattttttattattttttataagacaaacaaattagattacctaaagaccatatcataccatctcaagaagaattgaaacgtcgagcttattgtaaatggcatgattcccactctcattctactaatgattgcaatgtgtttcgacgacaggttcaatcagccataaatgaaggacgattgaagttcaccgatggttccaagatgaagcttgatcatgatccttttccggtgaatacaattaatttcaatgagaagaaggtgttgattcggccggagcaagccgaatctactaagggaaaaggagtgatcattggcgaatcgaggccgaagatgatagtgccaaagaagccggaggttggtgtttggaaggaaaataagagtgaagcttcaacttctaaagctcctaggaagaccaaaatgacccttgatatgcttttggagaagtatgaaaagcaaagtggtgagagaactcgcaacaaagggaaaagaccaagatcacctcctaggaagcgatttggtcactcaccaagacggtcgcattcacctccatatcatcattcacaagacatgtcatggggtccttatccaatgctgccgccgggttatctttatccttattacatgccatggggggcagcactgccaatgttcaaccatatgcctccaatgtaattcaaccaagggtgcggaggaccaaggaggccaatccatgagtgtttgtcttcaccaaacaatggccagttttatggtaagaaccgggccagtgaagaaaagagggaagggaagcgtattaaggtggaggcaaggacgtcgaaagtgattaccatcaaagtggggtctcatgatgtgccaataccttctggagatgaagttggagagtcttcaagcaacaaaaccgaagccggtaccagctcatcgcactcggccggtctgaccaggccctctggccggtctgacctcagccatacggccggtctgaccgggccatctggccggtctgaccgccgaccgaatgacggtctgaccgatgcctcaagccggtctgaccgccgacctaatgtcggtctgaccgatgcctcagaccggcgcatctggccggtctgaccggtggtctacgtccggtctgaccgggctccagcgccggtttgacaggaggttcacaaggagtaaagtgggggcttcatcgtcatcaagtaaactcaatagggggcactacttacctcctggaacagagccgaaacctaggtggatgcctaaggatttgacggctactcaaaggagaaggttgcaacgtcttcgggcccaagaaataagagagaaaaaggccgaagagcaaagagataaaaggttcaatgagttgtaaccaccaccggtatggaggcgtaaatccatagagaaggaagaaccggttgttgtagaggagaaggaagaacaatcagttgttaaagatgagtcatctccaaaagaagacatggatatcaacatggtatgtatgttgcctatggagttttgtgctatggatgaagccgaggttgctcaattttcactaggtcctaaagatgcggtttttgagaagcccgatgagtcaaaccgtcatatgaaacctctctatctcaaaggtcatattaatgggaagccggtctctaggatcctagtggatggaggtaccgccgtgaatttgatgccgtactcgttgtttaaaaagttggggcggggagatgatgagttgaagaagaccaacatgattctcaatggcttcaatggtgaaccaacggaggcgaagggtatcttttcggtggagcttaccatgggaaacaagatgctaccaaccgctttcttcatcgtcgatgtgcaaggtaattacaatgttattttgggtcgttgttggatccatgccaattgttgtgtgccttctaccttgcatcaatgtttaatttaatgggacggcgatgatgttgagattgttcaagcggatacatcggccgaggttgcaatggccgatgctacttttgagtggcgtcatgggaatattcaatgcttatcggggatggatctttctaggtatgatttcattagtatttccgatggcaaatttgtacctatctctgtaaagccggctagtttagcacggctaggccatgtcaatttgtacaatgagtagagaagctaatctagagttgttacaaaagagggtacaagaatatcggtctacaaagaacgatattggtgaaactattaaagattttgatgaagtggagaagcttggacaggggtttacatcggccgatccattagaggaagtagacataggtgatggaactaaaccaaggccgacttttgtaaacaaaaatatgagagccgattataaggttaagataatcgagttacttaaagagtatgttgattgctttgcattggagtaacatgagatgccgggtcttagccgtgagcttgttgagcgtctgcttccaattaaaccgggttttaggccttataagcaaccacctcgtcgttttaatcctttactctatgaccgagtcaaagaggagattgatcggttgttgaaggcggggttcattaggccataccgttatgcggagtgggtttctagcattgtcccggtggaaaagaaggggagtggtaagattagagtttgcatagactttagagatttaaataaagctactcccaaagatgaatatcctatgcctatagccgacatgatgatcaatgatgcctcgggtcataaggtgattagctttttagatggtaatgccggttacaatcaaatttttatggcggaggaggatatgtacaaaacggcttttaggtgcccaggatttgttggtttgtttgagtgggttgttatgacttttgggttgaagaacgcctgtcacatcctgattttcgttttaggatttataaattatttaataaattattattagaatttatattaaatgttcattaatttacaagtgaagttaaatgtgggaaataaaatttcctaaatataaagcatggatggatttaatttttattaaattatccatggttaattatattctctggaattttctcagatttttcggagctcaactcttaattttaatcatacaaagaacatttcagtaattatccacatattaaagtaatcattaaatgttctaattataattttgttaaatactttgagtgttcaagtattttcaggatttttcttaaaactatttgagcattggaagtatttttaacaactcaaagatcatttcagtgattattttaattggaaaaagttgttaaatcttctcctaagccgttgggctgatttcagcccaacatctctctccctcgcgtgcgtgctgtgcagcccaagtcggcccagccgagctccccatgtctttctttctttcctttgtttttcagccagcccaagacgaaagtgtaatttgcttccccgtttactgttcatcttcaagcttggacagaagcccgagctgccgtcctgtgctctagccgacgccgattcctccaccaaatcagccgcatcccgtgctccgtttgcaaaattagttgaggggaaatattcctcttatcctcctctatcttttcccccaaaaatcggactttatcccgaagaaatcaacgcggaatcgaattcgttttcgagtttatctctctaactaaccctcggtttttccggcttcgattcctctcggttggagtctgatctcttcaatccaagcctataaatagcatcccctagtcgtcctctttcgtttgccccatctcccgagctctctcgtcgcccgtagagccgccgccgctagcatcgtcgccgctgccgtccgtcgccgccgtcgggtgcgcacggaggagaggaaccccgtccgccccttcgcagccgccgaagaccaccggagcaccatcgccgccgtcaagccgaaccgtgccgccattgaacctcgtcgccggccgtcgttcgtcgttgtccgtcgttgttctttgcaccggtgagttcgcgtcgtcgtcctctacgcgtaggtgtcctcggatagcccaaccgagccctcttttgccggtggtcgtgtcaactgtgccatggccggcgatgatgacgtcagcgatgacgtcataaatccctttttctaggttttctttattagatgaaaatcgattaaacttcataaattcataactaaatcatcgtaactcggatttgagtggttcaagttgctaattcatctaaaatcgagatcttcagttaaaaatatccacatgtactatttatgcttgtttttgtactgttttgttgattttgttcttttgctttagtttccgacatttcggaggagagcgttttcgttgaggaaggttcggaagcgtttggggaagctcaaggcaagtcacacagatcctaaacacaatcctttgagcatgttgatcctatatttaaattctctatttatttcaactgtttattaattttcgaatgtcaccgggtggtgtgaacctattcctttgttatggccaatttgcattgaatgccctattccttgataccttgggtaataaattgactagcttgaaccttgaaccttatgtattggtttggttcagctaaatgttatatatataattgcttagccatgcttagaaacattagctcactaatgggatgaatcatatatactacattattatttatggttatatttaatgatagctcacgatggttaatcgtgttatgataattaattagtaattaaaatatgattaatggtgggttgtgagcacatggttttgaaggtcgtgctcatgacaattaaagaccggttcgcgagctactgttgtgaaacattaaccgtaccaaccacaagccaacgtgggcaacggctttaccttttgtatagcattgttcattacggggtgccagacggagaagcggtgagaagtccgtggggatcgctggggagtccatgcctctggttatatttatagagagggtgattatgatccaggaatggtgcactgtggtgagttgtgttgtgcagggggtattgtcacagcctctattcgggtactttctagtatcgcaacgcatggtagacatgatgttgaggctgtgtcttgtgggtacagtggtacacctctggccagagtaaaactattcgaatagccgtgccagcggttatgagcgagttgagcaatgtttttcgtgattagtctcacacctctcacaaataattattgatgcaataactggtaataatttgtttagctcctggtttggagttagatctgtacagccgggtatggttgttcaggatggttgggcctgagcagcatgggtgtgctgttcagtgttgattaaaatttctgattaattactctactgttttacttttaaatctttgtaaatgctgcttttgcaaatgagcctatattatgccatcctttggtatccttgtgcacttgcatatttgctgtgtggcttattgagtatgtcatatgctcaccttgcaataatcaatcaacctcagttgaagagaaaggatccaggagtagacgtttggcttataccccagttgagctgcctgtgggagtggagctgaagccatcgctagaccgttaattccgctgctgtttttcttttcttttgtaagtatgtaacgttattattatgatggatttgtatattaaattgtcagtttgtgtacctcggctgattcctggacgaggattttatgtataaattagtttggaaattactagtaaatttccgggcgtgacaacgccggtgcaacatatcaaagggcaatgaatttgatcttccatgatttgctagggattatcttagatatctatattgatgatattgttgtcaaatcggatggtatggagggacatatagcctatttgaggttagcctttgagaggatgcgccggtatggtttgaagatgaacccacttaaatgtgcttttggtgtgtcggcggggaagttcttaggattcatggtgcatgagagaggagttgagattgatcctaagaagatagaaaaaattcgtgatttcaaatcaccgacatgcaaaaaggaagttcaaaagttgctaggaaaggtgaattatttgagaagatttatttctaatctagcgggtaaaatcgatgcttttgttcctatacttcgcttgagaaaggaagccgattttacttggggagcaaaacagcaagaggcgtttgaagggttgaaaaggtatttgtctactccacctgttgtgcgggtgcctaaagccagaaagccttttcggttatatattgcctccgaagacaaagtcattggtgccgttttgacgcaagaggaagatggcaaggagtatatttttacatatttgagccgccgtcttttggatgccgaaacaaggtatgtctttatagagagactttgtctatgcttgtaccaaattgaggcattatttgttatctagtacatgcatagttgcttgtcaagccgatgttattaaacacatgttgcaaaggccaattctaagtgggagaattggcaaatgggcatatgctttgatagaatatgatttggcttatgaaaaatttaaatctatgagaggctaaattgtatgtaattttatagtagaccatcatgtggatattgcttatgagggagaagtttgtattgttgaagttataccttggaatatttattttgatggttcctcttgcaaagaaggtcaaggcataggggtagtttcgttttcgcctaatggaatgtgttatgaagcatcggttcgcttggaatattattgtacaaataatcaagccgaatacaatgctttgttattcggcttacaagtcatggagatggttggagctaagcacgtggaagcttttggtgattcggaattggtggtgcaacaagtcgccggaatttataaatgcttggacggatcactaaataggtacctcgattcatgcttggatattattgccaattttgataattttgctattagacatattgctaggcatgataattctagagcaaatgatttggcacaacaagcatctggctataatgtgaagaagggattatttctggtattggaagatgtcacgaccggaattaacccaacgagcattccatacgttcgtatattattccttgtcccaggaggcaaggtacaccaaaagttgatacaattcagagtttaacaagcggaagcgtaaatagttaatttattacatgggcgacgaaggcccagcatacacgaagataaacggaaaactgcgaaagactagggcgatgaccacaggcacttgacggcaagcacgagctagacaccaaagccttcatcctccaggaactcttcttctgagttggggaaaaattgagcaagattgagtacaaccaccatactcaacaagacacacccatgaatgcagaataaatgcaaaggagtacaagggagttataataaaggggttagggtttgcagtaaacagcatttaaaagacttttagttgctctaggctatgttgtaaagacgatcctagagctacacaatgttattattcaaggccgtgaacccacacgaacctgccttaacccaaggcctacgatgatttagaccgaactggcaaccagacccaggtcccatctcgtcccaagccaacccaggccaaccattccacattttagttgttaggcatgttttaagaattaaaacactaacttgggtacattgctaggcttgcccataaccgagggcgcggctattcgaatagattgtactctgatcagaggtgtacaactttacccacaagacacgtcttccttacgtgtaaccacgtgccacataccaccatggcatacgggcggaagacgtgacatagttcccaacccatcctagccatagacaagagtaccgacccaaccctgcctacggccggaacccccgagacaggtaggcaggattgagccccaagcaacaggacatgggccctgtgccatgacatctcgactaccgggccacggctcgtgtagccttcatttgtcctagagatgtccatcgagctccgacttcgtccgtctccatccgtgtacttttgcccatgaccagactgagccacaaactaagtcttacccactagacatgtggaagtacggcagtgctttgcaacagaggcccgaagaccggtccttatagtggccaaggtgatactatcaaaaccatgcacctcgagcccagcctaaaaccagtttgagggttttgaataggggggggggaagtgtgtgtccaattccacataatccaaccattccataatgtccaaatgatatgagcattcccaaagtctaaggttataaaaccacctaatgttgcctaataagttagcgaagcagctagctaaattcatactagtggaaccatgaatagggtaccaactagttggggttttgtttatcctagggtgaacaaggtaataataataatagcaataataataaggtcataacaaaggtaaataggcatggctaaataagacagtgataacgcgggaatttaaataaagcgataatgcagtaatttaaaccaaaataattttataaactgggattcgatatgttcaagaatgatgtgacttgcctttctcgctttcccaaaagtctgttttaacctctacgtagagcggatcttccgaagctgcagcgtctacacgaccaatggaaagaaaaaggcttttactctaataaaatccatataacaagcagaaacaaagcacaaaaagggttcttgacttcttaaggaaaaattagagacttgaacggtccaattctgagttcaaacggccaagttatagcctgaagtttatatgctcttttaagtgaatatttgcgaatttcttcatttaaattttaattaaaaaatagggtttattgcgtcagccgaggggagggggcgcgcggaccgggtccacgggagtggtgggccccacgcggcagcccctcggtccacggtggaccgggtgcacccgcggctcaccagccggcgccgtgggccccactcgtcagccgcacccgagggcacgggcggctgacggccgggccccacgcggcggccacacggcgctcccggaggcggccacgtcggcgcggctggcgggaggcggcgcccgcgccctgtggtcgctggcggcggccataggcgcggcggagcggcggccgagagaagagaagggaaggggaaaggaggcggcggtccacggctcaccgcggggcgacggcggcgacggaggaggtggccggagtggagggaggcggtggcgcggctcgggttgacggggacagcggcgtccggcggtcggcgagctcggcgaggcggtagacgggatcggcggcggtgtggcgaagccggaggagacgacgccgaggcgggggacggtcccggcgagcggataggcccggccggaggtcgacggcgacggcgaagagagaggatgacagtgcgagctcgattccggcggggagatagggcggcgagtgtcggaaacggacgagggaggcgcggggagggtttatatagggttgggagtaaaaaggccggccggcggggaaggaaaccggcgcggggttcccggtcggcatcaatggcgccggcgagatttgcgggagcaaatcttgccatttgaacgtgggagagagaggggaaaatagggggaatgggagagggaatcacggggaatatttccccccacttaattgcacgcgggaacggtaaggagcggcgggattcgcggcggcggtggtgctaggtgcaggcggagcggcgggaggaaggggatgacgggtgggccccacccgtcagcgagggtggtgggcgggcccgcccgtcagcggcgcgcatgcggggagagagggggaggccgagtggcccggggagaggagagagagggggagggagttgggccggatttggcccagagagagggaaggagggttttagggtttttctttttataaaaccttttcaactttgtttatttcttgataattattatttgtgctctgaaaattccactaaaatttatttacacattttagtcttttaggaaatatacaaaaatcctccaagccttatttgacttttaacatggcacattttaatttttggaggctttcactaggattttaattattctaggcataatttaaaggatatattttagggtcgttttgggacgtgacagaagagccggtgcttaattttaaatctttgtgcgaaattggcaaaattggagaccagggccggtctgaccggcattgcacggccggtctgaccggtgaccaggggcggtctgaccggccacatgccgccggtctgaccggtgaccccgaacggtctggccggccttgtatggccggtctgaccggttttgggcagagcgctggggggcatgccataatcaatttagaggccaaattaactgtgaattcgaacatttgtgcccaggaaacagaggaggattggaggattcatttgattcgatatttgaaagatcccacacttaaggttgatcggaaaattcggtggcaagcgttcaaatatccattgcttgatgaagatgtatatcgccgaaatatagatggtgtcttgttgaagtgcctagatgaagatcagtctaaagtggctatggcagaggtacatgaaggaatttgtggaactcatcaatcagcccacaagatgaattggttgcttaggagagcggggttctattggccaaggatgattgagaattgcttcaaatactataggagatgtgaagcttgtcaacggttcggcaatgttcaattggcgcccgccgccgtgttaaaccctataatcaaaccatggccgttccgaggttgggctttggattttattggtcaaatttattcttcgtcatcaaaggggcataggttcgtgctagttgctacgaattacttcaccaagtgggccgaagccgtgcctctcaagaacatgactcatacggaggtaattgactttattttgaagcatattatccatagattcgatattccgcaaacattaactacggatcaaggtgcttcttttacgtctaaggaagtaaagagttttgccgaatcttatggtattaaattgttgagttcttctccttactacgctcaggctaatggacaagccgagtcgagtaataaaacattgttgaagctagtgaaaaagaagattgaggaacacccaaagaggtggcatgaggtgctttctgaagcattgtgggctcataggatatctaaacatggtgctactaaagtcactccttttgagttggtttatggtcaagaagtcgttttaccggttgaggtaaatcttggttctcttcgttatatcaagcaagatgatttgtcaagtgaagattaaaagatgttgatgggagacaaccttgatgaggtcatcgacaagcgcttgaaggctttggaagagatagagaaagagaagaagagggtggccaaggcgtataacaaaagggtgaaagcaaagttgtttcaagttggagacttggtttggaagacaattttgcctttgggtactcgatccagggagttcggtaagtggtctcctagttgggaaggtccttatcgagtatgcggtattgttcgagggaacgcatattttttggagacacttcgaggggagcgtttttagcgagcaatcaacgggaaatacttgaagaaatacttcccgagcgtttggcaagacgcttaggaggtactacggccggtaattgagttatcgtcctaagaccaaaaacatgttctatgtttttagattcacgttgttcatcaaaaaggcagggtgtttacacccaaatttggcacctaggattaaaataggaaatattgccaaaatttggaagtctaccggtttcctccgagtgggccggtctgaccgccttgtgttgggcggtcagaccgccggttgagggccggtcagattggcgttgtgtggccggtctgaccggcaggtctgagtccgactctgtttcgtcgggtttcgaggtttccttgctcgggaaggcatgtttcgggtttcctttgatttctaccccgagttggacgtggaggagggcctgtagagggcaagaccaacccctatataagggacatggccggttcattgtaaaaaaccaagctacaatcaatcaatcgaatcgttttttcatattgcttttagttttctcttagtttgtccatctttgtcggtttgcgccgtaaaccgtccgccgccgctgcgagagtgcgacatctctttgtaggtttgtcctgaaaaccttccgttctgcccacgagacgggtagctatctagaaaacggctccgctagtcggtttagttatcaaaacccatctaggtttagctttttgctagatcgaggtggttgacgactctaggatcaccgcaaggcataaggtgctacgatcgtgcttgtcaactcgtcacaaaagttgccaacacatatttgtttgtagattatatatatatatatattatatatatatatatatatatatatatatatatatagagagagagagagagaaagagagagagagacacacacacacgcgcgtcttaaggttttcgccgaccgcttcgcatgcttcaccgctggatggtccgtttttgctttaggcctaacttgctactatattaatgaaatgcgtaaagatatcgattccattcagtccatgctggatgaactcgactgatatagtgttagctatccatagttccataccatacccacacccttagtactagaaattaaccaaccgtttggttaatttctagtaatttaacgtggcatctgccagccgagcataacccatcggacataacaacgcttgctgttgtgtttttgtttactcatgtgcttgcttgtcggatactttgcatttcaattttctcttcttccaacagtccctaaatgtttgggactcattgccagccaccatgtactactagggcgcaaattatgaattatgtatttctactatgatgaggacgaacctctgctcaccaagctttagttgaatcatcagatatatcagttcaacttccaaacttaactttttagaaacagttataatctggctgtttgtacgaaattcaggaatactgtctccaccccaccccaggacatcacccttaaacactaccattggattgctctaaacatcacatttctgagcgataaaattaggagctctgctattcaattaagtaggagaagggataaacatcacattttgcacacgaccaatatccatctgaaacagttttcagtgcaacacgtacagtccaatcacaaataagtgacattcttttgaaaatagaacgtgggatgctaagagaaacttagcacctactcattgatagagaagaataacagcgagaaaacccatgcaccagacggggcgcgaacgtaggatggtccaggccatcccataagtgatactagtatatttgtttgaagatattccatattctgggggattcaacaacaaattctatattttgttgtgatgttaactcatgtccattcaatagaaggcaggggttaaaagaaaatcaccctgctcttctattctgctgtata

SEQ ID NO: 74126 - DNA, 56697 bp, Oryza sativa
agcgtgataccatcccgccataaagcaacacataccaacctgcaacatcggtcattcgtctcaacaaggacaaagaaacatagagaatgtccccagattgacaccatacatgcctccatgaggctagagcaactagaaaccacatatacaaggacgttcattcacaacttttcaactgaaacacctccagatttcttcctacagttcaagagaagaatgcgaggatggtatgaggaatatattgatagtttgaaaagtcaatttctgatcaagttagcatagctgtacctaatttcctattcttacatctgtcattcggtttaaaagcctacataaataatctcacttcaccttttgaacttcactgagaaatatttgagattgaaattgactgggaaatattttgaatccacttacaagtcaatgatatatagcatgtgttagttccgtggagcaagtcaagcaagcctttgtaatatcattggcaagtagtttgtcatgtgtagacagaatattgtcttgatttgttcttctaggaactgtttaggggaaaacacaattttagacttaaatatattttcaccagtgaaagaataatgaagtaagtactatacgaaccatgtttcttgcatgttttaaaaaagttattagcaaaatgcagacaaccccttagatttcaatgtatatcctcccaacgcaactacattagccgtatgatgtctagagtgtgtatgtagcacattatctaaaattattagttgtttcattctgtcaacatatgattcaacactaggatggtatgtaacaaaggcaactatttactaatctctagagttcatcccaaggacacatccttaaaaatttgaaagagatgctcgaaatgcaatgggtacaccggtccaaaccttgtagagaatataatgtaaatacctgtataatccctacatacagacctgcattaaatgacactgtagagacgtttactacagtaaatgcatcatgatgaaaaataatgttttggctagtaaaagccccattatagcacaacccttcacgatgtagtccagcaacatgcatcaacagcttctgaatattgtaggaggcaaaatataagaaagaccacgtcttggggtacaatgattccaacatcttaacgatctagatgtaatggaacagtatggtacaataatctgtcattaacattgatttttttttatcgaatgtcattcacctacagcaaaacacaatgttacaacgttatagacacgtataaataaagaaaattaacatcagttttaaatagataatactcactgtccgactctttctcggtaacgtatttcaatagttgagtttcgatgtaaagtatactccgacaatgatttatcatagtcaacagtgcataggtgtcttgagttttgactcctatcttttgacaagcaaaattgactagagaatcaacctttgtattatatttatatccacttgcacagatacactaacaccgcatgccttgacaaatagtgattgtagcccctgtaaaaaaatggcaaaagagcataaacaccagtatataacaacaaagaacgaatgagagattgaataaatcttgttaatacgatgaagtgcatcaataaaaaaaaagtggcgtacacattactctaagttgtttacatgttataatcatgtacagagattagtttcaatattgttaaaaattgaaaatctaagataattatgtatatacacattactaagatgaagtgcagcagtgcattcaaagaagtggagcacacattactctaagatgtttatagattataatcatgtatacatattagtttcatcatttctctctagattaaaaattaaaaatccaagataattgtggttagcttcagaaagaaaggaattacgtcatactgctttgtaactaaaccgtcagcccaaaaagtagacaaatttatgcatgacttgagaattagaggggatcttttttacctagacttgagcaagtaagaagatggcgcaggcacattttgcttcacatggacttccttcacctcctcctgcgtgttcctgtagttaagacaacccaaaggacagaatccgcaaaagagcataaagagtagcaaatagcaacaaagaacgaatgcaagcatgattccctcccaatgcgaagggctgcaccatcttcacccaaaattttgttagtaagacaaaaccctctataattgccaatgcattaagaaagaaaaagaaaagaagtagcagcatgtttgcattacacatgggaatagcatagtccattctcggtcgcatccaaaggcagatggcgagggaggtatattcgaacaagaaaggaagaagataggtatattatgggagggagcccttagtagatctaaggagacacacacagcagaaccaacaaacaccacggatgacgtgtacaagaaaaggtaccttcttcttgcatagcgtagagttgccggagaactccatccatacgagagctaacattgctacagccttactagctggcatacaacttggcgcgtgcgcttccgtccccctctccatcgccagctgagatttattctcacacccctacagtgttttcaggtgcttaaagtgacatgctcgcttgggggaaacgggagtagaagcacagctgcattccacactgccaccttaatctttaaagttgtcatgatttttataataaaggaattgtacccttgttaagttgcactagatgaatctgagagttcaaattagtttatttcatccctgaatgttcctttctccttttttttgtggatggctacttgcaatgctatacttatatttgacgcttccgcaatgcttatgttttagaggagttgctgtcaaaatttctccttcttcattaaatgtatttctatttagtagcatcccggtgtctttgtagtttctggggtgttacacatcacctcctacgtgttcctctgcggtcaagacaaagacaacccaaagaaaagaatcgacaaaagatcaaacaacggtagatagcaagcaagaatgaatgcgagattgatcacatcctgcaagtaaggcgaagtgcaacaatgcatcaaaaaacaagttgcatgtctgcacacttcaatcggagcccattctcggatgcgaagcgcatcctaaggcctggcggcgatgcacgcaatcactgtcttttggcgcaatttcattttcaaatcagacatagatttgctcttttttattctatgtgtgtggggtcaaattttcatttgattcttttttattttgtgtgaagtcctagacgacaacatcacctatgcacctgatttttcttttccagatttccaaattactttctagatgtgtattgtaacacttgagcggtgctctaggagggagcagtatccgtgatacattcttgtatgatggattgagtacgtgatacgtttgaggtttaggttgtgatggggaaatatgaagtgagaattctaacatagagtagatataagggtgcacacacggcagaacgaagaaacaccacggatgacagcgtaaaagaagaggtaccttcttcttgcacagagtagagtcgcccgagaacacatccatgcgggagtcggtgtcactgcagccttagcagctagcgggctcgtcaagtcaaagcagccactgctcaacgtcgagcttgcctttgcagccatcgccgccgcatccatgcagcccttggtagcttggtccacgtcgttgcggcaacaagcgcatgcgcttctgtccccctaaagcacatgtctaccgcaacaacaacatctttgtcaatgatgacacaaatgatgctcgcgttcagtggatcaagaacaccaattcgcagtgtgttccacagacctcctcatcccttcacctcgcagattcgaccaagcaccacctgatgctctagcgtccagctgctgccatcgtcgttaagggcaaatgagctgagcacgaaaggatccttctaaaacaactcgatgtagcgcaacctaccctcgctgaccaccaggcgccggtgcataccctgctcttgtattatatttgtgctgggctctaggcacacactgttcctcgggagctcaaaaaaaacgagctccagccggtcgttgaacgggtcggtggagacgatgtaccatgtcagatcgagccaccacagctatccaacgaactccaccgcctcgatgtacatgtttatctgccatgggagcgggagcggggatggtttgcaagaggaaccgccgcatgttgaaggctccactgttactgtcctcgcagagcacggtgacgacatagctgtcaggcggcccgtggccggcatcggagcaggtgaagaggctagtgttgcggcacccggggaacatggtgctccgcttggtgccttcgatgtccgggaggcggaacagctcgccggtgagcgggttgcagacggattgcatgtattctggttctgggtcaccgaggtggcttccgcgagtggcgccggtggcggcgacatgcttggagaggccgctttcccaagtagcacgggctatgaggtcggagacgacagaggccgggacgcgggcatccatgtagatgaggtggaggccattgccgcttgtgcgtagaccttgccgcttacgaaccccatggtgtcgcttgttggtggcctagctcacaagatcacgcactcacttattgtttacacactatagaaagagtctaacagatgaacataagaactctcacgcacaagcgctagatgtacgcacaagcaatattttgtggcgctgcgcaccagcgcgcagctaatgcactgtctattctccacaaacaatataactaaacggaatgcttacatgcttaattagccacacaataataaaacaataacttagccacgattggccgcacgacgcggccgagcattctcgtggctaagtacccactcactaacttatcgacatgcaagccacaattgcttgcatgcagatcaccactaacatatgcatgcatgctagctgatccacacttcacgccataactctcacttcacttgacttggccactcctccaaggcaacttgcactagctgcatgtaatcacttgcatgcagatcatagctatcactgatccaactaactcgcacatacacctatcaacttattctttctgacacacacatgattgagtacagctcgactacatgcactcacacgacaagaacacttaatcaacaagattaaacccaacaatcacctcctaatctagtttttattatcacctcctcgttcgtcatcacaccaatgttggctcatcatccgcgtcaactgtggcaagaaaagccatgtccttcttcggcttaggacactcatcagcgaaatgcccatactcttgacaattgtagcaatgaacttttgccttgtcgaatttgccgtggtacttcctcttgtcaccaccactgctgctgccggaaccacctccactcctcctctctttagcaaccttggcctcccactcagcacgcatcagtcgtggctcggcatatgcggcgaacagctgctgctccccctctttgtcacgacgcagcccctgtgaagagtcctcgaatgcccgcaggtgcccaattgtctttgtcaccatcatctctgacacatccccccattgctcaatggtgcttatgagggattaggacttctcgggaacagaatgtaggagcttctccacgacggtggtctcctccactttcacgccaagagagtgaatctcgttcatgatcgtggtaacctttaaagcaaaatcattaattttctcagaattacccattttcataccatcaagctcgctcttaagggtttgtactcaggccttcttgatactctcttcacccatgttcatcaacttgagggcgtctcacgctgccttcgccgtctccttctcaaatatggtcatcaccacggcctccggcatagcttgtacaatggcggtgagagccatttggtccatcttctcatcggccgtgttgccctccacagcagcccacacgccttgtgcgcgcatgaaaattttcattttcactgcccaaacgccgtagttgttctcctcgagcatggggtaacatagcgtcaacctgttgacgaccaaatttggtaagatatgaaccaggttcgacattggaatcgaagcggattcggtagaaagatagattcgaagaacaaagcatgcatcggctgcgaaggcatcggctggagtcttgtcacagcctgattttccgtttcaagatttataaattatttaataaattattaatagaatttatattagatgttgattaatttacaagtgaagttaaatgtaggaaataaaatttcctaaacataaagcatggctggatttaatttttattaaattctccatgattaactatactctctgaaattttctcggatttttcagagctcaattcctaattttaataatacaaagaacaattcagtaattagttaatcaataaattaatcattaaatggtctggttttaatattgttaaatactttgagtgtccaagtatgttgaagatttttcttggaattatttgagcattggaagtatttttaacaattcaaagatcatctcatgggttaatttatttggaaaagtaataataatcctcttcctagtcttgggcccttttcagcccattccctccttctctctcccttcctctcagcccgcagaaaagtctgtttttcttccctctcgctacagtgttgtcttcaacccctggacagagccgactgtctccagcccgtgcacagtttccgccgatctcctcccaccaaatccgacctccctgttgctcctttttccaaattagttgtgggaatggaatcctcacaatctcctcttcattttccccgagaaatccccaaaagtttctatggaaatcctttccaatttcgcggatcaatctttcctttttccggcgaagatcctaaactttcgcccgagtttttcccgtcgatgtgggcttgatcccgagctcccgtgcctatataaaggaccccctagtcgtcctctacctatccccttaagtcccgtccgccgccgtcgccggaaacgctctccccgcgctcgccttctctctccacctccggccgccgctccagccgccgtgcgccgtcgcctaggccgtcgccctcctgcgccaccacctccatcggctccgcaaggtcgatctctaccccgtccaccggttcccctccgccaagtctcgctggaagtcgctgtcaccgtgaaggccgagttcgccgcctcggtttgatctccggccgagcctcctcgctgttgcggtcgtcgccggttcacccagaggccgtcgtcggcatcgcagcgccaagccgaagcccgtacacccctctgttgccgccgctcgtcaccagaaagccgtcgctgttgttgacccgtacctcgccgtcgtcccgatctcgtcgccagccatcttcttcgccgttcatcgctgtgtaagtgttggtaagcatcgccgttgcctcctcttcctcccggtgcctagaggtggccaaacgggccgggccaaaacgggcggcccgaggcacggcggaacctgtagccggcacggcccggcacggcctgctacagtaacgggccgtgccggcacggcacgagtagccgtgccgtgcttgggccgccggccgagcccgcgggccggcacggcacggcacggctactgtagtaagtccgcatctcatccttccgcaagtccgtatctcatccctcccaactgacggcccagcccgctagccgcctccgcaagtccgttgagcacccctcctagctgatggcccagcctgccagccacctccgcaagtccgcatcacatccctccgcgccatttcggttcctgggccaaccgtgccccgtccacggcccatttttcattcacgggcccgtactgacacggcgggccacacgcatgccgtgccggcacgggcacggcccggccatccacgggccgtgcttgggccggcggctcggcacgtgggtcgggacggcacggcccgtttcatgagccgtgcctaacgggccgtgccgaaacgggccgtgccggacccgtgcccgtgccgtgccgggccgggccgcccgtttggccacctctaccggttattgtgccgtggttcgcgggcaaccgccgctcctatgtcgttcaccggtatagtttatccctagggtcttaatcccatctaatcgaatcttgtttggccctagcgtcgtcatcgtcttcgtgtgttgtcgccggaccgtcatcgtcgaccctttctctccgatcgctttggttcagtgagacttctatccattctctcttttcagtggcatattatgtttttttatatatgttatctactaaatatgattcaatctatttccggaggttgttttaatattttatctcagttataaatcatttgtaaatggtttaattaatttagaatagtcttttctttaataggtttaattggaattaaatcttgtaaaattcgtaactaattcatatgaagtcggaatgaggccgttcaagtctcataattcatctaaaatcatgatctacatgtttgtttactttacatgtactgtttatttggtttttattagtctttttcctcattttacatgttagcttgtcgtttccgtcgtttcgaagattcgtgagtgcgtcagaagtattcaagaagattaattgaagaccctttattgcaaggcaagtcacacagatcccaaacacaattcctttgagcatgttaatcatatatttaaattctctatttattttaactgtgcatttattttcgaatgtcactgggtggtgtgaacctattcctttgttatggccaatttgcattgattaccctatttcttgattaccttgggttataatttgactaattggatttatatattggttcaactagatatattagatataattgcttagccatgcttagaaacattagcacactattgggataactaatgtttcactgttacttaatgatgtacatggtaaaggtagctcacgatggtcaatcgtgattggttaattaattaatttgacaactaaaacttgataatggtgggttgtgagcacatggttttgatggtcgtgctcattgcaattaaggaccggttcacgagattcagttgtgaaacattaaccgtgccaaccacaagccagagtgggcaacggctggacactttgtatagcaaggctcattgtggtgtgccagactgagaagtggcggagataagcccacgggggtcgctggggagtccatgccttgttttataagggggtaattatgatccaggaacggtgcactgctttgagttgagttatgcgaggggtcttgtcacaatcactcgccatggtgacgtgtccgcgcggcacggtgacatgacggtgggttgtgtcttgtgggtacagtggtacacctctggccagagtaaaactattcgaatagccgtgcccgtggttatgggcgggtctaacaatgtctttcgtgattagtctcacacttctcaccataataaatgatgctataactggtaataatttgattagctcttggtttagaatggtacattcctggtttggagatagatctgtacagccgggtatggttgttcaggatggttgggcctgtgtagcatgggtgtgctgttcagtgttgattaaaacttttaaatgtttgctaaatgctgcttttgcaaatgagtttatattatgccatcctttggtatccttgtgcacttgcatatttgttgtgtggcttgttgagtatgtcatatgctcaccttgcaataatcaatcaaacctcagttgaaaacaagttgcgaaggagaagacgtttggcttataccctagttgagctgcccgtgggagtggagctagagcttcgctagatcgttttttcgctgcagttttcttttcttttgtaagtatgtaacgttgtattattgatgattttgtatattaaattgttagtttgtgtacctcggctgattcttggacgaggattgaatgcacaaataagtttggatcggacagaggacagtcgatacagccgatagaggtgatgcagccgattccgatgatgacggtttcaaagatgtttctataatcgatcaaggtgcatcacaaggattgccatgatggagataaagctctcggataggcaattgtatctattaattaggatatttcatgtaatttctttagagatatgtttgggcaaaagtgtcggagcccaaaactaacaacttggatccgactagaattaatgtatcaatccctggatcagtaaatattgatacatacaatataactggttctttgttgcgaacgttaaagttttacaatactaagtgttttacaataataggtactcacctaactaattaatacacagcggaagtttctatacattatgactagggaggtataacctttagggattctctaagttatccgggtcatcgtagtaatagtcataagggtcctcctcttgacccaaatctgaaaaaggggttataagagcaaggatgagtatttacaatactcagcaagttatcatgggaatatgttatgcattgacatatagtagggttctttgcaaaaagtagtactagacaatctagaagagttatagcaagaatttataaaacatatagactttagatttctaaccagggtaccatatgagtcccggtactcaattccatgagtacggctattcggatagtttcaaagatattctactgcagcagatgtacgctttacccgcagtccacgacttgctgataatcatcagctttagtcatggcccagtattaagtcattaacaattgtggcacctgttccatgaacttatatcctcatatgctctgaacgtattgttaatagcagcaagaggagttctggcgttcccgagatatttaaggggaactgatcgtatgacaccatgtcatctcgatcagggtttagaaatataccatatagtttatactcgagtatcacaaaccatttacctgtacatggtaatggttaaagttgcccttcgcggctatagttgcctcctgcgcgaggacttaaaaataagaaccactatacagaggtgccatattgctaattaacataataacaaggtctgtccccattctagaaactgcggtcgtactcgttcgttcgacataagtacctggtaaaacttatatcgattgagacagtactagccacccggaaatcaaccaaatcttacgtactgtcccaatctaagtataaggtattttaaccagattgtaagcaaagtaagcaatactaaattatatgggtttctatgattgatttatgcatagaaaatagaatattgaatagaaggctataaataaataatttataaaatataggcttaaatgatcaacaggtatatggtaacttgccttgctcgatgtcttgagattgattgatattatctattgagtcaaaagaatcctcaagacctagggttagacatatataaaattcaaatttaaaaggaaatcaaataaaatccaaaaatatgaaaaatggagaaaataaaataaaatgcaaaaatagcaaaaaggggctcaaaagatagagaatgattttagtagaatattggtccaagtttcactggaattggatctatattttaaaagatatgggcttctaaagtttgaaaatcaaataaatgtgaaatggcactatgtgcgggtcccacctgtcagtctctctctctcctcttcttctacctccggccattccccaaatcggaccggcggtgctagggtttgggattacggcggcgatggagggggaaagtggttgtggccgaagaggggagggagctagggttctctggtgacggcgagtggcggcggaggggttaatttgatatgtggatgggttagcggctagggcggcggtggcacggttaggccgtaatggtgatcaaggtgatatgagttagacatggctaggggaggggttctagagcatctacgaggtgtctagagggattccggcagcttgccatcctttggcaagacgcggagaatagttgccgacgagcgcctccataggcggcggccgtgttcacgtcggcagcccagagggtggcaagatagtgcaaagggattgctaaaatggaatctaggtagtatgtagatggttgaaacggaagaactcaccgagatcggttgaaatggcggattacggccggaaaaacttctcggcggcgaagaacagagcagcacgggggcagcggtgctcggcttggcgcggcgaggtaaaactcgacgcagagcttcggttagggcttagtatactagaacatggtaggatataggtgttctaaggggtaattagggcggaggatggatggaggggtgtgaagtcgatcgcgcacaaggtgttcgaccgacgggcgatggtgattgatagaatggattggggaagcagagcttcggggttggggggttatggttgttgatgatcgatgatggacaaggaagggattggggtcctatttatagggctaggaggagcggatgagctcgggcaccgtcatcgccatggatgagctcgggatttggatatggctagggcggcagaggctgtgagagggcgggcaagatcaatttgagtggcgggaggccacgtttgaatacttaccggcgaaggattggcttgaccgcgtgcgaattcggctggcgacgtgttggcgccaatccgggcgcaacgcgcggcggcagcgaaggtgaaaacggccgactcgggggtgaatggtttgaattgtgagaggggataccaccgtctatcttcaatccaaccgtgcggcaagaattggtgcgattcaccccggatagaatcaaaatcggactcggcggcggctttggtcgggcgcgcacggcgtcgagctgcaatttcttgcggcggtcgtcgtcccggctttgtcgtcgtcaagattggtgcggcggtggtggtctgagggcatcgaacggctagcggtgcgccaaggcgattgggcacgcgcgatcgatcccgagaccgacgcgcggtggctcggcgcgcggcaaagtcagatgcccgggcggcgcgcgtgaaggggaggaagaagcaaagaaatccacggtttttgagtggggtatggtcccctaggatcaaatatagactttgcaaaggattgggtaggaattaggctgtgttagatgggctagacattttgccgaacaccttgagggcaatgaacagtaaaatccaggaattttgaatattttccctaaaaagatttgaatttaaactatgattttggaaggttttcactaaggtttgaagtgaagcatatccttactaatattagggtaagctaagaaaataatctctagtttgaaatttgagagaatttgctcaaatttactaaggtttggaataaagggaataattagagtaaattagtagggttctaaagaagtattacgtgaaccaatcaaatagatttttaaaacacactaatttaatcaaaagccagcatgatgcaatcaaattttagtttaaaatttgagattgttacaaaaaagtctgccgcaaagacttatggtatcttagagtttgttagagataagtatcgtgtctggcaaggacatatcttgtatctcaggtataaataggacccgaacccatgtaattaattaacaatcattcaatacaatctcgatgcatcgccaccctttttactttcgtttatttcgacgagttcttgctttcgggttgagctgcatcggtttcaatcttctactagaggtaaaacttgttatggcggcttgtgttctcgtggttaatgcttccatctttacggcactttaaccctgtttatgtaattcattgagttatcatatacacgacacaatctatattagttgcgctatataacttattatcggctggttcttatttttaggaagcaattggtagagttatgttttgttattaatctagattgtatcgtgtatctaccatctcttgtaggttttcatcatcctgcctagatctcatacttgtctttatgcttaatgctgcatcggttgagttcgatctattaagtagtatttataattataatatctggcttattttatgatcattgagagatatagtatcggggtttcagccgatcttacctgatttagctttatgtcccatatgcttaattgatatgctaaatctgccctttatattaatatcttgttgcaataaagtgtattagacttctatcatgatatgttctatctgttttaatatcttaatatagagtggtatcggagtactagccgatacatgctagatctatctgatcggctatgctataagcgcttataatctttatgttaatgtatacttcgatctaagtgatttatactgtctcggcatgacgaccgatctatcccaatcactttgtttaaatatacatcgacagaaggattatatagcgttaatatctacagtcgatcgagtagatttagtcttatcttgcttatttataactgccgatcgattcacatatgacatcggcttgaaaataaatgatacgtcatcggcgactggccgatcagctatcatttatggatttaaccgcgatttttcttgtctttgtttcttgttgattgcaggatcaaatcaactggcacgctcatgaacctaaaagcaagattttggacctgcactgaagttaagcagatcttctaggccagtgtgtgtttttcgcgtcaacacaacccaacctccttcacttgttgcacaacgagctcatggccacctagggcactaccgctgccgctaccgctgcagtgacagattggcggcggcgtgtacactccatcgctggacatgacagcaataacccacctccaatctgataccactgttggtggcccagctcacaagagcacgcactcacttagttgtttacacattgaagaaagaggctaacagatgaacataagaactctcacgcacaagctctagatgcacgcataagtaatattttgtggcgtaatgcattgtctattctccacacacaacacaatgcttacatgcttaattagccacacactaattaagcaatggctcagccacgattggccgcacgaccgaccgagcaatctcgtggctagctacccactcactaacttatctagtattgccattttccggctcaaattgcgtcgcctagctcgtgacctgagaagatggagccgcttccaggtcggggacatcaaactccagcttgcagtagcgttcgaagtaatcttccaactggaagtagctcaggaatcaaggctgctctctgccgaagaacaacatctgttgtcaggcctcaaaacaaaagtcttaggccttgcggtgctcaataaattgaggctaagacagtgcttgagattaacttggcttaaagaaggtgatgttaattccaaattcttccacattaaagcaaacacaagaagaaggaaaaactacattcattcgcttcaaaccccgtcaggagtggctgtttcggcacaaaataaggaagaagaactttttagatttttcaaggaaagattggggaccaatttccaaagaactttaagcctaaattggtctctattacaattaccttcgttggaccttaatgagctagacgaagatattacggaggaagaattaaaatccataattttcgatttgccccctgaaaaggcgcctggtcccgatggcttcattggggcatttttcaaaaccgcttggcccacggtgaaagatgatctcctcgcagcaattttatcctttatgcatctcaacacttctcaacttgcagaactgaactctgcctttatttgccttatccctaaaaaagatgatgctacaggcgctgatcacttccgtcccattagcctcatgcatagcttcgccaagattatcaccaaaattctggcaaatagacttgctcctcggctaaatgaaatgatctcacaaaatcaaagtgcttttgttcgtaaaagggcgattcatgacaattttctgtacgtccaaaacatggtgcagatgcttcatagatcaaaaaaacagagtctattcattaagatagacatagcaaaggcgttcgacactgtgaattggccatatctcctgaaggtccttcgtcatttcggctttgggcatcgttggttaagttggatttctaatctgatttccacctcctcgtcccaagtgctcctaaatggttccctagggatgagaattaatcatgctaggggactccgtcagggagatcccctgtccccgatgctgtttattttagctatggagccttttcaccggatcattaaagcagcggagagtgccaatgtgttagccccgattggcgtgagaagtggcagattcagatgttctctctacgcggatgatgtcgcggtttttgctctcccaaatcccgatgacctgaatgctctttctcgcatcgtttcgtgtgttgcacaaatttctggtttacattctaacatcaacaaaactgagattttccccatcagttgtaatggaatcgacatgcaacagcttcttgccggctggccagggcagatcaagaatttcccttgccgctacctaggtctccagctccacttcaggaaattaaggaaaattgatttccttcctcttatagacaagatcggggccagactaccagcttggaaaggtcgcttctttacctctgcaggtcatcaaaccctagttaactcggttttgagtgctatgccgatgcatcatcttacagtccttcatgcgccaaaatgggtcttcaaaagaatcgaccgtttcaaaagatcttttctatggaagggcgaagaccctgatcattcaaatccaagtgatagtctagtcaattggcaaactgtttgcaaaccgaaaagcttaggagggttaggcctaccggatctggacaggttctctagagcactctgactccgctggctctggttcaagtggaaagaatttgataaaccctgggtaggcatgaatgtgccttgcgatgagatggacacaatactctttcaagcggcaacgacaataatgattggtgacggagcaaaaactagcttctggcatgataattggatccaaaaccattgtttaaaagatattgtgcctagttgttttagcatggcaaagagaaagcaaagaacaattcagatggaaatgcgagataatagatggctcactttcttcagacaattcacttccgtgaaacaaattcatgatttggtacagcttggtggattactccaattggtttcactttcccaggatcctgacgacatcacctggaattggaccgagtctggcgtctacacaacaaagagtgcttaccttttccagttcgaaggctcatttgccaccaatgagtttgattctctatggaaatccccgactgaaccaaaaataaaattctttggttggctagttctccatcaaaaaactttgactgcccaaaatctgctccgtaggcattggccttgcaattggatatgttgcctttgtggttgtgtcttcgaagatacaaatcatttgttcagtgactgtgtgtttgtcagacaagtgtggaccctaatttgtcaattccaaaacttgtcttcggtcggaataaatcctgtcttggatgtgtcaacatggtagtctggaaccaaatttgcaggctctaagaaggatgtgcagctggtcaggggaactcttctaactatctggtggcatatttggttggaaagaaatagaagaattttccaaaagtcttcctgttcagagattgaagtagcttattttatcaagcaagctattgatatgcgctgcttggcctttaaacccccatgaattttttagcttttcctgcagttgtaattctctttccattccttggcttgtaacctctgaacctctgtgctactttgtatttttttctcttctaatgttaaattccggcagatctcctgccgtcgttctcctccaaaaaaaaaaaacaattgcttgcatgcagatcaccactaacacatgcatgcatgctagctgatccacacttcacgccatgactctcacttcacttgacttggccgctcctccaaggcaacgtgcactagctgcatgtaatcacttgcatgcaagtcatagctatcaccgatcgaactaattcacacatatatttatcaacttactctctctcacatacacatgactgagtacagctctactacatgcactcacacgacaagaacacataatcaacaagattaaacccaacaatcacctcctaatcttgttgtttttatttgagcccctcctcgttggtcatcacaacaaagttggctcatcatccatgtcaattgtagcaacaaccttttttccttgtaaaatttgccgtggtacttcttcttaccactgttgttgctgctggagccaaccccactcctcctctctcagcaaccttggcctcccactcagcacgcgttagccaaaaatcataaatggcccatcagccatgagctaccatccactaatggaaaagggataagtttactcttggtgtcttattttgtcgctgagtctggaattcgtctctaaaccacacaataccagatataatgcgtccctcaacttccaaaatcggtgcaaataaggtttcccaagtcggtttggacggcgggacgtggttcctgcatggcacttaaagtcaaaaaaaaactatatgatccacatgttaataggacccacgtcatcacccccatttctttcccctcttctctcccttcctcctctccgtcgtcgacgcaccccctctcttcgccctcttctatccctccctcggctgtgagcctaggatcgcggggaggagcagaggcggccgggcgaaggaggcgggagtggggaaggccacgcagagctaggcgcaatgggagctcgaccatggccgtgcaaagcgacacaggagcggaggaggttggacggcaatgaaacggtgagtaaagaggaaaccgagtggggcaaggcgaagaggaggaggcccacaacggcgaggtgatggtggtccagcccgggtagatccctccgcggacgtgagaagaagaagtggagttcactggtgaggtcgccgttgggctttgggctcggccttccccatgctcccctacatcacccatcccctccccgctcaccagcagcccagtcagagtcgtcgcgcttggcgacttcctcctatgtctatcttaggaagcagcccgcccacagcgggaggcctgctacgcccatgctatagtcgtccgctgcagcgtttgggccgggcatggagctcattggtgacttcctctgtgtgttgctctgccaccggccgacctcagctccatcattcctgtctctgccgcgacgtcgcctaccactacatgggagagagtgtaaagaaagatagggagggagagaaagagggtgccaggtgggacctgtatttttttttcacgcaatgacatgcaaagcaccatgtagacgccacatgcaacaaagaccaagttaaagcaccacataggataaagagaaaattccctatatacccctgaaaatttactcaatcccttcaatacccctgaatttgacattatcccttatatacccctgagttttcattttgatctcctctatacccatctccgttagttgaccattagttgaccgttaaatattttaaaatgactatattacccatattatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaacttttttttacaataaatctttttttattttaatgaaataatgttttattttcaaaaattcataacaaatatttagtaatttattccttattggttttcacaactcaaataatttacacataaaacatttctagcttttaacaatataacaaggacaataaaagtaatttctacaataactaacggtcaaactaatggtcaactaacggaatgggtatataagggatccaaataaaaactcaggggtatataagagatcaaacaaatttcaggggcgtagaagggattgggtgaaattacatgggcatatagggaattggccctaggataaaatcattgttccaaactgcccaggaacctgatttgttctggttttgatagttggcctatgttatgtcgcaagttttgttgctaagggatggtaataaaattcgacctatagttgagggacataaaatggaccttattgtcttacagatttcttgttacaatgggccttgaggtttaggggaaatagcccatcgacggtgggccacatagctagaattttggcgggaaaactagtgactgggtggcaactggtcgtccaaaaatatctcaatacggtctgacatgtggacccccaaaagaagaaaagctctgagcacagatgggtgcaccaagtccacgtacaccgagtgtcacgggttcacgacccccgctgcagaagaccgggcgctccgtggaacgagtccacgcccgcccagctccttccttctgcgctacggctgtcagagctctactacctccgtgaacctggctcaccgtgaaccagcaacccataccacctcctcggcttctcctctccggcttctcgcttccctttcccacagttcgcttcgccggcctcctccgccgcgcagaatgcgtctcccgctccgccgcgcgctctcccccgcggcagttcggcgcgccttctccacggccgccgcctcgcgccctcagtgggcgatgatccgccaggcgccgccggtcagatctccgtcgccgcacgcgtccctcctgctcgccgagcccccgcgcgactcctacctcctcgtgccggaccacctcatcgaccggcgtccgggccccgaccccagcagcgacatccgggggatcctaggcggcacggtccacgccacgagcggcgacggcggcctcctcctcgtcgtctacatggactcccacgccccggcccccatcatctccaagatcgtcaccggcgcctttcctgctcggcctcgggtcagcgatctcgccggcctcgacttgagcgacccagacttcatccgtttcgtctgcaaccccatcaccggcgagctgttccgcctcccggacatcgacggcaccaagaagaccatgttccgcggctgcgacaacgccggcctcctcacccgctccgcagccggagccgggcacggctcgcctgacagctacgccgtcgccgtgctcggcgaggaccgcaacggcgggaccttcaacatgcggcggttcctctcgcgaaccgggaagtgggagaagctagtgggcttaccatccccgctcccgctcacgcggcggatggacatgtacaccgaggcggtggcgttcgccggacggctatggtgggccgacctgacttggggcgtcgtctccgccgacccgttcagcgactggccggagctccacttcgtcgagctcccgaggaacagtgtgtggccagtgcccagcacagatcttgtacaagagcaggctatgcaccggcgtctgggaatcagcgaggggaggctgcgctacgtcgaggtgtcccaggaggatcctttcgtggtcagctcatttgcccttgacgacgacggcagcggctggacgctggagcacgaggtggcgcttggtcgaatctgccaggtgaagggaggaggcccgagggacaccgcgcggattgccgtcattgacccactgaacgcaagcgtcatgtatctgatcgttggcaaacatgttcttggtgttgatatggacatggggaaggtgatgggttgttcactggcagatgaaactgaaggccctccatatgctatcacctctgtccttaaaccatgtgtgctcccaccatggctttcatcaagcaaaatccctgctgcaggtaatcatgatcttccacatattcatgtcttgtttaagatgatatgtggttagggatagtagaattgttagatctgtagtacttattttccatgttctcttatattaaattatgtggttagttaggggcttgtgcttaggagtttgttttgttctatatatggctcatctcgtatgactgtttagaaacctcgaactcaaaaagggtggactaattgtagctgtctgtaatgtacatattataatatagcattttggtagtcttggcaaatgattgtgctaagccactaaccgatagcctatgaatattagcagtgtagtcatgaataacgtctttgaatatttcctcaaaaactaaaatttcagaatagaatattggtattagtaagcaaatccacatttctgttttaagtacatttgttataagaatgacatgctcttggtgtctaataaacctcaatagatgcaataatgtacaaaaatgtgagcttctacttttctttttctggcataatttttcatgtcctttcaattgaaggaactttttcacgcgacaatggtgacgccaaaagcaagactttatcagacatattggttcgtgcagacagcgacaagaggtgaagaaaattatttacttgtgtactctcctttggtacttatataattcaccatctatttccttatcaaacagttaagaaaccatgttagcaaatactagttaagaagtgctaattttctgttgaccatgataaccttgtttacagtgaaattggcacttctgttttaagcaaatgaacgatattatctgcgatcatgtaatataacgtcagaatttagatggggaagcacctttggtatggtggtggagttgtggattgcacccacccggttcaaattctggtgttgtacgtttgcatcctttgttgatgtagaggccagactttatttctattttctaaaaaataaaaactttagtgtcttgaccttgcttcagttgtacatatttgtagttgccagatggtagttcttactcaatacaaagtttgctttcgtccagtaaatcttattttgtagtaaaacctaaacaaatcttattcagatttctagttgtcttgttattgtctatattgcttagtatacccttcttgataagtgattatatcacaataaagaaactgtatatagaaaatcaacatttagtgtgttttaagaggaaaaaaaaaggaaacgggcatataatacaatgtcatcattcctgtttacttgctataattaatcaagaaaatttgcttcttcctccgctcatttttcttcatatgatcaattagatgtcatctatcatctctgaaatttaacagttgaaaatgtccttggtggactaggaagcgctatttcattttcagataggatatattaggatgtcaatgctgctgcaatcttgaactctcgttttgggggaaatgttggctgaagactgatgttatgatcttcacaatggtatcacacagaattgtgcttcacttaattgcttctgttacgctcattttttagtaggataacacagttctgttggcaagcgaccatagtcaggactcaagaacatagatgaagagcatcatcattttttgagtcatgacagaatagtttataagatggatttgtttagttgataatagttgagcaactgttgcctcttctgcagtcttaagggtagaggtagactacatcactacactaaaaattatcacaatcatgttctactcttgagtcttgaccttgcatcagtgtgcagattatagctttttttctgaacagcattgcatgacttacttgtatactccaaattaggctaatacaggtaccaaattaccaagtataaaagccttaaaagtgtttggtcttgtcatcattatgatttattttcatcaaatagatcattatgattattgtctcacataatattatggacaactaattaagagctttctatttgtgacacatgatcttgttctgatatttttcctgggatcaataaatttatagaaagtaataagcatatcatattcattgctttaaataaaatacaaagaggttataggggactatggaggtatttctgctggcttgtgtgtatacagtatactgaacaagcagacattattaagtgcacactagcactgtataagagctttcccagcattgttgtcatcatgctgagcaattgtcattctttagtcctaaaatatcatgaactatcagactaaaatgaagcttgctatttcataacaaggatcatggtgtaaccttctgccgaatcaagggatgaatatcaaacaatagatatgtactgtaatactctgctgaatcaggacaccaataaaacataaaacactactccctccgtactcataaaggaagtcatttaggacaatgtttaagtcaaaccttgggaatataaatcgtaaataactctcaagttgttgagtttgaaaatgtaaaaattatatgaatagatttgtcttgaaaaatactttcataaaagtatacatatatcacttttttcaataaatatttttatagaaacaaaagtcaaagttgtgttttggagaccgtgtcactgtcctaaacgacttcctttatgagtatggagggagtatctttcaatttttgtgagtaaaacggactacatggattgtcgtagtttcctgttttcttgcgtttatattgaacactgtaaattgtatttttgtataccagtagttctcttcatataattattgacatgcatcctaatgttttctatttgatccaggttatgtaaagacgaactgacaggtgttttaatagaaagctaatgaatggtagcttggagaagtctcgttttgggtaacttggagaattatttgagtgtgttggccctctcagtttacctgctgtcttattttgtgagaaaccgttactgtttcatgttttctttttttggtggacggtttgtgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccttcctatatataaggggggtccggtgcctctaggggcatgtgttgattctctccaaatcatacaatcaataagatactcggcggattcatccccggacaggagtaggttattacttcttgaataagaaggcctgaacctgtataaatcttttgtctccaaacccattcacttctccagcttgatagccacccccttttattattgccgaaatctagtttcgacagttggcgcgccaggtaggggtccgtcaagcttttcgccgatcagtgcaatgggttccgtctccggcatcgacgacctcgtcttcccacccgggcagacgtttcggttcggcagcctcgacttcgtcaccaacaacttcggcaagatctctctccttgactcggagtcagaccagtcgggagagaaccggatttcagtcccgtttggactcccaaacgcggctgaaagttacttcaagaccatctcaatcgagttggcttcaaaccactcgggcgagatcgcatcttctccaatgtcaccagatcaagatgatgaggcttacccaccgatcctgatgaagctccccaacgatttggcggccgtctccatcacgacagcgtctccatcccgtaggcctaggcggaagtcggcttcaacaccgatttcgcctagcttcagggaagtcggcgtcatcctccaaccactcggcacggtttcgacggatcagctggatggctactacagctctcccaccgtcgactcgcgtcccaccgacatcgtagagtacgacgagtttagctctcgctacaacgacgcggatctcgacgacttcgacggaagcctagatgacaactacacccctctctacttcggcgtcttcatggccgataacgagacggaggagcaacgccaagcccgggaaaccgaagcacgtcgcgagactgagcgtcgccgactggaggaggagcgtcaagcacaagaacaagaacggctacggcgtgagcagcaggagcgtgagcgaaccgcgaaggaggctgagggccgacggcagcgagccttggaagcaggccgccgagcgcgtgatttcatcggccaacaagatgttgaagggacaccggttttccgcacccctcaacagaacgcggttgccgcgatcaccctcctcaacaccctcctcaaggaaaacgagctcaatcaatctgatcacgtcgtcaacatcttgaaccagacaaagaccatgattgcggcttcggtcccagttaactccgaaagcgtccgcacgccgactggcagccgactcccccacttccgatctcatgactaccgtcgtccaagtctcagcatcactggcgcaggatccaatcgcaggagcaggggtcacgacgagcggtccgttcactcgcctcccgaccatcatagggagcgccgagtggaacggcctcgctcaccacctcgtcgccgccccgtcgatcttcgcgacacaatcatacagcgccaagcagctcgaggccatcatcattcgccggaccgccacgacgacgaccttgatggagtagcagccttcaccgacgacctgcgtcgagtggattggccagccggcttcaagccgactggaatagagaagtacgacggcaccaccaacccagaatcatggcttaccgtctacggtctcgcgatccgcgcagcaggaggagatagcaaggccatggcgaactatttaccagtagctttagcggattccacccgatcttggctccatggattgccccgtggtacgattggatcttgggccgaattacgcgaccacttcatcgccaacttccaaggcaccttcgagcgtcccggcacacaattcgacctctacaacgttgttcagaagtccggagaatcccttcgagattacatccggcgattttctgaacaacgtaacaagatctccgacatcaccgacgacgttatcatcgccgcattcaccaaagggattcgccacgaagaattggtcggcaagttcgggcgtaaacctcccaggacagtcaaacttatgtttgaaaaagccaacgagtacgccaaagccgaagacgccgtcaccgcatcaaagcagtcgggtcccagttggaagccaaaaaaggatacgccggctacgggaggaggtggaagtaacaatcataaggaccgcaagcgtaagcctgaggaacttgttgcaaccgccattcactcttctcgacagcgttcgcgcgtcaacacgttcgacaagatcatgaactcccaatgcccgcaccatcctaactccaaccacgtggccaaagactgtttcgtctacaagcaattcgcggagcaatacaccaagactacacggaagaactccgacgaagaacaaagcacgtcgaggaagaaggacgacggcgacaccccggtaggatttcaagaccaccgcaaggagctcaaccatatcttcggcggccccctggcttatgagtctaaaaggaagcaaaagttgaccgaacgggagatcaatgctgttcagcctgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccttggatgatatgcagattcctcgctccgagctaaaaccaagcaatgcgccttttcacggagtaattccaggattatccgcaactccactcggccagatcaccctcccggtcacttttggcactcgggaaaacttccgcacagagaatatcagctttgaagtcgccgatttcgagacagcataccatgccatactcggacgcccggcgttagccaagttcatggccgtcccgcactacacttacatgatgatgaagatgcctggtccccgaggagtcctatccctacggagcaacatcaagcaagccgtcacatgcgacaaggagagttgcgacatggcccaaacccgcgagatagcgtctgcccgggaggatatccgactggctgcagccacggcgagcgaaggagaagtgcccgctaccaagacttcaaaaagtggagaaagcgaagccaagactaagaagattcccctagatccttctaatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttgcatgtcaaagaagatgccaagcctatcaaacaacgactccgccgattcgcacaagacaggaaggacgcgatcaaggaggaattaaccaagctgttagcggcaggcttcatcaaagaagtccatcatcccgactggctggcaaacccggttctagttcggaagaaaacggggcaatggcgcatgtgtgttgattatactgacctcaacaagtcttgccctaaagatccttttgggttgcctcgcattgaccaggtaatcgactcgaccgccggctgtgagcttctcagttttttggattgctactcggggtatcatcagatccgactgaaggaatccgactgcttgaagacctcattcatcacgccctttggagcatactgctatgtcaccatgccgttcggactaaaaaacgcaggagcaacttatcaacgtatgatccagagatgcttctcaacgcagatcggccgcaacgttgaagcctatgtggatgatgtagtcgtcaagaccaaacaaaaggatgatttaatctcggatctagaagaaaccttcgcgagcatccgcgctttcaggatgaaattaaaccctgaaaagtgcaccttcggagtaccgtcagggaagctgcttggttttatggtgtcttataggggtatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactgaagaaaacagatgatttccaatggggacccgaagcacagaaggccttcgaagattttaagaaactcctcaccgagccaccggtcttagcctcaccacacccgcaggagccgttgttgctgtatgtatcagccacctcccaggttgtgagcacagtcttggtcgttgagcgtgaggaagaaggccatgtccagaaagtccagcgaccgatttactttgtcagcgaggtcctagccgactccaaaacgaggtacccttaggttcagaagctattatatggtgttctaattactaccaggaagctatctcactactttcaaggtcactcggtaacggtggtcacatcatttccactcggtaatatactgcacaaccgcgaagcaaacggacggattgctaagtgggctttggagttgatgtctttggacatatcattcaagccccgaatttcaatcaagtcccaagcgttagctgattttgtcgccgaatggaccgagtgccaggaggatacccctgcggagaagatggagcactggaccatgcatttcgacggatcaaaaagactttcgggcactggagcaggagtggttctaatttccccaactggagaaagattaagctatgtgctttggatacatttttcggcgtctcacaacgttgctgagtatgaggcgctccttcatggactgcgaattgcgatctccctagggataaagcgtctaatagttcgaggcgattcacagctggtcgtcaaccaagttatgaaagagtggtcctgccttgacgacaacatgatggcatatcgacaagaggtacgcagattggaagacaagttcgatggactcgagctcagtcacgttcttcgacacaataatgaagccgccgacagacttaccaactttggatccaagcgcgaggtggcgccctccgatgttttcgtcgaacacctttatacgccgacagtacctcacaaagatactactcaagttgcgggcactcatgacgtagctatggttgaagtcgactggcgagagcccctcatacgattcttgacttctcaagaactcccccaagacaaagatgaagccgagcggatttcaagacgaagcaaactttatgttatgcatgaagctgagctgtacaagaaaagcccttcagggattctgcaacgctgcgtatctttagaggaagggagacaattgctgaaagacatacattctgggatatgcggaaaccatgctgccgcacgcaccattgtcggcaaagcttaccggcagggttttttttggcctacagcagtgtccgacgccgacaaaattgtgcgcacgtgcgaaggttgccagttttttgccagacaaattcatctaccagctcaagagttgcagaccatcccactgtcttggccgtttgcggtttgggggctcgacatggttggcccgtttaaaaaggcagtcggcggttacacgcacctctttgtggccattgacaaattctccaagtggattgaagctaaaccggttgtcacaatcacagcagataacgctcgagacttcctaatcaacattgtgcatagatttggagtgcccaatcggatcatcactgataatggcagacaattcactggcggagtttttaaagacttttgtgaagactttggaattaagatttgctatgcctcagtggcacatcccatgagcaatggacaggtggagcgagccaatggcatgatacttcaagggattaaagcgcgagtttttgaccggctaaaaccctatgccggcaaatgggtggaacagctaccatcagtactttggtctttgcgtactacacccagtcgggccacaggccagtcaccttttttccttgtctatggggcagaagcaatgttgccgagtgaagtcgaattcgagtctttgcgctttcgtaatttccgcgaagaacgctacgaggaggaccgagtggatgacttgcaccgactggaagaagtccgcgaagcagctttgattcagtcggctcgatacttacaagggttgcgacgttatcataatcgcaatgttcgatcccgtgcctttctagtcggcgacctcgttttgaggaaaattcaaactacacgagatcggcacaagttatctcctctatgggaagggccatttatcatctctgcagtcacccggccaggttcctatcgactcaagcgcgaagacggtacactcgtcgacaactcttggaacatcgaacatcttcgtcgtttctacgcttaagcttatcactgtacttccctatcttgactgtcaacatcaagttttcttcttgaagttgtcagtcgggggctatcatcataataacggagtgtgattttttatcaattcaatttgcttccttggtctatcattgccttgtttgatttttttctacttagtttgcgaggactgaaagtttttaatagcttctttgggttttaggctcaacaaagcttgataaaagcttttaagaaatcaaagacttggctagaattatcaagcacagcataaatacaccagtattgtacaagttatgcctccatttgctacatttatgctcagtcagaatcagtcctttcatcatcagagttattactactcggctgaaggtcggtgttgcggaattgatctacgacgtcacttgcaatcttgtcagccgcattttgagcattgctgataagatcaagagcagcctctacgcttgtcccgtctgcaaagccatcaatggcgtcaatttcaatcctcgggtacaaggatttggtcatcaccaatgccgtgctagctcccatacttccagctttcttgatattcttgaaatatacatcggagcaactctcagcttgtcgaagatttcggttgcgtcgagtacactcggaccactgttattgaggaacatagcttggacgagtggtatagcgacattagcgacttcatctcttgctccttcaagcctcttgatcttaccaaccaggacgtcaaattgagcttgagatttgattttgcggtctacaaaacacatttatgataaaaatctactgcattaaaaagagagaagttcagattgtcagctggcagtaccttcaacctccttcaaggccgagtccctttgcgcagccagttctaccttgtctctttccagggcttcaatttgtttctccatttgagccatcctggcggcttgcgctgtttgaaatccaaatggttgaggatacagttacgacagcgtaaattaatgggacagatctagagattaccttttgatgaaccactcagctcgaagtttgaatcctggagctgagcaattcggtcccttaattccttctctgtctttttggcaagctccttggcctcatgtagctggtccctaactgcttcaagagttcccaaatgaggaaccagcttttctaaagttgcggtcttggcctcattgcgaagatggattctctgcatgatggttcatggtttagttttgctgaagagaaaacaaagtcatcaaaggcagtcacccggaagatttacattcacaatgcgagtggcttctccaagtgccttcttcagctggcacacttcctcatcttctttttgacgatttatgacgatgccggcagcttgtgagttctcgtcccaccatttgagcaagataggaggacgagagtcatcagccgcctttatgcgaggaatttcttcttcgtcatcgcctggtggtcctgatgtatttccaagatattagacgaataagctgaagttatttaaatcggcatcacttgagaagatgagttacttgaggatgttcctagctgagcgtggggtgatccttgttctttatctggagacccaatcatcgagtcgttaccagcctctggtccttgagaagttgtcgtctgcgcttcaacttcgggagtttcttgatctggacctacatccgactggtttccagtcgggggctcttgggttgttgtagtttcagttgccgccgactggttttcagtcggaggatggtcactcggattggccttatcacctgaagtatgggcgccagtcggctggctttcggcagtcggctcagaatccttggatgaacttggttctgtcacagtcggatcaggatcttttccagttggatctatgtcggatggtttcctgcaaagtgttctttcaatattcagtattatttccatgagagaagcatgtcgaagtgaaatggtaccaagaggtttatacctagaagttgttctgatctttggccttggacgactagccagttttttcctgggagtggtatgctttgggagtttattgggcgagcctttgtccccagatttgttgccgtcgtcgccttcgtcgtcattaagcaccagctttctcttgcgagaacctgtctgcccagtcggattggaggtttgaggttgcggatctgatctgattgtcggccctctacctccctgaacggtgtgctggcgaggagaccggcgctgagtgattggggggttagacttcatcaatacatattcctgagtgagatgcctccacggttagttaactcaacatgaagacaagattatgttttggtcatgggttgaagatttcagatacgtacctgcggaggcggattgaatgcgttatatggcacaactggcagctgatgtgagtagctgacgacaatggcatttgagaagtttttatacattctctccttcatgattttaaaatccagagaatctgattcttcatgattaggatcatgcttaccgtcaaactcgaatgccgtacgggatctttctttaattggtgccaatcggcatttgatgaagtgccgagtaatctgctctccttgtaagccttgttctttgagttttagcatgcgatccatcagctccaaggcttgggctgcttcatccccaatcggaagagagttccaggtatcttggtacaccggaggaagacaagagtactcgggaagagcaggctcaggattctgaatataaaaccagtttgcgtgccaccctttgtttgaggtcttgaagggcatagagaagtacttctggctcagagtccccctcagctgaaatccggcccctccgactacacatggcttactcttgtttggttggggcttgagaaagaagattcggcgaaacagagcgaagtggggcttaattcccaagaaggcttcacaaacatggatgaaattggcgatgtgaactatggaatttgggtttaggtgatgcaagctgattccatagaagcttaatatcccgcggaaaaattttgaggtcggaagagcgaagccgccatagaagaaatgggagaagaccacagtctcgtgtgtatcgggggtcggaaaagcctcaccgcacgctggccgccacccgatgatttccttggcagggagaacgccgtgcgccaccatctccttcaggttctcctccgtcacgtcggatggcgcccattggccttcaaagctttccttctcttccgccattgattttttttcgaatgcgctgatttgattcgagggatggctagggagaggtgaaggattgaggcggtggatcacgggaaggattttgatgaacttttcgaaggtggattcgagtggaatggtgaaccctagtttgccggcgtagctctgtactgtagcagggagtggggaaaatggcgagagttccggcgggggagatgaagtgtcgcttggatctcgggatttcttgttaagggtatcggaggtacgaatgggtttaggcctgaacagtacctcagcccagtacttttaacagcgtggcccattgtgctccttagggacttaggcattttttgctttggcaatttatgcgcacaatagtgttgcccaatgctgataaaatcctttttacgcggtcatataattctttggaattattacaatgcaaattaaaaggtgcccgacagaaaggtgttatgctgtttttgtaagcttttttaggctacaaaagctgtctgggttaacttggaatgacttgtttttaccatagtcatttcctcggtatgttatatgcctgttttcattatggtaaatagtcatagcctaggctattagacttattcattaccataatttttataatatttggtgggtaatctttagagttttctattcggatgcctgtcaagtgtgttcattcgtgaaccttttagagtgttaaccactcggattccttttaattatggctaaaaagcagtcggctaagaatgcctctttaggcgccgtgtatgcttttgtcatatgatgcacgattgtgctattattttgttctcaactatatgtttagtttgttaactaatcacatagttgggaggtacacctaattaggtgcatctattcgatgcaccatattctttatcttttcgccctttacagtcttcgtcttcgctactcggcaggccttggcatgaaaagtttgaagcattcggattattatctttgagaaggctatgatggttgactgcaaaggtctcgggggctactgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttctgtaacacggactccttcctatatataaggggggtccgggtgcctctaggggcatgtgttgattctctccaaatcatacaatcaataagatactcggcggattcatccccggacaggagtagggtattacttcttgaataagaaggcctgaacctgtataaatcttttgtctccaaacccattcacttctccagcttgatagccacccccttttattattgccgaaatctagtttcgacagtttgctttcaagcaaattgagaacattgctttaaactgtgaaagtgatccagttcagtcagcattaaactgccatcacttaagattatatatgttgtgttagttgtataccattaccatgcatcttatttaggcatcttctctgcatactcattctcttaagatacctgcgatcacattgtctcaggtagcaaacaattcagtatcagcttcctttttatcttggcactaaggtgacgatctattgttactggcaagatatgaaaagtcccttttatttggagcagatggctagaaattccttcgaatgcgcaagtgtgcaaacaccagtgctttgcttgttggtggtgtttatcttgtctggtttggaaaggaaaatttgaggcaacatatctatctatcaatctacagagggaagggggacaggaaggggaaggggaagatggaaggggagggatgctagctgaattgttcggtccttcaatgtgatatttgaactccatatgtaatagctttctacttactactctactttacttactaatttagtcggatatacggtaccaaatatagatagaatatcttcatgaggactcgggttagattctaaacttgtatgtcaaggaaatacccgggatcctagtcggttacgattgtattttatctataatcccatattctgttaggatatggactgtattttgtaaagcggacttcttcccctatataaggaggggtccgtgtgcctctcggggcgtgatcttttttccggtttatacaatcaataatacactcggcggaatcatccccggacaggagtagggtattacttcttgaataagaaggcctgaacctgtataaaattccttgtctccaaacctatccgctttcctagctagatagccaccccctttcattattgccgaaatcttgtttcgacagttggcgcgccaggtaggggtagcgtcaagtttttgccgactaagtgcgatgggttccgtctccggcatggacgacttcgccttccctcccgggcaggcgttccggttcggtagcctcaacttcatcaccaacgacttcggcaagatctctctccttgactcggatttgaaccagtcagggagagaccaggtccccgcgccgtttggtattccgaactcagccgaggcctactccaatatcatctctcccgagtcggcttcaaaccacccggacgagatccaatctactcctctgcgaccagatcaagacgacgggtcctatccctcaatcctgatgagactacccgatgatttggccgctgtcttcacagccaagacatcttcggccccgatccaatctagatccagagaggttggcgttatactccaacctcttgggacagtctcgacggaagagttggacggctaccttagctcccctggcgtcagttcccgaccaaccgagatcctcgactgcgacgacttcggctaccactacgactacggcgacttcgacgacagctatgaggataacaacacgcctctctttttcggcgtattcatggctgacaacgaaacggaggaacagtgccgagcccgagaagcggaggaagagcgcacgcgacaagacaccgaacgtcgccgactggaggaagaacgacaacgacaagagcgagaacgactacagcgtgagcaacaagatcgcgagcgagttgcaaaggaggctgaagatcgacggcagcgcgccttggaatccgggcgacgagcgagggatctcatcgggcaacaagacatcgatggaacagcggtttttcgcaccccccagcagaacgcggttgcagcaatcactctcctcgacaccctcctcaaagaagacgcactcaatcaagctgatcatgttgtcaacatcttgaaccagacgaagaccatgatcgctgcctcggttccagccaactccgcaagtgcccgcaccccgactggtagccgagtccctcatcttcgatctcaagactatcaccagccaagcctcagcattgccggcgccggatctagtcgcaggagcaggggacatgatgaacgatctgttcgttcgcctcctgaacgacatagggagcgccgagttgaacgaccacactccccacatcgaaggcgccccatcgatcttcgcgacaccatcaaccagcgccgcgcggcaagaggctatcattcaccagatcgctacgacgacgatatggacggagttgctgccttcacaaatgatctgcgttgagtgaattggccagccggctttaagccgactggaatcgagaagtatgacggcaccaccaacccggaatcctgtctcaccgtctacggtcttgcaatccacgcagcaggaggagacagcaaagccatggcgaactatctgcccgtggccttggcggattctgcccggtcctggcttcacgggttaccccgcggcacaatcggatgatgggcagaactacgcgaccacttcatcgccaacttccaagcacttttgaacgccctagcacacactttgatctctataacatcgttcagaagtctggagaatcccttcaagattacatccgacacttctccaagcaacgcaacaagatctccgacatcaccgacgacgtcatcatcgccacctttactaaaggcattcgccacgaggacctagtcggcaagttcggacgcaaacctcccaagacggttaagcagatgtttgaaaaagccaatgagtacgccaaagccgaagatgctattactgcgtccaaacagtcgggcaccacttggaagctaaggaaagacacgccgaccgcaggagggagtggaagtaacaaccacaaggatcgcaagcgtaagcccgaagaacttgtggcaacaacctctccatcttcccgacaacgttctcgcgtcaacaccttcgacaagataatgaactctcaatgtccgcatcatcccaactctaaccacacggccaaagattgcttcgtctacaaacagtttgcggagcaatacgtcaagaacgcacgtaagccctcagacgaagatcaaggcacatcaaagaagaaagatgatgaagacgatgccccgactggttttcaagatcatcgcaaagaactcaatcacatcttcggcggacccctggcttatgaatctaagagaaagcagaagttaacagaacgggagatcaatgtggttcaacctaacacgccccaataccttcagtggtcagagatagcaatcaagttcgaccgctcggatcatcccgaccgagtggtccacccggggcagtaccccctggtactagacccagtggttcgcaatgttaagctccgaagaactctcatcgatggtggcagtgcactcgacatccttttctctaagaccctggacgatatgcagattcctcgaacggaattaaagccgagtaatgcacccttccacggtgtcatcccaggattatccgctacaccactcggccagatcactcttccggttacttttggcactcgggagaattttcgcacagaaaacgtttgtttcgaagttgctgatttagagacagcataccatgctatactcggacgaccggctctagccaaattcatggccgttccatactacacttacatgatgatgaagatgcctggtcctcgaggagtcatatcattacagagcgacatcaagcaagccgtcacatgtgataaagaaagttgcgagatggcccaaacccgcgagattacactcgcccgagaagagatccgactggctgcgaccatggcaagcgaaggagaagtgcctgcaaccaagatgcccaaaagcggagaaagcgatgccaagaccaaaaagattcctttagatccctctgatcctaataagacttctgtaataggcgctgagttagattgtaaataggaaagcgcgctcatcacctttcttcaaaataataaagatatctttgcatggaaaccatccgatatgcctggtattcctagagaggtgattgagcactctttacatgttaaggaagacgccaaacccatcaagcaatgactccgccgttttgcacaggacaggaaggatgcgatcaaggaggaattaaccaagctgttagcagagggcttcattaaagaagtccttcatcccgactggctggctaacccagtcctggttcggaaaaagacggggcaatggcgcatgtgtgtcgattataccgacctcaacaagtcttgtcccaaagatccttttgggttacctcgcattgaccaggtagttgactcaacggccggctgcgagctactcagttttttggattgctacttaggatattatcagatccgactaaaagaatccgactgcttgaagacctcgtttatcacgccctttggggcctactgctacataaccatgccctttggattgaagaacgcaggagcaacctatcaacgcatgattcaaagatgtttctcagctcagatcggccgcaatgttgaagcttatgttgatgatgtagtcgtcaagatcaagcagaaggatgacctgatcacggacttagaagaagcttttgcaagcattcgtgctttcaggatgaaactaaaccctgaaaagtgcatcttcggagtaccgtcagggaagttgctcggatttatggtatctcaaagaggcatacaggccaacccggagaaaatcaacgccatcctcaacatgaaaccgccaagctcccaaaaagacgtccagaagctgactggttgcatggcggcgctcagccggttcgtctcacgactcggcgagcgggggatgccctttttcaagctgctgaagaagactgacaatttccagtggggactcgaagcacaaaaagcctttgaagacttcaagaaacttctcactactccaccagttttggcctcgccacatccacaagagccgctactgttatatgtgtcggcgacctcccaggttgtgagcacggtcctggttgtcgagcgtgaagaggaaggccatattcaaaaagtccaacgaccagtttatttcgttagcgaggttttggccgactctaagacaagatatccttaggttcaaaagttattatatggtgtcttaattaccgtcaggaaattatctcactactttcaaagtcactcggtcacggtggtcacatcgtttccacttggggatatacttcataaccatgaagcaaacggatggattgcgaagtgggccttagaattgatgtctttggacaatatctttcaagccacgaacttcgatcaagtcacaagctttagctaatttcctcgccgagtggactgagtgccaagaagacatgccagaggaaaagatggaatattggactatgcattttgatgggtcgaagaggcttacaggcactggagctagggttgttttaatttccccgaccggagaaagattgagctacgtattgtggatacatttttctgcgtcccataacgtggcggaatacgaggcgctgctccatggattaaggattgcaatctctctaggcattcgccgactaatcgtccgtggagactctcagttggttgttaatcaagtcatgaaagagtggtcttgtctagatgataatatgactgcttatcgacaagaggtacgcaagttggaagataaattcgatggactcgagcttacccatgtccttcgacacaataatgaggcagcagacagattggctaattttggttcaaaacgggaagcagccccttctgatgtgttcgttgagcatctttatgaaccaaccgtgcctagaaaagaaacaattgaagccatggatactcaaggtgtaaacatgattgaagccgactggagagaacctctcataagatttttgaccaaacaagaactccctcaagacaaaaatgaagccgagcagatttccaggcgcagcagactctatgtcattcacgagaccgagttgtacaagaaaagtccatcaagaatcctacaacgctgcgtatctttggaagagggaagacagttgctaaaagatattcattcaggcatctgtggtaatcacgcggctgcacgaactattgttggcaagacttatcggcaaggtttcttctggcccacagctgtttccgacgccgacaaaattgtgcgaacatgcgagggttgtcaactctttgcccgacaaactcacctactagctcaggagttgcaaaccatcccgttgtcgtggccgttcgcggtttgggggcttgatatggtcggtccattcaaaaaggcactcggcggttatactcatctctttgtagctgtggataagttttccaattggattgaagccaaaccggtcgttacaatcactgcagacaaagctagagatttcttcatcaacattgtacatcggtttggggtaccgaatcgtatcattactgataacggcactcaatttaccggcggagtatttaaagacttttgtgaagactttggcattaaaatctgttacgcctccgtggcacaccccatgagtaacggacaagtcgagcgtgccaatggcatggtacttcaagggatcaaagcacgagttttcgaccgactgcgtccctatgctagcaagtgggtagatcagctgccgtccatactttggtctttacgcactactcccagtcgggctaccggccagtcgccgttcttcttggtctatggcgcagaagcaatgttgccaagtgaggtagaatttgaatcccttcgatttcgcaacttccgggaggagcgctatgaggaagatcgagtggatgatatcaaccgactggaagaagcccgtgaagtagccctaatccagttagctcgatacttacaagggttgcgccgttatcataatcggaatgttcgatcgcgagcctttttagtcggcgacctggttctgaggagaattcaaactacacaggatcggcataagttatcgcccttgtgggaaggaccgttcataatcgctgaagtcactcggccaggttcttatcgactcaaacgcgaagatggtactcttgtcagcaattcttggaatattgaacaccttcgtcgattttatgcttaggcatttcgtttgtatctttcctctttgactgctaacttcaagcttttccttgaagtttccagtcggggggctattatgataataatggagtgtgatttttatcaattcaatttgcttacttgatttatcattgccctgcttggtctttcgacttagtcaatgaggactgaaggtttttaacagcttttgcgggttttaggctcaatatggcttgacaaaggcttttaagaaatcagaagctaagtatggaacaccaagcatagcataaattcatcagtattgtacaaattatggctccatcttcattaatcatcaaaatcattgttatatcaatcagtatcagttttttcatcatcggaattatcagacccagtcggccgaaggtcgacatcttggaatctctcaaccacgtcagcagcaatcttgtcagcggctttttgcgcatcattgatgaggtcgagggctgcttcttcactcgtcccgtctgcaaacccatcaatggcatcgacatcgattttggagtataaagatttggtcatagctaatgccatgcttgctcccatactcccagcttccctgatattcttgaagtaagtatccggagcgactcttagcttgtcgaagatctcggaagcgtcaagtgtactcggaccggtgttattgaagaacatggcttggatgagtggggtagcggcattagcgactttatccctggccccttcaagcctgttgaccttttcaactaagacatcaaactgtgcctgggacttgatcttgcggtctgcatcaacagattcacattaatgaatcagcatatagaagataatggcttttgaggtattgattattggtaccttcaacctcctttaaagccgagtccctctgtcttgccagttctgccttgtcattttccagagcttgaatctgcttctccagttgagatatcttggcagcttgcactacattgactctggttaatcaagattacaaacataatagcatgagttagttgggcagagtttgtgcgtaccttttgatgagccactcagttcaaaattggattcctggagctcagcaatccgatccctcagatcatgtttattcttcctagcaagttcttttgtctcatgcagttgattcctggtggcttcgagggttccgagatgagggactaacctttctaaggtcactatttagcttcgttcctaagatgaatcctctgcaagacagtttaatcagcgcttgaactaaatggcaaacgagatggttgagatcaggcgccaaaaagcttacatttacaatgcgggttgcctgaccaagcgcctttttcagtagacataactcttcgtcttctttttgcttatttattacgattccttgaggctgcatgttgtcatcccaccacttgaccagaatgggagggcgtgaatccttagctgctcgtatctggaggatctcttcttcatcaccaatcattggccctagtgtatccatgaataaagatgaagcaatcaaataaagtctgttggatcgaaatgatttcagatagcgtgtttacctgtgatgattcccggtcggggacgagtggactcttgtgtcttcacaggagatctggtttctgagtcattgccagcatcctttccgggaggactgtttgtttgagcttcaacctcgggaatcttttggcttggccctgtatccgactggtttccagtcgggggctcctggttaactccgactccagcttcggccgactggcttgcggtcgtgggttcgtcgctgggttctacattgtcgctggcctgcggattatcactcgggtgatcttttgcagtcggcccggtttcttttgaggaatccgcttccatgttagtcgggtcagagtctttctcagaaggatctatgtcagatggtttcctacaagttttaccatcagtgttattttcatgatgggagaataataatacaaggaaggttgctatatgatttgtacgtggaagaccttctgatttttggtacaggacgactggaggttttcttcttcggattagttggcttcggaggtcttccggtcgctcctttatctctgagctttccggtaacatcgccttcgtcgtcacttagaaccagcttcctcttgcgagaatctgactggccgactagatcagaagcacttggttgggttttagaccgaattcttggtcctccgcttccctgaccagtttggcagcgaggtgattggtgctgggcgattggaggatctgacttcatcaatgcgaattcctaagcataaatgtcaagcaacttaacaagagacgaaatcatgtttttaaggaaggttggaacgtttgaatacataccggtggaggaggattgaatgcattgaacggtacgactggcagcaagtgtgaatagttgacaacgatagcatttgagaagatcttatacatcctttccttcatgaccttgaagtcaagagaatctggatcttcacagtttgggtcgtgcttgccgtcaaattcgaaggctgtgcgagatctctctttgattggagctaaccgacacttgataaagtgccgggtgatctgttctccttgaaggccttgttcttttagctttatcatcctctccatcagttccactgcttccgcagcttcatttcccattggcagtgagttccaagtatcccgataaactggaggaagacaggagtactcggggagagcaggctcagggttttgaacataaaaccaatttgcatgccagcctttgtttgaggttttgaagggcatagagaagtatttttggcttaaggttcccctgagttggaagccagcccccccaacaacacatggtttgctcttgtttggctgaggtttgaggaagaagatgcggcggaacaaggcgaaatacggcctaatacctaaaaaggcttcgcaggcatgaatgaaattggcgatgtgaactatggagtttgggttcagatgatgcaggctgattccatagaaattcagaattccccgaaaaaatcatgaggttggaagggagaaaccgccatagaagaaatgagcaaataccacgatttcatgcgtatcgggggtcgggaatgcttcgccgaatgccggtcgccacccgatgatctccttcgccggaagaacgccgtgcgccaccatctccttcagattatcttccgtcacatcggagggcgcccactgactctcgaagctttctctttcttccgccatgaatgtgaactggatagtttaatttggtcctagatacggctggaaggggatggggaatcgaagcggtggacgcggggagaaatttcgtaaagtttttgaggatggattggagcggattgatgaaccctagcttcgtcggcgcggttctgtactgtagcagggagtggggaaatggcgaaagtctcggcggggaagacgaagtgacgcttggtcttcggtgtttttagggtatcgggagtactaatgggcctaggcctgtacagtacttcagcccagtattataatcagcgtggcccgttgtgatccctagggacttaggcgctttttgctttggcaatttgtgctcacaatgatgtggcccaatgttgttaaaatcctttttaatgcggtttgataattctttggaattaacacgatgcaaacaaaaggtgcccgacaggaaggtgttatactatttttgtaagccttattaggctgcaaaagctgtttgggttgatttgagatgactaatttattaagagtcattctcttagcatgttatatgcttaatttggttatggtgagagtcatagcttaggctattagactcgttgattaccatgatttttatcatgtttggtggatcattttaagagtttcttactcggattcctatcaaatatgtctgtttttggaccttttgagtgtttatcactcggcccttttcgtattttttatccttgatatgttcaagttgagaagcagttggctgagtgttttactgagtaccatgcatgcttcgctataaaaccactcggttcttgactacatgtttagtttttcaactaatcacatagtcgggggctacacctaattaggtgcatctactcgatgcaccaagttttattttcgcccttcacagtctttgattttagcactcggtaagctagagcaagttgaattgaagcgctcggattactgttttttgtttcgagaaggctattttgtcaactgcgaaggtctcgggggctactgtggagattatggataccccatatctacatgacagttataatttagtcagatatacggtaccaaatatagatagaatatcttcatgaggactcgggttagattctaaacttgtacgtcaaggaaatacccgggatcctagtcggttacgattgtattttatctataatcccatattccgttaggatatggactgtattttgtaaagcggacttcttcccctatataaggaggggtccgtgtgcctctcggggcgtgatcttttttccggtttatacaatcaataatacacgcggcggaatcatccccggacaggagtagggtattacttcttgaataagaaggcctgaacttgtataaaattccttgtctccaaacccatccgctttcctagcttgatagccaccccctttcattattgccaaaatcttgtttcgacagttaatggccatataatctagacatgtaatttgtggtgttatgttgactatgtcatactgtcaaagctcccttctactccctccgtttcacaatgtaagtcattctagcatttcccacatttatattgatgttaattttttagataatgaaagctttattaatctcagtaaaactctatcaagtgatacaattattctgagagcacctccagcttctgcacccaaagagtgcacacagccaacaagaaagaaacagaagataaactcatcatccaaatagcatggacaaaaagaacttcaggagccctctaaccgtagcctagaacgccacccatgcgccggagtagaaaactccatggccactagctccaattgttgacaagccgcaatgatagtaccccgcaaattgaccttctgaaggatagcccatgagcggagccaatgtgtaatcaaaaagataacctgcaaaggagcagatatgttttttctttcaaaaaccacatcatttctacaaagccaaatagaccaaatagtggtagttgcccataataagaccaaagatctcaaattgcgtggttgtcttcttatccaatgcccaaacatatgagttgtactattaggtaaactaatattcgaagcaaactggattaaagaccaaactacgtgggcaaaacaacaatcaaagaacaaatgattaatagtttcatctttgtggcagaaagaacaagacttgtttcccctccaattccttttaataagattatcttttgttaagactactccacgacgtaagtaccataagaagatcttaatctttaggggggcattgatcttccagattcttttgttaatattgggaacatcggtctgcaccaacgcaagataaggagatttaaccgagaatctgccatcagtggttagattccatttaaactcattttggtcataagataatataatattagcgatgcgtgagagaaggtgattccacgccactaacttagagcgagtaaggtccctgcgccaagaaaagcttagaggactggtttggaaaatttctgaaatagttgcatgtttatgcctaacaacgttatagagacaaggatattgttgtcttaaacaggcattcccaaccatttatcttcccaaaaccgtacttgagagctatctttgatgttgaaggagccaaacctgagaaaatcaggcttggccttcattagactagcccaaaagtgtgagtctcctgctttccactgagcttgagacaaaggctgtgaccccaaatatttgttccttagcatttgttgccatacaccatctgtagtgagtagtttatgcaaccacttgctaaggagagccttgttcttaatttcaagatcttgaattcccaaccccccttggtctttaggacgacatatgatgtcccaccttgctagtctatatttccttttgtgtccatccccttgccaaaagaaccttgatcggaaataatcaatcttcttgatcactcctttaggtatttccaaaaaggacatcatatacattggtaggctggtaagcactgaattgattagtgttagtcgtcctccaagtgataaaagtttgcctttccaacttgccaaccgtttttcaagccgttcaatcacttccttccactccgaattacgaagtctcctatgatgtataggaatgccaaggtaacggaatggaaaagaaccaacctcacattgaaaaaggttagaatattgatcctgagttgtttgggcttcaccaaagcagtaaagctcgctcttatggaaattaatctttaagccagataattcttcgaaaacattcaacaacattttcagattacaagctttctctagatcatgttccataaagagtacagtatcatcagcatattggaggatggacaatccaccatcaatgagatgaggcaccactccaacaagctgtcctgcattatttgctctctggatcataaccgctagcatgtccgctataatattgaataaaatgggagatagcgggtcaccttgtcgaaggcctttctttgtttgaaagaaccgtccatcggagaaaggggcaatgaggtggtcattttcagcctctgtaacttgggggatatcatcaattctatttgcatcaaaagagagagtacttgcatctggtggtccaaagagtttcttataaaactcagtgatataattctttatagcttcattcccctcaatcttaccttcctcttgatcttagactaaaaatacgtttcttccgatgtttgccatttgcaatcagatgataatattttgtattattatctcccaaacgaacatcatcagtctttgcaatcatattgatgttaatgaatctagatagatatatgtctagattcattaacatcaatatgaatgtgggaaatgctagaaggacttacattgtgaaacggaggaagtaacttgcttttgttggatattgatgtgtgctgttgagtatggtgctactttgtgatgcttcacatgttatatgtgatatgttggaaatatcacttgaaatcgtggcaacgatattgctgaaattttgtccatgatattgtgctatgtaatcttttacaaattgtgttcaaattattgatgaatttctatcaaaattttgtccaaaatattgtgttctgtcatcttttacaaattgtgttaaaattattgctaaaattctgtcaaagttgtccaaaatattgtgttccattatattttacaaattttgtcaacacttaggtcccatatgaaatacgcataaattcaacttgaaacatgtccagtgttcgcgacaacgttattgatctcaatagtagggctatatttgtccattcaccacacatttaaacaccgttaccatgagttcacagagtatgggtagtaggttgcttcatttcaaaaaagcaggagcaaaatcacaaactctaaaaagcaggctaaaatcacaattgaactagaaagcaagggcaagaacacaattgcctccaaaggtctatgtggagctcaaggtagggaaataaaaatgaggcattacttatatcacatatattgtaaatcagaaggtggatcaaagaagaaaacaaatcatacaatctggtcaaggtgagggctcaaaggttgaatcttgtgatgtggaaggtacaagatccaattcaacagttgagggcttctcatgggtgtgctcgatttcctggatggtttcgctgctgatgaaggaggtgttctctaggatacgatccaagagttcccttccttctatcgtggttttatgtgcaaaggtacctttggcgtaaatgtgaagatacggagcatattccttgtttagacccaaacaaaaatgttataacaagacatgatcgggtatagatgttggtatttcttaacgacattactagaaatataattcccagcaatggcgcagaaatactcctggtatattatggttagagagtttatccgcaagcgcacggatataccattgcagcatttcacccgagagtattacaagggtatcgtatttaatttatcccgtgggaagatcatgtagagagaacttgactaataatttatatattacttgtgataattatattctaagcaggggttaagataatctaagggtagagtgacacacaagcatcagctactcattctcataatatattatctaagctaagtggaaagaaaagagagagaatctattcctatacttctaatgtacatagtatacatacattcttagttaactgatacactagctaataccctctatccgatgccctcctggtacttcgagaagccacccctgactgccgagttccttacgtcagaccgtcatgaccatacaaccggggctaaatacggaggaataccctccccagggaattaacttaggattatatacaggcgcggaggaatacctgtactgagctgtcaccaacagcggcccacctctcatccgtagcatataaccccaaataatgatatcccgtaatctagacaccacgtctaaactaccagatactactctaatatcatcgtcatgacatagagtaattacataagcaaacattatacccgcaccaaagcatctgccagataagctagccgtacattcagtataacatgaacataatgtaaagtaggcattcatatactcggaaagtatttcaataccataaatgtagatagaagagtattctaataaaagtacaaggcttacaaaagaggagaaaagctattagagccatacccgaactctttcgaagactttcggactcctgatttctactctattccttttccactagctagatactactaaactaaacttgagagaaatgagagagctcttgcttgaggtgtgtgagtgaagtgatgatgagagctccttttatagcctcccaatgacggttgtgacggttggaaaggtcggtaatacccaccaaccgtcattggggagccatctcagctgtccaggagaaccctggatcaaacggcactgcagggggttcggctgaaccatgggctgggccgacctggcccaatttcggcaggcagcttcctcttttgctctcatacacagacttgtgaattttggcctggtttgttgtgtcaattctaagttcttgtcccattcatacacaagtctgattctcgacatcgtccgattgatttatcgtttgagttgatgttgattctcctccactttatgatcattctctgcaaaaggttagtaaacccaatactagtggaatattattattctaacatatttatgcattgcaagcatcactagttctcctctgttttgataaaattgacggtcgaaactgatcgataacgaccgtcaacaatagacaactctaaccaaattgagttaacaatgagaacctaagccaagctgctccaataaattcctcctttctctgctgaaagccaaggatttccatccgtagggagacaatactggatagcgggaagaaaccaagacaaaacctacttttgagttcccccattcgttgttcgtcttcctaacggaaagagcgtaccattgttttacctcctcaatgagagagaagggaaacaacttccactttggagtttcttgtgtcatgcctgagattgtctggcacgagcacaattgctaaaactctcgtagatgacagtagggctttgagctatcgcacccccgagaaggattgttctcgaatggctataaagccaggacagagttcatatccagatgtgagaataagttttgatgaagttgctggctcacaaaactcgcccttcggaaacatttcatatagatagttgctccatgatggaaaagaaaagaaaagaaatataaaaagataagataagaaggcaaactaggtttgaagataatataacaactgttccatagtaacaccgccagaaattcttatattgatatttattactcacagataaatacgcaagcgcacggatactgctgtagcacttaaccatatcgaatctcagggaacaagtgtgtaaaatcaaggaaacaggttcatccagggacaacaatttaatggtaggagggggatagagaggatccagatgggttaataatcttgaattaagttaaggtaaaactctatcacttgcttagggcactggcttttccatggtttgccaaacgaatcaggcctatagctctatgatgtacctgaatgtgaatcattacaaagtatgaacggagctatcaccacgtgttgcgtatctctacaacccatggagcacacaataaacaaaggtaatttttaacctagacacacgcttacgttatcgattacttctctagcccccacacaagaagtttcttctttatctagagtcttactagagcacttaatataaatattaaacgatgaacccataatagtgagaatatatcttacttaaaaaaattaaatacccaaaagaaatcacgaatactcacttaatgtggaatcctgtatacttatacagttgatccccactaactattttgctgtcctctcagttagccacgtcactttttattcttatccgttcgatcaatgtgttcaacgcagcagatagcttcttgagggttttctttcctactcagcgggcccagtccaaattaaccaccttgggccaaccggtgaatgacccctgcccttcccctctcgagttcccactagcgacacgaatcctttacgattttgctagaaatctgatgtcaaattttcttccccatatctgacgttttttgcgccgtccgatctgctcttcaagattcgtgctgatatttatggtattagtcaatgcgcggtctgaacgctgtcaaatttcgttttccgcgccgtgtctgtagccgtagctcctctttatctctcctactttctccggtatcttctccattcttctttcttctctcctcctctctttttgcttttttcttctctttctctccggcgagaggctttttcttctctctcgcgctcgagaaggagaggaatctcattggatttctctcatctgctccagatttgatcggttagttttgtgtcgttcgttgctgcttggtttttttgcatcctccggttgtttttttgagcgattttgtctaggtagttcgattttgattcagtttttgaaccggttgcgcgcgatagggagaggaatctcgtcgaatttctctcatctgatccagatttgatcggttagttttgtgtcgtttgttgttgcttgttttttgtttcatcctccggtcgttttatttgagcgatttcgtctaggtagttctattttgaatcggttgcgcgcgagaggcaggattttgaattatttttgtgttgattttgtggtcttagaatccaaatcctttttggatttatagtcagaatcctgtgtcgccgatgattcctaagttttttatgctgatctaggtgtcgccgatgattcctagttttttttagatctggcctatacttgtttttggttttttagttgtagttttaatttgaaatatgtcgatctgcttcttctgaggttctagacatttatttcctgaattgttttctagatctgattaggttttggttttgattttttccatgttgatgggttttgatctatgatttatggtgatggctattcaactcatgttgatttatcattatagtttttagtttttagattttttcatgtttgatttgtttatttttgtatttccagatccatgagatatcttatatagtgtttgtatttagttctatgctttctccatttctgtataataatgatgatgccaatatttttaaagttaaagctccacatgaattggtttggctagttcaggtatcatgtttatgtgtgtttcgaattacttagtgctaatctaaatgattctgtatgacatggttcactagtaatataattttctttttagtttctgtaccttttgttgttattatctgtgttatgttcattttgtaggtctaggtagatgtccaaatgacatgtatttgggttttggtatgttaattcttttgttcttgcattttttaaaactttcgatgttgattttgattagtttagccagccaaattcactccagtttttgtttaggatcaataaataaacctgattatttctgctacacctgattaaagcagtattgttttggtgagatttctgtgtgcaattggataaagcagtattgttttttggaattgaggtgaaatctgaaaaaacttgataaatttgtactcatgggatggctttatttttcttcattgaattttgattgtgcttgattgctctattaaagaattacatctcaaaattacttcttaagcacatgatatgaaagtcgtaggaagctgacaattgacattgttgtgattttgcatcattttgtattgcaaacttgacctgttcaattgacaaaaatagctgatcaatacttgttaaagttggactctatatgtgatgacaattaattggaactgtatgtatttttcctttacttaggtgacctggaaatgttctaatgtattaatgtcttagttctttaagctcatgttttttttctttgtattgatgagaatgcatctgatcttgatgagaatgttggtttactttcttacagaaaatctgtgtgatgcgatttaacttatggttctatgat

SEQ ID NO: 74127 - DNA, 13958 bp, Oryza sativa
aatggaatacccagccgatgcgcagtccgtatttagtaagattcaatctccttcaattccgcgtctatatctaactccaaattcgagtctatcttaccaaatttcctgttaacagattcataacttgaaaaacgtaagtataattctagagtactattttttcctccaatcacgcatcatttaaatttcaccgtgatctacccaaccacagtccaactcccaagcgcgctcgttaaatttcatgcaacagactgatagagacaagtcatgtaacaatcttcgttgtgcgggctttattttttttttgaatcgattgtgcgggctttattcagcttagcactataatagtttcaggagcagtactcaagccagtttccatgatcgatggaaaacaatacataatgatggtttcaatctgtaatgtaaatcactgactctaccaatatcattgctccttgttgcataactcactacaaagattcctatataaagaaactgtttaattgtaacagtaaattataatccttgttgcgagtattccttggcaattatgccaactgattttgcgatccaacgcacatcttttcttagatggttattcatcttctgattttaatcgatgaaatatcatttttcttttaagcatttcggtgtacatctaatttgttcacactgcaatgggacaatcattaatctcattatttgggcactgtaccataactctttttaagtagttgtttggagagctaagaaaatacacaagcaacaacatcactattgcgtactatgcttgcacctaacaaccacatggaatgattgaaccaggtaaacacgctttggcagtggaacatccacaccatgctttgctgggggcttaaaacatgctcatcagtgaggacctacagtgaagatttttttaaaaaaatatggtacaaacatatttcatctaacaattatttactccctcgctcctataataataaattaactgtaattccatatgattaaaaacaagtaaaaagtaagtccaattctagagtactattttttcctccaatcactcatcatttaaatttctccctcatctctccaaccactgtccaactcccaaggacactaattaaataagggatatatatctaggttatgtttcttccaggatattttttattttcaatcatacaatcacattaatattagaacagatatctataatgcacttcttagtcgctgccagttgtcttagttgctttggatctattgaccgtgtttttcttctacataggactagtgtctcaattggagactgcagagggcatttagttttctgcatagatatataatacaataactgccgagttgccactgtgaaccaaaagtcctatgatcactcttggatctcagtgagttgttcccactcgagggtttatactgtgatccaaaagtgccaaggtactaagctatatgaaagtattcatagtgggaacaaccctcctagcagaaactcgcgttcacattaaataacttcaaaaaatttgactaaaatttagagggatgatttattatatggaaaacaaatttatacaaattttggtcgatttctatatgtggacccacatatttctatgtggcaggcctaattccaacccccaattattttctgaatgattatacttacataaaaatgggcagaactagtcatcaataaaaataaataaccggtagcctaactcactcaaatccccaataaatattctacgagcaagtacaccaaccgttatagaacagtgatgcagccacaattattcagctcttgccgatagattcatcaatcagctggtcgcttataacatatcgtgaagccttatagattgcatgcttaaccagcagccacgactcttaagcatgtgtagatggatggtacatgtcctttaacctatccggccatacgatgcacctgcgtatggtactgtcacgtttgtgccatgtcattgaagtcgatatgtgctattgattacttgtttctcttttttaatctcgattacttaatcagctcatcggttgcctcaatcatggaacagtggccttatataatgtgtgtttaatcacagccacgtctgtagaacatgagtaggtggcagttacatatcctaataacctatccagccacaagatacaactgtgtatggtactgtcacagatgtgccttgtcattgaagacgatatgtcctattgattgattgtttctctttttttttatctcaattacttaatcagctcgccggtaggctccatcatggaacagtggtgtgacctcaatcatggaatagtggtgtgaccttaatcagctcttgtcggtacgcctatcaaccggtcgttaataacttatcatggcccaatacatgtccatattttaatattgtcctatcagcgctatatatttcatgtactgcaacttgcatcatcatgttccaaatcttttaagatgtctttagttttcccagttacatccacgcctacttaatgtgaaatgtttagatcagatccatttgatatctaccatatgatatcttgtatatgtatgcaacaaaactaaaaacatgcgtgtgatatgtctggtattaattccctcagccagctaaaagcattagattaagggacaagttgttggaacttgttggtatgagtattctattaatcctattaagccctaggccaggatgtcacaccccaacacccccattcatatacacaaccatcaatatatttaacacaaccatattcacataacattcattttgatcacatatttcatatccattcacatatttcacacggccttaatgggagcagctcgatgctctgacagcgaaatgaattgacatatatatttgagacagaagccaatccaatctatttctaagattgaagatatcctcaccaggtaaagatcagaactgaaatacaaattagaaaacataattgggtgaacatacccatccaatttgaaagtgttactcaacttgcaaacttggtgagttatattcttcttagatctgaatatgtagatgacaaatcaaccaattgatctacgtgatattgttggccgtatccttcaactggaataatgaaaattgatctgcagttcaggacaaataaaaaaaagaattgactcagtatcaagtatctggatcctgggacaggaaacggaaggaattgaaatgcatgggaaaactgtttgataacaaaaatgggaaaataatgctaatatgtattgggccatgcttgcataaacactgaacacatacaggttcaaattagaatgctggtcctattttggggaaacaaattagatgaatcaaccaaaggcaaagaggaagttggtaacctgtgctagatcgttggagaaaattgaagaggatggtgcagtgatgcatatttttccagcgagcaagctccagcaacttgagcgaaacaccatcggcctgatagattaactatcccgcttgataatgattatgattttatgaatttataagtaaatggaaagaggggataagaagagaacaaaaggcattagagccattaagaatgaccatctgtctgcctatcatggtggcatcggttttcagaagtaattgttcttgccgccgtcgatggttactcgtggtgatcggagttcacatcgaccactcgcatgccgcaagaggagaaggaagtgaggagactggatgggctggatcaatcgcttaagctgggttgggcctcagctgctgcaaccgagctatgtaacggagagctgagggagtttgcaaacgttgagatcaaatctaacggttctggaatttgtggtgacgtggcttcatgtgagggctgctttataggtgttaatgatcttagtaggtaccaactatatagagttgggagttttgagagacgatgctatttggttgggagatattggagttgtggtgggatagggatgggaatttataaaggaactctctcctttctaatatctggatagtggtggtaattgagaggaaatttctcctatactttatctaaaaaaaaatctcaaccacctgttttttttctaacttctaatcttcaactaaactaccaatcatctatcaattcccaccacctctaccaaacaaaagattgggactaaaaatcaaatttccatgttaatctcaccatcaatttactcgttgaaactaccaatcatcttccctcgagttttcaaacaagtcgtaatcattttattccccattccaccactacactgagttgcttcatacactgaattttttaatacatttaggtcattgtaagtttcgctatgtgagtaacggttttgataagaaactttcatatgcaaatgttatcaggatttaggaataattcctatttctagcgtcttcaatgtaagaaagattgtaaatgttattaaatttcatgcaccaaatagttcaacctaaaagattataaactgatgagaaaacacgtgatgcggatatcactccttcggatacacacaacaatcctccaccggtcattcaaggaccgataacaagcgctcgcgcgcgacaattgaatttagaggtgagctcgttcctatgtgctttttttgtacgaatttgagaatagattgctacctaatgattatattgtgattaggaacaatagaaggggaaaggagacacttgggaaaggacttagagtcatggaggatcatcgaggacatccaagtcaaggtggaggcccaaaccaagtcggcttcgagtgcaattcagagtctaggatcagtctgcactaaaatgggcacgcaggtcgcatacgtgaccagattggggcgttctctatatggatggaaagctaagaagatatcctttccaatggttttggacacacgtccaaattctttccgagtcaacgggaatcgactgaataagttgacatccaaaatatatcccggtgctgcatcatcctatttgggctttcgggccgtgtatcgtgttggaacctattagggttgcgttaagggttggttgcatgaccctaaactcttgatatcagtacctgtcgtcatctttagggtttgggttttgcttagattattctgtcgagaacagtttcaccgctagatcggtttgtaagacccaacttgtgagcttattcattcatctgcatttttggttgcgtccttctttgttcctgtgtgtgttcttcgattcgcaaatagggattagccttctcggcgaggtcatccgcgtttcgacatgggtgataaccagaggagacgtggtgctgcgattgcggggctcaatagtgtgttcgttcaagaagccggatcgatttgtgtcgcgactccgcccaaatcgttgattatcagaacctttcgaaagatcgggaaacctagtcaacatcaagtggtattagagctctaggttcaccgtcaggttcgctcggattctttatcctagtttagtttttgttttcgcatttatcctagagtctaaagaaaagccaaaaaaaaaagttgtagtcgttagtgtccttaacccaaaccgtgtttggcctttgcacaatccttttcagagtttgtagtgttgagtttgagtcctagcttaagttcttgttgatggtctagtgcatgttttagtctagtcgtgtgttttcctttgtaaccatagccgccacctttcatccgtgtgttagggttcatcttttgagatccgtttctgccatcataaacacctatccagatcaccacacctcactagaacatcctacatactccgttgccaccatatcccataccaccgctaaacagactagtttatataccctctggaaaacctacacggaagccccaacttcaaacagccataacttttgcatacggactcagactcagaaaaaaattggcttgcaaaattgtctgttcgagctcacaagtttctgcacattctttatagtggcttcagaaaattccataggccacatatcaactctgcttgagctgtaacttcgtggtgtgcttatcagccttgcggttttgctgtttttgctgagactcgctgaagcttgcctgccagtccttcatttgcgccatcattgttaccactactgtctaggacacgagtagaccagcaactagtggcaagtgacttgggatttttatttagcattactatctgtcattggattgtgtaccactcacatatatttagccttcctagctccacatattacttctggacagcacatgttcttgatccctacaatcgctgactacgccttccaggtatccattgcttggtaagggcttggtaaggttcttcatattgctgagagtagttgagaggcaccactgcacctgcctggtagattattatggataaccttcacatttgttgttgttttggtgtttcaatggcaggtgacgatgatgagaggactgcccaggactttgctgactgtgtcagtgttgacggtcgttatcgatcaattttgaccgtcaatattaccaaaatagaggtgaactagtgatgattgtaatgcatatacatgttagagtaataatattccactagtacttggttcactaaccttttgcagagaataaccataaagtggaggagaatcgacattgagtcaaacgataaatcattcggataatatcgagaatcagacttatgcatgaatgggccaagaactcagaattgacacgatgaattgggccaaaattcacaagtctgcataaaggagcaatagaggaggccgccagccgaagatgggctggggatggccttgcccatggttcggccgaacccatcctggtgtcgttggatgcaggtttcggcatggacgtccaggattgcatcccaatgacggttggagggcacttcggacaattccccttccaaaaccgtcataactacctctatataaggacttcaccttctcccttcactcacatacctcacgcaaagctctctcatattctcttaagtttagtttagtagtatcaagctggtggaataggaatagagtagaaaatcaggagtctggaagcgttcggaacagttcaggtatggctctagtagctttcctttcctcttttataagctttgtactattattagaatactcttctttatacatttacggtattgaaatactttccgagtatatgaatgccaactttacattatgttcatgttatactgaatatgctgctagcttatctgggagatgctttggtgcgggtataatgtttgcttatgccattactctatgtcatgacgatgatattagagtattatctggtagtttagacgtagtgtctagattacgggatatcattatttggggttatatgctgcggatgagaggtgggccgctaatggtgacagcttagtacgggtatacctccgcgcgtttatattgtcctaagttaattccctagggagggtactcctccatttttagcccaggttatatggtcatgacgggctgtcgtaagaaactcggtagtcaggggtggcttctcgaagtaccagaagggcatcggatagagggtattagctagtatatcagttaactagaatgtatgtatactatgtatactagaagtataggaatagatgatctcttttttctttccacttagcttagataatatattatgagaatgagtagctgatgcttgtgtgtcactctacccttggattatcttaacccctgcttagaacatgattattacaagtaatatataaattattagtcaagttctctctacatgatcttcccacgggataaaataaatatgatacccttggaatactctcgggtgatatgctacaattgtatatccgtgcgcttgcggataaactttttaaccataatataccaggagtatttctgcgccaatgctgggaattatatttctagtaatgtcgttaagaaatatcgacagtctgtcaagagcaactacgaactagtgtagaaaattgctcaaaatgacatgacggaggccgttacaaaggctgtccaagatgccatcaataaaagtggcttcttaaaccacatggagaggctggacaagcggatatccacgctagctaatcgggttgctgcgttggagacacaagaaccttccagtgaggaagtgagtggcagcaacgctggtggccatcctgaggacacgatgtatgatttagtggcaatattgatgcagaagctacaaggcaagcacgactacgacgtcgtctatgcacataccgcacaggtatgggtggcacttcaaatgaccaccaccaacaaggtaataataatcgtgtgcccgatgacccttatgctaaggttaagtttaaaataccatctttttcgggttattatgatgctgagaaataccatgattgggagatgacagtggagcaaaaatttagtgcccatcttgtgcctgagtagcatagagttcgacaagactgatgaaggagtcttggtatttcttaacgacattactagaaatataatctccagcaatggcgcagaaatactcttggtatattatggttacagagttcatccgcaagcgcacggatataccattgtagcatttcacccgagagtattccaagggtatcgtatttatttaatcccgtgggaagatgatagtagagagaaatgtactaataatttatatgttacttgtaataatcatagtctaaggagggattaggataaatcaatgggtagagtgacacacatgcatggagctactcattctcgtactaaattacctaagctaagtggaaagaaaatagaaaagaatctattcctatacttctagtatacatagtgtatatacattctagttatacgattaactagctaataccctctttccgatgcactcgtggtacttcgagaagccacccctgactgctgagttccttacgacagcccgttatgaccatacaaccggggttaaatatggagcagtaccctccctaggaaattaacttaggattatatacatgcgcggaggaatacccgtactgagctatcaccttcagcggcccacctctcatccgcagcatctaaccccaaataatgatatcccgtaatctagacaccacgcctaaactaccagatactactctaatatcatcatcatgacatagagtaattgcataagcaaacattatacctgtacctatgcatctcccagataaactaggagtataatcagcataacatgaacataaagtaaagttggcattcatatactcggaaagcatttcaataccataaatgtataaagaagagtattctaaataaagtacaaagcttacaaaagagtgaagcagagctactagagccataaccgaactcttccgaaggcttccggactctgatttctattctattcctactccactagcttaagaacactaaactaaacttgagagaatatgggagagctttgcttgaggtgtgtgagtgaagtgaggatgagagctccttttataacctcctaatgacggttgtgacggttggaatggtcggaaataccctccaaccgccattgggggctgatctacaccatctagaaaagacctggatcaaacggtgctgaggagggttcggctgaacctggggccggcccaaccagcccagattacggctggtggcatcctctcgtgctcttctccgtagacttgtgaattttggccccattcgtcgtgtcatttccgagttcttggcccattcatgcataagtctgattctcgacatcgtccgattgatttatcgtttgatttgatgtcgattctcctccactttatgattattctctgcaaaagtttagtgaaccaaatactagtggaatattattattctaacatgaatatgcattgcaagcataactagttctcctctatttagtaaatattgacgttcgaaactgattgctaacgaccatcaacaaaacaccccaagattgaacctttgctcgtcccaagtaaaggacgaaaggaaacaaagacttggttgttaatcaggagttgctactatgctgaatatctcaaaggtatatgtaatctctcttaaattaaataatctttggcacggtggcttaccctaacccctgattcccaccagacactgcttctccttgccttgggcggttgaaagacagaacaacaattaaagcagtaatcacccaatctttgttcaacttttattccggaagttttcaaatgattttgcaaaagaaagccgagttcctcaaatgattcactcagtctctctaagtgtatcaataagaattcctcaccattttgccattttgattcttactctaaggtttgatatgtggtgcttggtagggatcaaacatggcatatttgcattcacatttattactaagtcaaaaactcagactaaaatagatgactaaacatacttaggatcatgcaaagtgtgtgtgtgtgtgatatatggtggaaatggaatatgaagaaaaataaagaaaatgcttcttctttgtgcttacgtcctcccaaaaatcacactacaagagggttgagctatcgccaccaatttattacaacgaaaaataattcatggcaatatattatactatcacaatgatattttttctatggcaaataactatattttgttgcaacgatttacaatcgttgttttattcagtatttttgttgcaataggaaatgagctatcgccaaaaaaaacattactattgcaaaaaaacatgttctatcgccacacatttagttcgttgcaataaaaaatttatcatctcataatttgacttattcttttcatatggacacggattaggataaattttatatgaaatttatagctctcgatgagatctacaacttaaattttttatttgaaatcttttaaatactcaaattcatgattcaaatctaagttaggcagtctcaaatggaattgtatgcatttttaaacaaaactgatgcgtaggtgagttggtcatggagagcgcgcgtaagggagagatcttgggttcgaatcctgaacatgacaagatatcaaaagaagatagttaggatgataaattaatattgagacatttaatttggtacgtataactaatgccacacatagagtggtggcaatagttatttattacaaccatgtgaagtgttgcaatatatattttttgccacatctattttatggcaatatcaaattttattacaactaaataaaaatcgttgcaataacctgttaccacgctatttattaccacggctaacaacgattttaagattgtggcaacatgtatctattgccacaattttagcattgatgctacgatttttttcatggcaataaattatttttctagtagtgtcattcttttattaataaggagagggcatggccattttattcctttttttatataatatcatgctcatgcttgaaagagcataactttattattttttctttttttctcataaccatgcctttccctccttcttctttttttttccagaaagaattttctttttaggagaagaaagcacacaaaagcatgaagaatttatttagtggtagaatggaaatggaatggataattgctagctcagtgtaggagtttagcatgtgcatatatgtgggtatatgatcttgatcatagagcatgaaaagtatctacacaagtcacaagaatttgacaaagttcaattgaatggcaagtaaccaaaatttatatggttttaatcataatggcacatttttggctctcgtaagaatttatatcaaatgagaaactttcaaatttatcattttgaaaaacaaacatccggaatttaagtcaaacttggactaggatcatagcaacccttatttactatctcttatgttgcaacaacttagacttagattagcaaatgcagctcatttacctcaggttctcaaataattgtgggctacttacatttaatttgtgagagagcacttacctatgaatccatacataagagatataaaacagagcaactattcatcatttcaacaaagagaactagtttgtcttacctagcatgataaaacctaacctatctttttggtatattctattttgcaaattattatgttgttttcaggtgtatagaatgcaattggaaagggaaatacgcaatatgatacaagttacctcagtgaggggagagatgtccccccctcccaagcttggctttcgctctggttccttgataaagattgaacccctgaaagcggaagtacgcttgagggtcctcatgttgttgctgcatcaggttgttgatgttgatgaactgagcatcagtagtctgatgctattcttgcgtttgtgctatgtgttcctcgaggttgtattggatctctcccatctaaatatcaagggtatccattctcctggtcatttcaccccagtcccaacgagatggaggcataccacttggtacgggggactgatggctctagcctccccactgtatgtcatgaggcacccgccaccggtcctcactaccgcttgcgcagcttgagactccgatgctgtggcgtggagcttgggtccatccaggtgcatccccagttggctcccaacttgcctcatacatttgcacgggtgttgaggatgatgaaccttctcgttcattacttgccatgttgcgtgtctccctgtatgttccacctgcacgagattcttctatggtatgcaagggaatggttagttcatggtagttgttcaaataatatcccgcattaggcaacaagatttcatatgtacaaccggggaagaagtaaatcaaagatccatctactccatgtttaagaatgttcccttgcactagataattctcatctatacagggacaagcggctaagacataagcaatctaatcattgttaataacccctagtccctttgttatccgagtaatcaaggaagtgcactccacaggagtagaaaatcttatactttctagcctttgccttatcatacatttcacagcagcaactttgatcttcctaaccatgacaaacatgacaattaattcatcccctctaatgggtcgtagatcacctctaggaaacaaagttatagcaatccatttatgcataagcctaagtgtaggattatggttatcattcgtcctagttttcttgcaaattggagcattagaaatgtcttcccaaaacctatttttctcgaacctagaaattcctttctggagatcgattttacaggaatcgtgaaaaccaagaagtgtacataatccttcccatgaaagtgtatatttcttatggaaaaagcgaaaagaaatcccatcttgtatttctttcaaagtgcacagaaattgcaaagcaagtgttgtcgaattgataactgtgtcacgtcgaaggacctagttcttttaacagtggttggaagtaaagacaattgtattgcttagtaaaaattttttcagatccccctgttacatggccctagactctccattagggtttaggctctacagaggaatttacgtggttgcccttatgatagggacatctttatgggcatacaatgtcttttgctcgtatgggctcctaatgggccaagtgactcggcccagtccatggtgaagcctctggaaggcgtgttggcctgctgggccttctcctggcaaggttcgatacttggcgaaacacatgccctccggcatggtccatctttggcgaagcttgtcaacttgatgctacggcttttgctgtttggctttcacctatgttgtcccttcgaccttcgccacttgcctccagcctacgcctttgcctatgtccttggtttcggtaagcccggccaaaggtccttgtggtatacctccaacaagcccctcaagggcaag

SEQ ID NO: 74128 - DNA, 11112 bp, Oryza sativa
catttgtcctcacttgcattgagttatcttcatatgcatttgattggagttgttcctgaatcaaaggtgtgcagaaaatttaagatatgtgagcacacatatatatattataggaagataatgagaaacttgctttgttcaggtgaggatctacagtgtaatgaccggtgtcaggcgacaccgatgatttttagcaaaaactatagcgaaattgcttatccatataatataacaccataatctaaatataattagcatattatgacactaatagacacgttatgacaccaacgaattgattttttggatccgccactggctttgttgatcttaaggtggattgtgaaggtccatctgtttgtgtattttctaatgccgtaacatcttttcctatgagattaaaatagagaacaaaagtataagttaacaacaaaatagaagagaaggcataatttagtttagagaacctacttttctttcttgttttcttatttgaagtatttcttcctctatcaagtacactttttgatcttttagaatttagaccttttttgtgtggaggaactctaaaagagacacgtgtcttcacaacatcttcagtgcactgaattgtacatttaggaagatcatcatctaaactgactttgcttagcaagttatctattgtcaggcccaaaaattcactagtaatttccgaactaatttgtgcattaaatcctcatccaggaatcagccgaggtacataaaccgacaatttaatatacagattcatcaaataactaaatcgacaaatacttacataaaaggcactttagtccttaccacgaagaaaactgcagcggaaaaaaaatctagcgaagcttcatctccacttccacaggcagctcaactgggatctaagccaaaggtcttctccttctggatcctttttcttcaattgagatttgatgatgattgcaaggtgagtacatggaatactccgcaagccacacagcaagtatgcaagtgcacaaggatactaaaggatggcataatatagtgttcatttgcgaaaacaacatttagcaaagatctaagagtagtaacacagcagagtaattaatcatcaatattaatcaacactgaacagcgcacccatgctgcttaggcccaaccaaacctgaacaaccaaccccggtcgtacagatcaatcctccaaactaggaatttaccattccaaaccaagagtcaaattaattatcacattattaacattaatgagtagtgtgggactaatcacgaaaacattgttagaccttgccataatcgcgggcacggctattcgaatagttttactctggccagagatataccactgtacccacaagacacgattccacacatgttgccatgccccgaagtacccccacggcactaaaagggggaaatcgtgacaatacccttcgcataacacaactcaccacagtgcaccgttcctagatcataatcacctcctctacaaccagaggcatggactcccagcgacccccacggacttctcgccgcttcttagtctggcaccccgtaatgaaccatgctatacaaaaggtaaagccgttgcccatgctggcttgtggttggcacggttaatgtttcacaacagtagctcgcaaaccagtccttaattgtcatgagcacgaccttcaaaaccatgtgctaacaacccaccattgtcaagttttaattatcaattaattatcataacacaattaaccatcgtgagctaccattaaatataaccataaataataatgtagtatgattcatcccattaatgagctaatgtttctaagcatggctaagcaattatatatatatagcatttacctgaatcaatccaatatataaggtctaaactaatcaatttattacccataggaaaataaagtcatcttcggccataattaattgggaaaggctcaccacccgatgacattcgaaaataatgcataagttgaaataaaacaatagctttaaacagattcaacatgctcaaagggttgtttggaatttgtatgacttgccttgcaaacaagcgtcttcaattcgtcttcaggaacttcttcaacgaactaacaatccttcgaaatgatcgaaaactaaacctagaacgcaaaaaaggaaaaacacaaataaaaaccaaataaacagtaggtagagtttgaatttagatgaattatgagacttgaacgaatgagttcgtatgaattagctatgaattttacaagatttaatataatttagcaaaaggaattacgatttatttggaacagaaaaatagacgctgacgtcagcgatgacatcatcgccggcaacgcaccggaccgcaaggtcgcaagcgctaggaggctcggccgggctatccgagtgcaccaacgcgaataggacgacgagacgaactcaccgaggggcggcacgaccacagacgatgacgggagatggccggcgacgagattgagacggcgaactccggggaaaaaggatgggtggacgggcttcctgaggaccttgcgatgccgacgcaggcttctgcgatgaccagcggagacggcaacggcgacgcagcttggctgaggatcgaatagatcggcctcacggggacgacggtgtactgatcgacagcaacgtcgaagctccggtggtttgcagcggcagcgcatgggtgaacaggcttcggcttggcgctgcgataccaacggaggagacggcggggttcggcgaccacggagtcgacggcgatgtgcggctggagaagcggcaaaggccgaaaccctcgggttcgcgtcggcaagcggcttccggcgggatttggcgaaaaggaaccggtggacggggtagagctcttcactgcgaagccgaggaaggcgacggcgcagttctgggatgaccgaggaggcggcgcgacgtggctggagcggcggccggcaaaggagagagaagccgagcgtggcggcggctctagggctagggaaaaattcaaaaaaaaaggaggaaacggatgaggaggccgaggggctgccaaaggagggggggatcggctcggatacgaggggaatcggcggcgaaagagctagggttcgtcggcaaaatagaagataaactacacttcgaatccacgcgatataccacgggagtcttgttcctctagatccggtttctccccttcttcagtggttgttcttccggtggtcactggcggtgcggcgcccgctcccctcttcttaggtgctcctcccttcttaggctagggtgcttccagtcgatgccggggaggtccttgtttcggtagggatggcgtgcgggattggattctggcgtcctgtctggtcatcggccacgccgtaggtttgctgcagctgggttcctgtgggtgaggtggtctttggtcgagctgtagtgtgattgaatgttgaggcggagtcggagctgtttgtcttgcaagctcggcaacgatgacccccaacagatgtcccggcaatgtgacgagggtttggaggtggagcattttgagagagcctcgggtgaaaaccttgcctagtgtatcctaggttgatgatatcgacgcctatgggcgccgtttcctccttggaggtatcgtcatgttggctctctctcccttcaggtgaaaaccgggttcctttcggaacgggtgttgatagcatccttgatgttgttcccttattgaaggcttcgcttagaaggtttctgctccactagaggatgtttggtggttctggaggcctcgtttgcattatgttatcgaagctgcttgcctttggtaagctcggcaacgacgacttttgtgaggtctcaatagttgtcttctttttccttttttgtataggttttgccggtttcccgattaattaaccgtgcttgttcggtttttgggtccagtttcccttattaactgggccaattctcttcctctatatactccggcaagagaaactcctgccgtcggttcctcaaaaaaaaatataatatgcatatgcatgatttaaaactgttaaaaactgtaattatcatatataactagcatatgcatgatttaaatttgttaaaaattctaataatcatacataattaacatatgccatacaacaattaatttatatggatattcaatatatccaaaatagtttacatcgtgtacacaacaattacggcaatacatcgacggtgacggttgaccacacgtactttctcctcactattgttccttccttgtgatcgctacgtgagtaaagggtgtcttcatttgataggaggatgctagcgtcaatcctcaccgtgaaagagggttgcccatcaaactgatcataatcctcgtcaatcttgtcctctactccgacaattttccttttgcctgggagaaccacgtggcgcttcggctcgtcaggcccttttcccttctttcctttgctagacatgtccttcacgtaaaatacttgcgttacattattggcgagaataaaaggttcgtccgagtatccaaccttgttaaggtcaaccgttgacatcccactgtcatcaatcgttacgcctccaccggtcaacctaacccattggcaccagaacagagggaccttgagaggtccatagtcaagttcccatatgtcctcgatggcaccgtaatacgtgccagttgtaccatcgtgtcccatggcatcgatatgaatagcactgttctggttcgtggatttcatgtcttgggctctcgtgtagaatgtgtacccattgatctcatatccctggaatgtcgcaattgagccggatggtctcctcgccaggaaggccagttgttggttaatcgtttcgttaaccatgagatgttgtcgcagccacggggaaagtatcaatgtgatgccgtgtaatccatgcatcggacttaccgatgtttctggcgcgaactagagccaagtgctcctcgatgtaaggagccaccaatgaagattgctgcagaaccgtgaaatgggctttacggaataaattgttgtctaccgtcattattgctttccttccgagagtcccctttccctgtagtctccctttatggcgtgattcaggcaccccgattgggcgaaggtcttcaataaattctacgcagaattcaatgacctcctctgctccataccccttggcgatgcttgcctctagacgagcacggttacgaacataattcttcagaacgctcatgtacctcttgaaaggaaacatgttgtgtaggtacacaggcccgagaataccaatctctttgacaaggtgacaaagcagatgcgtcattatattgaaaaatgaaggtggaaatatcagctcaaagctgataagacattgcaccacgtcattttgaagggcttctaatctatccggatcgatgacctttcacgaaattgcgtacatgaaagcacatagctttgttattgttgcccggacattgtctggaaagataccccgaattataactggtagcagttgtgtcatcaacacgtgacagtcatgagactttatgtttgtgaacttcttctccttcgtgcttattattcactttatattcatagagtatccagacagtaccttgatgctctacaagcatttaaacatactttccttctctgccttgctaagagtgtagctggctggactcaagtaatggcttcctttctcctttggttccgggtgaaggtcgccgcgttgttctatatgcttcagatctttacgtgcttccagtgtatctttcgactttccatatacagctaggaagccaagcaggtttacgcaaaggttcttagtgaggtgcatcacgtcgattgcatggcggacgtctaagaattcccaatagggtaactcccaaaatatagagttctttttccacatcgccgcgtgactatcttcgctctctataggctggctgccaggcccctttccaaacactactttaagatctttcaccatagcaaattgttttcctgctgcaatgtttaggcttcgtacggtggtccgccttatgttcaaagtgcttgcctttcttccgtactgggtggtttgcagcaaggaatcgacgatgacctatgtacacaaccttcctacagtgcttaagatacgtactttctgtttcatccatacagtgagtgcaagccttgtaccccttgttagactgtccggataggttgctaagtgtaggccaatcgttgatggttacgaacagcagggctcgtaggttaaactcctcatgtttgtcctcgtcccacacggggacaccttccttcttccacaacagtttaagatctttgaacagtggtcttaggtacacattgatgtcgttaccaggttgcttggcgccttgaataataatcggcatcattatgtacttcctcttcatgcatagccaaggggggaggttgtagatacacatcgtaacgggccaagtgctatggccgctggccgttgctcatctctccaaaaggattcatgccattcgtacttaaaccaaaccgtatgtttcgtgcgtcctttccaaagtctttaaatgttctgtcgatgtttcgcccctgcgaaccatcggcggggtgtctcagcatcccgtcctgttgacgttattcagcgtgccaacgcatcattctagcattccccttgtttctgaacaaacgccgtagccgtggtattatagggaaataccacatcaccttagcaagaattttcttcttcattggctgcccgtcaacttcacctggatcatctcgtctaatcttgtatcgtagtgctttacaaacagggcatgcttctagcttctcgtactcctcaccgcgatataggatacaatcattcagacatgcgtgaatcttctgaacttccagtcctagagggcagactatcttcttagcctcgtacgttgtctcgggaaatttgtttccctccgaaagaatgttcttgacgagtttcaataaatcgccaaataccttgttactaacactattttttgccttccattgcaagaactctagagtggtatccaactttttgtgcccctgctcgcaacctgggtacaacgaagttctgtggtcctctaacatatgctccaatttatgggcatccttttcactttcacagtcctccttggcgtcctacaacatctgaccaagatcatccgcaacgctgttatcgtcatcatccctgtccacctcgcccgtttgatttcattcaaatccagcgtactgagcctagtccggaatgttctcatcctccacttcatcttcttccatttcaaccccttgctcaccgtgggatgtccaacaattatagcttggcatgaaccccgactcaaagaagtggaaatgaatagtcctagatgcagaatactccttctggttcttacttattgcatggacaacacataaaacccttatgcttgttagcttcggccactctcaaaaaataatgcacgccatcgataaactctttggaccgccggtcagcgtacatccattgccgatccatcttacatgaaatgaaaaaaaatcgtacataaataaattttcgtacaataatgacagtcatacaataatgataaaataattaaaaactctttaaacagtcatacaataatgacatatcattactcatacaattaataattataaaataatccaacaaacaattcttttatattatttttgaagttctaaactaatattaatgttgtattatattatttttgaagttctaaggggatattaatgttgtacttcttttaattttcaatttattttattttctatttttaagattaattttcattatattttaaactatgagaataaaactttttaagtaaacaaacaaaatttctatatattcatcttccccacaaaaattttctctctcatcaacttacaacaacgttttagagacaaaaaaaaaatgtgtgaaacatagctccaaaagtattataacaacaaaaaacattgaagaatgaagttactaaccttttagacacctccgatttgtatattatcactaaaaaaatttcgcaagaaattttggcatgacctcccctcttttttggagaaattttgaagcttgctcgggctggaggaggaagaagacatatataaagggggagatcttttgtcccggttggtagcaccaaccaggactaaagttaggatctttagtcccgattggtaacaccaaccgggactaaagatcccggggggcctgacaactttagaatcgggactaaagatcacatatgcccattgtagccccaaccgggacaaaagatcatctttagtcccggttttttgtggaaccggaactattgtggatttcgggcgaccaaccaaagatggtttctccaccagtgcaattgtaaggattctcatgtacagtaaggtgcaggtctcctttgttattcttgcctcttcacctgatctcatatatcatatatattgcagaaaatatgcatttctctatacgatttgtggacagtagatagcacttagaaggatcacagttatattgtatttcatcactggtgtgtattttgtaagtaaaatttccttgctattattatttagaaagctgaagtgtagtaaaattagaacatgtataacttcaattagttctaggagccaaattaaagttgttgttaattaactggtaaaattatttataaaggtttgcaaccatagtgtcctgattgcctgccttttgattgattgtgtacttactatttagcagctcagagaacaaatttcttttagcaaataagtggctcagagaatggaagttatgcttagaactctctatattggatagtgcaatgtgattcactggtgcaccttgcttttggggtttgacagtttgctattttgcacctgtgaactgtgaaaacttgtgcaagtgatagttcatgtgtttctagctgccacctgataaggagttcatgacttgattgcctcatttacctgacataagacgtgaaactttcttcttctttttttctacggggagacgtgaaacttactttcagcttctgaataaatccaacaaccatcttcttttcccttttcttcatctaggttttcaacaaaatgaattaaatattgttcagttattggagcaatactacagcttaaccatgttattagaaactctgtaacatgtatggttcaatggatatatagtgttttctgaccaataacagtcgcaggtcacaaccaaattaaggttgtctagcctccatccttggtaaaatagatcatcttccgtagtatcttatctctcacatatacaaaactttaacacatttctaaagtttcaatcgatctatttttcgggctggtgaatgtggatatgggtttttcgtttaaaaaatgtggatgtgggcgaggtggcggtgctggtgcacagaacaaaacactttttttttcttttcattctcatgcttgttttcaatgggaatgggtgtaaaacttgatttcttaattctttagaaagagttttcttgatttgttcatgaaagtctcagttggggctggacgctcatgaggtgacagcttccattatgcctcatgaaattttcccttgttccgggaatctgatatgttcatagcaacaacctctggcttgtgttatgcgtttctgttttcagttctacaagcaagcaaaatatgcatgtatggagtaggctggcagctcttaccaggtgcattgacacttgaacaagtttatttgatcaatgatgtggtctttgttgggatacacgtaggctacgatagcataaatcaaaatttttctatcgcgtaaaccagaaaccatgcaagctttagatcatagatcgttaccactcgacacgttgcgcagcggaagaaagcgctaaggggtcgaaggaaccctcgcgatgtagcgcgcgtcgatgtaaaggaagtagtcgatcgcaccggctcgatcttctcctcctcgttcgtcctccttgccgtactcccacgccgatcagcaccgcaaaccaacggcgcggcgcctctaccggtatccacacgtatagggatggaacgccacgcgcagatgtgctagcacccgcacgctactagggttttgctcggggaggaaaatggcggctagggtttctcacgtgatgcaatacctccgccggtcacacccctcacgaatatataggatccatcactcgggcctccaaggcccgtaggactcctattcggatccctatccgaattaagctcatattggatctatatccaatccccttattctggcccattaagcgtgcgaccctataggttcatgtacactcggctgtaacccgaaaactccttttcggtccacatgtcaacagcggcccctagcagaatgtattgacccaccggtcatacataaagatcatatcggctgaacctctagtgtatacttgtatgaacccttttgccacgatatcaattaagctcaaggctagatatgtgccatcctctaatagctcaatcattcactcgaacctgtgatagattatataacttgtgattgactcctcaatcacctttggcatggccatgcacttttataatctataacatcgagaggcccaaagatatctctccataggaggggcaaatcccatcttgattattcatatcccactacatgtttcatagcatacccaaaaactacttttataactatccaattacggagtagcgtttagcagtctctaagtaagctactacacatgttgggaaccatgataatctcaggtctaaggattcaacaccaacactaaatgagatcactgatgacacaacacatatggctcttgcagtgtctcatgttgggtctatctgtaacaccctgaaaattcgaccgacaaaaatcaaaactctaaaaatacggaccttcaaaaactttttaaataaattgcatcatgccgattttattcgcctatttcattggattttgatctcggaatttattaatcgtgaataatgaataactaactaggaataaaccctaaaaatcaaattggctaaataaataattaaaatataaattaaaataaag

SEQ ID NO: 74129 - DNA, 5723 bp, Oryza sativa
agccccgcgcgccaccccgagccccgcaccgccatcacgtcgccgcccgtcacgtcaccgccatcgtgtcgccgccccgagcccccgcgccgctgtcgcatcaggccggccacccgtccccctctctttcttccccctctcccctataaatactccacaccccctctccatttcccccactccatctccctcgttctcccctcttccctctccaccgagccaccgccttcgtgccgccgcgccgccgccttcgtgccaccgcgccatgtgccgtcgtcgcgccgccgcaccgccgccttcgtggcgccgcgccatgcgccgtcgtcaccgccgccgccgtcgtcggtaagcctccgcctcctccccatgctcggtcgccgtcgctagagagccgacagagagaggagggagaagaagccgggagggagagaaagagagaaaagaagaaagaaagaaaaaggagagaaagagagaaaagaaagaagggaaaagaaaagaaagaaaagaggagagacaaagaaaagaaaaaaaaatagaaattagagggagattagggaagttagaaaatttaaaataattagaatttaattatagatcaaatatagtcgtagaattgcaaaaatttaatataattatagattattttggtaatctctataggtgatcaattcacggtaggtactcggatttaattaataggaattttagacgtatattatatttaatcgtttagtcatagactaaattaaatcgtataatattataagataatttttggattccgtccgatatttagctcgcgatagaaatttctaacctattatatggatataatactcgggtagattaaattaaaaacttaattggtatggatataaagatttgggtggtgtccggaaaaggctagtgccgtccttggtcagttaaggaccgagccatgaagttaagcatgaaacgacccccgtacaaccgcacttctcgtatgggtatagacctagcggagtagatagctgagcggaggtagtatctatgcatagtggtttcttgatgtgtgaggcaggggctctacggtggggcaaccattggtagaaccgcgaggcgggtgtctacagtggtgtcgccatcggtaggactgccatgtgagaatctaaacataattataacttaatgcatgtgtgagtcttcccttcccgggtgcgccagaactcctctcactgctagaaaccgtgtacgcctagagtgcatgaggatgtaaagttcatggagcgggtactgccaatgcgaggttatcgaaaagctttgccgtgacgcatctcatgtgttaggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgtgggatgggatattgcatgatgatttctatactgatggagccacttcctgagaggcgggaatgtggacgtcctcagaaaaccatgatgactcaatggcaggaagctatccttgggatcacaatggatggtggacagaaccgtcattgtttaatatgaacaatggtactaaaatttgatcagtctgtgctaggtcttaggtttgtgaaaagaattataaaacttgttttgcgcaaaagaaccatagccatcctttgaatacccctgtcatgtgcattgttgctgtggtggcttgttgagtacggttggtactcacccttgcaatatacaaacttaatcagaggtcggagatgaagctttggaggatccctacgcttactaccaggagggtgatgaagacgatggcgctcgctaggtcttagttacggttgttgcctgtggcaatggcgtgccgctgccttaactccgctgctttatctacttctgtttttggaatgtattccagaccgctcggtccgatgatttaagactatgcctgcgggcttttgatgtaataattcgcactagactttcgtgtgtgtatttggtattttgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctgcacaggcccaaccatcctgaacaaccatacccagctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctgatcagaggtgtaccactgtacccacaagacacagccccacatcatgtcaccatgtgcctcaataccaccacggtacctcggaaaggagcttgcataacacaatccactgcagcgcaccattcctggatcataatcaccccctcaaaaaccagaggcatggactccccagcgacccccgtgggcttatctccgacacttctcagtcgggtgccccgcaatgaaccatgctatacaaaaggtaaagccgttgcccacgctggcttgtggttggcacggtaaatgtttcacaaccgaaactcgtgaaccggtccttaattgtcatgagcacgaccatcaaaaccatgtgctcacaacccaccattatcaggttttagttgacaagtaattaattaaccaatcacgatcaaccgtcgtgaacttccattaaatatccataagtgatagtgaagcatgatttatcacattagtgagctattgtttctaagcatggctaagcaactataaataacatctagctgaaccaatccaatatataaggtccatactagtcaaattataacccatagaaaaataaagtcatcttcggccataattaaaggggaaaggctcaccacccaatgacattcgaaaacaatgcatcagttgaaataaatcaatagctttaaacaggttcaacatgctcaaagggttgtttgggatctgtgtgacttgccttgctggccttggaactcttcaaattcttctcctgcgaaaacggactctccggaaacatcggaatctaaacagaaaagagcaaaaacaccaaaacagcacataaacaagcatgaacagtatatgtggatatttttagcatgtagatctcaattttagaaaaatttagagacttgaaccaactaaatccgagctaagatgatttagttatgaatttctgaagatttaatctattagaaaaacaggaaaaagaaaaacgatgatgacgtcatgatgacctcatcaatggccggaccaagatggcgacctcgccggagattggatggtcggctgcgactttggaggacatgtacacgtagaggacgacgagacgaacccaacggtactcaccctcgaaccaaacgacgaacgacgacggccggcgacggggtctagcggcggcgcggcttcggtcgacggcggcgacggggctccggtgatcagcggcttcgggggtcaggcggccgggcttctccaccctcccgcgcaccttacggcggtgacagcgaccggcggcgacgacggaggcgacggcgcgacgcggatggagctcggccggcgacgacggcggggtggagcacgtggcggcggcgctacgaggcacggaagatcacgggagagggggcaaacgaaagaggaggactagggggtcctttttatagccttggattgaagagatcggactcctcccgcaagaaatcgatccgggaaatcaaaaactcggttttggagataaactcgaaaacgagttcgattcggatgagatactcaacgattagctccgattttttgggggtaaagatagaggaggataagaggaatatttcccctcaactaattttagaaaaacacaaggggaaaggtcagatttggaggagaaaaaccgagccaaatcggtctcagttcggctgctagaggtagaagataaacagtgtcgagggacgcaaattagacttttcgtcttgggctggctgaaaacaaagcaaagaaagaaagagaagggggaaactcggctgggccgactagggctgcacggccgtgcacacaaaagagggagatcggccggaaagggcccaagactaggaagaggattattattacttttccaattaaaataatcacttaaatgatctttgaattgttaaaaatacttccaatgctcaaataatttcaagaaaaatcctgaaaatacttggacactcaaagtacttaaaaaaattataattagagcatttaatgattaatttaatatgtgggtaattactgaaatgctctttgtatgattaaaattaggaattgagctccgaaaaatctgagaaaattccagagagtataattaaccatggataatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacatatttcagctatgaactcgtgtgtaccagactacttgatccagggaaatggtactgtttacacgattgattcctgttataaaaacgggggtccacagagctggtatcagagccatacgactgtaggaaaagaccaaaaggcgccccaccccttttctaagttggcgaagggagaaattcccatttagtaatactttcaaaaataaaaacgctatgcttacaaaactttgtatgattttcatcttactcttaactattttcttcacaaaacgagttttactcttagttgaccttgggttttttaaaattagatggcagatcaggattcacccgctacctgggagatgggcgtacctcgcttagagggatacgtcattgagctacaccggctgatgaggcatctgcgataccccagatttccgatctaccgagtgagacagtgtggatctgtttgggaggctcgggtcgaggttcacacacgagttccttcagagtcagactaccgcttcccgacccgccaccgtcgcgacttaccggagactgcgatgcaggatgcagcccgggaggcattcctccgacttagctctatccaccgagctgagttggcgagtactgagtttgctcaccacctgtttcgagaggagagcaactccgtctgcacagttcaggacacaccttgctgctacaacccgatagtgacccgactgtcacgatgggctgaggcagtagacgacttttacgaggaggctctgttgag

SEQ ID NO: 74130 - DNA, 3661 bp, Oryza sativa
tttcgtgtgtgtgcatttggtatttcagctatgaactcgtgtgtaacagactacttgatccagggaaatggtactgtttacacgattgattcctgttataaaaacaggggtccacagagctggtatcagagccatacgactgtaggaaaagaccaaaaggcgccccaccccttttctaagttggccaagggagaaattcccatttagtaatactttcaaaaataaaaacgctatgtttacaaaactttgtacgattttcatcttactcttaactattttcttcacaaaacgagttttactcttagctgaccttgggttttttaaaattagatggcagatcaggattcatccgctacctgggagatgggcgtaccccgctcagagggatacgtcattgagctacaccggctgatgaggcgtctgcgataccccagatttccgatctaccgagtgagacagtgtggatctgtttgggaggctcgggtcgaggttcacacacgagttccttcagagtcagactaccgctttccgacccgccaccgtcgcgacttacgggagactgcgatgcaggatgcagcccggaaggcattcctccgacttagctctatccaccgagctgagttggcgagtactgagtttgctcaccacctgtttcgagaggagagcaactccgtctgcacagttcaggacacaccttgctgctacaacccgatagtgacccgactgtcacgatgggctgaggcagtagacgacttttacgaggaggctctgttggagatcgacgaccagcagaggcgtgtgggagagttagagactgaggtgactgacctcacagtgcagcagcttcagctggaagaggagcaccaggctatgaactcgtgtgtaccagactacttgatccagggaaatagtactgtttacacgattgattcctgttataaaaacgagggtccacactatccaacaacatgttcacaaccatgtgtctacattattaatttggtatctctataccatgatccatgagacatgatcatcaattaatacatgtgctgatcatttaaatatatttgttccacatatgatatttgatcagggatcctttaaaaatagtaacaaataacataaagtctcatgaaggaatcacatattcattaaccaataatgagttatctatttcaaggaacaatgtcggataaatatgtaaacatagtatgtgatacaatcatctctatgattgcctctagggcatatcactaacagtctcccacttgcactagagtcaatcatgaatgtatcttatacccattgccctagtgtgtgcctcatgcttaggctgagggagtggctttgtcaacggatctgcaacattcaaatccgtatgtattttgcatatcttcacatctcctctacccactatctcgcgaatgaggtgatactgccgtaaaatgtgtttggacttttgatgcgacctaggctccttggcttgcgcaatggcaccactattatcgcaatagaggtccatagagctagaagcactcgtcatcacacccagttgagaaacaaatttctttatccaaacagcctcagaagcggcaatgtattcggcttctgtggtagaatcaacgactatatcttgcttggaactcttccaactcacagcgcctccattcaggcagaacacaaatccagactgcgatctaaaatcatctttgtcgatttggaagcttgcgtcagtgtaaccatttacaacgagctcttcctgtcctccataggcaaggaacatatccttagttcttctcaagtacttcaggatattctttacagctatccagtgactctcacctggatctgattggtatcggcttgttgcactaagtgcatatgaaacatctggacgtgtacatagcatagcatacatgatggatccaattgccgaagcatatggaatcacactcatcttatttcgctcatcagtcgtttgaggacactgattcttgccaagattaatgccatgtgacatcggtaagaaacctttcttagaatcttgcatgttgaacctcttcaacaccttgtcaatgtatgtactctggcttaatccaattagcctctttgatctatctctatagatccttatgcccagaatatatgctgcttcccctaagtccttcattgaaaaactatttttcaacgatgtcttaacggattcaagcatagaaatatcattcccaatcaacaatatgtcatctacatataagattagaaacactagtgcgctcccactaatcttcttgtatacacaaggttcttcttcgtttctgacaaagcccaacgccttgacaacttcgtcaaaacgaatattccaactccgagatgcttgcttcaacccataaatggattgatgcaacttgcatatctttttagctgattgtggatcgtcaaatcccttaggttgtgtcatgtatacatcctcatccagatttccattaaggaaagcagttttgacatacatttgccatatctcataatcgaaataggcagcaatcgctaaaacaatccaaataaattttagcatggcgactggtgagaaagtttcatcatagtcaacaccttgaatttgtctgaaacctttcgccaccaatcgtgccttgtagatgtgaacattgccatctacatctgtctttttcttcggatcttcgcgaaaccggtgcttccacaactggttcaacaacaacttgttcaacctggtgaacaacatcttgcttagcttgttgtggttgtgtggacgtggaagcattttccggtgtttccttaatttcttcaagtcgcaccatgctcccaatatcctttcttgaaataaactctttttccaagaaaacaccgtgtcgggcgacaaacactttgccctcttcctgattataaaaataatatcctttcgtttctttaggataccccacaaagaagcatttatctgatttgggtgtgagtttgtccgattgcaaacgttttacatagacccacatccccaaatctttaggaaagacaaactgggacgcttccctgtccatatctcgtatggtgtcttatccaccgatttagatggaacactgtttagtgtgaacgcagttgtctctagagcgtaaccccaaaagcttagcagaagattagtttggctcatcattgatcgcaccatgtccaacaatgtacgattcctccattcggacaccccattccattgaggcgttcctggcggagtgagttgtggaacaattccacactcctttagatgattgccaaattcaaggctcaagtactctccaccacgatcagatcgtagatacttgattgtctttcccaaatgattttgtacctcattatgaaattccttgaacttttcaaaggactcagacttatgcctcattaagtagacataaccatatctactaaagtcatcggtaaaggtaaaaaagtacccaaaaccacctctggcagttgagctcattggtccacatacatcagtatgtactagtgccaatagttcacttgccctttcactttgacccgtgaaaggtgcctttgtcatcttgccaagtaaacaagattcgcatgtctcaaatgatcaaaaatcaaaagagtgtagaagtccatctctatgaatctt

SEQ ID NO: 74131 - DNA, 7417 bp, Oryza sativa
gtgtcttgtgggtacagtggtacacctctggctagagtaaaactattcgaatagccgtgcccgcggttatgggcgagttgagcaatgtttttcgtgattagtctcacacctctcacaataattatggatgttatacctggtaataatttgtttagctcctggtttggagattagatctgtacagccgggtatggttgttcaggatggttgggcctgtgcagcatgggtgtgctgttcagtgttgattaaaatttctgattaattacttcactgttttatttctcttaaatgttttgctaaatgctgcttttgcaaatgagcttgtattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctgttttcttttcattgtaagtatgtaacgttattattaagatggatttgtatattaaattgtcagtttgtgtacctcggctgattcctggacgaggattttatgcacaaattagttcggaaattactagtgaatttccgggcgtgacagacggggtggatctcggccacacgaacccgacggcggcgacggcgcggcttggcggcgaccctaacggcggctagcggcggccggagcagcggaaaagtcggcggcaaggggttgcacggcgcgggagcgatgggaggctcgagagagtgcggtgaaatggggaaaaagtgagaggggacgacggcgatgcttaaatagggggagagggaaccggacgtggccgggagaggcgggaatcgccggccgacgtgggggagtgggggaggagagagaggcgggattcgaaaatcgaatcccggccatctcgggcgcgggcgcgagcggtataggcagaggagtgggcgcggcatacacggcgcacgcgcgggcatggtcgacgtggcccggaggagccgtagacgagggcccgtcgacggttgcgggctcgccggcgcgagcgagatcggtgggaggtggggaaaggacccgacaggtgggccccacctgtcggcgaccccgagatagcaggcggcgggccggcctgactgggcctcggcctgcggccggcccagcaagtaggagggggaggaaggagggaatgggccgacggcccattcgaaaaaaagttggcaatagagaggactaagataatgcaaaaggtaaaaggattttccctggaattaaaatattgcttactcttttttaattggttaaaattatttctagagctctgaaaattccactaaaaatcctgttagtgaatttcgacatgtagaactcaagaaaaattccacatgccaattccgattattatttgcattgatttaaaagggtttactcttgctttgcaccggcatctttatagggtcatttataaattaaaattttggcttggggggaaaacttcggggtgtgacagtaatcgactgtagacgtagggaagttaccctgaccacaccttggggatcggatatgacagcgaccgtggatcaagatcctagactaaccgaacgtgccagaggcatatttaccaagctacccctaaagggaatgcccgtagtgaagcgatttcctgatgtgttcccagaagatttacctggaatgccaccagatcgtgacatagagttcattattgacctgatacccggaactgctcccatatccaagagaccatatcggatgccagtcaatgagttggaagaacttaaaaagcaaatcagagagttgcaagaaaagggatttgtacgtcccagttcgtcaccttggggagccccagtgttattcgttaagaagaaagatggtagcatgagaatgtgtgtggactaccgctcactgaacgaagtaactttcaaaaacaagtacccactaccacggactgatgatctcttcgatcaacttgaaggagctaaggtgttctctaagattgaccttcgatcaggataccaccaattgaaaattaggaccggggatatacctaagaccgcgttctcaacgtgttatggattgtatgagtttgcagtgatatcgtttggattaaccaacgccccggcatactttatgaatctcatgaataaggtgttcatggattacttggacaaatttgtggtagtattcatcgatgatattttaatctactccaaggatgaggaagagcatgcggaacacttgcgattggtactcgagaaacttcggaagcataaattatatgcaaagtttagtaaatgtgagttctggttagaagaagtcgcttttctaggccatgtaatctcagccggtggagtagcagtggatcctgctaaagttgaggccattacggaatggaaggcacccaaatctgtgactaagattcggagttttctaggtttggccggatactaccggaggttcattgaggggttctctaagatagcccgacctataacacaactactcaagaaagaaaagaagtttgtatggtcagaacagtgtcaagaaagctttgagcagctcaaagaaaagctgacctcggcacctattctgtttcttcccgacaacaggaaagactttcttatatattgtgatgcatcgaggcaaggactaggaggagtactgatgcaggacggaaaagttgtggcctatgcgtcgtgacaattgtgaccacatgaggaaaactaccctactcatgacctagaactcgcagctgtggttcatgcgctaaagatttggagacattatctgatttgaaatcattgtgatatctacactgaccacaagagtctgaagtatattttcacccagtcagatctcaacttgaggcaaaggcgatggttggaattaatcaaggactatgatctagaggttcactatcaccccggcaaggccaacgttgtggccgacgctttgagtcggaagagccattgcaatcatctgaggacggaagggatggctcctgagcttaaggaggaaatggcccaactaaacctacatatagtacctcgtggacagataaacaccttggacattcaacctcttctgagaacccaaatagaaaaagcccagaaggacaacgaggaaatccgagaggtgaaggaacgcctagccgcaggatttgcaaaggaattttcaaccgacgaaaaagatgttctatggtataaaaagaggatctatgtacccgaacagggtggactgagaggattaatcttaaaggaagctcacgaatcggcatattcattgcaccccggaagtaccaagatgtaccaggatctgaaggaaggatactggtggcccaatatgaagagagatgtggccgaatacgtagcgctctgtgacgtatgccagaggtgaaggctgagcaccagagaccggcaggtctgttgcaaccccttaggattaccgaatggaaatgggatgagataggtatggatttcatagtcggggttgcccaagaccgcaacagggtacgattccatctgggtgattgtggatcgactcaccaagacggcaagattcatccccgtcaagacaaactatagcagtgctaaactcaccgagttgtacatgaccaggatagtgtgtcttcatggtgtgcctaagaggattatatccgatcgaggcacatagtttacctcgcatttctgggaaaaagtacatgaagtcctaggaagttatcttgcttttagcacagcttatcatccacagacagatggccagacggagagaacaaaccaggtcttggaggacatgctgagagcttgtgcattggattttagcaaagactgggagagatgtttgccctacgccgaattctcctacaacaacagctttcaagcaagcctaaagatgtcacccaatgaggcattgtttggtcgacgatgttgaaccccactgatgtggtccgagacagatgaacaggcagtatttggacctgacattatcaaagaagccgaagaaaaggttcgcctgattcgagaccatctaaaagtggcacaatcacgatagaagagttacgccgacacccgaagaagaaacctggaatttaaggaaggagattacatttatctaaaggtttctccgatgaggggaacgaaaaggtttaaggtcaaaggaaaactagcaccaagatatgtgggaccattccaaatcatcgctagacgaggagaagttgcatatcagttacagctaccgaaaaacatcgccgatgtgcacccagtcttccacgtgtctcagttaaagaagtgcttgcgagtgccggaagaacaagctacattggaagaaattcgtattagcaatgatctcatgtatccagaacacccagtccggatattggatgaagctgaaaagaggactagaaccaaagtgtggcgtatgtacaaggtatctcatgtcgccgtcgcgtcgtcgcctcgcgccccgcgccccttcccagccgtgcgcccgtcccatcttccctgctgcgcgcgccttacgccccgagccggcgcgccgtcatcccaccggcccgcgcgcccacgcaccccatcaccggccgtcccgtcgccacgcgtgttccatcgccgcctcgagcctgcgccgctgtcgtcgtcgccattccatcgccgcgcgccgagccccacgccgcgccgcgccgttccatcaccgcgcgccgagccctgcgcccgcccaagccccgcgccgacatcacgttgccggccgtcgcgtccccgccgtcgtgtcgccgccccgcgccggcgtcgcgtcaggcccgccaccccgtcccctatatttcttccccctctcccctataaatactccacaccccctctccatttgccccactccatctccctctttctccgatcttccctctccaccgagccactaccttcgtgccgccgcgctgccgccatcgcgccgctgcaccgccgcctttgtgccaccgcgccgtgcgccgtcgtcgcgccggcctcgcaccgtcgccttcgtggcgccgcgccgtgcgccgccgttgcgccgtcatcaccgccgtcgccgtcgtcggtaagccgccgcctcctctccttgctcggtcgtcgtcgccagagagctgagagagagagaggagggagaagaagccgggagggagagaaagagagaaaagaagaaagaaagaaaaaggagagaaagaaagaaaagaaagaagggaaaagaaaagaaagaaaagaggagagaaaaagaaaagaaaagaataaataaatagaaattagagagagattagggaagttagaaaatttaaaataattggaatttaattatagatcaattatagtcgtagaattgcaaaaatttaatataattatagattattttggtaatctctataggtgatcaattcacggtaggtactcggatttaattaataggaattttagacgtatattatatttaatcgtttagtcatagactaaattaaatcgtataatattataagataatttttggattccgtctgatatttagctcgcgatagaaatttctaacctattatatggatataatactcgggtacattaaattaaaaacttatgataacaaaatatttatccccgcaaaaatagtttaggatgtataaattgaaattaggtttgccctagttcgcgaatagtaaagttaatataaaagaatcgactttcgcattcgacttccatttggatttatttggatttttatttgaattctaaccgaattcaaatcaatttttgcacgtaactatagagcccaagggagttgcggatccaagtgaaggccaagacccgcaagactttgagcaaggcaagtcatcactattccttgaacatgttgatcccaattgcgaaattattttgtttacaaataaactacatgcaatgatgaacatcctacttgtgattatgccatgccttgattcttgtttaccccttatggcttcgtaaccatgtttacgtatgagtccctagttaattatgacaattgcttagaaatgctattctagaatcatgcatactcatatttatcaaatgctatatgcttgggcaattacctttgggaaggtaattgagatgcggcatgtggggacaggagcgccatattgccatgatgttgatgacatgatttgtgaaaggagaaataaaattaaacaactgttttcgactgaggcggacggaagatttgggtgttgtccggaaaaggctagtgccgtccttggcaagttaaggactgagccatgaagttaagcatgaaacgacccccgtacaaccgcacttctcgtatgggtatagacctagcggagtagatagctgagcggaggtaatatccatgcatagtggtttcttgatgtgtgaggcaggggctctacggtggggcaaccattggtagaaccgcgaggcgggtgtctacagtggtgtcgccatcggtaggactgccatgtgagaatctaaacataattataacttaatgcatgcatgagtcttcccttcccgggtgcgccagaactcctctcactgctagaaaccgtgtacgcctagagtgcatgaggatgtaaagttcatggagcgggtactgccaaggcgaggttatcgaaaagctttgccgtgacgcgtctcatgtgttgggacgaggctcatgtgttgggcagtcgcggagtgcaagtaaagtgtacatccactgcagtgtgagtaaaccaaatctattcgaatagccgtgctcacggttattgagcaccgggacatgtattacacttggctagactctaaattcttaacttgtgtgggatgggatattgcatgatgatttctatactgatgaaaccacttcctgagaggcgggaatgtggacgtcctcagaaaaccatgatgactcacaatggatggtggacagaaccgtcattgtttaatatgaacactggtactaaaatttgatcagtttgtgataggtcttaggtttgtgaaaagaattataaaacttgctttgcgcaaaagaaccatagccatcctttgaatacccctatcatgtgcattgttgctgtggtggcttgttgagtacggttgctactcacccttgcaatatacaaacttaatcagaggtcggagatgaagctttggaggatccctacacttactaccaggagggtgatgaagacgatggcactcgctaggtcttagttacggtcgttgcctgtggcaatggcgtgccgctgccttaactccgctgccttatctacttctgtttttggaatgtattctagaccgctcggtccgatgattaaagactatgcctgcgggctttggatg

SEQ ID NO: 74132 - DNA, 1474 bp, Oryza sativa
atatatatatatatatatatatatatatatatatatatatatatatatatatatatatatatatattagtctttcagtcttgctgtttgaggttctgtcccatcaatatacttaggagtatttgctgcttgggacttgcagctgacaaaatattagcattttaatgttgttcctgcactcaacaggcacctccatgcaatcaaatactgcaaggagtttctatggctccccgaagtaatgtgctttatgtttgtctgtatatcttcaaaggtgacagtgctgacagcttcttggcaatgaagttctgcacaacggatgcgattatccgacgcgccatgttcaactttggaagaggaacatgcatccagttacaagatgatgaactacttgtagaagattttagttaagagtagtatgcaaactgatgatcggcaacatttctcgttgtatggaactgaccgaaagcaatctttttgtaagaaaccgattggcaacaataacatactgggagttgaaatctgatcctcaaattcatgtttgtaagtttgccactctcttgcaaaatgcaaaacgcagctacgtgctgccaaggttcttacaaagccccatctctaacattgatctagtatagacaagagccccatttgcatcgctcaaaattcaggcgaacttcacaggaatttggcacaaacaatttcgaaattcgtactccgatgttaattccgtgggttaaaccgtttttatcgcagtgatacaccgtcgaactgaatgcaacggtcgcacaaaaatttacatattcaccctcgtaacaagtcaaaattacgaaacacaccctccattctccgctccttccgttccattccatctccggtctgagccgccgccgccgccttcttcccctctcactcccacctcactaaaaccctagcccaaaccccacctcctctcccgccatggctgccgcggcggccacctcccgcctcctccgccgccacccgcctcccctccccctcctcctccgctcctccatctcctcctcccgccctctcctccagcagcccgagctctcccccgccgccgcggccgatgcggcccccgccaccgatgccgcgccgctcccgccgaagccgagcacggggagccccttctacggcgagaactggcggaaccccgccgcggcggccaacccgtcctcatcctccctcctccccgcggtcgtcggcggcggcgcgcacgcccgcgcggcggcgtactcggcgtccccgggcgcggcggagctgaaggagacgttcgcggagtggatggcggagcagcggtgggaggagatgaagcagctgttcgagttctgggtgaggtcgctcgacccggcgtccgggaagcccaaccgccccgacgtcgacctcttcaaccactacctccgcgcgcagctcatgtccggggcgctcccgatcgagatgctggatctcgccgagca

SEQ ID NO: 74133 - DNA, 11283 bp, Oryza sativa
  unsure (1)..(11283): unsure at all n locations
tatagggcgaattcgagctcggtacccccttctacatatatttcttatttaggtctattttccagtttcgccacagcttctccatagtcttcaacgcatattccttggctttatcgtcgtctgtcccctctggatattcaaacttgctttgcagtgacgtccaacagctgttctttctactctctagaactttcttccaatccttccatgtgatctccacaacattccttaccaccgccccacattggttgctatacttcgaatatgagtcttccggtgacaagggttcccctgtctcactcatccgtgtcagcacacttacttccttcaatagcattttcttccctcgctcgcccctccatttcttgggtttgcttgaagctgttgtgcgcacgacagctgtagcttcagcttcaggttcggttgcggcttgggatttccttttggagcgacgtggagcattcttctatgtttgcaattcacgtggtttcaattaaaatccatagttcgtggttaatatgattggaactaaacatatattatatgctacgtaccaccggttcagggggaacatagtcagagtcaacttcattgtcactaccgccctttctcttctttgcaggagaaggatgggggtcactcggtgagtgatacgatctactacctggttcacttgagctcgacgaagattcctccgcgactacttgcgtgcaaatttcttcctcgatgacggcctgagtttccttgcccttgtcacccgtgggttgctcttgggtgggtttgtccattgatatcctttgaaggtgaatatatgagattggtaacgacaactatattacgatggttgaactaaattatcatcgtacatctcatggttgaaccaaacatctcacaatgtttaattatcaaaaaacatctcaccatttcaaactacctaattaagttccttaattatcaaagaatgacagatttcgaagtgcatggaaaattttggtgtctaggttggttccgtgcatggactaccctgaccaatccaaaaaaattccccatgcacttcgtattctgtgatggcttgataacctaggaactacattaaatctacggccaatctatcaattcatccatttgaactaaattttaaaccctaaacctaattaagttccttaattatcaaagaatatcttcactggtgtcagcttaagagggccgccagagaagatatcctatcttccctggcggccatcttaagttgatcgctagcgaagatgtgtttccgctggcggcccttgaccccccgactccaagattttctatgctggcggtttttccacatagccgccatgaaaaatattttccaaacgccatgaaaaatcgattttctagtagtggtataagcccgattaatagattttatatgtcgcttaaatattagagaactactatatgcaataaaagaactctaaatctctaccatttgactcaattagttgaaggttaaagaaaattaatattaaatgacactgtgccccatatttgtgtttgagaatgtttgtaagaaaaaatttgtagatatatcttttcctatataatattggcttgaaaatctatctagcatgaatacaaatgggtgcctgagggccacaaatattcatgactaactgaatcgaagcaaaccttcaaatagtagtatttcgcattttatttgaattattccgtagaatccgagactatctgtctattatatactaaaagtccatgaaacttcctagaaacgctctcaagccgccatgtggcgttttacaaacgctcctaagggcagtcccaacccataacactaacatagacactacccttccaatgcaaacaccactattccatacttcaatttaatgctacttatctcacatgatgtcttggatgttgtgtagaaccatgtctgatgcaagacatgatttccttctcttttctcatttattcacttgccacatcattttttatcctaggtggcagcttatttaatactatggacaccatcctagtcattgggttgggaatgccctaagtcgcctattagatcgatctcttcccttcccctgccgtacatgcatgccactgtacgtatgtacgtatatgtgatgcgtattccatatgccctccccttttctcctattttctaacaactcaatacaaaatagtttaaattttaaatagctaaataagcatgattctcaatttatatacaacattaaattcatttgtgctatttttatttgtaattaaataaatacatcaagatcggtattgcatatattttgcgaaggtaaaggaaaaactgaaatacgtttggacatagaccctagcgtcgcagtcattaaacaatataaaaaaatgacaacaactatatcatcttaactcattctatatataaatatgcacattaaattaaatatcatgtaggacccaaaccatcaccctgcacatcttaaaaattaagaaatcactactacgaaaatatctttcatggtggccattttaggttttcgctggcggtttttgcaaccgccacaaagcaaacgccaatgaagatcaaaatctaccctagcggttatcggccgtgagcgaaaattgattttcgctggcggttgtgttataccggccgccaattcaaattattcccaaatccactcctcgattcacaaattcacataaatttacatcaacaatttacaataaaaacagtcaaaatttttcattcacaatcaacacaaatccacacaaatcataagatattttccattcacaagccacataaatccacagaaatccgagcaccaccgcccgcggcccggtggcgtccgtcgtgacgaggtcgaggccgatagtcacgctccaccgcccgaggccccagggccgtgctccccgcgccgcagccagggcggatccgtcgttcccctgtccgtcctccccggtggcagcttcctcccctcagacagatctgggagaggggagaggatgggatgggagggcgcggcgccccagtagagctagctgcggctgctctccctcttgtggacactcctgacatggaatccgaggtaggacagcgagtcggtgaaggacagcacgcacaggatggtcgtggtcgccatcgtcgtcacttccttcgtgttcgtcgtcgccgcagcttccttcgtgatcgccgtcatcaccgtcgccagttgacgtcgtcaccatgcacatccatgccacgcccctcccgccgtcgtggtcgccatcgtcagcgccgcgcccctccggccacgcccctcccaggtggaggaggctgggggcgcagccgcgcagggaaggaggagggtctcggtgggggaggaggaggagagggaggtgggtgganannnangnnnntngnnggnnaggagatngagaagagaggggacagtgggtggttgaagggaatatattagtgcgcgtgattttaaatgacgttgatttttttttagcgggctttgttttttcgctggcggaactgtttagtaaccgccagtaaaaatgttggttttcgctggcggacatttaagaagtacgcctaaaaaaatagagtattttttatagcggacgtcttaacgtggttgccaggaaaaataggttttcgctgacggtcctatacccccacccctcttgatgtttttgctggcggttttagcatatatccgccagtgaaaattatagtgcgacgccatgaaaaattgttttcctagtagtgaatatcgttgaaattctataagaaaaaaaaagcaaaacatcctaatatcattttacacttaaatcggcaggcgtattattttcacccattagatatatcattctactcccataagccgctacttgtcacatgttaaaaattaatagaaattacatgtattctaaactaagagtccataaaactttctagaaatgctctcaagccgccatgtggtgctctacaaacgctcctaagtcatcatgtggcgctttaataaattggaaaaaaatcctaaaaattttaagaaaaaagaaaaacatctcaccattggttttagtggacccattatttttaaccattagatcaattttaaaggaatatatactcaatccaacctatgggcctattagatcgatctcacagaatatgtagccttcccttcccctgccgtacatgcatgccaccgtacgtatgtacgtatatatgtgatacatattccatatgccctccccttttctcctattttctgacaactcattacaaaatagtttaaattttaaatagctaaataaccatgattgtcaatttatatacaacattaaattcatttgtgctatttttatttgtaattaaataaatacatcaagatcggtattgcatatattttgcgaaggtaaagaaaaaactgaaatacatttggacatagaccctagcgtcgcagtcattaaacaatataaaaaaattgacaacaactatatcatcttaactcattctatatataaatatgcacattaaattaaatatcatgtaggacgcaaaccatcacccttcacatcttaaaaaattaagaaatatcgttgaaattctataagaaaagaaaaagcaaaacatcctactatcattttacacttaaatcggcaggcgtattatttttagccattagatatatcattctactactcccataagccgctacgtatcacatcttaaaaattaataaaaatcacataaattctaaaagaatgaagcatccgacctcgataaaatcattatttcagccattagatctatatttaaagaaaaactttaaaaaacaaagtgccatcccattccccctccccctcgattaacaaagcgccatctttatattctgaaattataaatatatagtaaatgaataaatatatcgttggagtatataaccatactaacaaaaacagggagtagggaaattgtcattaattaactcaagttgcacgcattagatttttaacttatgtggtatgaaaactattctacatggaccaatgggagtgctagaaaggtccattaggacacttccaaggttacatgtggccggtgatggagacaaccattaataaaaattcatactgaaaagcataattttatagcagagagtacatgtctaatatcatatcacgaaaagacaaccttgcatgagaaataacatacaaaatataacttaaatgattatctcaactctccattgtactatgttaggagtaactttgtctaatgtggtcaatattgtggatggcagtaacatccttaactctcctaagatttatttcgaggcctaacaaattagaaaacaagccatagcacaatggggccatagtaagaatgcacggggtttgtgcgagtcaggaatcccgacaatggaattgcctaagcatcaactctattttatactaacaaagaattacattggactctagcaaatgagataaaagtccgggcatggccggcgttgtattaataaaattgccaaagtatcaactcgatctattttgtattaataaagaattgcatagcaactaactccactgttgaaaaataagtttgtcgtaaattcaagattccacaattttggcgaattttaatttagattttatgtgttttaaggatcgttacaaacaaaatcataaccatatttcagagcaatcccaaatagatttttgagagaagtatcataggtttaaaatatgataaaaaatccaagtaaaaatcagccaaatttatacattcataaatctatctatctattatatactaaaagtccattaaacttcctacaaacgctctcaaaccgtcacatagaactacaaacgcttctaagctgccacatgacactctaataaattagatttatttttcttaaaatatgatggtcccattattttataccataaaaaaataaaaaattgaaaggcccacattcctctccttccgacctgtacgtgtagtacgcacgacatgctaccatacgtacgtacgtagatgtattggcccctccttcctttctgtttctatctctcttatttttcttattttgatgacccttctattcctatctctcctattttgatgatgtggtagattgaaaacatattgatgtgttcgctggaggaagttgggaacctatcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatccttagttccggttcgaatgctgtcaggacctgttaggcccccccgggatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacacttttttttctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccagagaacttcgttgtacccaggttgcgagcaggggcacaaaaagttggataccactctggagttgttgcaatggaaggccaaaaatggggttagtgacaaggcatttggcgatttattgaaactcgtcaagaacattcttccggggggaaacaaattgcccgagacaacgtacgaggctaagaagatagtctgcccgttaggactggaggttcataacattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggtgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccattacgatgtgtatctacaacctccccccctggctatgcatgaagaggaagtacataatgatgccgattattattcaaggccccaagcaacctggtaacgacatcgacgtgtacctaagaccactggtagaagatcttaaacagttgtgaaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatgatcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaataacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttcgatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtactttaaataatgttaatgcattaacttctattttataaacacatatgtaagcgaaaatcatatgcaatgctataatcttcagtcccggttcttaaccctaaccgggtttaaaaagaatttcgaaatagcgggaaaagatatttactcccggttgttgaaaacaaccgggactaaaaatcttttctttact

SEQ ID NO: 74134 - DNA, 12535 bp, Oryza sativa
tcgagctcggtaccctatatatatatatatacatgtatatatatatatatatatatatatatatatatatatatatatatatatgttacttcgcatttatcctaatacattttttttatcttgcagaaaagacgtgttgtcggagtcgtccgtcaagcctgagtggaagagctagccctaaaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggatgcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctaaagaaaatggcagaacaatttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagtgtcgcgatgccgaagtgggagcagatggaggctagcttgattgagatgggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggagatggcaagggaggtcgatgaacgcatggccgcacatcggtcccatgatccccagccgaccattcctcctgcaatggtgagcccatcaggaaaccgtagcagctgcgcctcaacggggcaggtaggatcacagagcatggacgccatgcaaacacaagacgaatcgacctgtcccgtgatgacatcactcagcggacaccatgtgagctgcatattcctttgaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccaccatctcctcctcaggatcctgcaccgtctcctcctcatgctccgccagcaccgtctccaccttaggctccagcatcgactcctcaggatcctgcaccgactcctcctcgtgctcctacacctactcccccgcaagctcctcttccggcaccttcaaagtcaagggcccccccagctccaccgcttgcccacacaagggcaacaaagaaggcgaaagttgacgccgccaagatcaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagagacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtaggacttggtatcggttccgtcatttggtccgcggcaaatagagagaaagacttaggcggaagttcaaatttccagtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatgtatgcatatatatgtattgaaacatatatatgcatggtttatatatatatatatatatatatatatatatatatatatatataaaccatgcagcaagaggggcatgcaaaaaaaaaaggtcagctctatctttagtcccggttatttcacccgggactaaagatagcgatctttagtcccggattggtactcccggtttggaaaccgggactaaaggggggttacgaaccgggactacaaagggtttctccaccagtgtatctcagctacggaaaacggagcggtccattagcgcgtgactaattaagtatcagatttttttttcaaaaatggactaatttgatttttttaaaaaacttcccatatataattttttttttacaaaaaacaccccgtttagcagtttgaaaagcgtgctcgcagaaaccgagggagaagggttgccaaaatggggtgccaaacacacccataagactatacaaactaagggcccctttgaatcgtaatcgtaggaatgaaaaaacggaggaataggaaaacataagattctgacaggaatgtaagtataaaatagagaattgcaaaacacaggaaaaatacaggaatgatcgtttgattggaccccaggaaaaacacaggaattagatgagacactactagaaaaataatttgttgccatgaaaaaaatcgtagcatcaatgctaaaattgtggcaatagatacatgttgccacaatcttaaaatcgttgttagccgtggtaataaatagcgtggtaacaggttattgcaacgatttttatttagttgtaataaaatttgatattgccataaaatggatgtggcaaaaaatatatattgcaacacttcacatggttgtaataaataactattgccaccactctatgtgtggcattagttatacgtaccaaattaaatgtctcaatattaatttatcatcctaactatcttcttttgatatcttgtcatgttcaggattcgaacccaagatctctcccttacgcgcgctctccatgaccaactcacctacgcatcagttttgtttaaaaatgcatacaattccatttgagactgcctaacttagatttgaatcatgaatttgagtatttaaaagatttcaaataaaaaatttaagttgtagatctcatcgagagctataaatttcatataaaatttatcctaatccgtgtccatatgaaaagaataagtcaaattatgagatgataaattttttattgcaacgaactaaatgtgtggcgatagaacatgtttttttgcaatagtaatgttttttttggcgatagctcatttcctattgcaacaaaaatactgaataaaacaacgattgtaaatcgttgcaacaaaatatagttatttgccacagaaaaaatatcattgtgatagtataatatattgccatgaattatttttcgttgtaataaattggtggcgatagctcaaccctcttgtagtgagagagatagactcaaagaattcttaccaagaggttggacctcttgctaagctttctccaaaacctatatgcaataagccattccatatgaattttggaggatttggaaaacttcaatcctttgaattaaagggctacataggaaaaattcctataggattcaatcctatgaaattctttcataatttctttgattcaaatgggctctaaaatcatataactatttttttatgcacttctcgtacgtttgttgcataattcaagacccaaatcaactatatttaacaagtaactttggactagctattggacactcgagacacaatttttagggaaatcatagagtttaaaacacttgattgatagcacctagcttatattagaacatcatgaaacacagagaattaattaataagacttaaatattaagtagtagaaaaaatatatcattttggttcacgaagattatatttatgtttaaatatatataactctaaacggtaaatccgttaattggatctatctcaatctatccgtagcctcatctcccatataatttatctgttaataaacaatgatagtctatatcaatcttactgcttaaagataaaagattattggatttattttttttagaaaaatgacacataaggtgtaacactatcactatgtatcatatagtaaaatttgaactgaaaataagatttgtataaaataacatagaaaatagaaaaatctccatagagtgtaaattgaaccaatctatctatcactacaaacgttctcaagccaccacgtggcattctacaaacactctaaactcgccatgtgtcatgtcctaaaaatcagaaataatcttataaattctgaacaaaatgaaacctatcagcatcagttttaagttccattatttatataagttagaaaaataaatcgcatgcacctcctcgcctactcatatgcacataccactacctgtcccctccctatttttagctattaaacaataaatatataatcaataatttatatgttagaaaaccataatatttaagatgcacgtttgatttttttctctagttataattaaaccaagaatttaagatccgtatgcttatattttcttatatacaaagtatgccattcgcccatattcgacctacatgctttgtatattatacaaataaaattgaaataccttaaacaaattggctgcatatattacgtcattatacacgagtctgcaaacaagctaaattaaataaatagtataactacaaaactatttttgtagggtgaacacccctgcccttttacatgttactggaattgccgtaaaagaattatgaaataatccaacaacacaggttgcatcatcatatgttgtttttgcaaacttgcatagctaaattaggtagacattatctaagtaaatagaactaactaaaatatgaatagcaaatccaatgcccatagttagagaaaacaaagtccaattatttcgtgaattttcttaaatgtgctgaaataatgcaagccagctaaatgatctttcgtgtatttgctctaaactatgttaccatcaaattaacattgtgtgtggttgtggctttctacaccttcctggtaattctgtttattttctttgtgcatagaccattcaaaaggtaaatcaactatatgagcattaataatctatgaatatacacttgaagcattaactttggagtccatttagattttaatgtgagaaaatcgtacggtaggggaaaaaggaacaatgagtttagctaggtcttactttttcactaaccccaaaaactaatgaaaataaaaaccaccttgattttaatatacaattaatttgttgaacatgttctaaacaaactaagtctactattttttatatagtgataaagattatagataattggttatactgataaattaaatattatatagtatatgacttagaggaattatcaaagtgatgttgacgaagaatatttatcgaggaaacgtacttccgaaagatggtagaggctatctggttaatatgatccgttctcaacgcagcccacaatacatgccagcgcgcgtgcttgggctaccttcctagttttttaccaaaacgaagaaagctattttccaacaaaaaaaagaatacagaagtacgcaaaaagtcaacgtagcaaagggatacctatgaaaatagttttttaagtagttcaattgcacattacacaccccagcgtatagagaggacatatagatcgatatgtaagttccctgcttcaaaattattatgaaacaactcattctttggtgaactagtagatttttactgtcagtcgaccatgataaaacaactccatcgatacgccaaagatcgtaataatttcaaacaaaattgaaaatatgttccagaaattatatgtacagtaacatcaccaaagggaatatataacctgtattttaatttcttgccatgattgcactgttgttgacagtacgttccatcatcccacatgcatgtagccttgttcctcgtctactcagttgtttatttttattctgaattaaaataaattgaaaagttgttagtaccatcgatgaagccccggccaggagctgtcgaacctgaaaatcatgatcaatatggtggggctgaccgtcttggcggacgattccgtcgaatggtcgctcctcacgacgctgtcgcggttgcgtatcgtgctgcccaatccgccattaattccaatcagcatcagctaggctgctacgtacatacgtggttagcacatcccgatccgttgatataacttgagataggataggatacgtacagatataggtggactctctatacacgttaggttcacttaaaaatgccaatgataacacatagattacaatgtacggtcaagattttataatccatagatttagatttttctagttaacatgcgagctaaaaaaatgtccagttagtatgggtatacatagatggttggaacaccaggatttgatttgtgttcatagataaaggtatatgtatataggtagtattgattggatctgttgattcaatcaattttaattttagggttaaatattcttaatgacatacatttttatccagactacccattgttgacattctaatttttcagcaagtttataatcttctaaaagtttcaaatttcactaatggtaatgataaaatgtactacaccaatgttaatgcaaaatgaattgtccatggcagtttcaacagtttcttaggatgttagcttgaggagttgattttgtttactgaaatagagtagtttaaaccttaaatcagtgattttagtccagccattcactttatttgaagatatagtcattgatacagctggagtaaacattaaattactacctcggctgccttaatatgctgtggctgtgaagcagaacatatgcatgttctttggagtagtatatgacaagaattggggaaagaaacttattagtttttctttactactactctcacataggcataacaaaatagtgatattagctgttgttttaacgcaaacttccaaagcaggccgctttactaaatgttattactttgtgataccattactttcaagtttcaactatatatttatatatttattatatactccctccatctcaaaatataaaaagttttagggttagacacggttattaataaagtacgtagaagtgagtggtggagggttgtgattggatgagtagtggaggtatgtgggaaaagtgaatggtggagggttatgattggttaggaagagaatgttggtagagaagctgttatattttgggataaatcctaagagctaaaagttattatattttgagacgggtgagtatttattattcgaatgtgaaatgaaccgtacagaataacagtggggctcttaccgctgtggaaaatgcccacggcatgattgatatgggagggtatagctgatcgcatccattcagataacatatttgtttgcggattcagtcaaggtatggaaaactaagttttccagagctgtgggaagttgtaccatcaattaagtattgaacatattgtcttgcatgtgctctcacgttagtaattgtttactctatgccaagatgctacgtggtgagtcacataggtgtttggataggacttaaaacttttaaaactttttagtccctatcacaacggatgtttggacactaattagacgtattaaacgtagactaatgacaaaacctattccataaccctgaactaattcgcgagacgaatctattgagcctgattaatccatgattagcctatgtgatgctatagtaaacattctctaattatggattaattaggcttaaaaaaattttctcgcgaattagttctcatttatgtaattagttttcgatgtagtctatgtttaatactttaaatcattatccaaacatccgatgtgacatggacaaaagttttatccctagatccaaacaccaccaagactttacaataatcaaggaaggtatgcaactctgtcgatcccttttattcatctagtttagtttattgttcatatggtgtaaccgtgcaaccttaagagttggaactacgttactattcgaaaaacaacgaaccaccaaataaaattaacccaggataaatttattaggattgaaatgtattattatcttatatgaactaatttaccaagaatatttttatatggaatctgcacatcttatgtagtcagcttaatgtctttatctgaaaaaaaaagctgaaatgaattctgaagattttcaatgaatatattttaggcaaaatcgtatgaaattaagcaaagtttgaaactggcagcacatatcgagggtatcaaagttagcgagatgatgagggcatgtttttcaatcctgtatcaccttggtgcttgcaaatattcaactgtatttaccttttcttttctttcagtgaacttgataacatcaagagcagtaaactcaattactgatttatttatttattttgcatgtataacatctaaaaaaaagattggaaactactctgaatgaagcaaggtatgaaaagcacatgcagtcagccttatttggttaatgaaaaataaaataaaattaagggaaagctatcattacagacggtttggcttacatgaaagtacatgaatttgaacctaaatcgtattctatcatggaatttgacttgctgtttgtgctcatataaagctaaattagttggaagtgtaggatcgaatcataataactaagccaaccagagagggggtgaatggttggtagagaactcttttttctgcccctgcaaagctaattatttgtaattattttggttcataacttgtatatgtatcaatggtttaggcaatgaacacaacaaggcagagcggattacagagggaacggttggcttgagagttaatcatgtgaagtatgacggtggtaagaatgggcatcaaagaatgacaagatatagtgtgactgtttaggaaatatagtagtgatagtctttacgaccccttctttttagcaagaaacataattacaatgaaggatcacatcaaaacaagtcacctcctatattaattcttttctaccttcaacaaatgattttactcattcatcatgtgacacatccaacgatcgaaaattatctgatgacgtcgatcaaacggctccccacctccctcccgattcgatccagatcacatcgcttcgcctcaccccagcaaaatcaccgcgccctccctcctcctctttctatctttcacgcgctcctgcccatccgcctcgccttccactgccctccatctcaccgcactcctcagctcgcttcttcgtcaatccgccttgcatttcgccaccctctatctcgccgccgccaccccccatccacccgccggcccctcctcctatcgcatcggtctgcgcctccgggacagttaccggccagttcgctattgccggagtcaccatcccgcacccgccgcatcctccctcccgcacctccctctctcccacacccgtcgccaccgatccagctctctactggtagtagaaaataatctagaccgttgatctcaattcattaaaaggttgagatttatttctattaccacctcacttaatggtagtagaattgtggaaaaaatatctgtgcagggtataatcattctttacactcgctaactgctctctctctctctcgttcattccttagtccccgaaatccc

SEQ ID NO: 74135 - DNA, 17323 bp, Oryza sativa
aaaaattacttccaacagatttccataactaaaattttttgggatataattttagaatgctcttgatgattctctaataaacgggaacatatctcccttaactgcatgacgtcaaagcgccaaaaagtagtataaagaacatgcagcctgatagatggataacataaggacataacatgcaatgcaatgaaccagacagaaccctgaatatgtcgaaatggagagccaccggtggaatattagtactatgacgtaggctagtagcaaatcaaccatactggacatggtgggcatgcaaatcgaactctagctaaccgatgaacaaaatggctaatcgtggaaaatcaagggtggccttgggcagcttgaaaaggaacaaaatgcagatccagcaggtaactggccaaaagaaagaaagaaatagcaactgagtctttcggcggttggccccaaccatgaagctgtggctgtgtttagtttcacatcaaaaatagaagtttgaagaaattggaacgatgtgacggaaaagttggaagtttgtgtgtgtataaaagttcaatgtgacggaaaagttaaaagtttgaagaaaaaaattggaatctaaacagggcctgaataatcaacaatttaatacaactatagaaatagcccaaaaatagtgaattttcctattgcttgcttcattgtcatcctcctaaggattgaaagggagatgaatagagtgcttggtaggacatgataatttaaagcacaaaactcccaaatggaataagatgcattcgatccattatcttcacaaagatcaagagtagttcatttcaacgttccagatttgacatcacaaacatttgtgttattatgttttcagctcacacaagaaaggtatacatgcactttctctccacagaacagaaggcaaaatgatgtgtgcactaactcagcatatatagcaagccttcagtaactggtaacctgatattaatcgtaagttcttcaatttcctaaaagaaaaaaaaaaccttcagttttcaaacactgatggttggtttcaatttctcaggccaggtgtactgaccttcatgctaaactaaactgattttacatcaaagtacaataagtactaaaatcagtagatgatgaatacctcagaatagaggcttaacatggtaacattgagcaaatttcttgtttaagcaattagtacaaactacaaagtgccgatgcatgaattcaacaaactaatgtgttctgggtgataaaatacaacaacagtgtcctgcagaaacactcatatgaactagctagctacaacaaagccatatgtgcttaagatacacggtagttcaaaaatattatatcaagcacaacatttgagactcagcgcacataattcacgagatgttcatgaggaagcagggcatgtattgacaccattcttgcaatcacgagtaagatcactgaatgtctccaatttcctcttcccccgaaggaacacctcagtgtcaactgcaaccctcatgtatccatcgaattcaacagcattaccattgctcagctcctttgtttcagtgtaccactcgctgttctcatcccataaatccttgaagtcatccaggaagtgtgttcgatacttacccttcattgggtcaaagaatgatttatcgggttcattggttgcaatgtacaaatgccggccagcaccgaccttatcattaagtgtcgtaaggagactatctggagaagtatctctatcaagatttggccacaactgtttgttctgggctttctcccccctcacaacatggactgaatcaaagtcccaatccatccgggaggaaatggcagacacgatctccatcaatcgacgcgatttccacaataaataccatgggcgcttgatcactgcctccgtctcaccctcacatacacgagaccagaagttatcaggctcaacattcccaaacttcctcatgatcagtgtgtccttgacgtcacgaagttgcatcggggtcaccttgatgtcttcagtgtagtgattcttcagtctatccttcttgtgccacttcccccaatctgtccagaactggctctggtcaatgaccgatgctgattgcttcaagtgctcaaaatcaaagtagagcctaaaatctctctcttcatccttgccacttgaagtataccgtgaattgaggcacacattaaggtccataacaagtgtccggttcaagtactgtgcctcaccaagtgcacacaagaatccccaaacgtagtggttcatgctcttgcatctctcaccaccgcccatgtagatgagatactttccgcggctgaattcagactcagattcgaccaccggtaaattgtcattgacagcttcaccgacaactagctccggctcggaggcggccgtggtgtctgcattggcagcgttctcatcgagcctcatctgcgtcttggccggcacaaagtcggtgaccggtgcctcgcgcttgcccttcttccccttcttgcccttgcggcggccgctgcgcttggcgccggtgccggagtggtactcgcccacattgccgacgacgaggttgcaggtgttgacgtcgcgggtgagcgtgaagcggcggtagtccttgtagtaggtggtgcggccgttggtgtcctcggcggggcggaagcgccatgcgaggtcgcactccatggggctccccggcacggcgacggggcggccgaagcggtagaagtggaggtcggagaacttctcgatcgccgtgcgcatgagcaggttgaagagatccttgtcccccgtgcagtccaccggcgcctccgtgtcgcaggagaccgcctcgacgatggggttctcctccgccgcggcgcccgcgtccgagctggcgtcggtgtcaacggtgacggcccgctccgcccccgacgactcctccttggtcgcgacgtcctcgagcttgatgaacgggacggcctcggcgacgacggtggcctccgcggcggcggcggcatcggaggagttggcgccgatggcggcggcgaagtcctcgccggtgcggaggacggagtcgtcggcgaggaaggtggagttggaggtggcggaggtgaggaacgcggtgagctggtgcgatgaggggtggaggagcgggtcgtcggggctgtggaccgcggcgaggagggtgaaggcgaggacggccgccacgaagagcgcgaagaggaggttgcccccggagcgcagcgcggcgcgcaggtcgatcccgatcccggtcccggtcccggcgccgccgcgccaccgcgccgcggacagcgcccccgcccggcccagcattccgccgcccggatctggccgccgcggcgaggggggaagagtgggggagtgagagcgaggtggggatctgggagtgggaggagtcgccgacaaggcgagggtgcgtgcggcttactccagtgttggtgtttttttactggggaatgtggccgcggttgcttgcggtggtcgccggcgatgggcggtgtcggatggcccgttgactggggtggcccgggaattgcggtctgttgttgtgggctttcatgggccggaatttcgcttcttttttttgaataagttcacatgacgtccctcaactttacgtcgagtctagctgatatccccagtccacaatatcagaaatctatacccctcaactatcacaaaccgtgcaaaaaaaaaaaaaaaggtcctgagacattattgactcagtttttcctaggttgcgctgacgtggcattacgtggaccccacaatttagcgtcctctattctcttctcttctttttcttcttcttcttcttcttcttcttctcttttctctcctcttttctttcatctcctctcttctctacttcaccaagactgagaggccagcgggcaaagcaggcagggggcggcgcggctatgactatgagtacaaaagaaacaacagtaaatttaataatcctcaggtttctaaacgataattagattcacatttaagccgcagttgtgctgctcttctctcttgcgtgaatttcatcaagcatgtttctggctagcggcgagatcctagcctccaactcctagaagtccacctatacctccgccgcctctgtcttgaagcccagcttttcatcccccttacatgtactcgtccacctcgtagcctcctatccttaccaccgcctcatacaccctccacgtcgcatgcgccctccccttcaccaccaacgcgtcagcttgtacaagtcctcctccccctccacgaacctgccgccttgctcattctcctccaggaacgcctccacgagcgcatccacaggggcggcggcgccgtcctcgattatcggcgaggaggacacgaacgtggcatagatggccaggtcggcgtggtaccaaggttcggcacgatggaccagtagccatgacgctggagctcggccatgtggcgaggaggtcgctcttgaggaggcggccgaggagcggtcagaggaggtgaggcgcttgagggattgcacggcgaggatggccttcgtgtagtgggagcggccgcactggattgcgccatggttgtcgcacgggccacaggtgatgcgccccgcccccttcttgctttgctcactgcgccgctcgccgctgcactcgcccgctgcccctgcctgcttcgccttctgcctgcccccgccctgccaatctcgctgaagaagagaagagaggagacaaaaggaaagagtagagaaaagagaagaagaaaagagaaaaaaaagaagagaagagaagtgaagtgaagatatgacactgacatatggtgcccactatatgccacgtctgtgaaaccgaggaaaaattgagtcaatattatctcgggaccttttttttttcacacggcttgtaatagtataggagtagagatttatggtattgcggattccaaatttgatcaccgtcatagccatcatagtcgatccaacggaaacataaacatcgaggacacttcaccaatatgaaacatccagtgtgagccaccaagtaaatcgtgactcatcttaccaatcaacgactcatcttaccaatcaaataaaaagttaacttatcttgtacatacaactatttttctttataaacgacctcgtgctaaaaacatactacctcctttcttaatatacgacgctaacgctgttgactttttacatactactcatactattaaaaaaattaagtaaatatttttttcttgatttatcactaaagtaactttgagcattacttataatttttaagatttatataaattttttaataaaacaaatgatcaaagattgtgaaaaaaatcagcagtatcttgctccctccgtcccataaaaaataaatctatgaccggatgtgatatatatgtattgctagatttatagtattaggttggtattttatgggacggagggagtaaatgactatatcggaccttccaattggattttacccaaccgagagagttactgtgaaatttaccccggcgagaaactgtggaggctgaaggggcaatcagccaaacaagtaggcagttggcagagtggacgggagacgggagggaggccaccatggagagctcgccgccgccgccgccgccgaccatcaccgtccaggtcaagttcggcggccgcacgatcccggtggaggtcccggccgccgccaccgccgccgacctgaagcgcctcctccagccgctcaccaacgtcctcccccgcggccagaggctcatctgcaaaggcacccgattccccctcccccacccaaacccttgacctcctcctgaccgccaatctgcttccgattataggttttggatacttatcgttctcttgatgtggttgcagggaaagttctggcggatgccgccagcctgagctcgatgcaggtggtgaacggatccaaggtcatgctcatggcctcgcaggggctccatcagggggtaaattaaattaaccgcctcatctttagtgtttttagcaattagctccttttggaatgtggtgaggtacagtttgatttgagggagccttttgtggttgccgaagttgaatgacgatcagaattcgttttgtaggtgcctccatatgttaattagcttgattttttactccgattcgacaccatttcctcttaatattgagattcgtgaactgtgatgtttggggtaaatggctgaatagtttgtagtactgtcatatccttgacccaaccgcacctcaaggcaggattgcctatatgctttgcccgtttgccgcttgcgctaatgttctgtgggacgtctgcaacagccacttttcgcaacaaaaatatttgccatttcacaattgctacaagaaatcaaggacaagctcagtctgtggaaacatcgcatcaaatgcagacatcgcagccatatcaccagctggttactcgagctcagctgatctatgctgcattgctgccccaaatgggagtttgctgcaacaacatcaagatgaattatgctgtaaaatttgcttttatctttctttttcctgttatatttctttctgcattttcttctctttcctttctccctttctctactccttattgtacttggtttttccttttttctcttctttcttctttcttctttttctttttttttctcttttcttgtaccctcccctctatttctctgtactcttgacctaccattaatacaatggttataaggtagagtctctctacctttttgcttaaaaaaaaaccttattgcagtgccaaagcagcgtgagaaatcaatttcttgtccaattcattgtattgagcttacatgtgttccactctccaacaggacggtcccatcactaagaatagtagtgttccagcaccaagcacgagaagagcctcaaatgtgaaggaagctcaaatacaaaagtcggatacaaatgtcagtaaaatccgacctgaacgttggaaagcaactggtattattgcattgtctgattccagcttgaaggtaactgattccaactttcttacattacttttaaactaagcaacttagcgtagttatgctttgaagttcatgaaactttccatgtctgcctttctatcaaaagcaaattgaagtgcctgtgtcaaaactgccaatcgttggtaaggaaaaacatgcacatcgctagagtattatttgtatacttttgtagtcaccacagcctgtagaaaatactataatagtcttgaacatactttctttaatgcatctgtttgcaaaatgctattcatgaatcatgattggaagactgatttatatggcacaggcgcacagccatttgactgccgctatcaactgaatcaggattttcagtgcatacaaggcatctattattcatcaccacgtgataaagcaggccttttagttgttcagcattcaagaacttcattgatattccttactatccattatctttacccttttgaattaagagtcttattagctgtttctcacacttttgtttgttcaacacttagggtgtgtttggttgcctgtatgaagggtggctcgcatctcctcagcaaaattcgctgtgtttggttgcctgcatgggcatgggagccaggctcagctgatgcaaaaaggaccgttgggccaggctgaggggaaacgcaggaatcgaccgtagctcctcagccaggctaggctcatgcacacgcggggatgagcgggtgcagccgcgggatgagggggtgcaggcaacgggcaggggtcgagccatctcgcaatcccctcccctcatttgtttcctcagcaatcggtcgccgtcgtctccatcagtttccctcctcttcaacggcttgagcccgggcagatccaggaggaagaaggctcgacgagggtatccagccgtctggtgagctcgagctcggccatatccaaggaagaagagggccagatccaggaggaagaagagggcaagaggaaggagggctcaacgaggatacccggatctggtcgcttggagggcaacgtcgccaccgccggcatcatcttcctcctcttctcctcgttctcgccggcgctgtcttcttcgttggctcccaactccctccttcaggacctgcgatgttccggatccagtgggcagggcgtccggaagcaacagatccggagccacaaactccgacgacagcgacagacggggcgcaagggggaggagcgacgagcggcggtcatgggctctcagcgtcagcggtctctgtcgaccagcgatggggacgaaggcttcgagggctttctcttttcttttttttttccttcttttcttctttttctcgccgattaagcccgtgattaggaacgtttacttgttttctttttcttgccgattaagcacgtgattaaggaacgtgtactgctactgcgtaatttaccgtttcgatcttttattttgtgaaaattaataatacagtcctgtcatgttacaatttattgagtttctatttgttctacctaattaaatttgatactacattttgttcaaatttgaaagattatagattagataatatttatgtatggttggctaatatcaccatccaaataaagagacaattgagttcaaagtacatgcatccaaccaaacacaatcttttgcatacaagtttttatatccaaccaaccaaacaatatctcatacgagccgggctcatctaatacatacaaccaaacaactcctattgcatcattctaaccaggctaaacccagcctggatgaggcatacgagccaggctgagtgcattcgagcaaccaaacacacccttaatttcacttttggttgaatttttgggcttatactgtggttgtcttttcgagtaggcagtgcctgaagaagtatggggctgtggttcttctattagagtactggatgtcagtaacaactgtattgaagcaattccacaagaaattgctgctctgagatctttacaggtaattgttcttccccaatatgttggttgagacatcttcttcattcacaaggaaatataattgaatgtatcatcctttcatcttgtagaaattgatcctgactgctaatgatatagctgatgggaacatttcctgggaaggcctaacatgtgttcaaacattaacagttttatctctaagccaaaatcggtaggtctgatttttcaacatcctgtttcatcatgctatgaatatttgttttgttgccagtggatataaacaaccctttgtaatttccttaaataatcttctctttgtgctctcaataatgaaaaccgctaagctataatttttttttctccagactcttatatatgttcttagattcacccacctaatatttcaaactccacttaaacagttaggctcatacattgaaaagaaaaatgtagcaatgcataatatcttaagctggttcttttttgggttaattagatacatgccattaaaaattcaccggttttgaaatataccattactatttgcgtatttggaacgatgccattgatatttgtttgtaatttcagtggtgccactaagacacgtattttgcatgtattggacgaaaatgccctcatcttctacctctctccctcttctctcatcttcaagctctctctccccgctgcttcaactccggcgccgtcaccgccgctgctgctgccgctgccgcgccgttgctgctcgatgccgctgctgctcgccgctcgcgctgctgctcgccgccgctccgcatgctgctgccgccgcaccgccgctgccgctcaccgctgccgttgctccgccgccgctgccgctcgccgctcgcgccgctgctgccgttgttactcgccgccgctccgcacgctgccgccgccgctccgccgctgccgctcgccgctcgcgccattgctgccgttgctggtcgccgcctctccgcacgctgccggctccgccgctgccgctcgctccgccactgccgctcgctccaccgctgttgctcgccgctcgctgctgccgccgctccgccgccgctgccgctgctgccgttgctgccgccgctgctccgccgctgccgctcgccgctcgctccgacgctgccgctgctgccgctcgctccgccgccgcttgctccgccgccgcctgttctctgagctgtggaagaaggagaggggagaaaaagaagcaaagaagggtaatttggtccaaattttttcgtaaatggtaggtagtggcatatcttgaatatgtgtaaaattgtaatggcatggttccaaatacgcgaatactgatggtatatttcaaaactgataaatttttaatggtatgtatctaattaacccttgttttttcttgaataactggaaaggccttgaggtgctcagtttatctcagtggtttatgtggtgcaaattgttcttgtatcccttaattttcctgtcttgtgccagcacccgtgtcatgctgggccagcaatatcaaaggtgccagggcaacctgtccacggtagcagattatgggcatgctggcaaggcacagtagaccttaggtctttatccattaggaagtttcatgtccgccattattgtttagaattgaagatgacgagatgatatgttctaaatttataatttttcatgcaggctggtcactttaccttcaagtttgggctcaataactcatttacgtgaacttcgtattgcaaataacaggcttgagaacttacctgttgaaatagggttactgaagcatcttgagattctgatagcaaataataataggtactgtgctactagtgcttaactgaagtgactcattgaagtctcatttttttgctatgcttatagcataatttacactttgtgctaatgtgaagagttacctcaagagaggatttctgtatataatatagttgttgatagatttttcacaatcatgtgagactttcagcctgtgagcagttccattatagaaaaacttttaaagaaaatgtattctatcaagccagaaaatatgtcttttcttatacttctaatgagaatttacatgattacttttgttttgagaattgaaaggtatcctgacttccacactgctacaatttcacttgttggcaggataacttcattgccttcatctataggtggttgtgaatctctcaatgaggtgtgtgctttatttctgtttcagttttccttctagttctaggccatactgagcacttagctcttctgagtttccatatggcaatttctggttcatcaaaatttttaatttcattaggttgatttgtcatcaaatcttttggctgaactgccagaggcttttggaaaccttcaacatctcaaggtatgtgcctatgggccacacatggagaaatatattccttaataaaagactaaatctgcatgcatacttctaagctatcttgttcctagcattgaaacaagatattactagtgcccttggttcaagatggtacaactacatgcttactcccccattttaaggaagtttaagttgcatgttcataaccaatgaacatataaaaatattatttcgcacaacagtaatgccacaacaaacctgatatgtgagtagtcagcgtgaaacattccatgcaattttgtggtatcatgtagcctgcaggttcagtttgaacttaattttttatttattatcagcatacggtggacaaagttttggcttatgacttgacagttgagagagtcatgagtatttatcgttcatttgttatactccctccggtcaaaaatatttttgtcggaattttaattgtttgaccaaaccttgtcctaaacaacagatatttttgactggagggagtatatgattattgcaccagatcgttattaaactatagcattactagctaaacttggtcaaaagatttactatcctgctgcttctagttgttcactgtatattatttatgtcagagcagatggttatttgtgctttcctttatggtgatattttttttccattcaatattttttcttttgtctagcatgggtgtaataatcagttacattgtactgtcatcagtttctaatgttccttttttcaaaataactttattccatcaggctttgagtgtacggaacaatggtcttacatccctaccttcagctttcttcataaaatgctcgcagctcattacacttgatctccatggcactgaaatcacaaacgacgttcttcggcaggtataagtgacctaagtgacccaaggcttcacagttatgtagtgtttgttactttgttatggtcagtactctactgaattaagatagctaccagcatatgcttaagacctggacagttcagtaatcactctcttaaatagcctattggtttcactttttgggacgccaaagttgatacccaccacgttaaatacataatacataatacccacaacgttgatcaagttatatagttcagggtaaacatgtggtgaaaaccccaacttaggtgacaactcgtgtccatctacatgtgtgatttattttgatgaatttagacgacttttttggcttgggtttacacgagttttcacctaagttgggatttccaccatatatttacctttccgttgcgaaaaaggcggataagtcgtttatttgctagcggttgctttcattggtcctggctctgatggagacatttcaaccttgccactgctaatgccagtttttacttgtggaaaacaggtggacggttgggaggagtttgacgaacgtcgaaggaagaagcatcaaaagcagctcgatttccgggtgggatcatcagttgtgttcgatgaaggtgcggatgacgattacaggcgtttataaataaaatctctctttggataagattgtgtattttatgtctccagcttaatccgttgtcgcaagaataacttgtatacttaagaacaaattaggagctgatgttgctactcacatcaatcctagatatgtacttgtacttcatcctttttcaaaatcccttctttttagggattctttaaactgtttagggcatcaagagtggaaaaacattactccgtccatttctatttactcgtgactgttgaccaatcctgttgtaactttgaccactaataaattttgaatggtttgaattatgatgaacggaaacttactggattcagatttgctatttcacttgacagatttttggctcctatctttttttttccgtaggatcttgcatcaagattatgatatcatacttacagttatacttagttacaaaatatttacactcagttacataacacttaaaatcagttgcatagcatttacacttagttacaatgcaccaaaattagatttttacaacatttttttcctctagatttacgctttttgacatgtttatttcatttaaaaagggctatatcaattagttaaaaattccgtaagattcaaaactataaatctatcgaaagattaataggtagtcccggatacggatacaacataatgccttttttgtaaatatggataatatcaccctataaacattccatattttaatatgctgtgcggtctccctctctgttttacggtaaagtaaatatggataatatcaggtgccaagtggagtagtattaagtgacggagggagcagtaatcacttgtagacattagagactttatacgtatatatatattagaaaaaatccacgttgcaaccttgcaacggttggaggctattttaatcttattattgctactatttagttaaggtgaaatttactatggaaattcacttagtgatatattttctaagaaaatcatgagatgcaattagtagtctaatgttttttttaaagaaatttcttatacaactccttttgtattttaaaaaacgaacgaacttagaaatagactcaaatacaaatctgtgtttccaaaagcgaataaacttaaaaatagactaatacatgggtgatttaccaaagtaccgataaaaatatatttaatttttataatagtagaaatagagatagagatagagaaaaagatagagacagatttatcatgtactgtcactctacagatagagtattacctcactaaacattacaaatttattattattttattatgtcactatacaactgtcactctacatacaagccaaagctattcatttttttttattccaacacaccaacaataatactcctataacactccagcttatcggagaagcacacgaagggggagagagctcggtcacgcgaagccgccattgacccggatgacctggccgttcacccacgccgcggcgtcgctgacgaggaaggccaccaccggcgcgacgtccgtcgtctcggcgatccgccccatcgacctctcctccaccttcttcacgaacgcctcgtccttccccgccatgaacagctccgtcctcaccggccccggcgccaccacgttcgccgtcacccccttcgccgccacctccttcgccatgatcctcgtcatcgcctccaccgcgccgttcgtcgccgtgtacgccgcgtacccggggaggagcgtgccgaggatggacgacgagaacgtcacgacgcggccccccgcccccgccgggaagcggttcgccgcctcgcggcacaccaggaacgtgccgcgcacgttgacggcgagcatggcgtcgaagtcctccacggcggtgtcggccagcgacgggtacttggactccaggaggcccgcgcaggcgacgacgatgtgcggcggcgtgccgaacgcctcctccgtgcggtcgaacagcgcgcgcaccgccgccgggtcggacacgtcggcgcgcacccccacggcgcgcgggagggcggcggcaccgcgggagttgaggtcggcggcgaaggcgtcggcgttggcggagttggaggcgtagttgacgacgacgcgggcgccgagggaggcgaggtgggcgcacacctcgcggccgatgccgcgggagccgccggtgacgagcgcgacgcggccgtcgagcgggagcgcgctggctgctggcgccgccatggcttcacacgcactcactcgctcggggtgttgctgcttcgcgtgtttgtttgggcgcgcgagtaggattttttggtgtgttgaggaggtgcacgatgggcaagctagggtcctttttatagacgaccaaaagctgtaaatgtgacgtacgcggtgacactgggctgggttgatttttactgctattgttatagatgtgttgtgaattatcatgttcatgatgcagccacaaagggccacagggatgtagtttacttgtgatcatatgaattgctatgttcatgcaaaagtaattatttaattagtatgataaaattaacataacagatagactattgtactagttggcttcagcaatagctgtaaaatgatgtggacataatatagccagcagccgactacactattaatcttgctcttatggtaaggaaaatagccctcactgtcacgatgacttggctgagttcgtttagaggagatgaaaccgatctcctgcacacgaaaaacggagcaatgcattagcacgtgattaattaagtattagctactttttttttaaaaaaaatgatcaatatgatttattttttcaatatgatcaatatgggcaagggtcttttttatagacgaccaaaagctgtaaatgtgacgtacgcggtgacactgggcttgggttgaattttactgctattatggaaaggaaaatagtttttttcccacctgccctcactgtctcggtgagtggtgagtggtgacttcttcttttgaccaacttctccaggagtccaggttcttagcccccggcgcttccctgtttaatccgttatttgttagtaacaaaaaattacttcctcagttttatattataagttgttggaccttttgtttaaattttattaagtttaatcaagtttatgaaaaatattagcaacatctaaaatataaaattattttattaaatttaacgttaaatatatttttataatacatttattttgtgttagaaatactattatatttattttataattttgttcaaaaagtttgactaagaaaaaaagtcaaacgactaataatataaaacggatggagtaatacataggtatatcttctatataagtacgtggtcttagtgattaaaaataaatattgtaaaataaattatgataacaaatcacaaattatgtttaaaattaagttttacattttaaattttatagcttataagtatgaaaacgatgatagcagctcatcttctctgatcactgatcggcatcaagggacaaccagacaagcgcggttgctgtggttgtttaatcgatacgtggcgccgtcatacatagtaggataactatagtggcggctaagcaatgatattatgtttttgtctcaaaagtatggagatgtgacggacaactaggctatgacttttaactaggttggatatagtgacgaagaatacgtactcatttgaaagcagctataatagcagactataagctaactataaataaattttaaaaaaaataaaagagaagagataagaacagtgtgctacatatttgtgggaccggacattaatagtgtagtatatgtttataggtaactattatatgaatttgctatcaaatagactatagatgatttggagctagtagtggactgtactattacttgctccgataagaacaaatgaacgcaacacataatatatttatattgtaattatataaaatagtataatattataattaacaacttaaggcataaatcatatgagtaatcaccacacatgaattaagcgagtttgtcttgtaatggtcttaacatcgttgtcaacccggcattacactagcgaccggaactctctaaacctaagaacaaattaatactcaaattctaattacgagcaaccgcgtggctagataaaggtaccatcactaattgctaaatatttattctgaaattccaaatattgatttttttaaaactagacaaacataaaataaatgaatattttatatatctaaaaaaattatctataactttcgtgtttggagaacaatttaactagggactacttttggattacccttgcagcaaagaacatcaatttgaaatggatttcatggaattccccaatttcctcctttttccttgctctcttcttccttgtcttctaaattacattgttgaaaatgtaaaagtttatcgcatgagactatcacaattatgaggttgctgtgcaacaca

SEQ ID NO: 74136 - DNA, 8897 bp, Oryza sativa
  unsure (1)..(8897): unsure at all n locations
agtacccgccattgttatagcttactctatgagctatgactgcaggaagagatgagtcttgagtgaagaattgcatgggtatttatagtgcttgaggccacatgcaacactagtttcgtgatagcatgcacgttagcttttttagttggcaactcccagtaggatataatatcaagttgaggcttaaagaactgtagaaaaaagagctcatttacttcaagagatccttgctaatacatatccctgattaattacatatcaatgtagttaattgcagccacttgtattcctccctccatcttagagcaagtttaatagtatagccaactactagctccaattcatctatagccaatctaatagtccgttcatacaatagctacatactacactattaatatctgatcccacatgtcatacgcacattgtgtcttgaagtccgtgctacagttggctataaatctgtagcccgctgccattctctctcctcatttatcttcttaaaatatgtttgcagttgacttatagcctgctattgtacctgcacttagacgtattaatttcatttgtagtactataaggtttcttgtgttaacgaaacaaaatgcatcctatatttttaaaatattttaaagtagagagagtacttattactgaatatacgaatatacaaaaggtgactcaagatgcagagtgcttctatgctctaaacaaattgattgactaattacagtactacagcctggtaaactcttaatttcaatgacttccgcaaatcagcacgaccatctatgctgctaattaatgaataaaattacagctagaagaattgacattacgaggagacttcgaggctctcgactcgatcccatcgctgctgactttgacacattcaaacgccgttttgtactagtaaaagtgacaaattaaactgacaacccgaccagtctaccacacacagaatacttacaagaaaaggacagccagccgatgaattcatatggttgcatgatctgcatgcggagaatgggatgaatgagcgagacgcgctgacacaatcgttttaatagtgcttaattaatactccctccatcccaaaatatagcaatcttgtactggatgggacacatcctagtccaacgtacaagattgctaaattttgggacggagggagtagactactctctccgtcacaaaatatatgtaagagattttgatcggatatggcacgcactagtactaggatgtgtcatatccgataagggattttcatcgaatgtgatacgtcctaatatcacaaatttagacttgattcgtggtactaggaaatatttcaatgaaaatcccttatattttaggacggatggagtatctcttagtacagtgccttctctatgtggattattatttgaatacacaaacggcattctaaactttaagagcaggtacaatagcagactattagccagctataaacatattttaatgagataaaagataagagagaaaagcagcgggctacagatctgtagccagctgcagcacggactccaagacgcagtgtttgtatgacaggtgggaccatatattcatagtataataagcaactattgtatgaattggctattagattggctatagatgaactagagtaagtagtgggctatactattaaacttgctctaagcaacaattaaacagtactactgtaaaccacgttctagcacttaggggtgggcattcggtctaaccgaaaatttcggtctcggtcttcggtctttcggtctttgaaggacagacaaattcggtctcggtcttttcggtctcggtctcggtcctgaccgaaattcaacagcattttcatatatgtaaagaaataatggaaattttcaacacagaaatcacaaaaaaaattcgtatgcacttataagtaaagactcttattaggttgcatgcttagaagaagtagggatgtgaaaattagagtttaatcctattaaacatagtggattgtaggttgtatttagactttttttttgataattcggtcttttcggtctattcggttacccgatgagactaaccgaattgatgaccgaatttctcggtctcgatctcggtcccggttttttcggtacgttcggtctttttctgcccacccctatgtcacgccccgaactagtcccgaccggaactagcccgtgacgctccaaattaacctgttaatcgataccagtcccaggaaacagtgctggtatcacagggagacagaatatcacagcaacagaggtctctttattatagagtagaagtacagtcatgttgggctgcggacagatcccgagctcacaactgcattacaaaaggaaagcggaagccaggacttggaccaaacatcacaggcgcgacttgggaactaggccgaaaccctaaaactcatcgtagccggcttgctcctggaagaactcctcgtcagcaggatccacttcatcttcttcagcaactgggggggattatttatatagagcaagggtgagtacgggagtactcagcaagccaggggaaatgagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaaccacttttcaaacggccacccgggcctagctgatcccgtcagctgctgatttttcaaacatcgaacccagtttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcaagagcgggaaaccgtacacccggtacgttccccggtccgcggttttggaaattcatttagttcgcaagcaccgacccaagtgtcgggttttccaagtcttttgtaaaactccagttttacccaagttgttactcagattttaagtttgaaggcgaccgtcgatactcgcacagagtgcacgaatatcgaggtgcaactgggtggttacaaggggacatagtatggcaattaacaatggaaggatcaaatgcaataagttaggtaagtccgccaatctgccctacagacgggacaacagattaagtgtgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaatagagccctattaatgacctctaagcgtgccactagatagatctcgagatttgggaaattttagaagttgaacggagtcaaacggaattacggttgggaagatattgaatttctaagattattggatttttggtctaaaggaaaaggatttaattaaatcctttttgaaaaagaaaagaaaagaaagaacagagggatggaaattagactttttctcgggcggctagggcgcggcccaaggtaaatggagcggctcggccgagcttaacgggccggccggcccaagacggcccaagcgcgcgcgcgcgggagggaggagagagagtccggtggaccgggctcaccacgcgcggtcccgggtgggacccgcttgtcagcggctcggctcaccgtgcggagggagtacgtggctcatgcgcgcgggcggggaaaggacgtggtgcacgcgcgcggtccgtggtggacgcaggtgcggcgggcccacgcgcagcctcacggctcgcggtggaacacgcgcacggggagggactgaccggggtcggctcgatccggtctaggctgagctggcgccgacgtggcgcctacgtggcggccacgtgggctggcgggaggtagacgacgacccggccgcgaatggacgtcgggcggcggcggcgagcggcggagcgaaccacggcgatacgggcaaaagcgtgcacaccgggcggttgcacgtgacaagggaagacgagccaacggctcggattcgccggaggttgctcgacggcggcggattgcggcggcggcaaccggtggcgggagaagagggaaacggcgacgaggtcacgagaggtcgattcccggcggtgagagcatctacgcggcttcgggaactcgacgctagcgtcggattgggcggaactacgccgagcgaggccggcgacgagcgggtgctacggagctcgagcggcgacggcggcgaacacacggcgagcgacggcaacggtcggggcggcgccggctaactacggggaggctactcaagctactaccgaaagctagggggaggtgatggagcgaggaggaagaacggagagaggcatcaccgagaagaggagcggcgctgtgacgagaggccgacggcgcgggagtaatctctccggcctcgggccggggaagagaaaggagagggcgcggccgaagtccccttccgcgtcctcgaacgcaccggctctcccggcgcttggcgaaggacggcggaggcgagacagaacacgggggcggggtggcggcaatggcgcggagacgaatggaagatgaagggaaagggggaggctggggtttaatgggcggtaatgtcgatttgggaaccgccttgcgcggtcaagggcgagctggcgctcggcgcttgcagccaaagcggcgacaggaggatgacgccggcggagaggggaaaagaaaaaaagagagaaaggggagctcgcccctttctcctttgggaaaaaggaggaggagagcgaggcgactcggcagagggagaggggacgctgcctccgtcccttggcggcttgcgcgccgagtggcgggggccgggcggtgacgacggcgatgacggcgggcggtttggagcggagcggcgacactggcgacaggcgcggcaggcgctgacgacggcggcgaccgggcggtcggccactcggcgcgcacgcgcgggaaacaacgggcggcgtccgcgcgggcgcgcgcacgcgaacacggcgcgcgggaagcggctttgcgagcggggagctcgcgcgaggggaggggcgctcggcgcgggcgactcccgcgcacgcgcgcgcggcgcgcgggcggggcggaggggggagcggggagagaggcgctcggggcggctctcgcacgcgcgagcagcgtgcgggcgaggctgagcggggggggaaggagcgcgccggggggagagagagagagagagagagagcgcccgggagagagggagagatgggccggggaagagagagatgggccgagcgagattcggcccatcgacctcgggggaggcaaaatagacttttgcggaggaatttgattggaaggatttggattcggaattgaactcgacgatagatcggtgattgagatcttgagatggcacggacactagacaacaagcaaagaaacaaatttcgcaattagggcttttaagagataatttttccgctaggcgtcacgacggaacgggcgctacaccctactagccctaggcacaccatccttgttaaatctcgaaaattgcgtggcaaagcaagctaaatcgatccacgaacttatctatgacgacaagtactttatcagtcgattagcacaaacagaacgttcatcattatgcatctatatgagaaatcaagaacctcaggcacccaatagtttgccatactgcttctctatgaatctgcgaggtggcaccttaattcctatgacatatactactagagaacacgctaaatgtgcatgctcttatcaagaaccggcaccaataatactctccacgaccatcccgggctgcactggaggctatctgtgccggtttcaaaatcgatagtgatggttcttacaaattagcatggagagatgagcaggggcagatctatatagagccatggggattcctagacacccgggtgaaagaaaaatttaagctgtaagtatccatcttaccatgcatgtaggcacccccgtcggcctaactttgtgtaacccaagcagccaataagaccgagcaaggacaataaatcaatagagatacacagtacgtgatgactcatcacaggttaagtataacaccagtagtcaataatttgacaaattgtcatgcttggagcccaacacaaccagtctcatcaaccttacgccctcatttttttaatagatgacatcgttgacttttaaatacatatttgatcattcgtcttattcaaaaatgtcatgcaaatgtgtaagatataaagcatgcttaaaatactttgagcgataaaacaactcacaaaaaaataaattataattatttaaacttttttgaataatatgaatgatcaaacgtgtgacaaaaattcaataacattatctattaaaatacggaggtacttagtatgcaatcatagtgaaacagaacgctcttgccggccagactagtcaagctattctgtaatgttgtttgatactacctctgtcccaaaatgtagttatttctagcacaataacttgtccaaaataaagctatttctccacctgcctccttctctcaaccaatcacaaccattcttcttcacctattttttctttttaaccaatcatacactttctcttattattctcacttactttcttaatacatgtgtcaactttgaaaatatctatattttaggacacgggaaatagaacatataagcaacatatatagtggtgtacccctctgctttgctctagctctgccccgggagatgaggtgttctgaggtagtgatattatgtgtatgccggcactgcgagtttcattacaagtgtacctctattcaaaacttgccttagattgtcgttagatcaatactaaatagtaatgattagattttagaaggtaatggttttatctaactaataattggggcatactatgcagaactgacctaattaatcttgatagtatatttcctatttccatttttatatggcaaccaactaaacaactgctaggtatattataagagatacaccccaaaaatgtttgaatcctgcgggataataattttgggcttcatgtttaatttgtgtagtcctatgatgcatgtgactgttgaattcctcagcatttctggggtacgtacagacaattatcaccttccaatttgtctagttgttgctttggttgtgcgaatccttttctactggttgatatgatcatgctagatcgtcgtcctggtcgtggaaggaggaaaaatatatagtacaaatcaaatatatagtggaatcctaaaactaggagaatctaaaaatggacaagtgagaattgttcacgtcatcatgagtagatttaactgatggtgacatgaacatatcatatgtttattttttttatcctacggtagtttcctagctgcatgtagctagcacattgcagaattgtgtccataaatattagagtgacatgaagcataataatattatcaactgacagatcacatacttaattgcaaaatctctcatggttgtacactactaaattactaaaacaatggagccctttatttcattctgcataatgcataaacaagtactaataaattaaaagaaattctacttcacagacaatcaaaaatgactactagttgggctccattttccaatttcctttgtgaaggaaattaagggttcgcatcaccaaacccagatccggaacctacaccagcaccgctgccaccatattgaccctgaccgttaccaccaccgttgccaccagcatttgcatttgcatactgtccataccaggtattagtagcctcactagagcctgagccggtaccactaccagacccatgaccataggatggccagtaaccaccagcttgtccagctccagcaccagcaccgctnnnnnnnnnnnnnnnnnnnnnnnnntaaccataatacccattttgactggtctggctagagcctgagcccgaaccagatccactaccagaccctgacccaccatattggctgtagccaccgcctccgcctcctcctccaccacttgcatgggcaccattgtaaccacttctaccagacccagtcccacttcccaacccagctcccgcaccattcacgcttcctgtgccctctccacttcctgtgcccgaaccttgggcatttgagtatctttctacccttacagcactagctaatccaatgctcaagaggacaataaacccaagagctgcaagcttagtgcctgccattgtgagattattctgagtagtgaaagaatagatgaatacttttgggtgatgggtgatggattgcatgggtagtatttatagtgcttgacgaggccatatgcaacacttgttacttattatcttaa

SEQ ID NO: 74137 - DNA, 48136 bp, Oryza sativa
  unsure (1)..(48136): unsure at all n locations
cccccccccttaaaacccaccccgatccccggccgctattaagccaaaggcgcgcttccgccgctgcagccgatacgggagattggatcggaagcttctagaagtttccgtgggcgatggcgatccgcgcgaggtcctcctcctacgccgccgcggcggtcgcgctggcgctcgcgctggcgtccgtcgccgctgtcgccggcgaggtcttcttccaggagaagttcgaaggtgaatggctgacctgctcccgatcccgtctcgatcgatctgatccggttcgctgcgcgttgcgggtctcggctttggatgtagtggaggcgtcgcgtgggggtgtttggtggtgggtttgtttggatctctggggttttcgggatttctctggggtttatacgactaggaggcgtgctggttgttagggatctggagtgttaggcgctaaattgggtgctgatcgtggtttgtctcgccatttttggatggttgctgctgcggtatggtgggatctgattgatctgacgtgcatttgctcgtgggaatgggatctagttgcgtcgtctagtaagcgtgcgctgtgacgctgtgtcgatctgctttatgtgaattggttatggttttttgttagattgtgggaaaaaaaacgtggttgggttgattcggatcgaanaatgttaggtttgtntggtatatgatccgcaggtttggatacttcattgtagggagtagttggtattctgctgtataatgtggtgaattttactttactttatactgcgaaatgggaaaatttagagcccagacttggtgatgttttgtgattgaaccttatgctttatgtatgttgtttaattctgatgtttcatatgtttaacctgaatatgaataaatgtttaagatctgcctatgctagtgctacatttgaagcatactagtgagaattggcagcttatgatggttgtcacctgtccgtgtccattagaatgtgatttgccacttatctgcatatgggatatggcattatgaaccaggtgcattttacacttcaggttttggcgtatagtttattagttctatacggtatgtctggagatccataattcgaatgtgttgatctgtattgctaatgtcgcctgttaaaattttgtctgtactactatttaaggaaatctccgggcagataatgaatttgcgtgatcatttgctggttctgcacatgatgcactgaacatggagttctgtgttatctaaatgtattctattgtgtgcacagatggatgggaaagtcggtgggtcaagtcagaatggaagaaggatgagaacatggctggtgaatggaaccacacatctgggaagtggaatggagatcctgaggacaaaggtaaattggaagatcaatacacctcattcagacactaacagatgatttttactgaattatttttcttgttgcaggtatccaaacctctgaggactacaggttctacgctatttcagcggagtacccagaattcagcaacaaggataaaaccctggtgctgcagttctctgtaaagcatgagcaaaagcttgactgtggtggtggatatgtcaagttgcttggtggtgatgttgaccagaagaaatttggtggggacacaccgtacaggtaatgattttcttctattgtagctctgattctcacttttctcaagattagtactagttatctaacttggtacttttgaatgcagcattatgtttggaccagacatctgtgggtacagcaccaagaaggtccatactatctttactaagaatgacaagaaccatttgatcaagaaggatgtcccctgcgagactgatcagctgtcccatgtgtacactttgatcatccatcctgatgctacatacaccatacttattgacaatgttgagaagcaatctggcagcatctacgagcactgggatattctgcctccgaagcaaatcaaggacccagaagctaagaaggtatttcgcatattcctagctttcttggaatgccttgcttttgtgtctcttgaatgttaagatattaccttatgattacagccagaggactgggatgacaaggagtacattcctgaccctgaggacaagaagcctgaggtacttttcctttgttctgacttccgatatatcttgtaaaaatgactaacttcgtatcttgcatgaatgagaaacgggaaccttagctgacctgaattagaaaagttcacactatattgtactcttgtaatactatatgtcttaatagatttaaacgtgatgctagaaactaggaagaagctacatgtttttgttgtgtaatgacttgtggtatgctgtttccagggatacgatgatattcccaaggaaatccctgaccctgatgctaagaaggtacttaattgttataccattttatggtttatgttatatatgatgagcgtcattctaggttttaaaatttctttgatgtgatttctgtagcctgaggactgggatgatgaggaagatggtgagtggactgcaccaaccattcctaaccctgagtacaagggaccatggaagcaaaaggtgtgaatatctgtttactgatgcagatgcacttgaaacacttgcatatttctggtttctgacataaacatgtttctttttccagaaaatcaagaaccctaactaccaaggcaaatggaaggcaccgatgatcgacaacccaggtataattgcctttaattgaacaacttggtattacacatttttcagatgttgaactctgcattctgaactgtttcctttgtggttcacagacttcaaggatgatccatacatctatgcttttgacagcctgaagtacattggcattgagttgtggcaggttagttaagcaaagtacagtacgcctttagttctgatttattttgctgggtcaggaagacagacataaatagttatgaacttatcccttctctcttctatcaacaggtcaaatcaggtactctgtttgacaacttccttattactgacgaccctgagttggccaagacattcgcagaggagacatggggcaagcacaaggatgtatgtcgttcttcacctagcttttaccgtgtaatagtttcgttatcgacccaacattctctaacattagtgaatcttgtaggctgagaaggctgcttttgacgaggcagagaaaaagaaggaagaggaggtaaattccttcaccttacaatgttctaatatgaggatgatggatgtacaactgtccttgtcattgcatttcagtctgtgctccatttcactgtctttgctatacgttttgatttttgttggcatgaacaccagttccttgatgatcagtgggccattgcttccacttaattatactatggtgtgatcaaaaccttttaactcactggcatggttctgttatttgtagttttacgtattatcttctgattgttacaccagcatagctttaagcaactgaaatattctccttttgtgagctgccatcactcgtggttattgtggatgtaatttgcttaccattgattatcaatgtccttgttaacaggaagctgccaaggccggtgaggacgatgatgatttggatgtaagatttgcatccgttcttcctccatgttctatattttccttttgggcttgatctaaacctcaacaacatttatatttcacaggacgaggatgctgaggatgaggacaaggccgatgagaaggctgactctgatgcagaggatggcaaggattctgatgatgagaagcatgtatgtaacactcctgcgttttcttgataccttctggattctggtgatgcatttcctgttaacctccatgtgtcctgatcaccgtccttcctttccaggatgagctctaagatggtgaggatgaagaatggaggccgccttcgcgacgatgccaggatttgctagttctcccattgttatgaagttccctttttcgtgatcagaaacttgacaagaaagtactctgtagatgagcattgctgaggaactttaatttggtctttgtagctctctctgtagtgtcatttttcccaccacaagaaaaagaactgataacttattgaacaagagaaatcttttgcacaatcgctctgcatcctgctgtgattgtatatgtgcttgtgccatttcccattgttttgccatagggaaagcgtcttcagtcgttactcgttaggcacctggtcacctatggcatggagtcgaatcgatgagaaggccgagatagaaatgctgggcaagtttgcgttccaaacttccaatgccaagtctttctggttaatcaaagaaatccctcacattgcctgtttattgataccatcagaaatagtttgtttgcattccgctattgtggcaatattctcccacgaccgcaaataactaaatatgggttgatcaattgagcaagatccaaagcaatggtggaatatgcttgtccgaagagtggtattgctttttttgaaaaccaagggggttaaccacaaaattagccaaaacaacctaatggggatataaagttaactgatactccatccgtttcacaatgtaagtcattctagtattttccacatttatatattgatgctaatgaatctatccacatttatatattgatgctaatgaatctagacctttaaaatgtaagtcattctagtatttctcacattcatattgatgctaatgaatctaggtctagaatgacttacattgtgaaacgaagggagtaggagataagattagggcagacagcgcttggatcaggcttgtagttcgtcggtacatgatatcgctatatccgcatatatttagtccttaactagtgcatagtattttaattatatcaaaattattcgtatttactgagttttttatttagtgtttcttattatactaattatgattaaatagtaaatttaaaattattaatatgatataaatgagatataacaactagtgcttagtattttaattatatcaaaattattagtatttaatgagtttttttggttatttagtgtttattatttatactaatatatgataaaatagtagatttaaattattaatatgatatgagatatagctcgttgacgagattgctatctcgttaagataatgagctcaaacgagtcttagccttaacaacccgagctagctctttatccatctcggataagatacctactagttaggtcataacctcagtggcttagagtaagtgttagtagctataccttttttgactgataatacttatcattttgtactatgacgaggttaattttaaaatctttgactataaatattttctaaagtatttattctaaaaatatagagaccatattaataaattggtcttaaaaggtacttcaataaaataatatatttgttgatatttctatatattataaataaaaagtggtcaatgttgcttttgagaccgtgtaattgttcaaaacgataagtattatcatcctgaagagagtaagggtttaacttttcgatttggaagtgaaaacgctcatcaccggtttaccaaaatttaaccgaaaaccattaaaaactgatgactttcggtcaaagccgtacgaaaaccggctaaggctgtgtttggcagcccctcttcccaacccatctccctcgtttttcgcgcgcacgcttttcaaactgctaaacggtgtattttttgtaaaaagtttctatacgaaagttgcttaaaaaaatcaaattaatccatttttcaaaaaaaagcaaataattaatcacccgctaatcgctgctccgttttccgtgcgggcacttactgttgggaaccaggggttccgaacacaccctaataccgaccggttttcataaaccgagatctagcagtttcaccacagcccaccaatttttgtgaaattccatcagttacgtgatccctgaagagagtactaagtagagcataaataatgatgtgatgtcagcatctcatagtaaatgccacgttagattttataatgggttcaggagagagaaataggttagaatgaccgttgtttgagtaaatgccacattggatttacaatgtgtcaaattttacaactttttacatcctactccctccgtcccaataaaccctccgtcccaataaaaaataaatctagagtgtatgttggtttttttatagaacggaggaagtatgttttattttggatcactctttaaccaggccgagccgacccatcagctggcctagcaggccgaggcaaactaacctcgccccgcgctctgcaactgcaaaggattattttctgctttcgtgttcactgaatttctgctggtctaatgaccaccactttatgcacatctcaaatgaaaattgaagctccttccaaatcagcatcaccatcgtataccctttttataaaaaagaaaaatcataaatgtttcagaactacgcttatgcactgcctcgagatttcgccttgacctcctcgtgctcggcaacacaagaacaaaacaccccacactgcacagcagctcttgagccatcaaggttgacaaaaacacgcatgctgcatactaaccacatcacgatgaaaatcagaggaacaccaaatcgttttccagtacatgataacacttgtaatagctgtgatgttcgacaatgatcaaaacaaagcccaaagatatacagaaacaaataggtacaacaatcagaaaagcgttgcattctaaatcacaacccatccaaagtagaaatgcagctgatgtaaagatactaagtactaaacaataggtgattgaatgttctgttggtttgcttgcaaaaaaaagaataggtatggcagaatcttatcaaaatgtgaatatgccaaaaaactgaagccgtcacacaatcttcctactgctcagccttcttcacctcttccgatgactcgggttttgttggctcaaccttcatcacctcttcccattgcccatctgatgcttgcttccacagagttatgttgttctcaccagcagctacagataatatgtttccagtcaaggaccaggaaaccctccaaacaggggacccgaagtcgtgcatgacctttccctcccacttatcaccaactttccctctactccaaatgacaaccttcccatcttgagaagcgctggcgatggtcgccttagctaagcccaacactggtgcccatgcaacatctctcacacagtctgtgtgaacatctgaaggaagagcactctccagtttccagccaccattgacaaatccccagaccttaacaactgagtcaaaaccaccagagacaagcttataaacaagctctcctgaaccagccagagaaccaagtgctgttgctggagcccaggagattgctgtcacaccaacagggtgagctcgctcaatccttgcagtgtcccatcccccatcagctcgcatagtcatgacagaaatggttccatcagaagacccacaggcgagacaaagaccaacctcatatggggcccaagcaatggagttgacagaggacttgtggtcagtaaatacatgggcttgagaccagtggcctccagcaccctccttccaaatgatcacacgcccatcatagctgcaggatgcgaggatagtaccatacttaggatgggcccatgcgacacgccacacagggccatagtgcccgctgagtgttgcaaggagctgggatggggcagatttgccgcctatgctggagatcttgacagtggagtctgaggaggcagttgcaaggcgcttgccatagtagtcgatagctgaatcatggaccatgtccttgtggtccaactctattttcttcgatgacatggttcaaagctgtagtgtgccacaacctctaagtcctccacaattctgcacatgattaaataaaagtttcagcaccaattcatgggcatagcagcctaaatttgcgaaactagataatagaatcccacccgaagtgccctaaacggttaacaaggaccaagaaatagtcacctcacaaacttaatattaacaatctaaacaccattttttgtcatactcccaaagagacagaagggggatgcaatagaacaatgctggtgtatcatcgcctcataaaatcaaccatggaattaaacacaacgagactgtaaataagtatgtagacgaggctcaagggtcaccattggcaaatggtactaattcacaaactttgttagacttgtggcaaaccactatagtaaatgttggtggcttcaaaataataacagaaccacttacatgctaacctcatgaatgagtataacaaggcattggattaattcgatgaattgacttaacaggatgtaacaatttcacagctcaaaacacgttcaaacatggatttgaattcctcaggcatgagaagaacagaagtttcgatagactataatctaaaaaatgaaaacaaaattaattatacccctcattatttcacagctcccaaatctatacaattctgattcttctctatcatgtcaaaaaataaaagaaagatagctgatctggtgtgacctacacccattccctcattccacgagatcttgcgccccccagagggcggatccaacttgggacatgggggttcagttgaacccccaaacttttgggtgaacaaagaaactgttacttgtattaaggttaaggctctgaaattaagagaagagctccttccagatctagaagagaagctagggtaaacgaacggaacgcaagcgaattccagacaaaagtagtcccggtgggagagagatgaatcagaaagaggatgtggatgctcaccaggatcccctcccctgccctgctctgctcgccggatggagatcggcgcccctcccctgttcagccgcgactcgtcttggcgcaaggagcggaggagacgggagattttcttttttgacgcctaagggaaggggaagatactcgagttaagacgtggcagttactgggaatatttaactattagccactttttagacgtggcaattaaggatttgacactaaaatactaaggctgagttcgtatgggggagatgggtacccaacttctgcgtacggaaaacggagcagtccattaacgcgtgattaattaagtattagctattttttttcaaaaagggattaatttgatttttttaagcaacttttgtatagaaactttttacaaaaaatgcaccgtttagcagtttgaaaagcgtgcacgcggaaaacgaggggaagaggatgggaaaaggtgcatgcgaacacagcctaagtgtgtgtttagttcagcgtaaattttgtattttggttaaaattagagatgatgtgactgaaaagttgtgtatgtatgacatattgatgtgatggaaaaggactgaagtttggatctaaacacagcataaacccatatatcgcagatagagaagggtatagactatgagtggtaaatagttaaatgctatattttaaaagtgacgaatagtcaaatatcctgaattagatggatgaaaacagttcggaaatggaaagcgtccgtccgaattttttcgaaaataaattcggaatttttttctcagaaacggaaacaaatatgatgatgctactatccgtcgaaaacgaatttgtggacttttcgaaaacaaattcagaattttcttttctcggaatcggaaacgaaatatttctcatatacagctgattatcttcagacttttctactccaaatatttagatttatactatgtgccatagtacttataattggagttatggatgaatatagttatttttctccaagaaattaaactgtataactagttgtgttattattaattgataaaaattagaaatattgatttattgttttacaaaagatattgaggtatatctcttcatcgatttgagaagtttagcttaaggggtttttatattctaataaatatcattaccgtattagcttcgattcgtattcgctccatttttatattcaataatattctattcctttttttttgtatctgtggttttcgatttcgaaaagaatatggaagcggaaactataaaagtggtttccgaaccgtttccatccaatcgagtactctacctttatatctttttcttactactttaaaactagctttatctttatgatgactagtggcccacagatcagcagtactcagagaaaaaagtacaacaaactccgttggggattgtgttgacagcaacctcatcagaccactagcaaccactagctgatgcttcacgaatgtcacaccctgaagttcttcccctaagcctaaatggaattaataattggtctcgagaaaatacctgtgtaaaagcaagagtgaaaccctaattaattaatgtaaataataatcggaattggcatgtggaatttttcttgagttctacatgtcgaaatatgctaacaagatttttagtggaattttcagaactctagggataattttaaccaattaaaaatgagcataagcattatttaaatccctggaaattcttttccctttttctttttccctttttcccctccttttttcctaatgggccgccggcccatttcctcctccctcccgtaccgtgctgagccggccgaaggccacggcccagctgagccgcgcctcctccctcctcccgtcgggtcgccgacaggtggggcccacctgtcgggcccgtccccaacctccggccacccgccgtccgcagccgccacctcgcaaccgcccgcgccagccttccccgcgccacgtcggccacgcccgcgtgtgcgcccgcctttcccgtgcccctcaactccctctcccgctcgcccgcgcccccgagatggccgggatccgcctctctctccacctccacctccccatgtcggccggcgaaatcgggccgctcccggccacgtccgagccccctctcccctatttaagcatcaccgctctcctctctctctttttctccatttcgccgagctcccccgtgccctccactgccctagcgccggtgccctcctctccgccgccgccgccgccgctccggtcgccgctagccgctgcgccaagccgcgccatcgccgccgtcgggttcacgagcccgggggccatgccgtccacccctccgccgccaatttggacatcttggtacatcttggtacatttttctttgagatcttagtacatcttggtactgcctggatgaatggagtactgagtctgatgagcctcggtgagtatcagatctttcagctctttgtcatcaggtacgcacaatctttctcccaaccagattgtgccgtgctcatcttcaaggaaatcctgggattttccaaccctcatattctttttcagctctgctatttcaggatcatttacctgagctgctcggacttggtccacgagcgtaggccgtgcctctagggcagccatgtacccgtgttctacaattcccaagttgagatgttcaagttcctgctacaattctttacacatgtcttcggtgcacgaagcgttgcagtagcttttcctgcttaaggcatctgccaccacattggctttgcctggatggtagtgaatgctcatatcataatctttgattagctccaaccatcttcgctgacggagatttagatcaggttgggtgaagatatatttcaaactcttgtgatccgtatagacttcgcagcggttgccaatcagatagtgcctccagattttcaaagcgtgaaccaccgctgccaattccaggtcatgtgttggatagtttccttcatgtggacacaactgtcgcgaggcataagcgaccactctgccttcttgcattaagacacatccaagcccgtgacgggacgcgtcacaataaacctggaagtctttcgtctgatcgggcagaatcagaactggagcagacaccaatttcttcttgagctcctcaaaactcttatcatactcggctgtccatttgaatttctcatctttcttaagcaactgagtcataggtctggcgatcctggagaaattttcaatgaaccgacggtaataacccacaagtccaaggaaactccgaatctgtgacactgtcttaggtggggtccacttggtaaccgactccacattcgatggatcaactgccacaccctgagctgtaatgacgtggcccaagaatttaacctctgataaccaaaagtcgcatttgctaaacttggcataaagctagtgctcttgcaacttctcgagtaccagacgaagatgtcgttcatgctcttcttccgacttggaatagataagaatgtcgtcaatgaataccatgacaaacttatacagaaattccatgaacactttgttcatcaggttcatgaagaatgcaggtgcattggtgagtccaaaagacatatccgtgcactcatacaacccataccgagtggtgaaggctgtcttgggaatatcctcttcccgaattctcaactggtgatagcctgatcgcaggtctattttggaaaacaccttggctccttttggctgatcaaacagatcatcaatctgtggcaaaggatatttgttcttgatggtgacctcattgagtgcgcgataatcgacacacattctcttcgtcttgtccttcttctccacaaaaatgactggagcatcccaaggtgaagtactcggtcgaatgtaccctttctgcagctactcatcaacctgcttcttgacctctgctagctcgttggctgccatcttgtacggtctcttgtaaattggagcagttcccggtgccaaatcaatgcggaattcgatctctcccttgggtggcatggtagtgaggtcttcggggaacacttctggatactcgcagatgatgggaatatcttccaatttcctcgaactcttctcctcggtgaccaccggaatttccacctcaatctgattcaaggaaacccccagctttggtggggctggagatttgtacaccactgtttctcccttctcattgatcaaggtgaccgtgcggttcgcacaatcaatgacgcccttgaacttggtcaaccaatccatcccaagaatgacatctaggtctttggattcgagaaggatgaggttggctagaaatggtgatctttggatttctattgttacagaaggcctgaattgaaccgaggtggagctatttgtggggctgtgtcttgtgggtacagttgtacatctctgattagagtagaactattcgaatagccgtgcccgcggttatgggcggtcaaccagattcaccgtgattagtctcaccctagtttagtctaatggaattgattagttcaggtagatggttgggcctattgcaacgtggagtagcgttggacagtggatggttaacattgattaattattacaaatgttttactgctttcaactattgtttataactgctcgctttatgcaaatgtaccgctctacctatcctttggttatatcctgcatcataccccctgttccggtatgacttgctgagtacggtggttgtactcagtcttgctctacttttccccaaccccagagtttgagtatgcgtcagatggtggcttttctgaggagtaggcttcgtccgtgccgttaaggatgcctgtggagtggtgttcccgctgcagtcccagtcaaggattagctccagttatcttttattttccaatgcatttatgtaagacttttataatgtttgtaagacgtggatctgtatgtcaactttgtcgcttgtgtaccccggccggtcctggacaggggttttaatgcacattctgcttggaattctactcgggaatttctgggcgtgacaacgcaccgccaccactgctctttctctttgagccaccatcgttcctcatctccacctttgcatgcgcagccgcaccctctagtcactgacatgactttcctcctcccccgtcatcatgcacactattgtcgtggtcatcattgaggtcaggggtgttgggcttacagggattcagaggggcagccatgcaggagttgacccgacaaagagcagagacactagatccgagctcctccttggtggatctgacggtttcccaacggtcaaagggaaaaagaaaaaggagaaagggaattagtgtgcgaaatggctgtagagtcaccgaacttggagatggatagaatagggtggtctaaattgaaatgtaaagtttgatgttgtgtaaatgaaaagaatggttaattgatgatataatatgaaaacttttaaaaatacatagtacaaactacccgatagtctcgtgatatgctaagcccagtacagttttatcgtctctgcacattatggttgggttggtgtatttagctattactaataatctcataatatattgatacatgacgatacgaacttctactaacatgagttgattaattatggttagatagatctggctaaaaaaagataaaaataataccaacaattttgcccaatagtaaagcattcgattgtggtcttcttttctcattgcatgattgttgacggtcgttagcgactagtttcgaccatcaatactacccaaataaaggagaactagtcatgcttgcaatgcatatttatgttcaataataaaatattccactagcactaggattactaacctcttgcagagaatggccataaaatagaggataatcgacatcaaaacaggcgatcaatcaatcggacgatgttgagaatcagacttatcaatgaatgggccaagaaagcaaaaatgacacgaccaattggaccaaaatttacaagtctgcatttgggagcaaaagaggaggccacctgccgaaattgggccaggccggaccagcccatggttcggccaaatccaccgcagctccgttcgatccaggttttggttggacggctgggattgatccccaatgatggttggagggtactaccgacctttccaaccgtcattaccagcctatataaacccttcactctctccatttcaagacacacctcaagcaagaagctttatacatttctcaagtttagtatagtctctagagtatagtggaatagaaatagaatataatattcagtcctcggagtcttcggaagaattcgggtatggctctagtagcttttccttcttttgtaagacttgtacttttattaaaatattcttctttatacaattttggtattgtattactttccgagtatatgaataccaactttattataggtccaagttatatttattatgatgctagcttatctgagagatgcaatggtgtgggtataatgatcgtattaacgatgactctatgtcatgacgatgatattagagtagtatatggtaatttaagcgtggtgtttggattgctggatatcattatttggggttatatgctgcggaagcgatgtgggccgctgatggtgatagctcagtgcgggtattcctccgcgcgtttatatagtcctaagttaatttcctggggagggtactcctccgtatttatccccagttggatggtcatgacgggttgtcgtaagaaactcggcagtcaggggtggcttctcgaagcaccaggagggcatcggaaagagggtattagtaagtaagtatataactaggatgcatgtataacatgaagtataggaatatgatctttctatattctttccacttagcttagataattgtgaatgaaagtatgaatgcttctgcttagtgtcactctaccctctgaattagattaacccctgcttagactttggttgttacaagtaatatataaattattagtacggttctctctattataatctttccacgggattaaacaaatgcgatacccttggaatactctcgggtgaaatgctacaatggtatatccgtgcgcttgcggatgaactctgtaaccataatatactagaagtatttctgcgtcattgctgggaattatatttctagtaatgtgtaactatattggtattttcctaattctttcatattgttttttgtttttttcatacatgttaatttggactaatattttttctcataattaaacagataataaatcatttttcatatttctcctacaaaatgtgaatagtgcattgtataatttgaaaattgcattataagtgtatgtaatttaatgtgtaagatatggatttatagtataagatttgattttttttctaaaaataccgcactatagaagataggtggttaattagtgaacaaccataaaatatagtgagaatctattgcaagtcactgattttgtctctattttatgatatgccactaggtttgtcaagttctaatatgccatagtgttttgcttaacttctactacgtataatataccattgccgcctagttagccgtcgtcaatattgtacaattttgtcctaatgaccaaactagtactcctagacgaaaacttccaaattttggtcaaaaattctgaaatatcatattgtagaacttccaaagtttgagatgggtaactataagttcaagtgccctattttggttttggtgattaatggcaaatctaattatatgagactaacgtttttatgagctttttttaactagtctcatttggatatgaaaataaaaatgataatatgtatgcattaaacttcatatattctaacttggtctctcctgtggatccaagatatagtgtgagctccctcgttgatcttaattgattatgtgcatatgtgttcctttatatccatatatatgcacatcttgagggggagcttattatatatatttttattataagatctctaccttgatttgaaatatatttcatctcatctctctatattgtttatatcgggttattattcaacaccaaagagagaaaagattgaaagatcttggattaaacaatttgtgtaattgttgctttggtgatagttgataaatcgatgtttatgggttaacatctctattacataagttgtcaacttaaataattcctgataatgagatgtggtaggtatgcattctttggtgatggaccttaatcatgataaatgaaattcatgtagataaagttatattctcctttacattgagaacatagagatcatgaaggaataggtcccttcccaccgtgatgaggctaatggatgacaccatgtgttgatggtcaccaatccaaggacatcgccatgttgataagaatgaagtcaagcttgtgataagaataaagtcttgacaaaggatggttaagacctcggcataaacatggttcaaccgaatgatcacaagtgttgatcatggctcaatcattgaccccaaattggatagcgcaaggcaaaggtataatggagctaagaatgttttcttagtattttggtgtagaacgaatttgctagataggcgtcgtactatcaagaggggtctatgaagcgagcatgtcgatgatcttgggccatattagttcatatgcatgtaggtgcatttggtaggcttgtctagccaagtgtagtgagttttctcaagtctcaaacaaagagacaagtggacacattttgggtagccttaagtggttttgtccggtggaatatcctttggagtgtgagccaaagtcggtctgactggaaggtgctcgatctgacgcagccgaaggaggtatgaccgtgttgacgaaaaatccgcgcttggccaatggtgccagaactgtgttggcacgaactaagtcgacgaacacaacggcatgggagatcttcttagctccagtggcggtccaaatcttggtgagatgtgggcgtgccagtcagtttgatcctgcaactgacaagatatgtaaacaatagatcaaatagccgatcggctgataagctaatggagtaattccagccgatgccgacactagccgatgtcgatagggttttgagcaatcgactatatgtccaatgtagataatgatataaagacaatcggttgatgataatgtaatataacaatagtatactccagtagaaaccaatcggctaacaatgatatgatagaataaacactgatccgaaggttaaagcatacatcggctggaggttcgatgtcataaaatccataggattagataaacagtgaaatctttgttgcgatcggctaaaactaacttgtacgtaatccttataagccgatgcaacgtccatataactcatcggctaaaactccgatgaaacccttattataatcaaagatataaattccttatcggacactaaacacacattcctaaagataaaaggaaactaacaaactattcctaattaatagataaacttgccatgactcatcctccttgaactcggtctcttctggataagcttccttgaatagattaatttcattaactgaatcctccaagaatacaactagtggcgacttgataattcacatcgggcgataccaggactctaaagccgatactttctctaggctgatgatgacttcggggtttgccaaatttcactgttaacaaacctttgatggtcataccagctagccattgctcgtgcattaaatgcactataacaaactagttttctagccattacaatgaaggtcggtctgaccggccactccaaggcggtctgaccggccaacacctgtgagttgggatttcgcccccaccgactagttttggttgttgtgggtatatatacccactccctagtagcaatggtaaggttttagcactccattgcattatattgaatccttgcaagagctctcatgcccttgtgcactttatctagtgagttaagataacccaagtgggcaagtagttactttgcatgagcataaagcctctcttttctaccaaagcttcaaaagcagaatgggagtgtcaacctttcccacaatggtttcaaaaaagacatctcatgagacagtgaatgatttcagacccatttctctcatggggatcagtttaaaggttataacaaagttaatggatgatagattgcagtgtgtgattttgaagttaataagtgaaaatcagtatggtttcatcaaaggaaggataatccaggactgtcttgcttggtcctttgaatatattcatcagtgccagccgtccaaaagggagatcattatattgaagttggactttgagaaagcatttaatacaatagagcattctgttatcatctctgtcatgcaactcatggatttcccagtgaaatggcttgaatgggttaagatggttttttcttcaactcaatctacagtgctcctgaatggagttcctggtaagcccttcagttgcaaaagaggggtcaaacaaggacatcctttgtctcctttgttgtttgttttgggtgctaagctgcttaaagagtggtgaataaagcttttaatctggggttgttgtcaaaaccaattaatgaagctgatggtacatgcttcccaataattcagtatgctgatgacacccttgttctgctcaaggcttcacagaaagaaatcttttgcttcaaagctttgctcaattcttttgctcagtcaactggtctcaaggtcaatttcagtaaatccagcatatatcctcttaatctttcttctaaaaaagctgaacttctggctgaattgttgggatgtcctattggtactttaccttttcacatatttaggactgcccatgggcactaccagacctagagtggttgattttgcccctttggttgatagagtggaaataagactcacatcaagctcaatgtttcttcctcaggggggggggggggggtaggccgaccttgattaattcagtgttgtcctcaatcccaacctattatatgtgtcccttgcagttgcctgttactgtggttaaggccattgatactgcaagaaaaaactgcctttggaagggtaataaccaaggttctacaagaaaatcactagcatcctgggatatggtttgcaggccccaaaggacaaaggaggactgggcatagttaacctgagagtacagaacacaactctcctaatgaagcactcggtgaagttatataaaagtgccaatctgccttgggtgaacctagtttagaattcatattacgcagcaaaggtcccatactcaataaaggttctttttggctgagagacatcttggttttgttagacattttcagaggcattgcttagtgcaccattcagtctggtaattcagccctcttctgggaatatctatggaatgatgaactcctaagtgataaatatccaaatttatgtcatctagctttgcagaaggaggaatcaataagcaatatgtgttcaaggtctttggaggactcttttcttctgcctctgtctacacaggcctatgtggagtttttgcagctggaggagcagctcaattctctgaacttgaatgaggtgcagggggatagctggagttttatttggatttcagatgtctacactgcaaagcacttttacaagcttaatttcttggctttgaatccaccaagaccttttgtatggctatggaaaacgaagtgtgttatgaaagtaaaggtctttgcttggctgctttttagtgataggcttaatacaagaggcatgctgaaccgaagacattacgcaaaggaagatgatgatctcacatgtgtcttatgtgatggaggacataaggaaactcggttgcatgtcccttcagtgctaggtgctggcaatacttgggcattatttggaatctgaatttggagttctttcaaatggtcacttttgcaaggtggagatttggttctctgggtgggaagggcttcctggaaatctttttcatagttgcttggcacatatggaagcagaggaatggacttgtatttgaaaatgtggccccctcctttcagtcctggaagtttctttttacgaaagaaattcttctacatatgtgtagaatgaaggaaccactgaagcaaattggttacaaacattatagatttcaaggtttgttgtaattaaactcttgtaaatattctcttttaatgaaatcacactgctaggcaaagccttggcagtattcaaggtcaaaaaaaagaaaacccaagtgcattgcttctttttttttaccagaagtgcattgcttcattgttagagctagtgtggcacttgatcatacttggcaaacattttagacttgttactcttggaggttgccaccttctagacggtttgaaggagttgtccggtgacctctccaaaagagttgtagaggaggcctggtgttgattgtgagtggctcggtgttcgccatctccgcagtggagtaagaacaaccatagtgatagagtcttgggagaccacttcggtaccggctcccaccttgcccaccccttgacaaagaggacttgtggtggcttcgtggtttgagcggtgaagttgggctcgccccaatggtgatgtaggaagttggcaagcttccgaacatcgatagaaaaatcctttgtcatttgtctcttttattttgtgcaagtttactttgagcaactttacatagtagattttatttgtgccaatatcaacataggctagcttctttgtgcacttagttgacactagttgtttaggttttgaattgtgcaaaaccattttgatttacgcctccacatacaaaacttggttttagccaaaagttttaaaaccgcccattcacccccctctggtcggtctccttatctcattttgtgtatttcttatctttttttttctttatctcaaacataccctgaggcaattcggatcctctgctgtggaggagaaaattcagaggtagctacagtgcctggcattaggagtactgtgaagcgtccgatagaagatggatggatcagatgagacgctacagcaattcggatcctctgctgtagaggagaaaattaaaacactgttcccctcacatattactgtagctacagtgaccctctgcagtaatgcagaggatccgaatccgaggataaggaagagctaattacgatgaatggagaaaattaggcaccaactaaatattattctcactactagactactagaaaaaccatttttctaaatgatggtatttttttaggcgggtaagcctctcggagctaaatggccacctgcgaaaatgacaaccatgggatagggatgaaaacggagtggatacggacggataatactcatgccatattcgttttagtatttttttttaccggatataaaaacgaatacggatagctcgaatacagaaacaaatacggattatctcgaatatgaataagacgaatatgattggacacgaatacggaaacaattttttctcggaacacgaaaaccaactcaacttctaatagaaacaaatatcaacatatataattaactcattttatataaaatgaagtataatttataaatattttttaaaatttaaataatattaatagtatggactagtgttaagagataaactactattaaaatatataaatctatattgaaggttctagaattagaaagaaatagggtatgtctcatggcttctgcgaatatctgaatagcactattcaccggatatctgaattattatccgtatccgacggaaaccctgagaccatatctgtattcgtatccgtatccgaactatccgagaattatccgattcgaaaggtatccgtatccgtttttgttcgaagcggacggaaactatccgctctattttcatccctaccataggacaagatcgttgtccgcctacgaaaatagattttcgcattacgaaaatagattttcacaggccgaaatttaggtcctccacctgcaaaaatccattcggcctcatatatccgccacccaccccttatctctatccactcccttcccctcctttcccctcttcactctctcactcctccctcccagatccactctcttcccctcccctcccctcccccttcactccttcactacttcggcacggagggcactcccctccctccctctcctagatccgaccggtggcgcagagggcggaggcggcggccatggctgacaacgtgcggcgactagaaggagagacagcgccaccgaccctcccgtccctctcagatccggccggcggcggaggtgcgtggcgactgggaggagagccggtggcactcccctccctcctagatccggccggaggaggggagccggctgccgccgccggcagcaatggacagaggggctagagggggagggggaggagagccagcggccaagggagggtagcagcaggtcggggggatgtttttaattcagtgaggtggtctttgtaggcgggtggatgttgcgtttgctaatgaagtacagacaagatgaagatcgcctagaaaattttttttggtccgtttgcaaaaaccccgtttttctagtaatgtctctcaagttagacccattaaaagatcaagtgatttagccgaaataagaagcatagctccaaaaagaactggtacaacacaccatacgtcaaaacagtcaacatacacaagttcttttttttttcttttcaaatctaaacaacaaaaatttgcagaagctagtttcctttgttctacatttctccactatgatatttattcttcctcacaaaagtttacctacaacacaaggtttactggagaagttacaaattagctgtctggcgataagccgatgactgatacagaagttcagtagtgcaaacgttacgtcacacgactgtacgtcaaacatatagtgttacaggtagcccggctcagccgacaacagaaaaaacgctcacaaccatttacaaagaaaggggtaagcaccttgttatctccatacggtgttgtagtgcgtaaggaagaaccggaagtctggatgatgcacttgacggtcccggagccagtcgtccgctgcctgcatcaatgaggctgcgagctgctgctcatgaggcccattcgacgaccaaacagaactccgcaacttgtacggtgccagtccaaagacgggcaatgttagcttaccagctgcattcatgcagctgttaaagcccccagaaggggggcaggctggtgtactggggtcagcatctgcatgagacacatgaattattattgagaagaaaagatgaagctacaaagaaatgaactgagaccacaagaaatgacattgtattaatgtattcggtatgccgactggcataagatggtacttacccctggaacgtgtcgctgttgataggtagtgaaatgtcaagaaacatgcatcgagatccttgagcgttggtccagtagggattctatatatagggtacctgcaattgtaaggcccaggatgaaaccaacatgtagaatcatagcaatacttcatttccagtattgctcttctacacaagtttattaactgatatttaggccctgctcggcttagctagctgcggtagtgcagccacagctagcaccaccgagcaagaccttagcttagtgagtgcccttttgtatcagctgatacaccagcacaaaagcggggtatgcatcctctgtttgggccagcacagaaagtgttatgaatctggctattgcaaaatcagcattctatttcattcaaatatataggagaagtagatcgagcactaatatggggctaaatcttgtgaaaatattgatggtgctaataaaacaaaaaggtcagcttggtgcagtttacacaaggtatatgattgtctgcacatactataatgatataatgtggaaattatccttcaaaagaatacaaaatctctaaagcataccaagaccacagatgctactgataaaatgacgctgtaaattatatgaatctgaagtataagagatataccatgcaacagacatccagctagttggcagaagatcacagcttctgattgacattaactccggaaatttacttgcaagaattgatacctgatgggacatttataataagcataaaagcagtacatacatatggcaaattttcttttgtcaaatgagggaggggcccttgccttgtctgtcaaaggttctctaccataaggaggatccttctcaagatactcgaataatggacgagtagatggaaaatgcgattcactgtcctccctttgaaagccaccattctccaaacctcttaattggtcagcatcagtcccactgctactttcgctgctagtatccatagattcctcatcactttcctcccaaggatgccttaagtaagcgagaaaattaactaagagaagttctggactatgaaaatcgcagaagaaaaaaaatgataaatccacactggaatgtgtaccaatgctctcttcgtcatttttttcatctccatataactctttgatagtgtctttatttggaacaatgttatacagcagttatcaccaccagcgtttcttttgtttttttccttgaatgcaggtttacagttctacaagttgtagtaagattcagattttgtactggttctaacaaatactacgcaaatcaatcaataatactgacagtgtggtagctatagttcccccacaatccaacaagaaaactggcaaacaactggaacttcagatactaatcaatagacataattgaaaataatgtattgttgatagagtatacaccagtgacagctcaaaatcacacaggtaaataaaaactaagtttcttggaataactacggtagcctacaaacatatgactgtcaactcaatgctgattgtagtcaaacatataatcctgtagagagaattacaaattaacaagccactggtgattattaggcaatgacgaaagtccttaactagttcatttctattctagcagatgtaataagataagatcctgatgaccacaattacctcaatgaggaaaacaatctctaaacaaaagacaaaattgtgtgaactcaagaggaaatattttggttgagcaattcaaataatgaacagaaaaggtggcagcaagcagccatgcctacaggctacagctagcaatcacatttctctacaaggatattcaaagcactagctttctgtacgcaaatgagttgtgacttgcatccccaacacaaaagaagaaccaatagacttgcatagtcaaaggaaggcaaaataataataatgaatccataagtacatcctctcaactctcagttctattggttgtttaaccaaatcaaaaccttttttttctttagcagtcccatattaaataaccagagacagaagaatgataaaaaaaaaagaacctccagtgcttactgcactagcttactttgcagcttttataattcctggcaatgcacaaagcagaatggagaaaaataagtaatctaagggccaagagaaactagaataaatttctacctgattcttgttgaatgctttgatgggtctgcatagagttgtatggcagagagatacggcacataatactgtatgacggaatctttgccatttaacacaacggggacgccggccccataaaaactccactcattgaaagcttcccagagatctccaaggcagaaatatggtgatgaattcatagcatcaccactcctccaccctctcatgcttgtctgcacaacagtacataatccttcagtatgaccaaactaaggcagaaattgacaaccatcattgatgtgtttttctttttcatattttttatagcaatgtaacagcattttgtcctcataacaccaactatgcctctcccaaaaccataagtggcaaactgaatacaacaaataggctggttattttggtaacatgaatcaccacaattgagagctcaacctgatcccttagaatctgattcagaagggttgcccatcttttgtataatatgacaaaaactgaaattttgcccttacagttgttaccagtttccagcaaatttgttctacaaaaagtcacccaagacaagcacatttctacagtgttgaaagctccagaaatgatgtatcatcaataaataatgtggggttacaatgcaccaccgatttaccattatgataacagtacaagaaccttacatatctgaagcaggtgaataacataaccaaactatcttaaattaaccgtacgttctctcaactttacttgaaactaggtaaagatagtcgagaactatctttgtaaccacgattcacaaactttccccaatcataacgaaataaaatacagccgaaccgatgggcgaaaatttaacaatccgaacctactctgctagaactgattatcgaaacatctcctaatgcagtaaaattaaacgggcatcgcactgttccagtccgcgaccatttttttcgccaatgactgagaaaaaaaaaagtcagaggagagcctctcaccttgggcaagtactggacgggcacggatggcgtagtggagctgaggaacctctccagattccccgccgcctcctcctccgccgcccgcgctggctccggcgccgattccgccgccggcggcctcttcacgtccgcggaggacggcaacggcgacaccgacggctttgactgaacaaccgcgtccacccgcctctctacctccttctgcctcgccgcctccgccggtgcgggaggcggcggcggcggcgacggcgacggcagcggcttctgcctcgccgccctgggcgccgtcgccggcgagggggagagcgaaggcggccgttgcccctgcagcagctgctgctgttgcagcagcagcatctgctggcggcggacgtgaggcgggctgtagaaccggtcgctcagcatgtagcctccacgagtcgacgacgactgcgacgaggacgacgtcgtcgaggaggtggacgacgacgacgaggacgccgcggcggcgccagacgggccgaccatggcggcggcgggtgggggggctaaggttttggggggatctgaaccggaagtgggggggaggcggcggcgaggcggcgcgggggcggaggaattaggaaagggagggaggggaggtgaggcgaggtttgttttgccgttgggttaattaaattaattaatcactcgcttaattactccggggcttggggtttctttcctttgctagtcttgacctcacgacactctgctagaatgctagatgcaccaaacaccactcgagtgataaaaaaaaaatcttcctctctatgacggatcacgttggagttcttttcttttttgccttttttggtacgatatattcctggcagaaatgatgtcttgttttactgatatcctctttgcttcgtcccacagctattcctttgtctttctgttttcggctaggctttttccctagcattccctcccttttagattataagatattttaactttagttaaagttaaactgcttcaagtttgatcaaacttatagaaaaaatgtaacattttcaatccaagataaatttattataaaaatatatttaattattaatttaataaaactaatttggtaatatagatattattatatttatctataaacttagttaaacttgaagcagtttgactttgatcaaaatcaaaacattttataacctgaaacggagagagtaacttctttaacgcatactccctctattacacttctgaaaataaatctatatgtatgtcgagatttatcttcataaattctttttgatacagaaagagtattttttaaaaaaaaatagacagagagtttttttaaaaaaaataaggaacacaggaggggagaataaaaaaacaaaacaatccgagattacaccaacataattcaattcttgactacatcttatctctctcattcaatctaaacaacgaagaacgaagtctctcttaagaagcacaaattgcacatgtagatttgtcttgaaaagtaccataataaaatcataggcttactaggtactataattttattcgatgtaaactggtagtcagagtttcaatcctaaacataagtctaagtatataccgaggatgaagtttctcatgtttaccatgcatagttctaccacctactaatttgctgggatgtagaagcgcaatagaatatatagtttgtcattgtgccaaggagaagctaccacatggttaagatataatgcagaaccatgttacatgtgttttctctaggttttggaaggtcatacaatatgattgtgtttatgatcttacaatatatgtgccaacttgttgttttactcaaaaatatttcatctgctcacaatctctatgtatgttgagtgagatgtgcatccttctcgagtttaatttatcactgtatccttgtggccattaaacaaatcaacatcatttaacatgtccacgttgtttcttattctgcttttctagagagagagtgtttttttttctttgacctaccatggtaaatcctagcctgtataaactggaaatagtattatcttagataaaaaaagagtgggactagtgaagtgggcgtagcgcaactgattaagtttttatcttgtggtgaaatttgtccacctaaatttaaattttacacttagcataggttcacgtattaattattttttcaatggaggtaggcgggtaggatgtgcttataggagtaaatgaatgaggctaaagagtacagttcccatcgattcacgtcttaaattttgttagctatatgcctagtcaaagtaactaaaatgatggatatatagttaattcaagtgtcggcatttttagataaccaagcatgagtaaataatagtgtcgataaaaaaaacaaaaagataagactcctactacatcctagtcatacaatatggttacattactatatatctgccatccatgcactatgtgccaatttgatgttttgctaaaaaattaatcaaagtaattacaatctacttgcattgcattccctgtcgaagggtgatcgataagggctgaattagatccttgtggacttctaaaaaatccacacagaccattagcatatctttgatctaccacttcaaaatatacttaaatgcaaacaagcgttggtaagatgttgacaagatatcaatgagcatgttaagtacagctcggatccattgacacacatctttaaattcactatgcctggtcaaagcagctatggaacgatgcgtggtcaagcaagtattaagcatttcgtgttaaattaaacaaacaaaaatatataactctttgttgatcacaaatctcccaaataaaataaaagaaaaagaaatgaaaaatggcaccgtactagatactcgtacttgaggttatccatgagaaatctaatgggtgaacgtttcctgctaaacagtgctcagttcagcccacctcctagatgtctccagcacagcacctcgagctgtctcagaaattttatacagcacatgtattacctgggtatcaaaatatacgataactttgtacaccaaaagattatatgttcgacaccaacatagaaaaagttttcctaagtagaatatctctacattaaaaggttatatatctataccctttaaagaaggtattggtgatgacagtaaatctgtcaccccatctacttacattataaattttgcagttagcccttaaacttcttaatattaaaaatatcaaatctaaatggaaagccacatacaaaattagattaagattaatattccctatagcacaaagatggggaacacacttctactttttttttaccatagtaaagcacatgcatttagctcatatatatagtactaattatgtcctaaaatataagagatttaatttgtctatgtacttatatgtgtaaaatcaaagaaaagaaaaaaatacgtgaagaaggaaagcgcagggtactcaagcaagttcgtcacatgaacgtttgcgagatagccctttcaaagagggagagcacgcacatggatattctagtctttcttaaaaaaaaacttagggaatattatgattaaggccaaaatcaaccttatgccaaattattggcaagttgacaggattgccaaattttggtaggatggaataaatatgttgtgtcaaaattccctatgcgttatcaaaatttggtaacaaactaaatgcagccatatatttgtcaattttaccaaacaatggtatcgtttaaaatggcaccaatctaaacgggcccttaaatctctatatacttgtaaaagaaaagaaagatctctctcctaaaaaagatccctacgaaaatggtggcaacaatacataatgtgtacatgcttaaatcttgttgttccacatatgagagcgagcgaatacatattcatttaggataagtgtaatgggtgaaagtttagttgtcgcgcgaaacatatctagtctattgtccggggttgtctgaggaagttttttaatataaattttatatatagaaattaagctaagcttatgacagagtgacattcttttgttttccatgttgaaatccatatctaaattaagatttatcagcgagttgtcagcgaacgcttggctacttggcccctcttggttatccggataagatgctccaattttccgactattccctccccatcccccaccacgctggagaccgcaagcaaaaaggtccacgctactacagtctccctaatctcagccgtccaccaccgatccgacggctccgctccccccgcgtgggatcttttctttctggaaggatcatgcgacgtggagaatattcgcagtgagctcctctggactctggtaagcctctcgcgctccggcccttttcagccacttacactgacaaatggggcctacgtcgcttggtccacgtggggtccacctgtcagcgagaagaaggtcgctgcgggcctgtcactagcagctcgcgcgtgttgtgtcccacgtgacagacaacgcgcggctcgcggacgggccaacgacctgctaaacggtggggcccacaggtgacgtggtgtctcgctggtaggtgggtcccacctgacccggaacagatctgggcctgtcagagccacgcgcacgagctactactgctagtgactggccacagtactggctggtgccattggtcacgtggcgtggaaattgcaaggtccacgcgactggcacgagcactttgtgctcttttccccccttttttttagagtatttgattatttatgctttattttttgaaattttcacattaatcttatgatattctttccaaatatatcaaataatagaagatattacaaccttcttgttaaaaaaaaatcagaaacccaaagaaacaaaataaagaggctctatatcttatattgtcataagagaaatgagtatacgagagcagtataacgctgaaaaacaccggcataagcaaaacgatatgaaagagtatcaatcaccatttttcattcttccaacagctaagtaaactgacattaccgaacaaatcagtacctcggattctaaagcatacacagctaattagatcatcctcaatccaacaaacaacttcttctagatctctaatgaggtagccattgaaagaaagatagagaagaaaatactccaaacaaatcttactctatagataaaaataaaatctaggatggatataaaaccctaaagactatattcgagcaaaaacctaacttagggcctgtttgggggagcttttagtctctagctgctgcagcttctcgcataatcagaagctcccctaaacagtccagtttttggtctagattctaagaatctgttgttgtagaaaccagaaaatgaactagaagctagaagctaagaaacccagtttttttagattctcataagctgccttctaaccagctgcttctcagaatcttaagttccccaaacaggcccttagaccctgtttaaataggactaaaacttttaagtcctatcacattgcatgtttggacactaattataaatattaaatgtagactattaataaaacacatccataatcttggactaattcacgagacgaatctattgagcttaattaatccatgattagcaaatgtgatgctacagtaaacattctctaattatagattaattaggcttaaaaaattgtttcgcaaattagctttcatttgtgtaattagttttgtaagtagtctatatttaatactctaaattagtgtctaaatatagagactaaagttaagtctctgaatccaaacacccccttagttgctaacggaagaaattgattctcttttcccgtggtgatgaggacgttagagacgaaggaaggagttcggaagaccctctcgctaggttgacaggggctacaagcctgagacccacaaatatgcttgcattatccttaacgaatattgcgatattttttatttatacaaaatgttagatgttttttcattgatccaaaaaaaatgtttttaattaaaggcaagactttatctttcttgaaacgaaggataatccccattattcttttttctttagagcacccatttttcatcgattttccacaaaatctcatcgattacagttgattcttcgaccctccgatttgctttagattagtgctgaatattatgatttgagtatgtgtggtttgcgatccgcgctagctacctgcaatctatcatcgatgtattattgatcgagagcagataatcgctcaaacatcaaatgagagagaaagaggcccctaaaactaacactacagacctatatgtgcacatcttttctagctaggtaatgtgttaattaagtgtaattattagagatgactaacaaagttaattacacaccacttacatcccacttacgtaacacttacatatgtaattttaggacttacattataaatacactaaatttacatactccctccgtccaaaaaaaaaagacaaaccctgaatttccgtgtccaactttgactgtccgtcttatatgaaattgttttataattcgtattttcatgttgttagatgataaaacatgattaatattttatgcgtgacttgtctttttaatttttttcataattttttcaaataagacggacggtcaaacgttagacacggaaatcaggatttgtcttttttaggacggagggagtatgtaatttatggacttacaatgtaaatacacgctgactatttttttgctgaaaaatatggcgccataaatatagctactcccttttgaaatccgatagtcatttaggggttgtttgggctatttgggcctttctttgtgctaataccccagcccagatgaaagtttcagccttgcactattgggctcaactgcatatggcacagtccaatcggctaaacttcagttatttcacgcgcaaaaatttgacaaagcctgatgctccatttcaattacagaaataaatatggtttcattccagttggcatcctccttttcttgtggctatagtttccattggctatagcctgggtgtggagattatgggtacgccatacccacacggcacggttatccgattagttataggggataacctatatctatggaatatgtaacgaatcatgacttgtgtattatgtttccttgtatatattatagaacggcctaaaatcatagtttgataatattgtaaattagatttaggaaaccgataccgtattggttgggttggttaaggtttttatcttgtaatcctgccccccatcctatataaggtgggcaggaggtcctctaggggacatgagcacatatgatcgtcagatctatactacacccggaggattcaaatccccaaacaggagtagggtattacctctcattgagagggtctgaacctgtctaaatccttgtcttcgcatctatccacttttaggtctcgtgcgctaaccccttttattattgccgaattcttgtttcaacagttggcgcgccaggtaggggttcgccaagtttccggcaacgagtacgatggaatcaacttcatgagtcatcggcttcgtcttcgcttcgggatttttacttcctcgctgccgataacttgaacatgctctatctctctgacttggattcaaaccggtcggaagagattcaatctatagaagagaacaaacactcaaccatgtcaggagattcagatcagccgtgttgatcgcatgcatctactgatcactgccacatatgcatctatgcatggctgcctacgagaccatctaatcagaaggagttcgtctaactaccaggttgattcttcccgagtcagcaaggtcgagcaaagcatcaggatattaatccacgaaccagatcagatcatcgagtctgttggctccaatctttgacatggatcggtttgttattcttgttcaatttaattagattaatctccaattatgatttgctcttctggtgttttcctgcaggtcggcttagatcaagacggagccgtttgcagcgccctcgtacatagaggttttatccatgagcgatccaaatactggagcagcgccgacggacatcttgtggccaccacgggcacatgggagcagtcgcctacggcttacccggaaaaaatacatccatgaattgatccaactgataatgcattactaagcatcacgcttctataaggaaatattaatttccgaattctaactagattttctatctattttcatgcatgtatctctggagctaccatgtcacattgtggcagttggattttcggagttgtgatctccactgccaaccggtgtcatttcatcgtagaccgctttcgtcgtcgccgaccggtttcttcatcaccatggttggttgattccaccgctgttgcagatggcgacatcattttcaccaccggccgcctacgtcgccgtcgacgggtgtcctcgcctatacggttggttggtcacaccaccgttcataggcgtccatgtcttcaccgaccggcttgccttcgccgccgctgaccggtgtctctgcctacacgactggcctattatgctgccgttgttgggcatctatcgttttcaccgaccggccgcctcgtccaccgccaactggtgttttcgcctgcacggctggcctattacaccgccgttgttgggcgtctacgtctttaccgaccggccgtttcgtctgctgccgactagtgtctctgcctgcatggctagctattatgtggtcgttgatgggcgtctacatcttcactgaccggccgcctcatctgccgccgactggtgtctccgcctacacggctagcctattatgccaccgttgttgggcgtctatgacttcaccgccggcttgcctccgtcgccgccgactggtgtctccgcctacacggctggccgattatgctaccattgttgggcgtctacgacttcactgccggcttgcctccgtcgctgccgactggtgtctccgcctacacggctggcctcccgttgttgggcgtctacgactttaccgccggcttgcctccgtcgccgccgactggtgacctcgcctatacggttggttggtcacaccaccgttgttgggcatctacaccttcacggaccggcttgccttcgccgccgccgactggtgtctccgcctacacggctggtctattatgccgccattgttgggcatttatttacctacaccgtcggtcgcctcagctgcttacacggttggtgttttcatcaccattgatagactacttcgttcctatatcgatcacctttatcgtcaccgagggaaatatcaaaaagctaagtcatcattattttattttatttatatgatattgtccttttcctctgcctcaatacatcaacttgctcgccgttgactagtgagtcgggggctacagatgttatatcatatttttcaacatttttcataatgtctatcttgattgcttgcgacataatctaagtacaaaagtgcctatcgagttatggagttctatcttcctatgctttccgtttggtttgtcgatacatagttgcctttgggccgattcctagcacccgggggctcgttggatggaccgagtaatgcaaggtgctaagttcggaataaatcaaaagcatagagataagataaatttattttctgctcttaacaattgcaaaagtactcgagtagtaaactctgatccatgaaactttgttccattaatgacgaactcatgtcactcgtatgcatgtttgggaagtgcctaggctgactcctggtgcttgggggctatgactagtcgggcagagtgttcaaacgtaaggagtcatccgctcggggaaatcaaaattgacaagaggagaaatacatatttataaacattttaaaatacttgaatttttctcaagtattgtatttacatcagatactactcatcctatatgtttgttctgcaggatccagatccagatatgcacaatagggattcatggctttaagcttatctcctacgctttaggaatggatcagtcagaacatcaccgccggcttgccttcgccgtcgccgactggtgtctccgccaacatggctggcctattatgccgctgttgttaggtgtccacgccttcactgaccggttgcctcgtccgtcgccggctggtgttttcgcctatacggttggttggtcacaccaccgttgttgggcgtctacgtcttcaccgactggcttgcctttgccaccatcgactggtgtctccgcctgcatggctggcctatcatgccgctgttgttgggcgtctacaccttcaccgaccggccgcctcgtccgccgccgactggtgttttcgatatacggttggttggtcacaccaccgttgttaggcgtctatgtcttcaccgccggtttgccttcgccgccgccgactggtgtctccgcctacacagttggcctattatgccgccgttgatgggcatctacatcttcaccgccggctcgcctctgtcgtcgccgactcgtgtttccaccaacacagttggttggtcacaccaccgttgttgggcgtctacgtcttcaccgaccggcttgccttcgccgccgttgattggtgtctccgcctgcacagctggcctattatgccgccgttgttggacgtctacatcttcctcgaccagccgtctcgtatgacgccaactggtgctatcgtcttcacggctggccacgtcgccgcaaccgctaataggcgtcatcatcttcaacgcaagctgtctacgtctgctgccgactggtttctacatttccgtggctgcatgattctgccagtgttgattggccttatcgtcttccccgccggtcgtctcgtctgctgctgactagtgccctcgcctctacggctggtttataccgctaccactactaatggacgtcatcgtcttcattgctggccgccttgtctgatgccgactggcttgttcgcctccacggctgcatgtcttcgtcatcattgactggcgtcaacgtaatcaccggcttgcctttgtcgccgctcatggtgtcttcactttcacggctggcctattttgccgccgttcaaggacgtcttcgttttcgtcatcattctacttcttccatcgccgactggttatatcgccgctggctggtgtttttatcttcacaactacgcgtcttcgctaccggtttgcttctgttgctgccgactcatgttcacttcatcacggctatgcaactttgtcgccatggtggagcgacttcatcttcattgtcttcggtaccggcaaactctattgcccctactttgcaaactttgctacttcaccaaccacaacgcttacaagagcctcgacatctcggcattcactaccaaatttgacgtcatgctaatctactacaagtggttcttcaattttcaagacttctactcggacatcttcaacacatattttcactcaagcaatggctactcgacgacaagaagctacagttctcgactctatgttcagttgtttcccaactaaccaaagagtcgggggctatacaaatacaatactctcaaaattcaacaagcagaagcaatcaattatcagccaacgagtcaactccaagagtcattatcttcgtctttacttcggagcagaagttctacttcagcaacttcaattatttcaccggcaattttggcttttccatgccgccacaatctactccaaatttctcaagtatcaagtttgagatttaatctacatgtccaggagtttagagttatcaaccaatcagcttagtttcgacgagttggacaacaatatttatttaccttcgagtgaagcaccttctacggctataacaataagttctacaatcatctttataaatcaaggggcgtcgcatcagtcttcgttatgcacacgctcgcatcaaggaaactactcaagcttcgatattattgtcactcacatcataaccgacacctctacttcatcggccctgacatctccgtcgttgctaaggggtgactatgtcttcgccttcggtttgcttctgtcatgaccgactttcatcgccgacttgttattttgtcttcacggttggcctactacacaactgccaatgggagacatcgtcattatcatcggctgcgacactgctattgactggattaatgatatcatcatcttcatcaacatcctaccatgcctcttcggctatgcctactctgctgttgttgatgggctacttcatcatcatacccggttatctctgttgctgccaattgtcattatcgccgattgcatttgtcgtcaccgattgttttcttcttttgcatgattgatggatttcgccattgctattgatgagcgtctacgtctttaccaccggcttgcctccgccgccatccatggtgtcttcgctttcacggttggcttattatgcctctactgatgggcgtcttcgtcttcttcaccgggcacctcgtctgttattgactgattattttgctgccatggctacacaactctgtcgccattgctgggcgccttcatcttcactgctagttgatctgactgctgccgactggtttcttcgcttccatgccgattgcatcagctatcaccaatggacaattttaactactccaaaaggataagctatatgctcaagggcttacgagctcaagcacaagggtcataccttcaagttggattttgttctagatacagacaacatgcactcgtagtcctgagattattttctatgctcgaagactagaccaatcattattccccgtaagggctatcaaccgaatacttgcgccagtcgggattcaatttttatatctattttggagtatcccataagggataatcactagatcagaagctattcatgtgagctacacttggtctatatcacccggaagatttattactcgggagcatgttacatgcgtcatcctttaaagggtgtcgaaggcatattttttggcctaggcctaatatgtctgcagcccatattttcaggtgtggcctgtcacgttcgtttagggacttaggcactttttgcttaggccaaaatgcacgtgatcaagtgtccaataccttaaaatccttttataccgcagttactcaactttttaggagttgatacaatgcatcttaaaaggtgtcaaatagtaaagttttatatagctgccccgctgacttttttatataagtcatggcgttgtttgggtttaaaaagcaattgattagatacaatatcgttgtttttttgccatgtaagtgtgcatttcttattgaccaatattatggcttaggctgattatatatttcggtcattttctaagcggttggtaaatcttttatgactttatttactcggatttcatactacatatgtcatatatttccaggtgtggtgaaaccacgtgtcttttagggacttaagcacaattgttaaagcaatgtgcgcatggtgtatgcccgatactttggaaatttctttattcacagcattcaagcttttttatagctgttttgctatgtgaattttcaatgatgtagtcaactttagattgcacgcatcatattttataaagcagtcggtatatcacttggatcatattattcagggattcacaagtcacttggttgactatagttatcaaaaaccacttggttggttggattatttattccttgactatatgcttagtttgttcaactgaccacatagtcgggggctacacttattaggtgcatctagtcgatgcacctgactttattttttcagccctccacagtcttctgatttggaaaaagtactcgggagatcatggcgaagatgattgaagcactcggctttggagtaatctagttcgagagaagattatcttttcgactgcgaaggtctcaggggctactgtggagactatgggtaccctatacccacacggcacggttatccgactagttataggggataacttatatctatggaatatgtaaggaatcatgacttgggtattacgtttccttgtatattatggaacggcataaagtcctggtttgataatattgtaaattagatttaggaaaccgataccgtattggttaaggtttctatcttgtaatcctgcccccatcctatataaggtgggcaggaggccctctatggggcatgagcagatatgatcgtcagatctatactacatcaagcggatttaaatccccaaacagtagtagggtattacctctcattgagatggcctgaacctgtctaaatcctcgtctccgcatccatccacttttaggtttcgtgcgctacccccttttattattgccgaattcttgtttcgacactaggcaatcacaatgtattaaaaaggtaaccttaagataattattacacttgcaaaaggaaccacgtacattatgggaaataacttcagcttagaaatgcaccttatgcttaagttctactacaagaaaaaaaattatctatctcatccatctcatgaacatgagttaagcaagtttttctatttcatgtgtgtgtctcatcttgtggttaattaggtcttagctataccatcgtgaaaattgctttaacaattagtatcaactactccgtattcatgtacccactctcaaggttaagacactgtattcattgagcttacccttaaagccgtgcgtgcgtgtgtgcgcgatcgaaaagcgccgccctcgcgcgcgcgcgacgggtcaacccgcgcgcgctcttgatccaccgccaccaccccacctacgcaatccgatcgatcgccacgaaccctagcttagccagatccaatataggagtatgagtatacagctacccatccttataaatcccgaatcccgaggccacacatcttcccatgtcagatcatgtcgaccatccatccaaaatatatatagcagcagctagcagcgatgatcgatctccatttcacacgctcgctgctgggcatggcgctcatcatgtcgccgtcgccgccgctgcgagcccccctcctcgcgtcgccgccgccatcgtggccggattgctcctgctggcgcccgccgcggcgcagcagccgcccccgctggtgcagcagttctactactactcgcccccgccgccgtcgtcgcccgtgggaggcggaggtaccggcgggggcgggccctcgccgccgaccaaccccgcgccgccggcggtgccgtgcaactgcgggacgacgacggcgccggcggcgccctcgccgccgggtgtctacaactacagcgcgcctagcggcggaggcggcggtgggggccagctcgcgttcttgtccgggtcggcgaggtcgacgtcccacctgccgggcggcggagggtggcgccatgcgcggctgcttgcttctgctgctgctcctctactactaatagtatggtggtaattgatatattagtcgcttgcattattcatgatccatatgtgtaagtgttctctgtaattttagctacaaaagtcaagatacagtcacagatggctgaggactgatcagatcgaggagttaattaattagtcaaggcacatgtatgagtaaagtcgtcgactgatatacggaatctcttttgttgcgaaatggaggactcaaacttgatcttaaagctgaatgcaagataatggtactccattattaatcaagtcataggtgacaacttctaaattcctgataagagtttgtatatttcatcggaatttggtaaacagaacacgtgagtgttgcgttttcttttattgctatagtaagtgaacgacccgataggtcggcttctaatagttaaatgcgaaaacgttcccaaagtaatgcaccaaaggccgcaacctagctgaatgcaacttaggttgccaatgagctgagctcgagcgagctcacctaccttaggctcaagctggacacaaactcaaatcaaactcgtgtaatcttcgagctttcagataagcttggttcaaactcgatcaaactcaagctccactagcaagcttggcttaggccccattctaaagtggcaggttaatgtgttgctacctactattcagagcgccaattcagctcagcccagctaagtctgcactttagaatggagtcttctaagtagaagtatgcatattttaagaatataatctcttaaaaataattaatttttagttaatcacattaataaaagagaaaagtatatatggtactaatacaagctacttccttgtgtgggtcacatacaaatgatatatttgatgttctagtttattaataaacaataaaaatcatatattgttaggcacgttaagagatcgagctcagctcgataaagttagtaggctttggtataagctcgagctcggtttttatagaactcgagcggagctcgaatccagcctagggcgagccgagctcaagtagcttgtgaacctcaagccattttaatagccctagtgcaaccaacagtaatacatcaaaggcgcgcaactatacgaatattggaaattttgaccagacgaaaagttccatgttatgggttgtgaatctgtcgaacgcttattcgggagaaagagactcattagagcaagtccgtgctagtgtgccggcctacatcagcctccgaaggctctaggccattgttttacaccgtattgacaaaagacaaacaattaataataggggcaattgcgcatctgaccctctttttttaagcctaactaccatttaactctcttttttttaacttggctcgtttgacccttctttttaaaattgaagattcaatgtgaccatattctgttaagggcatgtaacggtgttaattggagcaaaaaaataccccttctacccttggtcagttgaccctattttatcaaaagtataaataaaatattaaaaaaattggatagcataagaaaacatgcagcttgtgaataaaaaaaacagaatccacagcaatcgtcgtggccaaccaggcggcggcggcgcgcgtggaggaagacggacgccagcacgcacgcggaagaagacgaaggccggcgcgcacgctgagggaggaagcggcgccctgtgcagagctcgagctcgtcggcgtgcggagggcgggcggcggcaacacgcgagcggaggcgagaggcgcggaggacgagtggtgacggcgcgcgcgcggggagagaggcgcggaggacggcggcgagcggcggcgagcgctggagagcttgccggagtggagaaggtgtcgcgcgtcgttgccgacctgcagtctctgagaccactgccgcaccgccatcatcaacccgccgccaccagatacgcaacccgcatgccttgacgccgccggattcgcggcttgcacgcccagccgctgacggatcatccaccgccacaacccgagctctaccgccgttgctcctcctcgtcgtcatcgagccgctgctgctccttccgctcgccacagccgccgtcaccgccgctcctttctccgtgcacgtgccgtcggcaccgcggcgccatgcctctgcgcgcgcgccccgccttctcctacgccgcatgcacccagatagatggggttgggaccgaatgaatggatagggttgagttgtcaccatgggtattttggtcaatttgactagtaaatagcactattttctttttttctaaatgaaaccctaacagtgtggtgaaagtagggtcaaacggtgacttcgattttgaaaaatggggtcaaataagcaaactaaaaaaatctaggtcatattagtagttaggtttcaaaatagagtcaaataagcaattgtctcttaataatatgtggttagaagggtacgttaaggcaaatggataaaaaaagggttagcacttgaactttactttaagtttatttttgagtaaattgcattggtggcatacaaacttaacatttggatgcaatctagtacacgaatttacaaaatgcttatttcagtacacaaacttgtttaatgagtgcgaaacaaggccaaaatggcagacaatgacaaagaatttctgagttggagcctacttagaatggcatgagcatacataaggggtcatgatacacgctacatgtgcgaatagcctctacttggtaatacctccgtttctaaatatttgacaccgttgacttttttaaatatgtttgaccgttcgtgttattcaaaaaaatttaagtaattattaattcttttcctatcattttattcattgttaaatatacttatatgtatacatatagttttacatatttcacaaaagtttttaaataagacgaacggtcaaacatgtgctaaaaagacaactgtgtcaaatatttagaaacggagtatttatttttgttatttctttgttttcaattcattgcattctttagctatatttcatattatgtccgtataatcggtatctcttattatatatttggttgagcacatatatacatgtcaagatgacatcatcctgatgtgtgcctgtatgacatcctaataaacacaactaagtaggtagtaggattaactagggcatgctcatttgaaggttctcatgcaccaaataagtttgtgcatcgaaataagcgttttgcaagcttttgtgtatcgggttgcacccacttcacaagtttctgtactgtcagtgcaatttacacttcattttttaccctaagctacagaacctatacatgtttgtcattggttttgtttgaaatggagatgattttcctatttcatacttttatgttcctgatgcaatgtcatttaatttggttcacaaagttcatgctagcaaaaaaatcactatcatgtcaatcaaaaccaccatacaaatgttctttagaaaatatgtatccgattttgaaagacatgggtgaaataactagttttgtatttgaggataaaaaatggactttcacataaacaaaaaaggtaaaatttataggttgattgtgttaactaggtgacgtttcaaacagccattgtccccctatattaatggcaggggtcaaaacccttcaattggactcaaatataacataaaatcaactcaaatccttttcaaaagtcacaaactgacttggaccagaagttcctatactgaagaagcgtgcgctttctatctgtttgattaaaataaggccatatttgtttaggcttataagccaaaaagtctctaaacaaacaatcagttttttcgtttggcttttttgaagccataagccactctaacactaagggcctctttgtttaagcttataagccaacttataagtcgaaaagtctaagcctaaacaaacaagcagcttttccgtttggctttttttgaagccataagccactctaacactattaagccaaaagctaggttggagaagcttttttggcttatgtgaggtagatgtatgactcaactactaaacttaggacattaaatccaccggcttataaatcatataagccaataagctgacttaaaagtctaggccaataagcctaagcctaaacaaagagggcctaagccaaaagctaggttataaaagcatttttttttacttatgtgaggtagatctatgacttcaccactaaacttaaaacattaaatccatcgacttaatgttcagataagccattgattgaaaagtctaaaccaataagcctaagtctaaacaaagagtacctaaatcagccaaaaggtccgattcataaccggaagtttcagaatggaactattgtgtccaaaaggtctgatttttcagcaaatcaaattccgtctcgaactatgtccatatacctaatatatattccgattgatatagccacattgcacagtgccaaacgttggtgtaaataatgcgcttaatgaatatttggtgcctttttctgtggaagaaatgatcgggacgattgaatatgtgtatgcacaaagagaaacagagcatgctcactatgggttaattgggtatatcagaatccaattgtgcaactgttggttatatcttagaggagaaaaaagaattacaatatcctatttggcgagtctgttagtaagaggtaagctctcaactagcttgatatttaatcatgttttagagagggtaaaatctaaatcgagagagctctctatttagttttaatgggagacaccacatacatgtcttctttgctacacatgcatgccatgtttgctattatgtcatatatattttttccttcttataaaaaaatttctcttacattacttatctgatctacaatccaattacatcattgagttcgttacaattaaatctttataacaagatcttacatgattatattatgataaaaaatatttatgtttataattacttttattatatttttaagttacttttattacgtattgactccgatgttgggctcaactacaaaggtctgataaggacataatgctaatgaataatgcatgccataaacttgagtcaacggtcatgcaaccctttgccaacatgggtgaagattcacaaataggatccaataattatgttttctttatcttgtgttggttttcattagcgtgtgc

SEQ ID NO: 74138 - DNA, 25241 bp, Oryza sativa
ttagcactcctattgcacctcattttaaattatcagttttacaatgtgctagtactgatgaggatgtagaatacatgtctagagttccatattctagtgctgttggttctttgatgtatgccatggtttgctccctgccagatttatctcatgctatgagtttggttagtagatacatggctaatcctggtaaagaacattggaaagctattcagtggattttcaggtacctcagaggcacagctgatgcttgcttgaagtttggcaggactgataaggggcttgttggatatgtggattcccattggtagttgtgctatgagttggaaggcaacattgcagcctgttgttgcccagtctaccactgaagcagaatacatggctattgctgaagcatgaaaagaatcagtttggctgaaaggattgtttgctgagctttgtggagttgattcttgcattaacttgttttgtgacagtcaaagtgctatatgcctcaccaaagatcagatgtttcatgagaggacaaagcacattgatatcaagtaccattatgttcgcgatgtagtcgcgcaaggtaagctaaaggtatgcaagataagtactcatgataatcctgctgatatgatgacaaagcctgttcctgttgctaaggttgagctttgctcaagcttagttggtatagtggtttagcctgagaggctatttggcgccgaaagtgtttttttttgtctttgttgtgttcagggtgaaggattgattcatgctacaagaagggatttgtctcaaggtggagtctgttgagttgtgatccaaattcatttgcacttaatatcttcactatatctgggctgtgcgcctggggacgcccggaggggcgggggcagagcccccgcggtacggatcatcatcccttttagggttccactatatatatacctcttgtaagcccccgtgcggcgatgtaaccttacctcagatatagtgaagatattttgctggctggcgcctgtggttttttctctcctgttttgggagggttttccacgttaaatctcgtgtcttttgtgattgatctattgttctttatcgtttgttcgcctatcgtttcctaacagggagtggatctatgtcagaacctggtctcgcacagcttcacagtggaggtggtggtgcgagctgaataggcaaaaccagcccgtcgtccttgccggcgttgtccactggctaatggatgcctcccgcagtagccactacatcctgacgtacgacattgcgacggcggaggaggggaagatggatctccccaccgattattgtggttgcaaggaaatacggttgggatcgtcgccggaggggaggctgaggctgctcgtccttcatcagcacctctcgttgtccgtgtggctgttctccggctccggctccggctggacaaggcacatcatgatcgagacggagagtaggctacggtgtgtgtacccgtcgtggagcgtggacttggagttgccgtggtcgtgcaagtgggagaggagcgacacggtgttgctgcgtcccatggactactccgggtccgggtggacaagatgcccactagggttgctggtcttggacgtcaccatgggggaaatgcgtactgttaataatcggagcgaccaacttgttctctacgcagtcgatctcccctctcgcatctcagcaatgaaaacctactagctctttttttcttttcgagtatacatgcatgtcggacacaccctcatatacttgcaactagcgagtattatcttctcatgcatcaaataataatccagatacatgattaattaaagcatttatacttgaaagacatagccccacgacatgtttctgtgggctggtataccaccacggtaccccggaaaggtactgtaacaggacccttcacataaccctctctaaccaatcgcaccacacctcaggtttcgcccccactcctcaaccagacaccccatggacagcccccctctcgtgccatggtgaattcggcggccgatcaaccagacaccccagccgacccaactccatcacgcccaccctagcctgggtacgtcagctagaggaaagatccactacaagcccagttgttgcccacgctggctcgtggtatgcatggtaattcttctagggtttcccgtgaaccagtccttaattgccatgggtacgactagcaaaaccattcacacacagcccaccattaagccatattttagttgaataattacgaccaataaaacatggccagatgtctcgagctcgtatagctcaacaatatactaaagtaaaataatgtaattatcccattatgtgagctagtggtaattaagcacggctaagcatatcatgattctagcaagatcaacagaagtgacacaaggtagttagattatcacccaaagtttcacaaatgacggaccacaactaagtataactaagtatagcacaagcgagcagaaaggtaatcccataatccagtgtagttagtaaaacatgcaatttatttgtaaacggtaaaaaaattgtaaattaggttcaacatgctcaaggggaatgtgtgagtgccttggttcttcaatcaatctttaaactcttttccttgtgatcgcgatcttctgaaacgatggattttatgcgccggcacgcaaaatgaggaaaaatcctaataaaaatcaaatggacagtacatgaaaagtaaacaaacatgtagatcttaattttagatgaattttgcaagttgaatggctcaatttggagttgtatgaattagttatgaattttagaagttttgagccatttaaatcaatttatgaaattaatatcgatttattgcgcaatttattatttattttctcaaagaaaaagttaagcgctgatgtcatcaaaggagaccagcgcctacaggtgggccccacatgtcagtggcacaagggaggcggcccaccatggaccgggatcaccgaggtggtccaccgccgacccatatcagcctaagccgaccaggcggccacgtggtggcgtggccgaggcacgacgacgcccgagactggcctggccgaccatggtgcagcggcggcgcggggccaccggtggccacagccgacggcgccaaacggcggtgagcggccggaagacagtggcactcacgggtgacaacggctcaccatatgaggcggcggccggcaaggaagggggaggggagaatgagaggagggaggaggggccgagggagcgggatgccatggggaatgtggtagaggggttacgatgagcaagaggacgcttgcagcggcgtgaatcgctggccggaggcgagaaagagcggcggatgctcaactcaagcaaacgagagggagttccggtagcgattggagccggcggagcggtggccgaggggctgcgcggtacagcagagctgatggaggtggtgcgcggcttgaggtggtaagggacggcggcaagaggcgactagaggcggcaggcggtggtggagctcggatcggcggtggaagcggcgctccggtggtggtagagaagaaaagagcggtggccggggtgcggcaaggcgcggtgaagccaatggtggtggtggcacagcgcagcggtggctagagtggcgagaagcggcggccggagcactccggcgagtggcggggagagaaagcaacacggggagctcggacggaaagggaaaaaaatggagagggaggtgcggggatggtttttattggctcgggacagcgggatcgtgccaggggcgaagccaggataaatgatcgccggggtcattactaaccagggtctatgttttcaaccaaaacggactgaaaacaacgtaattttgatgttttgacttaggatgaaagtagattctgagagaaattttgaatagttttcaagaattcaaatttgaaatggtaaaattgaatcaattaataaaaaaaatcaaattttggttaaaaaaagtcatatcgctatgtttggaatccaatattaaatcaaagaggtggaccccgaatctgggtgtgttcggaccgctacgggttctgaacccttccctcccagcacgcaaaatgaaacgaggattaacgcataattaattaattattagcttatagaaaatttgaaagtagattaatatggtttttaaagccattttcctatagaaattattttgctagggaattcaagaagttgtaggtcgctggttttatgtatggtctcaaatctcaaaagctcaaatgtatatgcatattcagctgacgaataatcgtaagtgctagctaattttcttttcgctgctgctagtgtcgtttcaagttgtcaattgggatttaacacagcaatcaacaattaatgttaccggggtctaacatttatttttaccggggtcatagctagtaagataaagaggatacgagagattaaaagaaaatcatcgggtcgactaaccccggtaaatgactgtagctttgccccgggatcgtgcccggggagaggtggcacacgtcagggaagtgagatggcagcgcgggctcgtggcggggtcaaaacggcaccaatttttgggggaaaccgggggaagagatggaggagtgagtggtaggcgcatctgaacgtaggcacgaaggcacgatcaggcagggcgtgttgtgcttgggccaagacaaacttcatgtcgttggtcgatcgggccgttgggctgcggtcattttgaccaactataggttgctgcattctctagccaattgtatttatttagtcatgtatgcatttgtttaaaacaagaaaagcaagcgaataaaaggttgttggctgtgagagcctagctagccaccaaaagcctcgtgtattattgttcttgtacactctgtttatgtgtgtttagattagtgtgtttgagtgaaacaccaaacaatgagctaagggatttggctcccaacaagatccagggatctacttccaaaatcgaatacttccatgatcaaaaagtcccaagttaagaggaaacaacgttcaacatgatcaggtgttcgaaaaaaaatagaaaacaatcggtatgcaaaaagtattaggtagaacggaagcagagtttagagtttatcttggttgctcgatctacttcgtttgtaccatgcaaacaatgcacggaccatgcgtaagctgtgaaaacccagctagacacccatattgatctacaaaagcacagcatcacgatgtgtgatggacgaagagaagagaccggctaaactagaacttccacgaaggataaacgggcactgcagagacgggcgacggatagaaacactctatatttattaagtagataaaggtttattctttatgattgacacatgggccccaataatatggaggtttccatcgtgatatgccacgtcagcacatgaagtgggttaattaaagtctgtttggatcgacaaatttttcttggatccccctattacatggtcctatgagactatttatagcccctattacaggttcttactactagggttttggttatataggggaatttatatggttacccttatgaaagggatatttacatgggtacatagtataatagaggttcatggactcctgatgggccgttaggcgatcgtcggcccaatggcccctaggcttgatgggccggaaaaggcttcttcggccctcgtgggagggggggttcgccccgactaactttgacgtcttgggcttagatccccactcctcgcatagccttcggcatattttggtcgtagggcctcatgccataccgctaacaagcccctcacgggcaagggtgaatttggagcttcggccgagaccgtgcaaaccatgtggtatgtggtatggtatgtggcgccccctttcgaccgatgctcctgccgaaacctacattgttcctgcaaataaagtttgttgtctgtgcggctggtattgatttgccgctcttcgcctcctgcggatggtgatatatatttattattattatttttttatttttaccgggccgaaagaaatagtaatgggccttccctttgtgggctttttactgtgcagctcggtcgatgggaatttaccgtttcgcctaccctcgcaacacgtggcgctttatcactgctgggtagacgaaccgtcgccgtgttgggctatatatgctcccccgttatcttgtcaccgccaggcttgccactttcaccgctcgcgctctcttcctccgttcttgctctcacggcaccccttggccctttagatttctcgctcactccccttgttcgccactacacacacccttcgctacttcacacatccttcgtcatggctccccgcaagcctgacccctcttcggtgaaagggcccgaccccgaccggattgtcgacgacaccaccgcctatttagggatttctctcatagacgacggcgagctggcaaagttggtcagctctggggcgttagtcgagggacaggctttcgccccggggaaagccgttgtaccgaagcccgttgataaccggacagtgagtgttcgccgtattttttgagacggggctccggtttccgtgcaacgcgttgttgccggagattcttcgccttttccaggtggagctcccgcagttgagcccatcggcgctggtccggatcgctatcttcaactgggcgtgccggacatccgggtttgagccaagcgccgaactcttcggcgccatattcttctccaccgtgaattcgaagacggtgattaccccagctagaacgaagaagacagtgttcgggagcgtaaactttaatgttcgccccgagcggtccgatttctggccggtgaacgccgccatgccgaagtgggaccgccattggatggcgaggtggttttaccacaccatccccttcgaggctggttctgactccacaaaagcccttcggtgccggcgcagggcgattgcgccgaaccgaaagcccaagatcgccgtggacagcgctatggaggcgtggttcgctctactgcgtaagttctgctcccgccttagttgccgcgacttggtggaggaattctgcatgcttcgcatctttcccctctcctagtcgtgccaagtcgcagttgagcaaggcgaagaggttgatggtttgccgaagttggttctccctgatgggacgaacggtaagactgccctttcgcaatacactcctgcgctttgttatttttctttgttcgacgcttaatgtggctacaccctttatttttgtagtgttgaccctcgaccaggctgacaccgaagcccgtaggatgatcggcgacgtgtcggtcgtcaagtatagccagctgctaacgcgacaagcggttggccgggcgaaccgggtttacaacggcgaattgcctccccgggcgaacccccacaaggccgacgacgatgcaggaccttcgcgaaagcgaacgcgcgaacaagtaaagcttgcgccttggaagcgaagggttcctgtttcgtccgattccgacgccgacgacgaggacaacgtcgaagatcgtgacggcgaggagaaaggggaggaagaggaggaggttgaggtcttggtcgaaaaggccgcggacgagacggtcgaaaaccacgtcgacacccctggctatactcctactccaagcctgggtcacaatgagactggggtggagtcgaacagctccccccttcgtcgaaaggagttggttggggcgaaggtgctaattgcgttttcggcaggcaaggcagcgaagggaggtccggtcaaaaagatttccaagaagaaaggactcgtcgatgtcgctcgcgtcttcagcgacgacgagtcttttgacgagactccgacttctcccactggctgcagcctggacctttcgactgcccccgttctttcacttggcgttgatggagcaggtggtagcgccgccgccggggcttcagcctccgcggaacggattgtgacagctgtggtgagggtcttcggtagccctctgcgtcagccggttgtttcgccgctagtcaaggcgaaggggaagggtgcagccgtcgaaacatctacttcggagtattcccttgcggcgccccatttcgcccctggcgatttcgagacccgggcagaccttattccctttgtggagggagtaagcaatcttgtcttacctgctagcaccccgagcctattcaccgaactgaatgagttcgatgaggggtgttctgctattaaaagcttggcggttcgggtatgcttttcctctattcttggttttcctcttcttttttacatgtcccataattaacatttgctctcttcgccgttcctattttgcatccagattcttgcagctcactgttcgacagagcgaaccatgcgggctcgtcttgacagatttaagaaccgtcttcgggccaaggatgacgaaataggccgcaagaacttggagatggaggccctcgccaacaccctgaaagaggcgaaagccgaaaacaagcggctccaatccgagttggagaaaggaagagaggttatggccgaggtcgatcgcctcaaggccgaactggagaaagggagagaagccatagctgaggttgatcgcctccaggccgaattaaggaaagaaaaggctcattccgccgtgctgatggattattataaccttactgagccgaagatggaggctcttcgcctggaggtcagcaaggccgaagcgagcgctgtggaggagtcgcagcagttttcgcgggagatggcgaaaactaccgaatctgcaagaacggcgtgccaaacgcttcgcctcgcccttactgacatgggtgcaaaagtgcgaggggtctctgctgaagatgcctcggccttcgacttcttcgagtggacccagcaggctggtggttcggtttcggactgcgccactgcatacggcgattgctatgcacgtgtatcagcggcctttactatgggtctcctgcaacagttcggctgtgagcacgtcgccgagttccctaactatgtgaaggaagggggactgggagattagcgcgcaggacatttcgcccgcacatcgtgcatggcggaaacagttctggtagaaggacagccggtccaccgccaaggcacgccttttggagcaactagcgaaggcagaggcggcagacttttgcgaagaagaggacgcggcggctgaagggggtggaggtgatgcccaggatcacccagaggtgtgaggccctccgccctttccttagatttttgtagttttccttctttttgtgttcgccaggagtggcgaacgatgtgtattcggctagctgccgctaaccctccttattgtagccgaaaaagaggcccttggatattttgaatatatatgactcactcttagccactttttgatggtcgaagtctttggcgtatttatgaatacgcccatttcacattatgcaatacttttttcttttttcgcctattcttactatgcaattcgccttttgccctttttgcactgtctactagggtgttcgccgaaagttgtgtattcggcccccttctgggagtttgcgaaaccaaaacgagaaatttgtggcattaaaggatttgccaaaggtgcgatgcccatttcggcctgtttatcatgaaatggtgataaacggacgcagctataaggtttttaaggttgccgggtggcttcgggcacaccctgggtgaaccttagaagactatgatcttgttcattcaagacatttggaggacatggctcgcttttggcaaaatgtcacatcctgatttttgtttcaggatttataaattatttaataaattattattagaatttatattaaatgttcattaatttacaagtgaagttaaatgtgggaaataaaatttcctaaatataaaacatggatggatttaattttgattaaattctccatgattaattacactctctgaaattttctcagatttttcggagctcaattcttaattttttaatcatacaaagagcatttcagtaattacccacatattaaattaattattaaatggtctggttttaatattgttaaatactttgggtgtccaagtatgttcaagatttttcttggaattatttgagcataggaagtatttttaacaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctaatttgcctccctcggcactgtttatcttctacctctagcagccgaactgagaccgatttggctcggtttttctcctccaaatctgacctttccccttgtgtttttctaaaattagttgaggggaaatattcctcttatcctcctctatctttacccccaaaaatcggagctaatcgttgagtatcttatccgaatcgaactcgttttcgagtttatctccaaaaccgagtttttgattttccggatcgatttcttgcgggaggagtccgatctcttcaatccaaggctataaataggaccccctagtcctcctctttcgttttccccctctcccgtgatctcccgtgcctcgtagcgccgccgccacgtgctccaccccgccgtcgtcgccggccgagctccatccgcgtcgcgccgccgcctccgtcgtcgccgccggtggccgtcaccaccgttaggtgcgcgggagggtggagaagcccggccgctctctccccgaagccgccgaccaccgcagccccgtcgccgccgtcgaccgaagccgggccgccgctagacctcgtcgccggccgtcgtcgttcgtcgtttggttcgagggtgagtaccgttgggttcgtctcgtcgtcctctacgtgttcttgtcctccaaagtcgcagccgaccatctaatctccggcgaggtcgccatcttggttcggccattgatgaggtcatcatcatgacgtcatcatcgttttttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttctttgttttgcgtgttagcttgtcgtttccgtcgttgcgaaggttcgtgagtgcgccggaagtattcaagaagattaattgaagaccgattattgcaaggcaagtcacacagaccctaaacacaatcctttgagcatgttgatcctatatttaaattctctatttatttcaactgtgcatttattttcgaatgtcactaggtggtgtgaacttattcctttgttatggccaatttgcattgattactttattccttgataccttgggttattataacttgactagttgagctttatatattggttcagctagatattagatatgattgcttagccatgcttagaaacattagcacactattgggataacttatgactcattgtttaatgatggtttaatggtagctcacgatggttaatcgtgttatgataattaattgataactaaaacttgacaatggtgggttgtgagcacatggttttgaaggtcgtgctcatgacaattaaggaccggttcacgagctactgttgtgaaacattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagttgtgttgtgcaaagggtattgtcacagcctctattcgggtactttccagtatcgcgacgcatggtagacatgatgatgaggctgtgtcttgtgggtacagtggtacacctctggccagagtaaaactattcgaatagccgtgcccgcggttatgggcgggttgagcaatgtttttcgtgattagtctcacacctctcacaataattatggatgttatatctggtaataatttgcttagctcctagtttggagttagatctgtacagccgggtatggttgttcaggatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggactaagtgcctcttaagtaagtatttatcgttttagttaatttgatgaatctgtatattaaattgtcagtttgtgtacctcggctgatttctggacgaggattttatgcacaaataagttcggaaattactagtgaatttccgggcgtgacacaaaaccatcagaagactgatcggcaggaggtgatctcccagcgttgttacagtctagtctgtatttcgtccccttctcctcttagggttgtgtatgatattagtagtgatgacgaacctagttcgcccgatcactccttagagagagagagatagcgggggctaagatgtaatttatctgtaagccgggctataacgccattgctcctttctcttcatttgtaccattgtgatgtattcttcgacacatttttatttaaaatcaataaaggtgcgttttattttctttttgctatttttgcattgtcacttcgcgtgcttttcgttgggtcggaacgtgtcgacccctttgtatatattagcgaaataggttttgacttttcagctttcagcttccgttttcgatccgttttgttctacgttacaaaaagcactcgtgctttcctttcgatcaagtgtaacggtgttcggctaattgttctccgaaacaagctgttgcggtttcaatcgttcggcgagcaatgcttcggccgattcgtttcacccccctgcctttttcgctgatcaggcgtttgccttggggtttttccgcaaattatcaatcgcacaaacaaataaaaagaaggcagaggacacaaattttatactggttcgggcctccgtggtggataatagccctacatccagttttttttttgtcttttttcattttcctctttttttccttttttgttctcttttttttctctttttttttcttgccgaaaggcttacatagtgccgaagggcttgcatagtgtcgaagggcttacataacgatatatacatttttacaagttggcgatttgggtgccacccgttctagacatagaaacgcttgagagaggcagcgttccaggaatggtcgaactcttcgccttccagtgtcgccagtcgaaaggatcccgtcctggatttgtacttgatgaggtacggtccttcccacttcgattcaagcttgccaacggctattgggttcgcttttttccttaggacaagatgaccaggcaacaactccgtcggtcgaacttttttgttgtaagttgccgaagtgcccgtggcatacttttgcatgtgctcgagtgctttgactcttaccccctccaagagttcgagcgacaactcgcgcccctcttcgcccccagagaacgtcacccttggtgagttagcccctagctctgttggggtcattgcctcatcgccatagagaagcatgaacgggctgaacttgattggtcttgtgggggtcgtccgaagggcctagagaacagatagcatttcctctggccatttgcccttcactgccccctcaagccttttctttagtgcttctaggattttaccatttgtacgttcggccgctccgtttgactgccggtgcgcgaccgatgcgaacctgatttccaggttaagcccttcgcacatttctctgaacatgtcagagtcgaattgcttgccgttgtcagtgatgaactcttttggcactccaaaacggcaaacaatgtttttccatacaaatttctgtactgctgccgaagtgatcgcaccaaggggttcggcctcaatccatcgagagaagtattcaacggccacaattgcgaacttgtgccagttttgcgccgccgggaacggcccaataatgtccagtccccatctagcgaagagccaaattggtgcgatgggctataactcatactggggcgcggtttggcttcggccatgacgctggcaactttcgcacttcttgatttgctcaacacatactttcaacacagtgggccagtaaactccttgtctaaatactttggaggcaactgttcttgcggcttggtgcgcgccccatagcccctggtgtatttccttcgccatttcctcgccttcggtgaaagaaatacaacgaagcaacggttgaagtatcccggagcgatagagctggcccgagaccatcttatacttcgtggctctgaattgcaaacgctttgcctctgcttcgtctaccggaagccagccagtttcaaggtgcttcacaaacggggttcgccagtcgtatgggtcttcgcccaatttgacctggtagatttccaggacctccaagctgtccatgggcacgcttggtgcatacaggacctcaaaaaggatgctaggcgaatgtgggccaccacaagcggcagatttcgccagggcgtctacttcctcgttctggcctctaggtaaatgtttgaccgttatgccggtgaagcacttttccatagaccgaacggcatccaaataccttttcatcccttcttttgcctcaaaagacttgtcgacatggcccaccaccagcttggagacggttcggattagcaggcgccgaatccccaatgctttcgcctttcttaggcccaaaagaatggcttcgtattctgccgcattgttggttgtgtcgaactgtagccttgcagcataccgaattggcacaccatttggcaaagtgagtactgccgcaacgcccgcccccttgtgcgaccacgaaccgtcggagtacatcacccagggctgttcgatgggctcgggttcaggggcgaatgctggtgtccattcggccacaaagtcggctagcacttgggacttgacagcagtgcgggcaacaaaatgtaagtcgaaaggggatagctctgcttcccacttgctaagccggccagtaacttctttatcccgtattatttcgcccaaagggtactgtgatggcactatgactttgtgggcctaaaagtaatgcttaagcttgcgtgaagccatcaccagggcgtaagcgagcttttccatttcaatgtatcttgtcttcgctccttgcaatgcttcggagacgacatagaccggtttttggcctgaatctgtttcttggacgagagcagcactgactgccattggcgaagctgccaggtatagtagcagtttgcttcctgatgctgggctgatcagagctggcgggctttgcaggtattgttttagctcgtcgaacgctgcttggcattcgggagtccagttgaattttcccgcaccccggagggttttgaagaagggcaaacctctatcggctgcctttgagaggaatcaactgagtgccgcaattcggcccgcgagcttttgtacttcacatacgctcgacggaggcttcatttgctgaatggtatcgattttcttgggattcgcctcgatgcctctttcagaaacaaggaaacccaacagcttgcctgcgcgaacgccgaaaacacacttctcgggattcagtttcatacccgctgcgcgcaagttgtcgaaggtctcctgtaggtcggacgcgtggtcgaaagccttgctgctttttaggacgatgtcgtcgacataagcttccacatttcgccccaactgcttgtaaaggaccttgtacaccagcctggcgaaggttgctccggcattcctcagaccgaaaggcatcctgaggtgacaaaaggtgccgaatggtgtgatgaaggctgtcttggggatgtcggccgggttcatgcgaatctgatgatagccggaatatgcatctaggaagctcatgagttcgcagtcggctgtcgaatccacgagctggtcgatccgtggcaagaggaaatcatccttcggacatgctttgtttaagtctgtgaaatcgacacacatgcgccatttgccatttgacttccgcaccagcactggattcgccagccactcaggatgatcgatctctcgaatgacgcctgccttgagcaatttttggacttcggcttttgctgcctcctggcgatcagcgggcatcttgcgtagcttctgtttccttggcttggcatctggcttgactgccaggtgatgcatgatgagatctttaggatgttcttagcttcttcttcgcccatgtcgccccccagtgatacgagctttgtggggtcggcatcatcaatctgcatcttgactatcttgccgtgagggacgggctttggcgcgtgcttcgcccggtcatgcggttcggcctcaacattatgcactattctgttgattatggccaaatcaccttttgaagcagccgaaggctgaagccccttgaccacgatcactcctgccgggccgggcatcttagcttgagataattatgatgggaaatggcttcgaacttgttcaaggttgcatggccgaagatggcgttgtagttgtatgggatgtcgacaatgtcaaacaatacttgctcttcgcgtctgttttcccccgcgccgaaggctactatcaactgtgcttggccaagaacttgaactgcttctccgccgaatcctcggagcgatgtcggtgctagggtaagggcttggatagtcaatcccatcttggcatatgcttcggcaaagatgacatcggccgaacttcctccgtcgaccaggattcgccggacctcgaaaccagctatctcggctaagatcaccagaggatcttgatgcgggaacattactccttcggcatcttctggcccaaaaaagatttgctggttcagatactgcggagccccttcgcctgtcgaagtgatattgtggaccgttcgcaaatgcatcttcttttgtcgcttcgacagttggatcggcgggtcggcccttgtaatcacttggatcactctgcgttgcgcatcttggcgttgttcggctgggggtgcttgttcttgagctacttcacgagttgcttcggtcgctgctccctgctgcgtccttggatcttgcgcattgccacgtttctgaatgtttcggcattgctccgtggtacacgaagagcgtccgtggaaggcgcagtagaggttttttcggaccttcttgcggacaggctactaatggttgcttgcttgctgagcgttgaactctttgcggagggcttgcacttcttcgacagccatcacagccttgcccgcacggtcggttctgaacttcctccaggtcatgggggcttgaccttgccttggcggttgtgtttggatcgccggctggggctggtgaacaacgagaggaggtggttcgacaacttgaaattgttgttgggtttgagcagcggcgacggaagtcttatcgtactcagcttgtattgcttgccgtcgcttggaatcctcttcgccccttgtgaacccatcaatgatgcgaagtaggtgttcaagcgtttgcggctccttgttggcgatttttcttgagagttcgccctcgagtaaaccggccgaagcggcgtttatgactgatgcctcaattatgtcttgaacttggcagcgggcttgtgagaagcgacgcatgtactcccttatcgactcctccggcctctagcaaattgaaataccaagagcgtgcgatgccgtctagggtgagatgtattacctttgccttggtattttcgtcgccatgagccgcttcgatcgcggattcataaatggagaggaattcctttgggtcagtttcgcctaagtagcgtgggacgggtgggaacttgcactggggtgggattggacgggtcttgattcccccactcagcggtagccccttttcgccccctgccctgttcacggcaccttgctgcgggtacggcgtggcgaagggcgaaatcacggcttgtgcgtgaggttgggccatggcatccggctgcccggccccgattggtgatgcttgctgagccgccatgaatgggtcgaaagttggctgtgaccatgtcatggcgacctgatttggtgcttggtttgctctgaagcctggcgttggtgcttgcggccgaacggttggcgcctgagcagcattgatagagtcgaactgcggtccttgacttcacggcgaagcccacagacctggctgattcgaaggcaaccaactaggcgcaccttgacttgtattcccctccgggcgggccgaaggggctgtacttgaaatgttgtggggttggctgagctgctgaaggaaagcttggagctgcgcctgcagagccgaagccccttctgccattgttggtggcacttggccaggcggctgaggatgtacttgggcagtgaccagttgagcttgcagttgcacgtgagggaccggatacgctgctgcggtcaatggctgcccggcaaagtacatcggcgcttgcgcaacttgtggcggaaggggctgggtcggcacttgtggatagacttggggtgggacatagcctgctgaatactggaggattggtgccgaagcgaccttggaccgccttgccgcctcgtacgcttgctgctgttcttgcatttggcgaagcatgtcttggagtcgtgtcatgttctgtcgcatggcttccatgtcggcttcggtttgtgtctcggggtcagggttgacttgggcttgcacagcggcgagcgcagtttgggccgctgccggctgcgacggagcagcttggggcaccagtagttggcttgtcgaaaggatctccgccctggtctggagtgccctcgtcgccgcagccgccctcgccatgtcagccgcgttcggcacctgcacagaggtagcaggggccgaaggcggtagtgatggcgcaggtgcggaagcagatgacgctcctccatcttcggcaacaggcgccgaaggctctgctccctcttcggcggccatatccgcccctgtgtcgctttcctttcgccttgtaaccttctcctttacgaccttcttcggtggcattcgctcttagtggtttcgctcggaggtccccacggtcagcgccagctgttgtcgaaacgcaattgcatacgtcgaaagacgtggttactcaacagtggttgaaagagcagggctgtaaatggaggtttcatgcctctacaagtaagaaatactatggctgcaaggtaaatttgtgctgaaatgttcagttaattattttatcatttcatggttaaatttgatgcataaaaagctgataattacattgttatatgtgcaggtcaaggtaaataggcctgcccacagttgttgttccataaataagactggggctgccatggcaacaaatagctgggttgctgaaagagttatagattggctgaaggagattccaactctaggagctagtgcattgaaggtcaagctagagaagaagtacaaatttacaataggatatgacaaagtttttagaggcaaagagaaggcccttgagaagatatttgggaagtgggaagacagctttgcattgctgcccacttttagagaggagcttttgaaggcacaacctggaagtattgtcgatattgataccgagattcatgaagaccaagtatgcttcaggcggctgttcatagctctaaaaccttgcattgatggattcctacaaggttgtaggccatatattgcaatggactcaacacacttgacagggaagcatagaggacagctggcagctgctgttgcaatagatggaaacaactggctttttcctgttgcatttggtgtgatagaagctaagacgacggagagttggacatggttcgtgcagaacttgaagaatgctattggtaatcctcctgggctagccatcagcacagatgctgggaaaggactagagagagctgttagtgatgtctatccaactgctgagcaccgggagtgcatgcgacacctgtggaagaacttcaagaagcagtaccatggaccactttttggtgaaaacatgtggcatgctgctaagtgctacaccagccagcagtacaactatcacatgaacaagattgctgagaaatctcctgaagctattgcatatttaaaaaccaatcacccatttttttggagtaggagcaaattctcagagctttcaaaggtggactacatcaacaacaatctttctgagtcattcaacaattgggtgatgaagatcaaggaattacacatagtggacttatttgacacacttaggcaaatgataattgacaaatttcacttgagccaacttgcaagcaaaatggaaggaagaataattccatctattattaagacactgaatgaacagagcaagaatctaaaagattacaatgtggtaaggagtaattgcgatgatttagctgaagtttctatggtgtccaacaagggagtggtatggaggcatgcagtgaacctgaaggctcatacatgctcttgtagagcctggcaagtaagtgggaaaccttgtaaccatgcattggcattcataggctctctaaggttttctgacatgaatggctatgtggatgagtgttattcagtgcaaagattgaggcaaacatatgctgggatatggaacccaatgacatcaaagaatatgtggacatttgtagatcctggtttcaaattgatgaggccaaagttgaggagaaagcctggaaggcctaggacacataggattaaagcttcagatgagcctggctgtagaaagaagaggacatgccctgaatgtggtgacaaaggccactttgcaaagacatgtcagggaggacctatagctagcaaaagttacttgtcatccatttttttccctttcatttgtaaattggctgctcactctagattttatacaggaaaaggtcatcttcatcaacaccatcctcagatcaaggaagcaatactcctggtgcagcacctaggtcaaagaaaaaattactactggatcatccatgtaattagtatttcttactagttaattccatcctcatttgcaatctatttgcatcttgtattcagatttaggtactaacttatagaattgttgttacagtggcaatgcaaatgatgtgtcaacaagaccaccaagagcaagagagaaggggaaggagaagaaagggtttgttgcggcatccatttgatgcggttgtcttttgggaaggttctaatggtctggaccatgttgtcctatcaaattgatatgatgtagaacactgctatcagatgtagttgtcttttggatgtgaggatgaatcatatgatgtaaacctctaactgtgttggttgaattagtcatatgtagttgtcttttggatgtgaggatgaatcatatgatgtgaacctcaactattgtcatttaatttgtttatgttactgtgttcatgccagaatgacgctagttgactatgttctcttgcttgttgtctcaaatggtgttttattgatgccaaaatgctgtcaatattacaatttcatgggcaggggcattcttgtcctaattttcatgaaaatcagccatataacggtgttagtctaagctgtgagtccagtggcagttatgttgggttcaaagttcaaactgtttttaatggcaaatttgcaattacatttttttatgggtagatccacaatacctgttcaatccagtggcaaatatgcaattgaccccttttgttaacaccactccttgacgtagataccaaaaaagatatttactttaagaggcattttaaactttcaaatagttttgttaatattgggagctttcgtatgagccaaagcaagataatgagatttaatcgagaatctttcatctagtgttaaattatatttaaaatcatcttgctcacgtgacaaaactatattataggatcttgtcttcaagattttgaaaatctcggcattcgcccactcctcgtgaccattgctgcttgggtgagtagagtaagcaaagcagagcagcttgatcccgaggtcaggtcccggcaatatttgctaaacaaggaaatggtggattgcacccctttgttagtgattattcgattcgggccaccaaaacgacatgtgatgccgtggatgaacttgaccgtgccgtgtactgcttataactttaatgctccgaattaccttgaaccactttgatgaacttgttgatggcgacctagaggtgttcgtatccttcatctgctcattgaagagcccaaggatatccagttctcagattgcaaacaaccattttgttgcaaaataattaggcaataaatacgtgcacgtgttaagttaagtttagtaagataataatagtctcatgataatacagatcgttggaagttagatcgtaaagaattcatagatgtgtttctgggactcagatatggaatataaatgaattttcatttaattgcatcaacctgaatttataatcagcctcaaatattcggaattcatattgggcgggtgaatcgctactccatccacccagcgatcaccccccccccccttctctctcctatactatatactcctccctcctctcccccttcctcctacccttcttctctttctactacagtacaccccacaaatttttttaaaaaacaaaagttagaaaaatttatgtataaaaatactatatataaaaaatttgaattcaaattcaaatttgaatcgggtatgtaaacttttgacttgtaaactttgtatctataaattttaggtgtataaactttagatgtatagaaatactatatatagaaaatatttggattcaaattcaatttgaatataattcaaattcaatttgaatataattcaaatttaaatttgaatcgggtatataaactttaggtctataaactttagatgtatagaaatactatatatgaaaaatatttgaattcaaattcaaatttgaatcggatatttgaattcaaattcaaatttaaatcggatataattcaaatttaaatttgaatcggatatataaacttttgacttataaactttaggtatataaactttaggtgtataaactttagatgtatagaaatactatataaaaaaatatttgaattcaaattcaaatttgaatcggatatataaacttttgacttataaacttttggtctctaaactttagatgtgtaaatttgaggtgtataaactttagatgcataaatttattaaaataggaaagtaatgcggtgccaaaaaaaaaaccaggtggagggagggaggggggctacaggtatggcgatcgatcgcccattagaactaccctcgaatattactcctacatcaagtggcaaaaaaaggttactgacaaaagcaaagtcgctgggaattactcctctacggcactacccctatatggcggccgcctccctccggctggccacctagctatcaatttccaccgccgcgtcgccgcccactaaccgctgaccatcacactgcggcggcggtggcggcggcgacggcgacggtgcaggctgcagcagctgctccgtcgccggcagcatcacggcttctagtggataggtgcgcgtgtgggccttagtcgccttcttgacggcgatggcgaggacggccaggaaggcgatcggcagcgccatgatcaacgttcaccggcaggccgctatcgatcgatctatcggtcgaattctccggcggtggtcgtgagcgcgggcatggtgagttagttggttaccggcgtggtggaagatatagaggccggccggcgtgatggagtccggctcggagttggcaggcacagccacgtacacttcgatttgctgcgtactcgcatcggcatcggagtaacgacgaggaatccagtaatccgagtccgtgaaagaaagcagtggatttttgttcttgtgctgttatagttaatttgtaaaaatatttgtattttgaaacctttcataaatccgttgtagtctagctggttaggatactcggctctcacccgagagacccgggttcgagtcccggcaacggaaatttttttatgttgttttgtttttccataagtactaaaactgtagaagtgcccggctgctggacattggccatcggtccacggaaatggctaatcagcgatcgctcgcgtgcgggagcatcacgcgatcagtgcaaatccatttttcggcccacttgagtgctgagaatgcttagttgctttattgctcaagatttttacacagctgatgttagcgattgtttagacctttatttatgtataaaaatactatatataaaaaatatttgaatttaaattcaaatttgaaacgggtatgtgaacttttgacttataaactttgggtctataaactaatatttgaattcaaattcaaatttgaatcgggtatgcaaacttttgacttataaactttggatctataaactttagaggtatagaaatactatatataaaaaaatatttgaatacaaattcaaatttgaatcgggtatgtaaacttttgatttataaactttgggtgtataaactttagatgtatagaaatactatatataaaaaatatttgaattcaaatttaaatttgagtcgaatatataaacttttgatttataaattttagatctctcaacttcagatgtgtaaatttgaggtgtacaaactttaggtgtataaatttactaaaataggaaagtaatgcggtgccaaaaaaggaaaccatgtgggggagaggagaggagaggagaggggaggggaggggaatgtgg

SEQ ID NO: 74139 - DNA, 12811 bp, Oryza sativa
  unsure (1)..(12811): unsure at all n locations
ctattttagtaaatttatgcacctaaagtttgtacacctcaagtttacacatctccacaattgttttaaaaaaacaaaaagttagaaaaatttatgtatagaaatactataaaaaaatttgaattcaaattcaaatttgaatcgagtatgtaaagttttgacttataaactttgggtctataaactttaggtttatatactttagatgtatagaaatactatatatagaaaatatttgaattcaaattcaaatttgaatcggatataattcaaattcaaatttgaaacgggtctataaacttgaggtgtataaactttagatgtatagaaataatatatatagaaaatatttgaattcaaatttaaatttgaatcggatataactcaaattcaaatttgaaatgggtatataaactttatgtctataaattttaggtgtataaactttagatgtatagaaatactatatataaaaaatatatgaattcaaattcaaatttgaatcggatataaaaacttttgacttatgaacttttggtctataaactttagatgtgtaaacttgaggtgtataaactttaggtgcataaatttactaaaatagaaaagtaatgcggtgccaaaaaagaaaaccaggtggagggagagagggggaagggggatcgatcgctacccccatcgtcaggcgatcgatcgcccattaggcgtacctgaggaggggtagggggggcgacctgattgtgggtcacaagatctcgcgatcaatcgcgaactaggtcaaccctctatccacatgggagtatagtagtgcacgagacatcaatagcaattagtaccttgatcatattttttttctaccttgcccatttgagtgacatccaggcttttacaaagaaagtcggtgacatcttttcttttctttttttttatctgaagtcggtgatattttagtttgtcttgatggtggaggcatagaactgaaaaagaaaacgctcaagtcgttcatttcagctatacttcacccccactcaattataccgcgtttataagatataagggtgtggtcaattcatttaaagaaaagatacaaggatgtggttaactcgagatgagcatccaagagtaagccggtctaacatcccattaactcgaaagagctaattggcgacctgttgcgcgcgctctccctcgtgcgactgaacatgtgtcgcgtgcggaggggggcggcggactgcgcccgcgctctttttcggtttttctgttttggttttttttctcttccgttttttcggttctttttctgttttggtttattttcggtttctcttcccttttttttgggttcctttctgttttggtttttcccttttttctctctttcttttttcggttttttaagatgtacgtatgcaaagtttatatttgtatgtatactaaattttatatttgtacacatacaaagtttgtattcgtgtttttttctcttagtttttaatatatacctatacaaagtttgtatacgcgtattcaaagtttgtatacacgtatacaaaatttatatacatgtatatttttatataaaattatatatacgtatatatatactctgtatacacatgtataaactttatattttatcagtacaaagtttatatatgtgtatacaaagtatatatacacataatagtattgttgtagtagtactactagtgtagcagcagcagcagcagcgcgctagtagtagtagcaggagcagagcagcagcagtagtaggagcagtaggagtaggagtagtgctactactaaaagagcagtagcagcagcagcagtagagacggactggtcgcgcgcccacgctcccgcacaaccagtcactcattaggggcggccccattaactctccctataacacaaccaaactattctttgtaagaaatttgattcataaatatgtggcaatcacagatatctgagacatcccagtaaacatatagccatataaatggtgacagaaaaacatgccgattattacatgtttccatacggaaactttctgctcgcaagaatctaatgcatacatctgttttgaagaatacaatctaatgcatacatttacaggctctctctttccagggtatattcccaatcccacacaagtcaaaaacattctcaagtttcaagtacatcgagcatcatttttcaagagccatcaagcatcatagattggactaaagttcctcgaatccgtcttcatcggcatcatcctctattctttcaaaatgcatccggaagctctccatctatcaagccagagatcaaataaacaaaattgcactataagatctcaactaattgagggttcatggctatatgattaacaatggggcgcatcaacaaatatgagcaactgtggactagcaaatgataattgttttagtaaatcatacaccagaggtatctttctctgaaggacattaataagactccaacaccaataacaactgattaccttaaatttaaggtgtagtaatagataaattacttgcaaaactctcatgggaaaattgtaagtaatgaaggacctcgatgaacaaaatcagacagttgagaggctcatatcaacaaaaccaaatgtagaaggctaaacgttacatatgaacagttgaagctttaaagggcttacatcaaaagattttgactttgggcaatttattataagtgaaatagttgggtgcttacacattagttttggcaaaagaagaaaaataaaatcatacatgtactgtcagtagaatattaccaatatgcactgaatcaattaaggtgtgcttttaacagctagattttctttatataaacctggaaagtttcttcaatatgtaacttgacaatttattcagaacaaaattaaattaagggttacaaaaaaagctaagagtactctataagtgatgaaaataacaaatgcagatgttcctacctcctacataacatgggaaaggtgattggttggctgatttgcaatttctgagtcaaagttttgtatggatgtttcatgaagttcaccgctctaactcgtgtgtcatgtttttcttcatgagggcccaccaacctcgttttccgaaaagaaaaaggaaaggaaaagaacaaactgatatcttggctcttcaatctctcaagatattgcaatcaaaaggttatgggcaatttccagatgtgagagtgatatttttttagagctcacgccaacccccagaatcattgaagttagaatccatgtcgaaggaatagagttggtttcattacctgagcatctgagaaacgcagctgttctgcaataaaaatagctctaccatgtatttccggtggagagtctagacctaagccaacatcctttgccacttcttcatagtgaacaaagctgacacgaaaaccctgagtaaagaaaaggttttccagcctgtcttgctctgaggcctgtgcaatgtagaagggaactgttacttgatgagccaaattaaaataatatatgcaaattttctagtatgtacttagccaaccatgtctgttgctgctccccactgcgtaaaacgtggcacctcccctataaagatactccctttcattgctaaattgccaatgacaagcaaaaggtcctccaagcttttaaaagtgaacaaaggtaaaccctgcaatgccagaacaaattcatgacacaaaaatacaaaatgcagttagctttcctatttgagtgatgccataaggacttggatgtactcaaatggatggcaaaaaataacatcagtgcacattttagtgtcagcatacaaaaccaggtagctagtcaagctaaagcaaataaaactccatcaagccataggagaaaaaaaaaattatcgtctactctagagagatatatagcacagaccccctttgcactcttccactcacatttcctctcttgcagatcaaatttatcaatgacatgcgctgcataatctaccaaaagagtgtggaatttcccccatccataacaataacatatatttatccatcatcatgttaaatcattcaaatgcaatatcactttatgacctactcatcccatcatctgattagtttcatgtgtacaatgcaaaataagttataaaccatgaaacattaatattggcctacttcaaatactgtccactagctggtgccaataagctcatgaacaccaggtatcataagaggtactggaattgccctctcagcagagctaagggttctgtaattgctgttaaaatagctaattgtgaatatacatagcaagtcagtaaacaccaggtttaacaaaaccatactttcagaanattctccaaccttggcatgatacctcactaattaaaaccagaaccaagagacaaaaccagataggggcagtttccagttcttcctaaaatactcaggaagacctgctcattttgcctgttgaaatattgtttttcttttgcaagaatgctgctttctggttaatttccaatctaacatattagtacctttttcctatgtttctgaaaacctaacatttcaccctgctgtgtggatattcagtgtaaaacaacagagaaataactcgattccagaacttactgcagcaccctgagccaaccctaaaacaagacactacacagttcctaccagtttgcaaccatttctgaacacatggatgcaatggctggtatgaacatgtagaaagtgataattttgcataatatgtcacaaccaatatgctggtgatttacatattaacgggagcaccaggagtttttaagttaggtgcatatgtaagtgttgctttgcataaaaagagtgccctttattggttttgaggatttgtgctagcacataatccttaaatctaaaaacacatcaattgatttaattcttgtaagttgattttgcttatttgatcaataacacttgaaaaaaaaaacaaatgtagctccactgccctgctgcagcattattgcactagagctaccaatgttaagtgtatttttgttttatatttattctagcctagggtttgggtatgtccttgagtccttgtactccaaaacctagactagagtgcagtatttgattaattgcaaaggggaatataacaataaatttaatgattagtatcgaaattttgtgcggaaggacatagtggagtaagttacctgcagtacccacaagctcggcctattcccattgaagccatttttattcaagcccgcttgcaagtcaggagactctgaagaagtatgaagtacaacacagttccgtgatatttttgctccggctcctatcatatcacaagattttttttttttaaaaaagaaaaggttagctaactacatacgtgtttgctacggatgaaaatgaatcatacatattttatctataatactattgaaacgaaataaatgatgattcttgcatcaaacatgtccttcacttttttgagttacaagaatcattccaaagtatattaaattttgatttttttagaagaaagaagcatatagaaggtctactatgtaacaaccaaagaaattcagagagcaactcataaaagtacagtgtgcaggttgtgtgttggcagattcactaacaccattaccttgttttcaaagaagtatagatgtacatcaaaaactcatgtacatctatacttcttttttcattaaaaaagaagtatagatgtacatgagtttgtggcaacccttgaatcatcagatttcttttgagaaatgtaaaagatagatagcatggggggctctaattgctatatcattgctattgtaatgtgcttatacagcttggccagccaggtgacacacacagtagcagatgttcccacagaacttgaacaaacaacggctggctgagtaacatagaggataagttacttatcttggttcacccacccaaaagggaaaaaaaaaaaacaagagtttattatcatggttggcagcagagtacccttaactttaagttaggactaaatcttcagaacatgtaaagcttagtttgagttgttagggccagcccaatacaaggcaaaccgaagatttattggagacaagcaatgaataaaaattatgtttttttccaatgcccctctccctcctttatgtctctccccctatgatcagatcaccagatgttgcatatttctcccatgctaaggtttcatacagctattatccatttatcctcctctgtacaaaatacacatggagcagtagagaagaataaaagataaatgaatcaaggataaatattgcctttaatctcaattgagagatcttgctgtttcagatttctggatagtcagaactcgcatgttagtccctcaaaagaaaaaggacttgcatcttacaaatgacagtcgaaaatgcaccagttccttaaaaacaatttgtgatagcataaaacatgactatacctctgagttgctgtgatgcagtaatgaagactcttctaggtgatacatcatacacaacagacaaccttggccagcttagcctgtaaggacgagtgtccattccatctgtcaacagaacaatctattaggaataagccagcaaattctccacagattatgcggacagattcatcgtaacaagttaaatttcagtacctgtctaagatcatctgaattgcttatgaaatgttgcaatttgtcatcaatatatctggtcactagcctataatgttctgcacttggcattaaatgtaaagctagaagatctttatcttcacttgccacatcaagtgaaagtagaacagctgcatatgggtcaataaaaagaggatctgcaacaaaaataatactgagaaacattagaattttgatatacaatcatatatagccatgtgtggccttctcctaaaaaatcagatgatactctacagggattatcatctgaattctgaactttgcgaagaaagagcaattcatgattcaaagttctaaacaactgcgttaaatctgtctcatgtgggactgagacaaaactctgttctagttaattcagaaaaataaatgaacaagcaactaaagcacgtcactgtaaaaacatgtaatttgcataaaaagtttgtatatggtgctgaaatagtactaatgtcatactttaataaataaagatttccaatattaggtaatcaatatgcacattgctgttggtttttttttaaaaaaagtgcacgctgcttaagattggcagacttgaaaacaggtgttaccaaataatttacaacaactaatctataagcacattgctgttgaaattatgactttgcatgcgccgccggggggggggggggggggtaacaaaaccattcccctcaattcgtcgaacaggtagcgcgcactgccagttccgacggaatcggcggcacaagcaaaagatgagcagcagcaaagccagcaacacaaaagatgcaccccccatcgctgacctgggcggcgggactcctcgtcgcggaatcgtgcggcccggagcgcgccgtcgaggagcgtgtcgcgctcctcctcgggctcagggagcgaacccccgaggggggtgtcagcggcggtggcgaatggcccccgcggcgggagcccgctcttcgcgcagttgctccagggagggaaggaagaggccggcagtcggagcagggcacgcggagtagcggggagcggcggcgaccggcgcacgggcgtcgtcgccgccgccgcgagccatggcaggacgggcatgtgtgtggacagttgctctccatcggtgtttcgctgccttcccctctatccagtatgcgcgatgtttacgcctccgtgaaggggaaacgtacttctgtgctttgtaaaggcgcattttactacaacgtgtataagcggaggggcacataccatgaaagtttattcgaacatcacaggtatcaaaacgtgtaagctcaagaactttactagtactactctctgtccggtcatcaaaacgcgatgtttttaacattaaaatttgaaacaagaccaaaaccactatttactactccctccgtcccaaaatatagcaatattgtatcgtgtaaaatatcacacgatacaatgttgctatattttgggatggagggagtactcttggtactacttagaaatttcgatagatgatgacacggtgatgtacggtaacggtttattaggttgggaggaattcacccaataagaatacaaaatataaaggtcctaaaaattaataagatcctcagaaaacagttacctgatcaatgggggcattgccaagtgccaaccaagatattttagtacaccgaaataaatataattcatacggaaaatagttttcaaaatatggatgaaactattttttatcgaacaactattacaatagtttctatatgcctaatttgattaggtttcaaaaactccatactactccttccgccccaaaagaaaaaaaaaacctagaattagatgtggtgtagtctagtacaatgaatctgaacaatctcctatccagatttattgttttaggatatgttacatccaattctagatgtgtactccctccgtcctaaaatataagcatttttagcatagtgttaagtcgatcatttttaactttgactattaataacaaaaaaaaataaaaagatcaattatgtaaaattgatgttactagatttattattaaacaaattatcataatatgcaagtctttttatttaaaatatcttatttttatagatattattggtcaaattagcatctcgaagactgtatcgaagtctaaaaatgcttatattttgggacgaatggaatattttatgggacagagggagtgtgcaattgcaactttttccaaattgtttaaagtaatttagcaacttaacaaagtcaaatacatatatgcagttgaatattcagatttaggaatgaaaaaagtttcaaaaaaatatgcacattataggattataacctagataaattttgtctcaatcagaatacaagtacttgttttcataaaagtttatttgtttatgagcttgctggggtaatttactaattttcaaaattcaaaactatttttagcataatgcaacactaccatgccaacgccgatgtcataattagaatcaccctatgtttgagccaagtttgaacaccgagaaaaatcagatgaaaaaaaaaaggagtcatggagctagcacttagaacagatataatttcatcaaagaaaaccaatacaacatataacaatattacaataataataaaaaaaatctccttttcccaaaaaaataaaataaaataaaaatctcccatttggggccacatgccatctctcctatatgggcctcatttcttgatccgaaataatcctcataaaccatactaatatttttccccttttccccatacaccattgtaataattatgtcaatggattttctacgtaggcttaatgatcaacccatcataatcttcgctagtgtcaacggattattcaaagaagactggagaaaaagaaatggtgatatgaagaaggaaaaatctgtgtagccatgcatgcgccgtacgtcgctcagtactcctcggaatccggtgcgctggcgccgggtcccggcgcgtcggcggagccggacgacgacggcgatggagacggcccttcggtggagccgtacgacgagggcccttcggcggggccggcggcgccggacggcgacggcccttcggcggggccagaggcggcgccggacgacgacggcccttcggcggggccagaggcggcgccgtacgacgacggtccagatgcagggccgccggcggtggggccgccggcggggctgccggcggggctgccggaggggctgccggaggggctgctggaggggctgccggaggggctgctggaggggctgctggatgggctgctggatgggctgccggaggagccgccgtagccggtgtcgtcggatgggctcgggcccggcgcgctggcggcggagcctgagccggagccgacgtcggagtcggactcggaaggcgccggcgcggcggcggcgctgctggattcatagccatagccgccgccgccgccgccggtggcgggcgggagggcgacgtcggcggacatggagccggaggcctcggtgatgaggtcgagcgtgacgcggaggagcttctcgaactcgaggctcttggtgacgacggcgttcttgatctcgctgatgggggcgtccttgcaggtgtcctcgcaggtggaggacccgccgagcgtggcggagagccaggccttgacctcgaggaacttggcgtcggtgagctcgcgggtgagcgcgctgaggtgcgccaccgcctcctcgatgtcgtcggagcagctgtccacgcacttgaacagggcgtcctccttcacgccgttcagctcgtggtgcgcgaacgccgccaccgccgtgcccacctccgccgccacgtacaccgacagctccgccagccgccgcgcgttcgccgtccggctctccgggttcgtcgtcagcgcctggatgcacaccttggggaacagcgtccggttgcacgcgtcctggaggttgtccgccgcgccggcgagcggcgccaccgagacgaggacggcgaggaacacggcggcaagctgggagcgagccatcgccatggtcgtcttcgtgtcgcggtggaccggatcgagctcgggagagatctctctcgctttttgtgttgtagtggttgaggcagaaatggggaggggttggatggggttttatactacgcttctcaccgctgcatgcatatggtgtccatgagtggtcagggacttgttctttccctgccctgcattagcatgggctgaccttggttttaggagaggggagtgtgccctgtgtgacaaatgttgcatttctatcttcctgtctcgttttggtgtttacttttagttccatttgtttttttttcaaaaaaaggtaattgtatttgttttggtcacaaatataagatcattggtgtcctctctattatatataccatcgatcgtcaccacttataaacaagatgtaaacagtgatttgcagtagaaattacagcgcgtctatggtttcccgtgacaccaatgcactggtctatgggttaactcaccagagtaatttattattttcatgtttatgttgtgaataaaaatgtaagcattcgtattgaaaatactctctccgtgcagaaatgtacaacatttgaggaactatacaaccaattttcttcttactttaccggtgatgtataaaagaacaatggtacaaatttttttatgaaatatctcccttctataatagtttgtttttattttcatatgcatataccatgaaatatatgggcgatcaatatatcaaaaccatgtattggcatagtacccatgtccagggcatcctactttcaaaaaaaaaaaggatggaccactattcagtattaccccgagccatatcctatatcctatagtcgatggttttgtgcatcttcataggttacatttccaattaaatataacaagcaaaaatcagaccaaaggcaaccatgggacttgtgtgacaaatgttgcatttggtgtttagtgttgcatttgttttggttgcagatctgtgtcaccgggttaatcccttggggcaattatttttcctgtatgttgctgttgttgtgaaaaaaaaatataagtagagaaccgatattgaaaatactgctaacacagaaatgtactccgtttactttttaaatttaatcaagtttattaaaaattaaatataacaccaattttgtattattaaatcgagcattggatagattttaataatatatttgttttatcttaaaaatgttaccattttttatgaacttattcaaacttaaaaagaaagtcaaaatactttatagtatgaaatgaagggagtatactaattgggataccatgaacccagttttcctcttaattttgaccctattaatttttcatgaaaagtttcattgatatagtagttgtcttctttttcatatccatattttgtaaaagaaatatagtggtcaatctgtcaaaatcgtgtactgtacacatgtcactccagaacatcctactttctaaaaaaagatggagtacgcttaagtggattctaatctctcgagggaataccccatcgtgtatatttttcttcaaatttaatgcaaatggttgttaagaaatctaaaaaacccaacacggtagagtatagtaaagagtatagtaatgtcttatcactccaccaaaatcatgcatcttactcaatatgtacgttgaaaaaaaaggagacaaattcgggatgaattgtactatctaattttcatatgttgaattttcctttttatttttcaatatgtgatttgtgtttagaattaagattttctggagatatctatatcgtatgaatgcttcctttttagttttgtgtgtgagtcttacaagaaaaagtccaagatgtgagctcttctcctccgaaagctaatttgctgacaatatagctaactaagcccatgcctattttgcaagaagagggagaagaagacgacgaccaaaaaagtcaagcatggaacagaagcttgcgtgtgatagttttacactttaatgggaagtaaaaagttcgaattaccccaaaaactactatatggccagtacgaatttatcctatgaacaacaaaactagacatccttcactctcaacttttcataccgacaaattatcctct

SEQ ID NO: 74140 - DNA, 4083 bp, Oryza sativa
cgcaacccctacctggcgcaccaattgtcgaaacaagatttcggcaatacaaaaagggggtggctatcaagcaggaaaagtggatgggtttggagacaaggaattttatacaggttcaggccttctcaatgtgaagtaataccctactcctgtccggggattgattcgccgagtgtgttatagatagtatgatctgggagaaaagttatgccccaagaggcacccggacccctccttatatagtgggaggaatccgtattacaaggtacagcccatattcctaacggaataggcaaataaagataaaatacaatcgtaaccgactagaaccccatgtatttccttgatacacaagtaaggaatttaacccgagtcccttaaaggtattatatctgtatatggtacccctatacctagtcggatatacatgttgtgtgggtatgggtatccataatctccacagtcgagcacgtgcttgggaaatatccatctcactttcacccctagtgctaacgaaaaatttgaagttgaagaaaaacggggccttggtcatagaaaaatttagcccgacggttgtccaagatgatgtctctaacataaacactgaagtataaagtgggacatggctttgggccaagtgcacttcttgtgctagctgagccaacctagtcaagataaaagaagggaccgagagggtatacatgtgaaaggaataagtctattttacctccctcatctcttgctcgtaattgaaacgcttccttcaaacatcgatttgtacccatttcgaaaataagggagttgtagttgagggatgtgattgtcacatcctgatttttgtttcaggatttataaattatttaataaattattattagaatttatattaaatgttcattaatttacaagtgaagttaaatgtgggaaataaaatttcctaaatataaagcatggatggatttaattttgattaaattctccatgattaattacactctctgaaattttctcagatgtttcggagctcaattcttaatttttaatcatacaaagagaatttcagtaattacccacatattaaattaatcattaaatggtctgtttttaatattgttaaatactttgggtgtccaagtatgttcaagatttttcttggaattatttgagcataggaagtatttttaacaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctatttgcctccctcgacactgtttatcttctacctctagcagccgaactgagaccgatttggctcggtttttctcctccaaatctgacctttccccttgtgtttttctaaaattagttgaggggaaatattcctcttatcctcctctatctttatccccaaaaatcggagctaatcgttgagtatcttatccgaatcgaactcgttttcgagtttatctccaaaatcgagtttttgatttcccggatcgatttcttgcgggaggagtccgatctcttcaatccaaggctataaataggaccccctagtcctcctctttcgtttgccccctctcccgtggtctcccgtgcctcatagcgccgccgccacgtgctccaccccgccgtcgtcgccggccgagctccatccgcgtcgcgccgccgcctccgtcgtcgtcgccggccgtcgtcgttcgtcgtttggttcgagggtgagtaccattgggttcgtctcgtcgtcctctacgtgttcttgtcctccaaagtcgcagccgaccatccaatctccggcgaggtcgccatcttggtccggccattgatgaggtcatcatcatgacgtcatcatcgttttttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttggttttgcgtgttagcttgtcgtttccgtcgttgcgaaggttcgtgagtgcgtcaggagtgttcagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattattttattcctggataccttgggttattataacttgactagttgggctttatatattggttcagctagatattagttatgattgcttagccatgcttagaaacattatcacataattgggataactaatgttacactatcacttatgattatatttaatggtagctcacgatggttaatcgtgttatgataattaattgataactaaaacttgacaatggtgggttgtgagcacatggttttgaaggtcgtgctcatgcaattaaggaccggttcacgagctactgttgtgaaacattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagttgtgttgtgcaaagggtattgtcacagcctctattcgggtactttccagtatcgcgacgcatggtagacatgatgatgaggctgtgtcttgtgggtacagtggtacacctctggccagagtaaaactattcgaatagccgtgcccgcggtcatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgcttttgcaaatgagcctatattatgtcatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagaccgtaattccgctgcagttttcttttcttttgaaagtatgtaacactattattgatgattctgtatattaaattgtcagtttgtgtacctcggctgattcctggacgaggattttatgcataaataagttcggaaattactagtgaatttctgggcgtgacagtgatttaatcagaagcaagaaatgagagagaaaatatagacttattcccacatgtgatgtggaagaagagagagtgaaatatgggctgggttgctccaaagttcagcccaacattgatgtgttttttttggaataggttcacatcaggtccctaaaccaagttgtcgccgagtctaaaatttgtcctaaaccgcaataccaaatatgacacatccctcagctttcaaaaccagtgcaaataaggtgccaaggcggtttgggtggtggtttcagctgacatggcacctatgtggcattgatgtggcacttaagtaaaaaaatgtgggacccgcatgtaagtgactgttcggttaaaataaataaaatattacagtgggaccctgtcacaccctgaagttctcctcccaagcctaaaattttatttaataatgaccctaagaaaatgccggtgtacatcaa

SEQ ID NO: 74141 - DNA, 785 bp, Oryza sativa
ggcccattttccttcctgctctccactccgctgggccggccgaaggccaaagcccagttaggccggccgcctccctcctcccacccgggatgccgacaggtgggccccacctgtcgggctcgtctcctacctcgcgcccgcaccgccgtaaccgcaaccgccgccgcgcccacgccaccgcctcctccgggccacgtcggtcacgcccgcgcatgcgccgcacctcccgcgcccactcccctctctctcccgcccgcgcccgcgcccgagatggccgggattcgatttttcgaatcccgcctctctctcttctctcccactcccccacgttggccggcggaatctcgcccctaccggccacgtccgagccgagccgggtcgccgccgcccgtccgatcagccccgggggtgatctgggccgttggtcccgtggaccggcggtggaccacccgcgtggtcccggtccacggtggaccgcccccccttgagccgctgccgagtggggcccgcgtgccggcgccccttttccctctctcccgagccgctgaccggtggaccccgcatgtcggcgccgcactcccttgatgacgtcagccctgggaattattgcgcaataaattatttaaggtctttttgttatagtaataaacacagtgaatcttctaaaattcataactaattcatccgagctccgtttaagcccattcaagtctcagtaaatcaagaaaaatgcgtagaatccattaaaaatggttttttttctgtttcagtagttttgtagcctg

SEQ ID NO: 74142 - DNA, 2423 bp, Oryza sativa
  unsure (1)..(2423): unsure at all n locations
attttagatggataggtagtgagctgtccttgtgagactgagcaacaaaattatcccttgtatatgagcaacaactatagaaatttcgaaaagataaattactgagtgctaagaagcctgcacaaacaagaaggaattatccatgttttatttggcattgcatgtctgcaccagcataaaactatcattgatccttttcacttgttagtcatgatccagcattccagttgctaaggacttacaattagctgataagaaaacatgacaaagccatactattggatcacacgttcaacacataacccgtgttaaccaaacaaatcaagattgactcacttctatgaaaacattatattaacgcaaattatctcaaccaaaaagaaggaatagaaacaaccagtaatctctttgatgcatagtagacaacatcagatgccatggtgtcctcctgatggatttgcttcgacagcctaaacgtttttcctgcatttttttaacctaaaaagaaaagttagataagttcgctagatatgaaaaagtgacatgaattgtgatagttaatctacatattgactaagtttgctaaacatttcagaatctagaacacaccatgtatatttaaggtaacatagttgattaactatagaacatctacaaatagtgcaattcatgcaatagtgttctatgtaaaaatatatggaacatgatcctgacctcagattgtaagtacagaacctctatgctctcattgcaagtgcaagcagctaaccaacatattaccgtttttgctttgagtatcttgtaatgaacgtgtgatacaatgcaattacctgctacaagttggaagtcatgatccaatttcaaagaactgtcattgattgataaaatatgtgacaaacggaatacaaaacatgcattgaggtgtaaaaatcaatttgagaagtagaccattagcaatatatggatttgagatctatcacacaaatatgaatgtggtacttgttattatttagtttattacgactttgtaaatgaaggaaaatatggtgtgtattatctgtatttgcatacgattatgatgtagagcatcntctgttgtttattgaagtaggtagaggcaagcagatgatttttttttgaaacacggcaagcagatgattgactcgaatacttctagccacacaagtcaaatagctcccacctgacaatatcggtggattatttggagcaacaaataacatcagttctaaaacctgaaaccaaaataaaaaaattctgctactgctgctaacatgtggcattagtttagtcaaaataaaaagattagccactaagtgtgattggaattttggcactacaaaatcaaacaatgattctttgacaacttattgcttgtattattaagaacctttgataccatcaattttcaatctgttgcagttcctgctacagtatgcaacaaagtttctccaagccaagagtttcagcctagaagaaatcatatatatatatatatatatatatatatatatatatatatatatatatatatatatatatatcaatctgaccaggaaaacacatttttttactactgaaatgatttaccaggttggccaaaggattaggcctaccaaatttattaagatttagggagaaacaaagtacaaagtactatgatgtcgaacaaaggtatgaggcaaagcatcagaccacaataaacaactaacactaataaataatcactgcaggataaaaaatgctagccgacttccaaatcgtgatctccttgatgtctccaaataattgctctgtaggtcaagacctctgctcaaatacccaagtgttccgtctttccagatcaaccaacagatcatcatgaatagcaagaatcgaaattatgcagttcactatataaacatttggtctttgccatgaagaagaggttgtaagccgatgagaaagtaaactggccatcacctgttagctagcaccgaatggagtcggggctattcctggttgaagctgcaccatctaaatttcatcccacaactgaaagaactcagccattgctctgttggacaaggaactctgtaggtctctcacccatcagtgattcaccaaagcctgtgccagcatcaattggatctgcctacatatgatagaaattagtgttagtgctatagccacgtgctgcaccgtggttggaaaaattgcttgacctttctgttccaagcttggcatgccattttagccatagtgcttggccaaagaagtctaaatccagagttgatctgttatagagtgagcgataattaattgagcaagaaagagcctgcagagaatctactacagagttcatcagtgtatgcaaagaaattaacccctcagaaaactactgattgtggtgaaaggataacaat

SEQ ID NO: 74143 - DNA, 17493 bp, Oryza sativa
gtggtgaaaggataacaataggatttgttaacgaccaaatttggtaatatcagcatcggaaaggaggattagattgaagtggagtcgaagacggagatcgattcgagaacagagcaagaatcggctggagtctggatcggctacgattggatcggctaagtctgagtcagactgggttaagtgatacagccgattccgacaatatgacttggtgtacaacatcaggttgagttgatatgtttcaagatgatcgccgcacatggatagagtcctgagaaggcaattgtatctattaattaggatgttttatgtaatttccttagagatatgtttagggcaaaagtctgccgcaaagacttatggtatcttagagtttcttagggataagagtcgtgtccgacatggacatagtttgtaattttcgggtataaatagaccccgaaccccatgtaataaattaacacacacattcaatacaattttggcgcatcgccacccttttgctttagttttatttcgacgagttcttactttcgggttgagctgcatcagtttcgatcttcaacaagaggtaaaacttgttatgacggcttgcgttttcgggattagtgcttccatctttatgacactttaatcttgtttatgtaattcgtcgagttatcatatgtcatgcccggaatttctatccaaaactccaaacacttacatgtgtgtaaaaccctcatccaggaatcagccgaggcacacaataacaaattgataatagagtgcaattattaatctaattaataggcgaatataaattcattacagaggtagatagttcctctcaaacaataaagatctaagcagcggaaaataaaataaacagcgcagacgacttcatcccacaagcagcttgaccagggctacgcctaatcctccacaccttcaacgtccggcggcggcgatggaaggtttagggttagaggagagaaatcaaatccgaatcaagctcgaatccgatgatttcaaaacaaaattagatgaagtttctataggggaaaagatagaggagatcaaggggatcatttcccctttaccaatttgatcggatcgggaaagatgcaaccgaatttggaaggggtggcggcggcttgcgcgcggctagggcgtggctgcggtgggaggtagacgacaaccctgataggtgggctccacctgtcagcgggtgagaggagggagagcgagcggctcggcttggtgggctgacttgggccgaacgcgagcaggccgaaggagagagagtgacttgggccgactttcggcccaaagccaacagaggacttttaaaacctttttctttttaaattattcatgaaatgcaattccatttattaaaaatacttccttggctcaaataaatcccagaaaaatctaggaactatagaatcaagagaagtatttaataaaattttatatagcccatttttatattggaatttattatttaaaattggatcttttcttctaggcttttaaaatcatttcttataattccatttaaacaacaatttataaatttagaatttttagggtgtgacatcatatatcttgcataatctctggcaatatctttatctaacctacaatcggctaatatctatcagtagagggtagccgattaggttagacaccgacgttgacttggattatatgagatatctaccaccctatgaaactttcagcggcttgattgtctagatattgttcttcttttcatacttaatgctgcatcagttgagtttgatctattaagttgtgcttagaatatcaatctctagcctgccttctggttgccgattagggtagtatcggagtttcagccgatcttatctgatttaactatatttgctctatatgcttcattgacatgttaagtccgccatttatgtcaagatcctattacacttaagtatattaggcttttgtttgatatattgtacttgttttaatatcttgatatagagtagtatcggagtattagccgatacatgctagatctatctgatcagctatgctataaacatatatagtcctgtcattaatatatatttcgatctaagtgatttatactgtctccgcatggcgaccgatctatcccaatcacttgatttaagtatatatcgatataagaattatatattgttaatatctacagccgatcgagtagatttagtttttcattatctatttacgaccaccgatcgatttacatatgacattggctcgaggataaatgatatgtcatcggcacttagccgatcggctatcatttatggatttaaccacggtttctttgtctttatttcttgttgattgcaggatcaaatcaactggcacgctagcatatccgaaggctagttttggacctgcactggagttaagcagatcgcctaggcctcgtgttttacgtcaacaggattgtatccacttgaactgatagctagatcaaatagtgtaaatcaagccatagtgaaagaaaatgatgtacattcagattcaggtaatccacatagaggactattgggctgaagaggggaatcggaagactcactttcagctgaagcactctgcactctcacctgcaaaagagaggatggcacacgtccgtgagaaccgagtgcatggtgtgggcagactataacccttacaacggcggcaccactggaggcgcggcagagtgtcgttggaaggcaggaccacagggccgtgacgggatggtgataccagccgaaaggcatattcacgggggagtcgactatgtgcggcagcggagacaggcttcatgacatacagatccacggcgccggcgagggcatggcatggtggtgtgtggcagtggtggggaggagcggagcgaggagcgcgcggcgaagtcagctccgttgggagcaggccgtggtggagtgtgtcagcagcggggaggcgcggagcacgctagagtgaggagttgcggatcaagggaaggaggagcgtcgcggagtcatcgcgcggaggatggggccgaggtcgactccggtcgcggcggtggacctcggcgccggtgccggcggatggggccgaggtcggagccggccgcggcggctccggcggcggggaagaagcagcggctccagcggcggggatgcggcggcagtccacgcggggaagaagcaccggctccggtggcggggaagaatcagaggctctggcggcggcagtccatgcggggaggatatccagcgaggatgcggcggcgcagcggcagaacatccggggaggaggaggagctagcgaggaggaggagaagcgaagtcttcgcgtgtggagcgatgtcttcgcgggtggaggaggaggagcgaagtattcggcgtggcgtggatggatggatcgtgcggtggcgaaatcaagcacgcagatagacggtagagatcgattcgagtgatttggcctgtaggattggcggagggaactgctcctttttatattagtatagatatagatgagtaaacttcataaaaccacacctattgtggttcaaattgtaaaaactatagggattttggcacgtggcacgtaaccattatagtcctaaagttttataaaactatattgttgaccattttgacatactcctatataaaaaaaataaaaaaagatgcaacatctatatgatagtaaaatcctcataaatttaagatgtgattgtagaacttgaaagtatggtagatcaaaaataaaatgatcaatagtgtgattttgtgaaactttggtattataatatctagggttatatgcgacattccaaaatccctatagtttttgtgcaactttgatcatattaaattgggatttatgatatttgcttttattaaattgatatgctacatattttccatgtgatattactatggagtaataaatatcacctaaatatcttgacacgagtacttttacatgtttatgctagcaaaaataaaaactattggacacgagtgacgatctaatctatggaatgataggacttagcattatatgtactttgattataaaattttgtctacaggcgtgtgttttggttacatgtatatatattggccttgtttgaagaagtagctaagagttattttgagtgctatttttagcataaagaaatagccctaagttatttggatgcaagggttattttaagagctatttggcctttaatgcacttttctatggagagagaagacatttttcggtgggccccacccgaaatagccccaattagcactcctttacagatttttgggtgtgttatttccaaagagccctgaaatagctcatatgtttgaaacttttaggctgtttaggggctatttgagagagggctaaaaagtaacccatagatccaaacagagctactgagagtgttctcggtacaattctattgtgttgatgtaattgtatgagcttttttattaccttaaaaattttgttggaatttaattacataaactacaatcaatttctaaattaatatatgagataggacaagatgatgtcttcaaatcatgacacttacaagacactcaaggtaggagaaaaaaatgggctaccacaagttcatcaaagtaagagttaagcaagcccccttcagaaaataatatagttactaggattggtgggaaagatttcttttatatcgataagctggagcgaacacgctcatgcaaagaaaaagctcgtaagctgctcaaccaacaatacttctttacagggcgagtagcatgatgaatgagatggctgtaacggaaggggagcagcagataacaaggaatgtggtgcggaagaaatggtcgcctcccgggctggtcagcttaagctcaatattgatggtgcttttcaggagacgcaaaaaactggcggttggggatttatcttacgcaacagtgaaggccaagggctgcttgcgggtgctggacggctggcgttcgttcatgatgctgactctgcggaagctagggcttgccaggctgccttgcttgccgcttcggtgcagggcatcactgaggtggggatcgagactgattctcttatcctggtgtcggccttgaaatcctgagagtatgatcaggccccaggtactgccatcttcggtgaagtgaagctccttattcagctgaattttatccattccccgttgctgtaatagtggtgcccatgatcttactaaaatgggcgctagttgggacccgggtcaatccatcgtttaggtcgaccccctcccagaatttataaatgcctttgtggttcgtgatatcactgaacctgctgggtgaataaaaaggcatcgatgaagttcaaaaaaaaaaaacaatactccgttcttgaaacctaatcacgagcaatgtaacaacgaaactgaacgaggtaagcatagcattgctgatctaagccatctcgccttcttgaattgtattggattctctcaaacctataaagttcctttttctaaaatttagaggagatttcagaaattttaaaactctgaaaagagtaaaattgttcaaaataatattgttggattctatgtttgtccctttattacctctaactaatgtaattttactaatccacgcaaaaggactaggtttattgaatccaaattcatttatccaacaacatcaatgctggattcatcactagaaaaaaaagaaataagttcactttttaggttcctcaatttgtcgccgagtctaaaattcctccataaaccgaaatactatatataataggtcccttaatttacaaaaccagattatgtgagatcctaggtagtattacatccggttttagctgacgtgacaagctgagtcaacatgagacccacgcggatcccacatgttagtgactaccacttcttcctcctctctgtccccttctactctttctgtctctcccctctgccagggaaggactcgcagaagaaatcgtcaaactccagtagcgcatgtacgagcgggacgcgattggaacgagatcaagtcagagaagcatagtattgtgactttagggtattcttagccgtccgatttacagtgaacgaacgagatcgatcgctacagtataccacagtaacactactcttgcacagtgtacttcactgtttgttactgttgctacagtaaaaaccgcaaaccactgttctggcgatgaggacttggcgcagcttcacaagcgttgattccctcctagcgccgatgcacctaaggggaaggaagaatccgccgccgccatggaggtggagagcgagagccccgttgcctcggtggagtccagcttcgcgctgccgatacaaacaaagcaggactcggatcttggcccccgccgcccatcccagcaccctggattgggaagaaaggggaagagatgggatatggaagagagaggggaagagatgggatatggaagagagaggagaagagaggggagaaggagagggatcccaagctcgctacccgttttttgtagctacccgctcaccagcggtttggcaactaatgcatgatggcgatcgatggtttcccggtgatccgcttgccagaaaacaaggcgggggcaatggtggtacgtggtaggggcccggccagttgagcccgtcgctctcgttgccgcaattcccaaccgctattggatccgagcgaaggggaactacgagtcccaagctcccagcttccagcttctgtgatacgagtcctaggaggcgtgagcgagcgacacatgctgccggtggctggtgttaacaacggaattttgcattagattcggagaagaaggaagaagatcgaagcggatttggtgttgaatcgagttggatttggagtcagactacgcattggctagatatcgtatcggctaaaaatagaatatgggttgatcaaggttgatgaagttgatggccgatacagccgatatggtataacttgggctcggtttgggtctagatcgggataaccgtcattatcaattagagatagagctcgaataatacaattgtatctattaattaggatatttcagtcggtttgtgttagatttggcaagagaccgccgtctatggtcttgtttgtattttatctttagaaaggtttgaatcgtgtccataatggactaagtctgtactcggagtataaatatgaaccccataccactgtaatacgagagagaatccaatacaacttcagcgcatcgccaccctaatatacatgcttctttactggttttatgtatatttgccacttatttagacagatcatcctatataattatatcaagctagatcagtatcggctgggctatttgaattagtaactgatcatgatttcaaatgtttatatagattgatttgtttatataagttcgtactaaattattagctagtactttatcgttatctatagattctgctctaaatattgttccattggctattttcataatattgtctttatgcttctttatcaaacctaataggcagtattatcgtcggtgaggcatgtttagggtttgttattcactaatctatccagtccatagcctatttggtctactacatcagctgagatcaccaactatactctatcggcctatcggctgactaactatgcttttatctttattgcttattgcatgatcaaattagccggcctagcctgcccttgacacactcgagtaggacctgcattggagttaagcagatcttctagaccgccgtgttttcactcaacagctgggttgccccattcgttgctacggcggaccgaggtgggtggtgggcatgggcaaacaaggatcccatgcagagttttccccaggattgatgagtgctcggaggatggcggcgaggggaccttcgttggatcgatgagtgctcgatgtccgaaaggactttcaacggcaacgctagccccgacgcgggccgcatggatccctccgctatttcactagattggggaggatgaggagacggggagattggggagcaggaggaggagaagtgggtctgtcatgcccagaaattcctgaatagaattccaagcagaatgtgcattaaaatccccgtccaggaccggccgggtacacaaatgacaatgttgacattcagatccatgtcttacaaacatcataaaagtcttacataaatgcagcggaaaaacaaaagataactggggctaagcctggacttgaactgcagcgggaataccactccacaggcaccctcgacggcacggacgaagcctactcctcggagaacccgccatcggacacatactcgcactctggggttggggaaaaaatagagcaagactgagtactatccactgtactcagcaagtcataccagaataggggtatgatgcagggaattatcaaaggagagctagagtggttcatttgcataaagcgagcatttataaacagaagttgaaagaattaaacagttgcaataattaattaatattgatcatccgctgtccaacgctatcccacgttgcaacaggcccaaccatccacctatactatccaatttcattagactaaactagggtgagactaatcacggtgaatctggttgaccgcccataactgcgggcacggctattcgaatagttttactctgatcagaggtgtacagctgtacccacaagacacagccccacaacacgtttccgtgcgccgacatgccaccacgacataccggaaagagtccgtgataggacccttcgcataaccccctctagccaagcacaccacacctcaggtttcaccaccatccccagcgggcgacgggcagtcccctctcgcgcctaggtgaatccggaagccgcataggccgtcgcagggcccatccaaactccatcacgcccacccttgcctggatgcgtcagctagagaaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtggcactaatccaacaataccattagaaccaacagtctaaacattaataagattttccctattgtatcctagttgaactaagcatggctaagcaactcctagtccaacgtctattcatgttataacccaagctaacaaaggagtaaggtaccaaaatagcatggctgtaacaataggtaaacatcccataataacattataaaacgctttgcagctggaggaacctcggcgactatctcgaagtacaccggaacgtcggaagaaccggaatctaggcgacatacaaagcaaacaatacaaacaggctacaaaactactgaaacagagaacaaaccatttttaatggattctacgcatttttcttgatttactgagacttgaatgggcttaaacggagctcggatgaattagttatgaattttagaagattcactgtgtttattactataaaaaaataccttaaataatttattgcgcaataattcccagggctgacgtcatcaagggggtgcggcgccgacatgcggggcccaccggtcagcggctcgggagagagggaaaaggggcgccggcacgcgggccccactcggcagcggctcaagggggggcggtccaccgtggaccgggaccacgcgggtggtccaccgccggtccacgggaccaacggcccagatcgctcccggggctgatcggacgggcggcggcgacctggctcggctcggctcaaggccggccgaccggccacggcgatggcgacgacgcgcgggcacacgttgccggcgacggcaaccagcggcagaggcggcggcgctaagcggcggctaggaaggagagggaggggagtagaggggagagggcgcctcaccgagggtggccggcgcggaggaagacgacggcgaacgacgacggcaagccacgggaggacgacggcaaccggcggacgggcttcggggtgccctaaggaagaaggagagagagattagagagagggagatgaaccacggcggccggcatccatggccgaaggcggcggtagaggtagaactcaccggagcgcgaggggatgcgaattccggcgacgaatcccgacggaggaagggcggacggggtggagttcgtccttgcgaacccgacggcggcgacggcgcggtgcggcggcgagcctagcggcggctagcggcggccagagcggtaggaaaggcggcggcgggtgggtgcacggcgcgggagcgatggggagcacgagggagttcggtgaaatggggaaaaagagagagagggcgacggcggagcttaaatagggtaggggagtctcggacgtggccggtaggggcgagattccgccggccaatgtgggggagtgggagaggagagagagaggcgggattcgaaaatcgaatcccggccatctcgggcgcggccgagggtgggagagagaggggagtgggtgcgggaggtgcggcgcatgcgcgggcgtgaccgacgtggcctggaggaggcggaggcgtgggcgcggcggcgcaggcgcgaggtaggagacgggcccgacaggtggggcccacctgtcggcgtcccgggtgggaggagggaggcggccggcctagctgggccttggccttcggccggcccagcggaggggagaggaggaaggagaatgggctggcggcccactcgaaaagaaaagggggaaaaagaaaaagaaaaaggaagaaaaggattttccctggaattaaaatattgcttgctcaattttaattggttaaaattatttctagggctctgaaaattccactaaaaatcctgttagtgaatttcgacatgtagaactcaagaaaaattccacatgccagattcgattattatttgtattactttcttagggttttctcttgatttgcaccggcattttcttagggtcatttataaattaaattttaggcttgggaggagaacttcagggtgtgacgaacctacccccttaaacggaatctcggccccgagattcggaggagctggtgaagaggtgcggatgggcagctttcaactcatcttccctttcccaggttgcttcctcctctgaatggtgactccactgaactcggcaaaacctggtgaccttgtttctggttcttcttttgctggtatcaagtatatgaaccggcttctccacatatgtcaggtcctcctggatatcaatatgctccgaatcagcttgttctttgggtactcttaagcacttctttaattgggacacgtggaacacgtcatggatgccgatcatattggatggaagttctagctgataagcaacttccccccttcgttccaagattttgtatggtcccacgaagcgtggtgccaacttgcctttcgtctgaaaacggtgtactcgccggagcggagtgacacgaagatacacgtaatcccctgcttcaaaagtgagctcccttcggcggttatccgcgtagctcttctgtcgagactgggcaatcctcaacctttccctgatggttctgactttctcttctgcttccgctaatacctctgtcccgaatagttgatgctcgcctatctgatcccagaagagaggtgtgcggcacttccggtcgtataaagctttaaacggtgccatctgtagactagcctggtagctgttgttgtacgagaattccgcatatggcaagcttttgtcccaagctccaccaaaatcaagagcgctagctctcaacatatcttccaagatttgattgactcgcttggtctgaccatcagtttgcgggtgataggccgtgctgaaatttaaacgggtccccaattcttcctgcagcttctgccagaattttgaggtgaactgactccctcgatcagttacaatctttttgggtactccatgtagacacatgattctcgagaggtagagctccaccaaccttttgcccgtatacgtggtatgtactggtatgaagtgagaaaccttagtcagtcgatccacgactacccagattgaatcgtgaccagatgatgtccggggcagtcctgttataaagtccattccaatctcctcccatttccattccgggatttgaagaggttggagtaaacctgctagtctttggtgctctgccttcactcgttggcaaacatcgcagagtgcgacgaattcagctatttctctcctcatgctgacccaccaaaacttttctttgaggtcttgatacattttggtgctgcctggatgaatggagtactgggtctgatgagcctcggtgagtatcagatccttcagttccttgccgtcaggtacacacaatctttctcccaatcagattgtgccgtgttcatcttcatggaaatcccgggcttttccgactctcatgttctttttcagctctgctatttcaggatcatttacttgagctgctctgacttgatccacgagcgtaggccgtgcatccagagtggctacgaacccgtgttcaacaattcccacgttgagatgctcaaactcctgccgcaattcctcacacatgccctcgatgcatagggcagtgcagtaactcttcctgcttaatgtgtctgccaccatattggctttccccgggtggtagtgaatgctcatatcatagtctttgattaattccaaccatcttcgttgtcggagatttaggtccggttgggtgaatatgtatttcagactcttgtgatccgtatatacttcacagcggttgccaatcagatagtgcctccagatcttcaaagcatgaaccactgctgccaattccaggtcatgagttggataattcccttcgtgtggacgcaactgccgcgagcatacgcaaccactctgccctcttgcattaggacacatccaagtccgtggcgggatgcatcgcaatagacttggaagtctttcatctggtcaggcagaatcaaaactggtgcggatactaatttctttttgagctcctcaaaactcttgtcgcactcaactgtccatttaaacttctcatctttcttaagcaactgagtcatgggtcgggcgatcctggagaagttttcgatgaatcggcggtaataacctgcgagtccaagaaaacttcgaatctgcgacacggtcttcagtggggtccatttggtaactaactccacgtttgatggatcaactgccacaccctgagctgtaatgacatggcccagaagtttgacttccgtcaaccagaagtcacacttgctgaacttggcgtatagctggtgctccttcaacttctcgagtaccagacggagatgctgctcatgttcttcttcagactttgaatagataagtatgtcgtcgatgaaaacgacaacaaacttgtccagaaattccatgaacactttgttcatcagattcatgaagaatgcgggtacgttggtaagtccgaaagacataaccgttcgatggattcatgaaggccgtctttggaatatcctcttcccgaattctcaactagtggtagcctgatcgcaggtctatcttagaaaacactttagctcctttcagttgatcaaacaaatcatcgattcatggcaaaggatatttgttcttgattgtgacctcattgagtgcgcgataatcaacgcacatcctcttcgtcttatcctttttctccacaaaaatgaccggagcaccccaaggtgaagtacttggtcgaatgtaccctttctgcagctgctcatcaacctgcttcttgacctctgctagttcgttggccgccatcctgtacggtctcttgtaaattggcgcggttcccggtgccaaatcaattcggaattcaatctctcgcttgggtggcatggtagtgaggtcttcaggaaagacttctgggtactcgcaaactatgggaatctcttccaatttcctcggattcttctccttcgtgaccactgggatttccgcctcaatctgattcaaggagaccccttgctttggtgagactagtgatttgtacactacggtttctcccttctcgttggtcaaggtgactgtgcgattcgcacaatcaatgactcccttgatcttggtcagccaatccatcccaagaatgacatctaggtctttggattcaggaagaatgaggttggctagaaatggtgatctttggatttctattagcactgaagggctaaaactgaccgaggttgaactatttcccggggtatgaaccctcattggtgtattaagctcttctttccttaacccatgcatccccacaaatttctttgaaatgaaagaatgcgttgcaccggaatcaaaaagtactattgcagggattgagttaacaggaaatgtacccagtacgacctttggttctgcttgcgcctcctctgcagacgcgtggttgacacgagcctggacaaaccttggcccggcacgcctgggcttcgggcatttgtcagcaaagtggccaagctcgccacagttgaagcaagaccctggttttgttccagtctccttcttggcttgcgcggacgggcctgactgtgccggtgccactggtgggcgtggagctgcaccgcggttgggctgacctccatggtggttctgactgccactggcgccctggtggaagttgctagagttgaacgggcggtactggcggacgatcatggtggtaggtccaccctgctgcccgggagcgaagcgcggtcgctgatggtttccttggttggaccggaactgtgccgcctttctcttcctgtccattttatttcgctgatcctcctgacagattgccttgtccaccagcctttcaaaatccgcgtagtccccagatatcagttggttggtcagctcgtcatccagacctgccatgaacttttcctgcttctcggcgtcagtgcggacatcctccgatgcatatcgcgcgaggcgattgaactcatggaggtactcggtcactgtcctgtttccctgatggagtgcccggaatttcctcttcttttgtgccacgaccccgtctggcacctgcgccttcctgaagctacgacagaactccgcccaagtgacttcagtgcctggcgggcgggtggccatgtgattgtcccaccaagctgacgcaggaccttgaagctggtgtgtggcgaaagcaaccttctcctgatcattgcactgcaggagattcagcttcttctctatggcatggagccagtcattcgcctccatggggttggtggtgctggagaaagtgggtggcctgacacgtagaaactctggcaacttggactgagggggagggggaccaaactgctggtgctgctgttcggcgtgctgcagcatcctctggtgcatctgctagtgctgttgctgcatctgctgcatcatggctgccatcatctgagtctgatgtgccatcacttgggctagcgtcggattctcgggaagtggtggcggaccattgccggaatcgctgttgggatgcacaccatcagtgcgctcttcgtcgttggtgccctcgcctgttgtacggctaccattcctggtgtagaccatctggaggaagagcagacggggaaaagaagaaaaacagatgctcaagaactaagctttattatataggaatttaaactgcaattgttctgatctgaattaaaacacttaaaaagcaagcaaaaatccttattaagacaaccatatcataggcacatgatatcgaccgtcgactgacccacaagcaagcaacctaaacacacaaactaacaaataaatgctagacagtcgataaactaatggaaaacgagcctaatgctcggaacggctcctgcggtcggtggagtcgaaggcgtcctcctgctcgtcaccaggtccctctgagcgactcctggagcctggcggataagtctcgccgctgcccggctctgagccactggagctgctgctgctgaggtcgcgactgccactgggagtagctggcaaccaacctccattgccactggcagggaccctgacggctgatgtaggcgcgaaggagagagcggatgcaggagctgacacgggaacgggagctggagctggtgctggagctgcaggaactgctggagctgcgggcggaactggaggtgctgcgggagctgctgatggaggtgggttcctgggcgcaagctggatgcgcatgggtgccgttgtcgacttgcggggtgtagtgcggatccggactcctcctggcgcgtgaagaccctttaacagagcattctccctcttcaggcgcgctatctcgtccttcagagcgacgatcctcatgagcttcccatcattcaaggccttggacgccttgtgcaggtccgagtgcatcctgtccatccccctcatcacagtgcacatgtgaccaaaggtggtgtcattctcgccggctgtcggacggaaagtactgacatcatcaccgctggctcgacgagggtgaaatcggtatgccgtgtcgtggaagatgtagttgtggcgctcccgtagtctggccatcatcaggtatgctgcctcctgacaggcgtgatctgctgtgccttcggatgcctcaaccaccatattagctaggcaggtaccgacgtagccatggacctctaggcggacacggtgaggaagctcgccgctgagtggtggaacagtcgtgtactctggcgcgttggggtagcccaccaccagcgtcatacgtgctaactctgccacaaagtcgatcatgccttctccgcggtggttgggtgggtggccggccatctagagaagacaaaggagtaggatcaatgcatgcttaaatccaaatttaaataaagcaataaaggactcaaataagagaatcgaataagagcgaaattttatgcatagataattttgcatgagagcgaataaataagacagacttacataacgataaaataatggggaaattagatacatactaataataacaataaaggtacaaataccttgcaacccatattcctgagctaggacctaatgcatttcacccatcaaatcccaactgactgacgaataaaccccaaataattttactaaaaccctagactgacttgttttgccaaatctcacttaaacaagcgaccaagatttttcccttgaaccacaagaacagatcccaattttcccggaacaaatccaattgcaaagaacatatgcaatgaaaaggattcagagggctcttaggtttttccatttggcttgtcctacggtcaaggtcggctctgataccaacttgtcacgcctagaaattcctgaatagaattccaagcagaatgtgcattaaaatccccgtctaggaccggccgggtacacaaacgacaatgttgacattcagatccatgtcttacaaacatca

SEQ ID NO: 74144 - DNA, 7927 bp, Oryza sativa
tgtgttatgatcttttgcttgtaacatagtgttctatgttgatttataattatgcatagcttgaaatgctttgaagagcaactttttttttttgaaacgtacaatttttttcagccatggaacaaaaatatgttcattcttgctctgttactatttgtattggctatttcaggactagaggtgtattttaccttgacatagcatgtgttttcccactgtctgctggacttctgttcctcaatgctatattatcatcttttgcagtttaagcgacaaggaattgagataaggcgtgtggtcgaaagtgacagtgagggatgtcttcctgctgacagtgacttgcacgggtccaaacataagaacatacatcagaaagtgcgtaaaccaagagccttccgtatctcgcgcaatcatgcctcagagaaatctgaacaacaaaaacagcaacatgtgagcaacaatcaagaatatgaagagattgaggagggagaactgatcgaacaggaccatcaggatactgcttccagaagcaagtctaaccaccaaagaaaagtagtactgaaatcagtgatagaagcaagctcagcatgccagggaggggtgattaatgcaacatcaaaagacgctgattgcagcaacggagctacaggggaatgtgataataaacatatacttgaggtaatgaaaaagatgcagaaaagaagtgaaaggttcaaagcgtctattgcaacccaaaaggaggaagatgaagacaggaaagaatcgttggccgtgacttgtgatgtagatgacatcaagaatcagcgacctgcaaggaaacggctttggggttgtagtggttaagatgctagaaacctttaacaaagctcaaacaaaccttgtgtcaggcatagtttatcacagaccatcaccatttggttgagccagaatgtctagtaaacatctctaaccaggtttgatcaagactctaacgctccaaaggtattcaggttcagaaaccgtagatcttttgtttgtttggaatgagaggaaaaatatacagagcattcaattttttgcctatgtaatacatttacaatgttgacattatctaccataattcttcatagtaatatggtagaaaatggaaagaaaaactgaaagtttatgcatatgtctgtaatggattgctcccttccaacagagtattgacttctggtaaactgggaactgaactctccatatgtatttatacacaattttggatctgagacgctgttacatttctgcttgtcatgcaattttgcgtttatttcaatagtaccgaagttaactttctttcagctgtgatgtcgtccagttatacacctgtgcacttgttctgatatttgaatgacatttcccgtggatatcctcagctttggagatgttgatattgagcttttagctttgtttggaataatgggctagtttggtttaaggcctaaattaggcttaccaatatttggcaatttcaatagtgtttagtgtctattttgtttgaagccaaattttggcatgctttcttaggccatttcaatagtgaacttaggctattttggtttcaatccaaatacaactttaccttatcaaaattagtcatgcaaaacttatcaaaatttagcattgtcaaaatttggtaaggcctatttagaccacaaaccaaaccaacccaatatgttctctcctttttttccctcgagtcctgcacgaaatatggtgccgtgttcctgtaggtagcttcaatgttccagaacgcattcggcatccactcgcatttgtgaacagtactgtttgtttgactggagtagtagcatgcagtagctgccgtgttgataacttgatatatctccagtcccttccgtaaaattttctgtctccaactcgagatgggcattcagcctcgtacctctaaaaggaaacacacacaaaaaagaaaaaaaaaagacagaaaaaagatagagagagaaaaaaaaagctttctgcaacagaaatacgccactcgtaccgacaaaaatatcgaagcagttcagtgaaacccggcccgaccccacctgtcagcgaaggcaattcgaactggcgcctgcatcgccgacgtggcgcgtcgtgcgcctccaacccgcaccccccaatcccccgcctcccgcttttacccctgcacccgcgggtacggcattaatggcaccgcatcttcgagggcaatcccgtaaatccggtaaccgcctcctctcccttcatcacaaaggacgcgcctccctcgcttccacctcgctgctttgctacggccggagcggcagagcacactccggcgaggggggccatggcgatgcggctcttcccgtcctcgtctccgctcccgccgccgccgcctctgctcccgagccccagcgcgaaggcaccgccgtccgcgcccttctcactctccctccgcctccgccgcgcgcgggtggcagcctccgcggccgctgcggcggggggccccgagaggggggcgggcgggtacgagggggatgcggaaggcgagggcagcagcggggcgttcgacaggggaatgtcggagatcgcgaggaaggtgcctctcttcgagccggcgaggggcgacgccgcggcggtcgccggcgagcggccgctgcccatcaacctcgagctctggctctaccgcgcaaaggtgcacacgcggaagtacgagttcgccgacgcggagaagctcctaaaccaggtgcgttccttgagaattgtggatatttcgcaacgaaagcagaataaacacgcacaaaaaaaaatgctcccacagcttagcaaattgacaaggcatatatagctagttgaagcctgaaggaagcgaatgttttcctcctatatcgataatataggggtttaacaatcctaatttgagttgtttaatagttgatggatcttgcgccgcgtatctgatttatgcagtgcatcatgtattggccggaagacgggcgtccatatgtggcgcttgggaagctatacagtaagcagtcgaggtttgacaaggctagagcggcttatgaaaggggttgccaagcggcacaaggtgaaaacccgtatatttggcaggtttgcaccggatcacttctcagcctccatttggtaaattgactggaaaaaactgtacagcaccaaaaaaaaaagtagcgcgtgaggtttcttctttaacattccctaagatatgttaatattccttagctgtgtttggagttcaactttcaaagttctccaaatggatgaccatgcccattagcaattcacaatgaagagttattttaggcatttgagcttcagttgcatacattgctttcctctcaaatatggatgcaagatgaatagatctagtccattgcactttgttcacaggaacatcaatgtgattgatggctgatcatgagatatgaatacactgctcctatcatggccatttgccctcttcttttcaagtacttaactcatatgtcaaacataatctcttggattttctgaataagtctaaagacttttggtttgatacaccgggctgggatcatctttcacgatccacaatttcacactgaacaaaccagtccactgttttcttatgatcatatcttgttcatgttatagaaattaagcatataattaagttcctgttgtccttttgctttgagtatgcagtgttgggcagtcctagaacgcaaaggtgggaatattcgaagagcacgggagttatttgatgctgctactgtagctgatgcaaagcatattgcagcttggcatgggtgggctattttagaaatcaagcaaggaaacattaaaaaggctcgaaatctacttgcaaaaggtctaaaatattgtggaggaaatgagtacatttaccagactcttgctctgcttgaggctagagcagagcgctttgaacaagcacgaactttattccaacaagctacccaatgcaatcccaaaagctgtgcaagttggctagtaagtatttgcttcataatttatccattttagtgcaaataaaaactgcatagtttttttgtctaaactgtgaacttatgtacggcaacttctagtaggcatgggctcaggtagaaattcgtgcagaaaacaatgccatggcaagaaaactctttgaggtaataatttattttctatttataattgttcccatgaatgtttgcgttagttcttcggtactcatacttgaaagttttctaacagagatccatccatttccacatggcaaattagaaaagatttcccaagtagagatgaaataatctttaatccaacccagagaactgtgctttcaaaatgattttactaccacatatcaatgcaatgatgtggcaataatttttataacttaataatatgctgttagtgtgattcactccatagttcattcacacctgcatgggatggtttcagtcaacacaatgctgtctacaaagtataatttcgaatttctttttacagaaagcagtccaggcaagtcctaagaacagattttcatggcatgtctgggcactatttgaagcagaacaaggtagcatcgacaaagcaaggaagttacttaagattggtcatgctgtgaaccctagggaccctgtgattcttcagtctcttgcactactggaatacaactactcatctccaaataccgcccgtgttttatttagaaaggcatctcaaattgatcctaggcaccaaccagtttggatagtatggattttctgtgcttatctctcttttttttataagtaatatattactcatttgagccgcatttgtttttttacacctctggttaaattaacttgtagggtttgttttagtattatttacctgacatttcgcaaatagctatgattaattagtttatggcacttcttgatgtaccttgcacacttgagctgcatcttgcaacttgcaagtgctctggctgttcaccttcctgtcacaaatcacaactgaatatgcacacgatacaaataatttgggatttgatggatgtaaaggttcagttgagtgcagttgtctgaattattttgttttagttactttcaagatgctatatatctcatcgttacatttgtccatatttgtgctcatttaggctgttacttgggatctcccgttcaacactacctttagaatttcgtttttctatttgcacttatttagacttgtgcaaagcactatatatcttacaatcaaggaagcatcgcatgttcctggccagagtaaagtaaaaatatttgttatgaactgttagttggtagaggtggtattaagtgagcaaatctattacaccaattttaaatccctagatggatctgtcttgttttatcttgcaaactgtcacgtttgcatttgtttatggaatctcttttatttggactatctttgaagcttagctctgacttatggatcatgttataggcttgggggtggatggaatggaaagaaggaaacgccagaacagcaaggacactgtatcaaagagctttgtcagttaattcaactaatgaatgtgctgctcgatgtcttcaggtaaatgatctattgatggcaatccagctcatattgaactggtagctatacgtttttgctggccgatagctataggagtaggtttttgtctcacgtggtaatgtgttactattgaataataatactatgagtttcatggtttttggaagatgaatgcttctatgtgtgaagtttcttctttactggaactgctgtactcatttgtgatcgaaagactcaaatttctgtacacttaaaacatatcctgccctatttttgtaggcttggggagtcctagaacagcgggccggtaactacaccgctgccagaagattgctgagatcttcactgaacataaattctcagagtgaggtaacatggatgacatgggctgcactagaggacgaacagggtgatccagttcgagctgaagaaatacggaacatctattttcagcaggttagtcccgggtaactacttttagatatgagtactgggtaactttagagtagcatctttctcaattcatgtttattgagttaaaaggcagtaaaatggaattatttttcttcatgttttgtgattaccaatttcatttgcatcacccatgaacaacgtattaacaacaattgctggtgttcgcatcatctctgttgaagtttctccctgatcattatccatcctgacagcgtaccgaggttgtggatgatgcctcctgggtcatgggcttcctcgacatcattgatcctgccttagacagcgtgaagaagctcctaaacatagaccagccttcggggcctgcaacacgagacaatccgaaaagcactggagagccaagcaatacagctaccgtccggacttctgccgatgcagagttttctggcggttcaagagcagaaggatcggacgcttcggaccttgctaacgccgatgacaaggagagcgatgacgctgcagagacaccagagagcgatttcgacgtggatggattcatcaggaggcggctagccctggacccggccgagctggacgcggtgcttgagggttctgatcccaggggagttgtttccaggaggaggacgcagaggttgcccaggaagccccttcctcttctccctgttccgtaaatatttccacttcagttcaacaatgcacatttgccatctacgccgtgcgaagcatcgaccactaacagtaacaggtaccgtgactcgcgagatagttgaacatacatatctgtgtatatctctcagaagaagagcgcggcggctgccattagcagccacatgtttgttactagagttgttattggtccacccaggtgtatgtaattctatcattcttcaggagcagtgtatctgtgtacataagcgcaatctatcaatttgtatgtgctagtgaagaattcaaaatctgcggatatcacttcaatccatcttatgccaattggataggataaagaccatcacaaaggggtcatgaaactagaaaatgatttgattctaaatctgagttatccaaatgtgcgccgttcatgttgccgggtagtacaaattaacaacagtgacaggaagtaaaaaattaggaatcagcaggagaacaaaagctgcaattagggggtggtaaacgatctaacattttaggcttttagcctacaaaatttaaaggctggttttaaaataggatgaacaaaatttctgtttattttcaaattgggtttaaaataggatgaacttttctatttatttataactaaaaatatatgagaattagatctttatccataatgatcccatagctgcaacaggtgattacaaacaacaattaggatcaacagtacatacatctgtgttggctcgaaagattgcaagaggacaagcttagcaatgcactccctccctaatacgccggcctgccccagaaaactcccggcggcggcggcggcgattgctgctgctgcagctgcaaggtgggaggaggtggctgatgcagcgctggagctggcggcgatctgatgtggccccagtgcggcagcggcgacggccgcggcggcggaggttgagcaccccagaacggcgcgccccagaatggtgccgggtaacacggcggcaccgtcggtgggctccagaaaggtcgctgtcccgccgggggatgctgcgcgaacgcaggcgctcccgggaacggcggcggcgccagtggcaccgccgccggcaacggcaggccccacgacagccatggcaccaccgcgggcgacgcgccgaagtgtacgggtcggggaggaagcggcgccaacgtcgggtggccgcaatacggtgggggaggaggaggaagccgcgccaacgtgggctggccgtaataccgtggggga

SEQ ID NO: 74145 - DNA, 5430 bp, Oryza sativa
cgtctcgccggtgccgttgacgcccttcggacagccggcgaggcgggcggtggcgatgggggatcgggcggagcagagaaaagagcgatgggggcggcagaacaagcgatgtgaggggaacggaaggagaagagctagggttaatgtctttgcacgaatcttaaagcatatccgatggtaaaaaatttgaaagatgggagatttgattttctatcaacagatatatagacagtcccattttataaacaatactcccaccgtttcacaatgtaagactttttagtattacccacatatatataggtgttaatgaatctaaacacatacatatatctaaattcactaacatataaatgaatgtgagtaatgctagaaagtcttaaattataaaacggaggaagtatatctttatccgttcgaataacgtactcagggcaagtactataatgctccataagctgcccctaaatgtgccacattggattgagtgatgaggtggaggagagaagtgaggagagagatggtgaaccacccctaaatgaagaggtaacctccacacaaatttcaagaggggtgtgagagtataagagacattggtatttgtgtactagaggtgacatattgtataggttacctcttaatttatgagtgaatgatgtggataaatttagatgtggcacatctaccataacacttgccctcgtgagaaaataaggaagtggctggcaaaaagctcaaaagaactctaatgaagcatgaatgtagtgggaccgaaggctgcttatatcctgatcaaaccatctctttcgtaggagtaccaggcaagccaattgagatcctctgtagtactgcacgtgcagtactgctcactctgtagtactgcacgtgcagtactgctcactgacatgtgggcccgggcgcggtactgctcactgacatgtgggcccgggcgccagtgctgcagagtacctgcatcccaggcaagcataccgttatctgtcttttctttattaaacaaacaattattatgttctctaaagtttgaggagaaggggattgagaagattgggaagatacgcaaaacgaggtgagccattagcacataattaattgagtattaactattttaaattttaaaaatgaattaatataattttttaaataacttttctataaatttttttttacaaaaaatacaccgtttagtagtttaggaagcgtgcgcgcggaatacgatgggctttctcacccaatccgccatgaacgaacgcaccctagttcaccaattaagcgaccctaggcgctgagaatatctccttttcaccgtgcggaagacggagaaatttccttcatgctgtaacctgtaatgtatcgcctgctttccttcatgcaaagaaatttccatcatttatcctgtctcgtttcaaatggtcctttgctccacgagttaatccatggacctattaaataaagcataaccataaaaagaatccgatgtcctgacaaaacactgaacaacataattcagccatgcatgtaagcgtctggaacgcaccaacctgggtgaccagggactaattaaactactaccaatgtcctaggatgcatcacagtgtcttaatctaatgaatgaacagtaactgtagttactaagtaagctttggatacataaaaaaaagatccttttcgaagtccacaagtttcaactccactgctgctccgtagaccgtaggtctatctattagcaatatttaataggtagtattactaatttagttgtatctgtatatatatccacactataacttttactatcacatcccttttgagataaacatagttttgaaataactacagtcaattcttaaacttttagcaactaatggacggcgtatcatgcgaaatgttttacgattttgatttgtaaaaagaaacacactttggcatgattaactttcaagatcgtgtcaataggaatcgctctttggtttcaacgagacaacgacttaatgatgtgtggcgcattgaatggcctattgaataaatttacatttcagccccttgcatgtttcagcccataagcttaccaataattcaatatacagtacacatttgatttacaaccatgcccctccggacccacttgtcagccactcgaaatcctaatttcctcttatttcacgcccatctcgatctcttcctcccccttttccctcttccccttctctctcccgcgtgccctcctccgccgccggtggatgccccggcgtgcggccgctctccgctcccctgatctccggccaccgagcgccggcaatctctctctcttgccggccttcgccgcctcagccacggcgccaccgacctgcatgcgcggtctctcacccgcttcccaaaaaagccctcgagctgtactgaaattgtgaaaaagcgagtcccgttgggtagagacgggtggtgtgtgtggaaagcgcggggcggggcaggggcaaaggcaaagaaaaaggctgctccaattggccctgccaccgaggcacgtggcctcttctgtccttgcccctctgcgctgcgcctcactcccggcctccctccctccccacccaaatcttcctcccccttccccttcaaggcctgggcctgggtgcttctccggggcggcactctggacggcggcggctgcgaagcgggagtgtggaagggtaacttcactgctgcctcgctctcctgcgggtttgttttttttttctcgttttttttcttgggcggcgacttcagggtggtatgttggtttcgtcggtgagacgaagattgagggtttttttttgggggttgtttttgaggtggatgttgtcgtcggtgcgtcgatttgaagctggggaggcttggagtggcaatgcggccgcctacgagtagtcctcgcgcttcattgcggtggtgtattttggtctgtgtgcttgtgcgtgtgtttttttctgggtttgtgcagatttgggattattgctgcttgtctcgcagtttttaggttttgtttggggggtttagggatgccatgtcttgcccagtgcgcggtgctttccctgttgctgcaacctcgatctagtgccggtggttcaatttgctggtttatggcttcgctaccgccgcatacttttaatttttacttgttctcttggagttcatctcaggccttcattgcctgcaatgagtggtaccttttgatcattgaaccaatttttaggtgctttacttagacgttgtttaagaatcaggatggtgtgcttagcattccttgctattattctaatggtaacccgccgtgcttgctgtttttttaagtgcaaagtttctacctatccattactgacatccaggttcgcattaagtaaaacatgaggctcacctagccaagggtgcaaaactctaataacaaccacaatctttggcagcctatgaacctccacattagaatccatacccttgtgcatgaaatgcatgcttagctgtcatatttcacaaaaacaagtgtgcaacttgccttaaatcatgaactatcctctagatggtatggtgttggactgggctgtgagattcagagactaatgatctggtttgtggatggagtagtggcatgggctgtacataacatagccaagatttctatctcccttcctttctccttgttcttctactcctaatctcctatacctctcttcttcacagatccttgccagtttctcttttgattgctgccaataaattccatgtatattacaaccaaactacacgcatgctagcacattagtcactagtgctattggtgataagcattggagatccataacactttgatgcctttatgcaggttgaggtgtgagaaccaggtggttgctccaacctttggggttcaaggaagatgggtttcatgtcagcgaagctctttccttcgtgtgagagtatgtgcgtgtgctgtccagctctgcgcccaagctcgcggcgccctgtcaagcgttacaagaaactgcttgccgagatattccccaagacgcctgtatgtgtttgcttttcactttatttctgtgcaagtttagattagcaagtcctgtttggacattgttgctgcaactttaatgcattgtgctgtttttgatctataagcagttaatagtccttgttaacctgctctatggagtttgcctatcaaatggttatattctccactgacgacatattcgtggacaatgcaacttcactgtcaagtgtagcgctgctgattttgcagaatttacttgcaggatggccttccaaatgagaggaaaatcatgaagttatgtgaatatgcagcgaagaatcccctgcgcattcctaaggcatgtgctgatatcatattgctaccttttattatactgataaaatactcctgagtatgtggttaatttttttcatgtttccatttaccgttgcttattgcagattgccaagtttctggaacagaggagtcacaaggagctacgttctgctcatgtgaactttatcaaaattatcactgaggcatacagcaagctactcttcatttgcaaggagcaaatgtgagtgtgcaaacttattggctgacccttaggtttcctatatcgaactgttatttgacaggaagagttcttatttcttgttattgtgtgcatgtgatgatatagggcatattttgccattagcctggtgaatgttcttactgagctcctggaaagcaagcaagagaacattcatattcttggatgccaaactttggcgaagtttatttatagccaggtcaggcattgtaaatactaccctttgatcatttgttttctttagtgtatgtatcagaatcattattatggtacattaacaggtggataacacgtatgcacggaatattgaaagcttggttcgcaaagtatgtgtgctctcacggcaacagggagtggagcacagtcttctccgggcagcaagccttcagtgcttatcagcaatggtaatatatgccttttcagatccttttcctgactttctcttgcacgacttagtttcaaagtgtagttctgttaactactatcataatattgtgcagatctggttcatgaaggagcattcgtacatatttgtggattttgatgaggtagcgacaataggttccttgtgggaaccacctatcgttcattccttgtaatctattggaaattaaacctatttgcttgagttcaagataccatactagcacatgaacctgtttactgggttgaggttatccatttgcactaacttagagatgccaatttatccccacatactagagcagttatttttcttgtcatctgtgcaaacacacatatccaactttttagttattgttgttctgacatctacctgatttatcgggccataatacattaacag

SEQ ID NO: 74146 - DNA, 1102 bp, Oryza sativa
tgatatcgttaattggcaattgatttgcatttgtgacgctctgcaatttatgcatcttataatgtttaattctttagcattctgttcaattattcaagtaagggtttcagttgatatattatggtcaacatgtaaacatgcacctgtttccagttgtatatcccgcctaattccttctcctttcataatgtgggaagcacaccaaatcattgattgtatcaggcatgttctattcagtataatcagcctcaatctaggattttgggttgactgagatcaaattttgtgctgcgcatgttagcaaagaagctttgtaccctcatacctccttaatcaaaatataatttttcaaactttatgtttgtgagaatccatatggatgttgataacaggagagtttcttcatttcatgtactttatcaatgtttagccaacaatgcaaattcaggagtgcttatcagtattccaggcacacagtttattagtaaaacatgataactgttcagctgcaaatctgtaaccatttctttctcattgtacttttggaatgctctcttttagctatccatcttgccttaagttgcattgatttcggttatgcactcattttcactgttttgtttccctttttggcagtatgggagcttttctgcttagtgctgggacaaaaggtaattgagtgattgttaatgcaagtactacatttattctacaactagactgatctgaatccttgaatactgtacttgtgaatgtaacacagggaagcgatacagcttacctaactcaagaataatgatccatcaacctctcggaggagcccaaggacaagagactgatcttgagatccaggtaaatccacaaagttaaattgtgtttttatcaagatcaggacgacatctcaatagcaaataattaaccatatcattgtttctctcttgccggtatatggttcgatctacatgaaatacatttatttccacaagcgaatagcaactccgctggctttctattgttacttgtatcaccagaagatttttctgtcactgattttccattatttcttttaggctaatgagatgctgcatcacaaggctaacct

SEQ ID NO: 74147 - DNA, 979 bp, Oryza sativa
atcacagcctaatctaggactaacaaggactcatatataacccaaagtgagtagcaatggtactttagtgtctggtattgagtattgacagataaaaggaccattttatctggggattaacaacaatcatccattaaaacaagacaccatatagttcatgtaaaattgtaaatacagtgagcaccactcccttcatcgcctcagtatttttagagtaagcagttcgtaacaaagctttggcagctattggtataggaaataggaattggatgtcggatagcgtcttattcatcattttcaccttgttaggatcgatggcatcgagatatagcagctgggcaacgatgatgttcgccatatcatcctccacgggtccaccacaccggataatcctctgttccacaatcacacagagtcagacagcacacagaaccctccacaaataaacttgtgcaacaatctagtgctcccgtacgtgctggaagagctggctgacgacgctctggaaccgctccatcaccatgggcgatggcccgcgttcctgccccgacgcatactccacagggaagtagggcgacctcggcaccaccaaatcatccctacgaaacacacaacaaccacagcatcatcagctccctcgcatccccacccaaccctcccccaaccagacgatgcagagctacaaatggttcgtcacaaaatcaacccccccccccacctgatcgaccaaatcccgctcctctgatgagcggccccgtggccagcggcggcggcggcggtcgccacggcccgagcgcacctccggctcctgcaagaccgagtcagttagggtagagcgagtggagccacgacagagtaaagtgaggagggagggggaagaggggagtgaacctgaggagcggcagagatctcggggcggggttcgcgttccagctcgggcggaggagaggggcggtgagagaggaggagggggtggtgg

SEQ ID NO: 74148 - DNA, 10236 bp, Oryza sativa
agggcaagcaagggatctcgcagtgtagacgagcctggtgggagggaggagggagagggagagtgacagttgagacttgagagagagagagaagagaggcagattgggagcagttggcgcgtcgccgtcgcgcgccaccatccccaccctgcgccgcgtgctgcagcgctcgcctttattacgcccccgccccgcagagctcgcctgggcgagcgagcaggcaagcggcgctcttcgtctgcgcacactggggcggcgagcggagctgatctctcggctttaggttttgttcaggtacacgggaaatatctcatcctttttgtttcgtcgccgccgccgcaagtggcgtcggctctgtttgtgaccgggggggaaggggctgattagatttgtcccggggtttcgctggatcgatcattgttttgagattttttttttgcttttttttgggggattttggctgctggttttgatcctttctattggtgcgtgatgcgggatgagtgttgttgcggttattcttcaacggattggtgaattcgtagtggtatatttggatgcttccctttcacgcaagcgcgtttgtggggcaagcctttttttttttgcttcagcacggcgacggctagctttgagccttgagtagttttgctattatgccaccgccgccacgcttttgctgataattggtagcgctagccgccaggtgaatcgcggctgattgatttcatgctttgttcctctgattacgatcttgctctgttgcatgctgtcttgattaaaccgaattctagtgtaaaaaggaatcacttttgcttggaagattaatctactagagttagtgtttgagtttatctcctactctggttgtgccattgtcattaacaattgatagatttgtctgttgctttgctttgattcctctagaacactttaaaatactttatttaaagtgttcctttattgatactgtattgaatcatataattcagtagtatagtagattattctctttggtctgcaaagagacaacgcattatgctagtatttaggtattcccgtgttatgatctgtcgtaccatcagctcatttattgccggttggtacgcatcacttgagcgttttcgtctgttcttgttattcttggtttcttccgggtactgaccgcggtttgtaccagaggacaccgaatattggctggtggtccacgccaaggcaaagatgtcggtagccaagaaggaagaggtacatgaagtttcctccttggaggtccattctagtgggctggatgtctctttctgcatttgtataaaaattctggatgttgtatgagcaggtttgcagtcatcggctcgggccgcgattggatgagccggcggtcggcgtgcccattaagaaaaggccagttttgttgtctgatagattgcttccgtctggaatgccgccctcgatgagaccatcgtctccggcaacggggatggccgtttcagttgcagaggcaggatgcagcaaggacactttcttgaacagatctgtatcagaagaaacaagtgcaatcacaaaaggtaatgggatgtttaatccccaggatcaaaggcatgccaagaggtcattcattcaatctttgaccgagaaaaaagggctgtcacttgatggatcaagtggaatcccttctcgcatagagagtggtacaggtaatgttgctcccgttgatgatactcagagtcagaagtttttgagtttgggtttgcgttcagcatctcgtctgaatggtaagatcaattctagttccaatgtcaaggaagagaaagttgatcagggtctttctagctttccatcagcagattttcagaaggatgctggagcaacaaatgaacccaaatcatcttctgacagtagctttgggcgactaccgaatttggatcttaatgtgccattggaccctcatgatcttgctgaaagtttgcctatagtgcaagattccagtaatatactctaccatgaaactgttcagcttcagaaagcacatgttcccccagtgcccccagtttctacagtgagcaatggactgcatcgaaacattgccagtactttgaacctttccaatgcatatggactttctaataagcgtggggcagctgatgttaccttagacttgcaacttaaaccaccagctagacctgagctaggcataaactggaaaggacttgctcctgttccaggactaagtctctctctgtctagtaagcatgttgaagagtctgagaacaatgctggattaaatctctctctatttggtaagcacattaatgagtctgagaacaatgctcctaatgttgcagttagatctgaacctactgtaagtgccaaaagatcaccagggaagttggtataccaaggacagataaatcaccagttgaggaggttgtcaaattggtgcccttgaatgaaaaccctcataaaactatatcatcaagtgtggctagaatttagagcatggcatctggttgtttggtgaagaaagagcctgaagaacagtctcaacgacatgttcagaatgatgtagaaaaagaacaaccattagaatcacaaagtgttggactagctaacaatcgcgctgaaattgaaaagcctaacggtgcccaccaagttcctggaaaagctgcccttgatttgaattctggaatctttccaaatgtagcaactgctaacgttccactatcaactgaaagattgcgtgatgccatccgcactgaggccatgcatgctgaccatgaagttaagaaatctatcaagtgtgaggaaacaactgctgcaatcccaagtcctgcaactgcatcagtaagtagtcgctgctcaccactgatggccacaaagcaattgcctttgggagaccgtgatgctagccgcgctggattacgtgtatcagccagccagccctcattgcctactgaacctgcatgctgtaatcctgatgaggctaatgttgattgcaaaccaacaatgagtcatgtgaattctcgcaatgctgttgaagtttgtggttcattgcaaagttcctcgaatcctatacctgaaccatcgatttccaattctcggaatcgttttgggtttgatggtatgtcacaagggagtgctgaaatggactgttcagaagatgatgacaatattgtatcacatctatctactaccaataaacctcatggagggacactagggaacaatcaaacctctgacagtatgggttcgggtagaaatctacagaaggaacatgacagtaatacacatcagaattgctcatttgtgacaaataagatcgacatgcaaggtattagtgatgacaagcgtattaatgttaaagatggtgttttccctcattcatgtcagaacagtcatcaaagtggcaatgttgtcaatgaagagtccaaaaataaacaactattgggatcagataagaatactccaatgaataacaacgacagtaccatacgtgttaagaccatcacaggctcaagtacagcagatacccgaaggttatcatctttggaaacatccacttcccctaaaattgaatccattatggaaccttataaggaatcaggcagctgccttgagaagagtacaactcctaaaataaagtcaaaagggtgtcaatctccacttggtaagcaagctgctaattgtagcgaggaccatgcggaaaatgctgctgtgaagattgagcattagacagtaagtgaagaggttgccaaagtcttagaattgcacccaagggattctgtcctaggtgaagattctcatcctgatggcgcttcaagcagtcaactgcacgatgagtgtggaatggtaaagtcggcatctgagaggtcagaatgtgataaatccaaacctgactcttgtaggacaacttctgtacagaatgaaagagatggtcaggttgacgacccacattggagagggatggggcatccttatgtcaatgtcaataggtatgattcttgttgttttgtttcttttgtgggatgctgcagtaagcgggactgggtttcctcatccatatggtaactatctgttaggtattgtatttggctggagttacaaagtctttgttttcttctcctctttgtgcttattttacaggaatgaaacatgggagaggcttatgcagtctaagagagagaagaacaaaggagagtaccatggtggcaggcatgcgcctgatacattcaatcaacgaaggccagattaccgttatggtggacgtggtgttggatcccgtggtaatccaaggaacttccggggtccaagaatgaatgaatctgaactttactttgacgatgaacctatggcccgcagaaggcgcccctttgaagattacctagggcacatgcagcgaattccacataggcgacaccgctcctcgccaatgaacaatcagttgcagggcggtttgatgagagatatggacattgatggtttctctggaagagatgttccagaccctaggctgctggcacatgagcatatggaagatctatctgatgacatgatggaggagaggttttatgtaccacattcccgtcggcatcatatacaaggtgaccatgcattcattcacagaaacaagagccattcacctgggtagagaaggggtgcacctatgcatttacatagaggatggtctcctgaaacaatgggcagatcaccaccattaatcagaactgacagaccatacttacctcatcgacaccacacccgccgccatggttcgccctttgaccgaattgagcatgatgacagaggtatgcaaagaaacatgagaaggtgtggcatgcatcatggaggtgtagaaggagactccttcgagccacatctacatcctgctcaattagccgaactacatgcaaaagctgaacttaccgagagaaggaagtttggcgagaggagaggccatcatctccgaccctttgaaggcagccccgatgacgacgaggtcatactttcctacggcgcggatggtgacatggacttcgccgaaggtggcagcggtggtctgccgccaggagagctcgacggccgcttcaggaggcacatggggagggatgaggaagaagaagaccacatgtgtcatggacctcatgggtggcgcgatggcagctctaatggcagcagggcaaagaggaggaggtactgacctagtcgcacaactgtgacagctgcgagcctatctaaactaatgcatagtggcgttttttggttggctggttcatgcatcaccgactcaccgattctcttaaccaaaccttgctataggtttgcaagcatgtctccttcaatatttatggcttgtttctttcattctttcctcatggaagtacgctaccctgcagcttaacacccacaaggctgtctgaagtactactatatttacactatatatctcaataaggtgatattagcatgtggacatggtcacatggaggtgaaactgacatttcaggacaaatcaaagtaaacgtggacttgtctttgcccctctagcttgccttttttgcttggtaaatcaaattaatttgaggaaggagaagaatatccgggtcacaaagctgctttgcatgccattggctggtagggtccttttgtattgaagtgagctgtctcctcaaagtttgctttgatctgatctagaatgaagatgggatagtggggttatacggagtactcttacctagtagctttggtgttttggctatatgctttcttggactagatatttgtttctttatcggacaggcatggccaaggggcaatttaatttgcgccttgtaataaattattgcttggcatcttttcgtagtgtgtggacaaaggtacgcaagttgtgaagttttgacaaggacgacatggcccgggatgtgtcacatgagcaatacctgccataccttggtcgtaggagctaataggaagcagccttgaagcatagcgcctccggttggtgaagtcaagtcgtcgggtcaagtgttaagaaatttaagcacgacgcttttcattggctagtctgagtcggcgctgcctgatgtgccttcttgccgccttcttcgtgctggtccaatgagatgcaaaaatcagcaaatgtaaacagtttccgccctgtacggatagcggtatatcgcccactggtataggtaatagatgggggcaaagaagttgtgcgagctccagcacgaggaatcaatcgtggttggtacgaggaaacgaggcaggtaatggcataattgggcctcgatctcatcctgatgctaactccacgcgaattcacatcttggcatctcagaatttgagaattaggttcctcaattatgtataaaggaaggcagttcttatcacaaacaagggcgtaatatgaagagtacagaaaggatttctctttttcacacatggttaaccaaatttcggtggagtatttcacagcgcggtttgtcgataccgtaccgtaactcgaggaaaaagaaaccaccctaccaaaagccaaaataccacgaagtgaagtgcccattcattcaccagtctgtcgtcggcattacgggactggcgctgatctgctccttattatacttacgaacacgacggacgacgctggtccggcagcagaagcatacaattgttgcgctgaagatttcccttccagaaccaaatgtgggcaagcagcctgcagcatacgcagcaacatgaggcacaatcatgatactattgaaaatttccaaactcaatgaattagggcgaggaaataaaaattagtccacgtctaacggcacgtctcaatgtgctctggctggcaggcgacgtacttgtgcggagggaggactgaggaaagggattgattctgtaatccgttggtaagtcttgccgaaattttgtcttcctcaactacagccagagtttgtttcggaaatgctctttgccgctcgcccgatgcgggggagccggatcaggcgctccccccgcgccccctcccccacgtgtctacttgggcccacccacttctgctccccttttttctacaaaagatgtttcacctagtgtatttacaatgtttcactatttatagatctaatgttgcagtgaattaaaattctcttttgcaaaaaaaaacccacatattttggaaactctatattaagggaatttggtttattttttgttccacctaaaatgtttcacctagtgtactcacaatttttcactatgtatagatctaatgttacacttaacgaaacatttcattgcaacaaaaagcccacatattttggaaaccccctattaagggaatttggtttattttttgttccactgaaaaatgttttacctagtgtactcacaatgtttcactatgtatagatctaatgttgcagtgaactgaaacattttttcgctatttgctgaaatattgtttttatacaaggtgaaacaacacccgatttaaacaagtgaaacatttttgatctacttagtgaaacaattctgatatatctggtgaaacatcgtgcaacatttaaaaataattcaataataagctaaaaaaaatttcgtcggaatatatccatgtgtggtcttgttttgaagatttaattgcaacgaatttaatggtgcaatcggatcatgatttggataagtaatttaagagataaattagtttaaagtaattttgcacgtaaattggacgctaacgtcagcgcccgattttacccctcccgatcgggcgcccaaccgggagtcatccccgtttgatttgggtcccttacccacaaatcctttctttctatgtagttggaacccccttagtgcaattactactataaagcagccaccaggttaagccacgtcatcacaattatctcagctattagatataatctagatgctaaacgattatcgaaccagcccccttctctctgaatcctacaaattcttagtggatccaatccccttcacagctagcctgccgcatctacttctcccattacgataagcaattgtgcagcagaaactgcctccaataattatagcagcgagaccaaacgtcatggttaatcagatttattctcttccaaagcatctttaaaatcctcctgcagccacacataccagcgctctcttttgcagaccaaccggcccccatatttgatcatcagatattgcatggtgagtgatatatttgctatcatttttttcttattacatctccatattaatttacaagtattatctttttttcccaagggcaatagctttttctatcaactaggtgataagtgaataagtgataacatatttgatttgatgatttgatcggttcatttgactctgacttttgattcgatgctgatcttgaaagtaattttgtacaacctccagattatattgccttccgttgttctatcaaccgcaggatagctttttgatgatttgatcagtttaagtcctttctttatttcactctgatttaaatattaatggttcttgggcaggtatagaaatacgatatgggcatatgggtgtgctccaagaaggatgagtcaatgatgaatgtgctaattcaaggacaaatttgtagcagattatagaacatcgaaggatgcttatatacaatgattggaatgatatgttgtcaatggtctacagttttctttccggaaaatctatgcacgccatcaattagctatactgcttagttgttcgtctgttttgcatgtgaaattttcatagtttcaaattggaattcataagtatcctagcagttgcttatatttgtagtgctgtgtatttattcgtaaactacaattgttatcatctttttcagacttttcccttgcacattgtaggcattgttgctaagagctgactgttaaataagaacagttccttccctttttttttcttaaccagtcaatgaatcgaaagtttacggtatgtcctatgattgatacgatgggtgattctacctatacaacaagaatagccatatttcttggatttatattctatctggacaattgtatctccactatataggcattgccctgaaacaattagtcatcaccaatttgaattaatgctattatgtacacacccatgattcatgaacaaaaccaaaagttgtctggttttattgacttttatctcaatctttcacccattcttcagttgtatttttcatttctcgcggcaacacgtggggtatcatctagttagatatatgatccttgactattaaaactagtctattttcctataaaaattggtctattttgcattccagagtggtttggataacaattttatcgtacgtgatgtgatctttattcaacatgacgcctacgtggtgcttatgtggtattgcacttaagaaaaagtaaagtaaaaataattataggtgtcgaatgtcagtaaccctttgtctgctctttgtatagtttatatcctaggacctatttagggagctttagattttaataagtagctagtggcactccgctgatggattttggttttggcttctagtttttttttattctaaaactataataactttttagaatctacgtgaaagactcgactgtttggaattgtttttgattatgagagaacctgcagtctgcagttgtcagaaggacaccaaacattgtcagaaggacaccaaacaagtcccttgaattttctctcctcctgtgtccacggaatcattttttccaggcaactaccacgacagttgatggaggagacgatggcatggtggaggacccaagcaaagcaggaagcccggtgcccattgcggcggtgcgcagtggagccatagattcaagacggttggtggcggcggcggcgaagatggctcctcgacgacagtcacttccacgctcattggttcttcgcaaagtaatgacactcgactacttgatgacgatgaggcagagctccttgccaccagccttactctcctaccctctccaccctccgcgccaccaaccttcctaccatcgacggaaacgagcggactccagcacaatgcgaggcagtgcctggcgatgatggtgatgaagaagaagatgcgtgaggggaggaacttgcgacgaccacagcgaaggcctgagtcctagtggcggcctggcgggacccatcctagggaagaggaggaagggttgcttcccgccattccccctagccatggcatcacgg

SEQ ID NO: 74149 - DNA, 12731 bp, Oryza sativa
ctatgtgagctgctcatgtctccaaaaggattaactccatcagtactcagggcaaatctaatgttccgtgtgtctttagcaaactctctgtactgagcatcaaagtttatccactgacgagcatctgccgggtgtcgaatcatcccatccttcttgtgcccttcttcatgccagcgcattagttccgcatctcgcggattttagtatatccgtttaatgcggtctttgacaggaaggtaccacatcacaagctgcgggatttttctctgtcatccctcagttgtgtcagacggttctaggccagtattgctattcgatttgtatcgtgtcgcgaccgagaaaatttgcattttcccgaacgctagtgtattaatccccgtcccaggaaaagccggggtacaccacacaaacatgatacaaaaggcacatctttattatatcgataatatttacattattacaaagacactttaggcttgacaaacaagaataaacagcagcggactagcgggcctatggctccatcttcacaggcgctcaactggggtataagccaggactccacctaagacttcttctccaaagcttctcttactgaaggggggggggaaagattgagcaagaatgagtacaaccacagtactcagcaagtcccaccgggagatgcatgattaatgcgagggagtacaaggggtaataatataggggttaagttttgcagtaaacatcatttaaaagtcacttagttgcccaaagctattttgtaaacacgatcctagagctatacaatattattaatccaggccgtggaccctcacgaacctgccttaacccaaggcctacgatgattcagaccgaactggcaacccgaccctgggtcctagctcgttccaagccaacccaggccaaccattccacattttagttgttaagcaagttttaagaattaaaacactaacttgggtacattgctaggcttgcccataaccgagggcacggctattcgaatagatttactctgatcagaggtgtacatctttacccacaagacacatcttcctcacgtgtaaccacgtgccacataccaccacggcatacggacgaaagacgtgacatagttaccaacccatcctagccataaacaagagtaccgacccagccccgccttcggccggaacctccgggacaggtaggcaggattgagcccctagcagcaggacaccagccctatgccatgacatctcgactaccgggccgcagctcgtgtagccttcatttgtcctagagatgtccatcgacccccgacttcgtccatctctatccgtgtacctttgtttataaccagactgagccacaaactaagccttacccactagacatgtggaagtacggtagtgctttgcaacagaggcccgagcttaatccttatattagccggggtgctacttcccacaactggcatgcacccaaaccccaccgaaaaacaggttttaggggttttgaaagaggaagagaggtgtatgtccaattccaacataatccaaccatcccatagtgtccaagtgatatgagaattcccaaagtctaaagttataaaaccacctattgttgcctaattaatcagcgaagcatctacctaaattcatactagtggaaccataaatagagtacccactagttggggttttgtttatcctagggtgaacaaggtaataataacaatagcaataataataaggtcataacaaaggtaaataggcatggctaaataaaacattgataacgcaggaatttaaataaagcgataatgcattaatttaaatcaaaataattttataaactgagattcaatatgctcaaggatgatgtgacttgccttgcttagagataacggccttctgaacctttggcgatgaccgcgaaccacgcttcgagaacctccggaacgatagaagctacgcgaagcacacaagcaaagctacaagcctataaagaagcaataacaatacataaaaagaaagcacagggttctttaggttataacaaacattaggagacttgaacgggtcgattcggagctcgtatgaccaagacatgatcatccgaagtttaatgctgttatatggagatttgcggattattgtaattaggttttacaactataaaacatgtgtaagcgctagcctggaaaagaaaggaaggctgcgccattgacatgcggaccccacatgtcaacctaaaggaccgcggtagaccgagtacacagagacggtccacgggtcgacggaagcggaccccgtgtgtcaaccgaggcgagaggccgacaaacggacttgactagacaccacgcgagctgcacacgtgaaaccacgcggctaccgagcggacacactaacacggtcaccacacgcacacacgaacgactaccaacaccggtacacgggtaccagggtcgataaccgcacaacgggcacggggcgacacaaaaagagcgaggatggggcagcgaaggagagatccttaccaccacgcgacgaggcgagggaacgacaacgacgaacgggcgcggtggagagggacgggaacgacggagacaaacggcgaggggacgacttcggcggcgatccttggacgaaggcgagacgcggccggcacaaggcttgacgacgcaaagccgaggacgaagacgatgacggggctgcggcacttgacggagcgaggacgacgaacgagaacggcttgacggagggacgaacgccacgacgaccgggaacgacgggaggacgacgacaacgacgaccagggccggcgaggaggcgacgtgggcagccggcagcggctgcacagagacgaggatggcagggaacacgccgctgcgaatccgacgacggaggcggcgcaacgagacaacgagccggcgaggaggaacgatgacgacgacgacgaacaccggcggggttcggtcgaaggggaggcgaggccgagggcgaccttgccgctgcgatgccggaggtggtggtggtgcggccgacggcgcacgggtggaggaagggccgaccgggggaattccggcgaggcagatggagaggccggcgcggcacggcggtgttccggctaaattagggcgacgccgtggcctagccggtgaagaggacggcgttccggtgccgggagaggtggtggcgacgtcggccggcgcacaggagacgcggcagaggcggccggaggcggaacagtggtgacaacaccactgttgccggcgggggcgcacttccgggggtctccacgcgaaacggagggcaggccgggggagaggaggctactgcgacgccggggaaggcgacggcacggccggccggcgcacgggcgggacagcagaggccgctggaggtggccggcgctcggagagagagggaggaggcggggaggggtggtgaggccacgggagagcgcgggagggggctaaaacgatagaacggagcgaggggattccgttttatagcggagggaagcgagtcgagcacgggaggagcggggaacggcggcggaaaaggcgcccggcggccatggaaggcggccatgaatggcgcagccgttccggtcaaaatagtgcacgattaaaggggagattagggggaaaagggagaagaaggaaaggggattaattccccccaattaattttggaatccaacgcttaaatcgcgcttattcgagggaggaacgaactagggttttcacgggagggagagaggagctgtgcgggaggaggacgacgattgggcgggtgggacccaccggtcaggcgcgtggtcagcgcgcgtgcggcgcgcgcgtgacaggcgcatgcggcgcggcctggggaggctcggctgggcccggaggtggcccaggtgggagggggcagggcggcctgggccgggcaggggaaggggaggcccaagagaaggagggaaagaaggagagggagagaaagagagggaggaagggaggactttggccgtgggccgagagagatagagggaggctttgggccagacttggcccaaagggaggagggggattatttttagtttttctttttagtaaactttgttaattgtttttgttgcttaataattatttccggtgctctgaaaattcaagtaaaatttgagggctcgttttagactaaggagaatttaataaaaattctctggaccacattcgaatttttcttgtacgtattttagtgtttgccaatttcttttcgaattttaattaattctattattccttttagaaaataatttttatttcgggatgaatttatcaggacgtgacataccggctagcaccgcatgttggacatttatctaaagaagcgtactctttcctgtacagtatgcagtgatttacgcacgcatgaatcttttccacaccaagtgaaagggggtatatgagtttctttgcttgatatgtgctgtatggtagtgagttaggcctcgggagcattttctgcagaagttctaacaaactgtcgaaactggtatcagaccatccatgtctcgcctttaacctcataagttcaagaactgaccggagtgttgtgaactcactgtcacagcccttcgactcatcgtacaaaacttcctttgctgcaaagttatttaaccctctagccgaccccatcagcacctcaggttctacatgatgtaacatttcctctaggtcgattttgttctcaacagaaccatcgtcatgcaccatgtcttcaacttgtgtcggaactacattttcaggcccgtccacttgttcttcgccatgacgtgtccatatttcgtacttgtccataaatccacgagttactaagtgctccttcactttaaaagcatcgtcgaagtcccaggctatttcattcttgcagtcagcacatggacaaactatcttcctcatattgttcttctcagcgtgtgccttggcaataccaataaatttagacacttcgtttctatatggagacaaaaacctcggccaatgatacatccattcccgactttccatatctctaaaaaaatacacataaaatatttgcacaattaataccaaatttgtagggtttattgaaaaaacttatcgctattcaaaactaattaactaaaggttaagtgcaaattaataaaaaaatcaaagtttatttcaatttttttacacagacatgccaaattagtacattaggaaaatctaacaaaatcatatcatcggcatattacaaaatactataactattttttgattgcaccgaataaatagacattaaaaattttattctctctctatatatgacaagatctagatctagatctagaactaggaagtggatgtgatagcaaaaataaaaatctaacatcaacatatcaaaagaaataaaattaaaaaacatggagctcttccttcacaattttgcatgcataaatccatcacaaattaaggtctaaaagcttaaaaaattgcatacctagtgtggaaatgagtagatctaagtaccgtagaaaaatctcccgaagatttgaagttcaaaacctcccccctatatttaagtcactttaggagagagaaacttcggggagaatgaacagggctcggggaggaagaagactatataggggcatcttttcaggcgggccatataagcggcgcctgcgaagattgatcttcgcaggcggaccgccccctccaccctgggtacttttttttgccggcggggttttggctccgaattacatgcccgcctgcgaaaatcgatcccctacgacgccgaaaatgagttttctagtagtgtgactagtctggccctcttgtgttgcattaaaatcaaattgccacggtcttcaaaaaacaagtgacaaacatttattggcaccacatcacagtctactttatgaacatattgctcccgatagaaaatgcatctctccgctcgattcacccattaattgaatataacacggcataggaagccttctcatagacaaagataaatatgcaccaaatctaaacggatagcattagtgaaagtgccaccacaattattaatttgcataccttcccctgaattttgcactctaattaaaaaatattacagcactgccccttttcatcaatattagagctatcttgctgtactacgcatggaagcatagataaaccattattctgtttagcaccatcatccattgataaaacatcaaaatctcaatagcatgcagctagagtatgatcaagatgtacaccttctgaatttttctgatgaactctcagaaatatagccctctctagttatcaatacatttttctgattagggcaatctctcatgtaatgtcctcttctccctacaagtataacactgtacacttcatgattttgaaccagatgcaacggtagattcaactttagatgtggatttattcaccgaactagtagcaagtttagatccatctctagaaggagtagtcgacttgaaagagactgacttactagcagcacatacattactgtctcgctgaaaagaacatgaacggctagtgtgacgactctttggttgttgctccaccctctgagatatgttcaccatactttatatatatctcctattataaaaaattaaagatgtttctgctggaattttggtacgtcgtccgtgtttgagttggttatatatcgtccaaatccaattcaacgtgtgtctagaataactattatacacccctatcctagcccaacccctctccctcccagcccaacccaaccggcccacaccattccgcttccccatcttgcacgctcctcctatcgacgtctttttttcctctcctttttttgttttgtttttctcccaataatcctgatcgtctcctccttccaatcccatctcttttcttttctttttccttatttttttctcttccaaatttctctcctcaaatattttccttttgaatttatcattgtttaaggtgcatacacaagtttgttactttgcaaatgctttccatctacagaaaaaaaatatttactaattgaatgatcaaaatttcaatatttggtctacgaggtataacaaaatgcacatgtgtcaacttatgaaatagtcacccaatcgatttttgaggctatgaaaaagtgtacataagagattcttcgtgtggtatacaaaagattcatatcttggaaataagctttgaaaaggtttatttttaaaattaaaaattttaaaagttcaaaaagtaaaaaaaaaaaaaacttgtgatcggctctccccgtccactctgcatgcacgattggtgattgggagtggctgcccgctcccaacttgtgaagagcagaagtaaacaaatatgttttttttttgaaagaagggaaaaagctttacctcttatacattgatagagcaggagaaaaccgaaaaagttatatacaaagcccaaggaactcaagcccaaaggaaaaggtagagatctacactcccgctggaattgatctcggttagcttagccgctcccactgcgatccaagctcgctcctcctctttaatcttggcaatgatgatggcaggcatggatgccacttgtctgaaaattctggcgttgcactcgcaccagagttcccacgccatcaggataatcatcgatttaagggccttcgtaggatagtttgttgtgcacaaaatttttcacaaccagtcttccactgttgcgcattccccccattcttgtaggcggaggtctataccagtccacctttgtgcttcagcccaaattcttttggagagcctgcagcctgcgagtaggtgaagtgctgactccggcacagtatggcagagtgggcaaacacgctaattagccgaacttcttttctgcactctatcaaccgtccaaaccctattctgaatgattagccacgagtagaatttgcatttaggtggggcccaacatttccatatggtctggttgtagattgtagtagccacgccaagaaattgcatcccgtatgccgaactagtagaatagatgacatttgttgtcagcttctggacgatggagtcccgctggtcggatagcgggccaacctgttggatcaagttccaaagacagacatattggctcaggtggtctgcttctgtagtgtgcattagatctatgtccctaatccaattgttgtgggcaagggcgtcgtgtaccgttcttgatttgcgctttcaggccgtgaagatggctggtgcgatctcttttggcgctttgttgtccagcgagtgcggtcccaaaaactagccatcttcccatcccctaggatgattgttgtcgccgctaggggtgggcattcggttacttcggtcttatcggttcggtttattcggtgttttaaaagttcggtttcctaaaactacaagccaaaattctttttttcaaaacaaaaaccaagctacaaaaactgatgtaacttggtgcggttttttcggtctacggtttataccgatattgagcgcggcgctttgctcatgggggtggcggtgtcttgcggctagggttagcatcaatagaaaggccgatgcggtgtgtttggatgggagtaaatattgggtaagatgagatgaagctgggttccatgttgttgttgggtcatgggttgaggtgaggaagtggaggctctagttcggtgttttcagtacatgcggttttctttctaaatgaaccgatttagacaccgaacaccgaactgcgctaaaatgaagaccgatgagaaaaccaaacaccgtaaaaaccgggatgcgactacaccgagaccggtatcgcgatagggctatcacgcgacgtgcgcaactggcgattccgcgccgcgcgcgccccatgccaaaaatggaaaccactttttcctgggcccccgcgtgcgccatcgctaaaaatggaagggaaagcgcgcgcttgcgcgcgcaagcgccgtgcgacgcacacgtcgctagctggcgtgggccccacctaagacagcacgatgcgcctctctcccccactccaacccatcaaatcgggacatccggcgacatcaatccccacacagtcgccacggcggtaaaaatcagaaaaaaatcgctatcttggaagtggggacggaggagaagcaaatccaagaaaatatccaggtaaagtacacatgaagtttaaattatgtcttctttgagatccatccacaaaaaaaaggaactaacctagaaacttttagatcttttctgtattcttcgagaaatgaattgatatgaatctgtgctgtaattttgtaagtaatatcctttttgatttctatcttcctttataccctaaattcactttctagtgctgctgagaaaataagttgtagaaaaggcatgagtactggtgtttcaaaaatctcaaagcaatttctaggaacatgctacttacttccagataaacttgaattcacaatccctagtttaaacaacatgaaaacatctcatctagttgtctctcagtgcaatttgaacagaaaagttaatttacttcccaaaataaacttgaatttgcattccctagttacataggcatgagcgctggtgttggaaatctcatagcaattttacagaagtctcagtgcatttttaatagaaagttacttctaacacttcaatgagttacttcctagaaacattaagttacttctcactgtgcattaagttacttctcactatgtattaggttacttctcatagcaattctaaccgtctcagtgcatttttaacggaaagttacttgtaacaattcaatgagttaccacctagaaacttgcaagttacttccctataaacttgaatttacatttcctagttacacattttgtaccttgtttctatatacagcataatgcatcacctagttgcgtctcaatttcattttgtactgcatcaaaacaaattgtgaaaaaaaaatcattagtatagccactggtcttaatttgagaaaattgcttcctagaaagcatctaaaaaaacagaaacatttgtatcggttatttaattacatcgagtccagttataaagagttactatcctgttgcatgtaacttacttccaaactgtactggcttacttcaaaacatataaatgttactccctctaaaacatgcaagtaattttctataccacagatgaaattgtctgacaaagttactctgaaaacataaaagctttactttcatgtgatgtgtaagttacttctccccccccaattactaaattacctcaatgaatgctctgtataaactttgttactaatagcctgaaacacatgcagcaaaaatggattttgacctcaacagtatcccagaattagtttctggtgaaaatgaacctccagtacaccatttactagttgatgatgaagacagaagtaaaacatagttccctataaatccacctgacactagcatggatgattcctgctataaatttggactacacttttgactttgaaactatgtatacttctggtgatgttggaagtttacaagcacacaatgtagccaatgatgagatgcaagtatttgaagccaatgatgagatgcaagtatttgcaaccaatgatgagatgcaagtatttgaagccaatgatgagatgcaagtatttgaagaaatgtcagatcatgcagacacaatgcatactagtgttgcaactggcgcaacaactgctactgccaacacaatttcaagtcaagactctggaacagatgattcagaagtgccgtacctcatcttgactttcaactcagaggaggaagcaagggctcactacaacaggtacgcaaagcgcgttggattttcaatcaaaatcaacactgcaaggaagtcagccaaagatggagaacgtgacaaagtaatgtttgtttgcaacaaatgtggtccagaagaaaaaacgggtgaagcattccccacaaagaaaaggaaaataagtagaacaagacaggctgcctgcaaagcaaggatgacagtgaagaggaaaggagctaggtgggaagtaattcagtttgttgaagaacacacacatcctctggttagaaagttttcactcaagaagttcctaaggtcacatagagcaataccgaaagaggaaaaagatttcatcacaatgctgcacggaatgaatctctcagctggtagaattatgaaattgatgtcggaattgtatggaggggctaggaatgtaccctacactagaaaagacataagcaatttcaagtcaaagttggggagtgagtataggtgtagagatattcctgaaccaattgctcacttcgaggaaataaaaaaggatgacccaaatttcttctacaagattcaacttgataaggaagacagggtgcagaacatattttgggttgatggagcagcaagaaatgcctacaaagacttcaaagattgcgtctcgtttgactgcacatacatgacgaacatgtataacatgccttgtgcaccattcattgggataaacagacatgggcaatcattacaggtactcctttttttttgcaaaaaaattaattctaaaatatctgtaataactttgtacattatagtacaccataagttacttgttgcattcattgagttacatcaagtcctgataaaagttgcttccagtagaatatgaagttacattttttttaaaaaaaaaagtaaaaaagtaactaagtttacaagctacatcttttagtgtctgttctatagttcaaaattgtactgatttacttccagcaaacacaaactgtacaaactacgcaaaattgtagtaacttacttgcttcaaaactgtactgacttccttatgtgtattttttttgatattcagctgggttgtggatttctaaggaatgaaaagacagaaacctttgtatggttgtttcaagcatttctagagactatagaaggtgtaaagcccacaaacataataactgatcaagacttagctatgaaggcagctatagcgctagttttcccacatgctaagcatcgcaactgccgctggcatataatgcagaatgcttagaagaagattggccatatattagatcatgacaaagcattgtgtgatgcattcaatgactgccatgacaacagctggacagagtaagagtttgatgctaaacgggttgcaatgttgacaacatatcatttagaagataatgagcacttccgacacctttgggagatgagatagtgttgcgtcccagcatactttatgcactgtttcttccctttcctccagactacagcatagagtgagggatttaatgcagtgctgaagcgctatgtaaatccccaaaacagcatatacaacttctttttgtagtacaagaagattcaagaaaaatcactgttgcaacagatcagaatgagtttgaagcagaagaaacaatcccttctatgtgggcttactatccgatgaaaacaaaagcattggaggtctacacaaggcctatattcaacagatttcaaaaagagctgattgcttcaacatcatataaattgacccgaacttctgaaaacatgtatctagtagaaccgaatggaggtcctgttaggaattatggatcaaaggcattcattgtatctgcaaatgtgttggacaggatatacaactgtgaatgctgtaagtttgaaagggatggcattctttgctgtcatgttct

SEQ ID NO: 74150 - DNA, 11507 bp, Oryza sativa
  unsure (1)..(11507): unsure at all n locations
tttcattccacattagtgggacaatcataatgctgaatgcaatactccctaatgctgaatgcaatacttctcgtttcgcttctagcaacttttcatttcacattagtgggactgtgggagaatcgtaatgctgaatgcaatacttctcgtttcgcattagttctagcaaattttcattttacattagagaagatacaatagcaggctataagccagctataaatatattttaaagagataaatgaaaagagagaaaaacagcgaactacaaatttgtgtatgacatgtagaatcaggtattaatagtatagtaagtaactattgtattaattgactattacatgggctatatataatttaaagctagtagttgactatattaaacttagttctcgttctcgcaacaaattacatcgactctcgtgaactatatcccgatcatttatcaaagtagcattaacatcattacatcaactttgattaacagtagtgcgtagctgcattaatgaaggctagagaaatgctttgaggtgagaaatgacaagtgtcttgataagacaaactgaatgctagaatggcagcaatctgaaagagagggagtaagaattttcatgcccgtcaagaacaaacggatcgctggccattgcacaacatacgtgcagttgcgcacatcatgtaatatcttgtaatgattttcatgagtaccgcatatacaattgtgcacatcatgtaagaccttagaacgattttcatcaggtgtactgcatatacaataaggtacgggtagtaccaatggaccaattcaacttcgtctataactaaacagccatttacaattcttaggggtttataacttatggtaagcatagcagccgctcagacaccgaatggggtagtatagctcttatcaaatctatgcacaaacctacctaaaacttgccctcaatgtaaccggccagaccattgattttgaagaacttcttgatcacaagggccataatagcaagagtgagtccaaatgcagccaaggtcaataatctgtcatgctttggcttctggattgcaacaacaggattctgtggcgttggagcaactcttggaatgttttctctgctcaagttggcccttgaatggttgctaaccccttctgtccgaccttcaacaatgtgttgtacaatttctgactcagaatcaggccttggaaggtcattattaacagagtctgagttggacccagccgtgttcacgcctccaactgccttgtgtgcatgctcatcagaagcatcagatgcaggcaattggttagtctcctcattagtttcatttgtcagcagctgaggaacagggggagccctactgagcatttgctcatggatctgtcattgcaacagttctttgcatcagaaacagaacaggtgtgcgtttgttcttattaaacaagtgttaggaatttacctcatcaattactttttggcgttctgcagagccaaactttggtggtgtttcacgtgatttgatagctagtgcccgtctatcttcctttttgaagtccaacgaacccaatgccccaccacctggtgttggcatgaatgcaatcaaagctacaagagctgtgcgcactgcaacacaaacaatcgggaaaaaaaggaattggtatcagctggaggatcaatgccataatggtttctaacactaaattggcaatccctcaatgggtaactaatatattatttgcggacatagcacgaatatcctccccaaagaattatgaatctgtacatatatatactcactacctatctaacttactcccaaccatgataaattgcaataaaatcaaaagttccgtattgaggctatgacgctgtcttaaaaacacaaaaagtactactattccttcacagcaaaaagatatgcacaggacagatataaaaagggaaagcacatgtccctcctttggtccagtcatgtgctaaacacttgctacatgacgattcctgaaagaaccaaagaatagtttcatttggcaccatgctcgtatagtacacatagtaaatatttgtatactatgaaaaatggtgcccaccatatgaatggatagaaaaaattacatgccaatccttggttgtattttaagattgaataatttggtgtacaagctttagcatatatctctcattatacaccaactgacaaaaggatatgataagcagcaaattgtaaaaaacaagaacaccatggactgcctattgtatcttagcagcattgaaaggaagctgctgaacacaaagttttgtaagaactgcagggagaagtgcatgtttcttttggcctggtcatagggcaagtactcgcccatgaaaatcacaaagaccaatacaaaaagaaggcattacttttgcaccatgctcgtatagcccacaagaccaaatcaccgtggactatgaaatatggtgctactcattgcattaggtaccccaacgtaagggcttacttgaacaatccctttcgaaacaaaatgctactcagtactcaccactccatgatggttgccagtgctcagggtggtaattggatatgctcaaacaaatcttcttttgaatctcaaatcttccacttggctgaataacagataaacatataataaaaaacaatatttagcaagggctcacaaatagcatggtgagctaacgcagggaaattacagaccgtgagcagcatgaatgatggtggcttaaacggatagtccgatggcagctggatccttccatggtagattcctccctcaaactcactgtctcgtggccccaggatcgcaaattgccactcgaagatgtcctcctacacaaatacatacatttaaatcataaaaaacacatcagcctcgatcagaataccataagtaaatttgtaatccgaaaatatatcatggaaacggcctaagtaatactggaatcccacttgattcacacaccagttaatcgaaatgacgtaatactacccaatatcaagagtcatcctgcatacgatgatctaatcgcaacattgatatacgctaacatcccaacatttcgttattgcacaaactgcacaatcagatcaagaagaaatgcagatgaacccccaaggtcaacgcattaaatcaagcctctaaatttccgcaccctaaaaacgccatcaaaaccagatctcgccccactagcgttcgattcggacacaaccaagaccagatcgggcaggaatgtaaatgcaggatgcagggttaggatcggggacctcgaggggcatggccatgaagtccggggacgggttggactgcatctccttgacctcctgaaggatccgcttcaccgccgggttgccccggttgtacttcgccgtggcctccatctccgccggctccgcggaagggaaccctctcgcctcgtcgccgccgccgccgccgcttgccggtgcaggcttggcctccgaattggggaatcgggagaggggaggaaggagcggaggagtgggaacggtgggtggattaaaaaggaggaagagctggttctggtctttccctggctcgtgggaccggttactatgttgggcccacgtgtcggcgagggcagagtgggagggggggcgacgtggatgggctaacgtggcacgtcgctattggttttataggtcgtgcggtgagtgaatggaatattccgattggtttggtgcgttgggccagctgggcggctgggccttaaatgttgggcctaagaagcttctataatagaggtggttgtttcccttcaatttatgtcatccatcaacaaattaagagctatcatctatccataaattcatttagtttggacaaattcaaaattgtaaaaaatggaaaaaaagatcatataggtagtacctaatttatagtactagtttgtgaaaaataaaatctaacaccatattttgcagacaagccgaaattgaaacttaaaatagaaaaaaaaacaaaaaggctaggccaatagtgagcactgttcattaagtccattaggctcacttgagggggaaatggatttctactttgttcaatgtccataatatagcaaatatcatgccaaaactttctacatgattcatattcttttacatttttctgattttcctctacattttctaaaattatctacaatttttatttttttaaatagttttctagggagagatgggggacgaagccatcgcggcaatgcggcagtggaggcctgaatcaccatatgcttagacacccgaggcatttcaggtgaatcacaccagtaatctctccagaggagcaaactcatctctgaaatgatgaaaaccgtgaagcatccctattccctaaccagaatcagtctctgtgtcaccttggatatgaacttgggtggcgttgtggcactccaggcacaccctaagattcttgattatcctgatttcagatctcggttctgtgctgagaaatccgaaggcaattgccagcttttcactgtgcactttcaaacatatgctccttctcttcctcctcaacatcgtacaatgctagctctgtctcaggtcgatacctagcgtcaaatcgtctttgaagttaagattttccaagtatggcctcacactgtggatgggcacagtcgccggccatgaggaagtttggcttgtcaactatctcgattagtttaaccagcttcctgccttttgccgctgcttcagagatttgcttcttgactacaagtaaattagagagcagaacatagtagccgctgttttctgggggtgcaatttgtgcaagatcgctatccttatggaccatgcaagcaccannnnnnnnnnnnnnnnnnnnnnnnncggtcttggggaattcagaaatgagcttaaaaacctccttgagctggccagctcagccaaggaggtccatcatgcatgtgcatgctcaatacttggaattattgcaaaatgatcggtcattgactggaagactttgcgcccttcctcagccaaccttatgtggctgcatgcatagagtaccaacaggaaggtagcgtttgttggaataaggtttgcatccagcatgtccttgtagagcttcaaagcctcagcaccttggcccatgaaggccatatccagctaattgcattccatgagaccacattcttgctatccatactgttgaagtgaagatgctccgagcttcggaaatgcttccacactatgcatacatgtcaatgagcactgtcatgacataaacattgggccccaagtcctcctcagcgataatcctatgcagccactttcccagggacaaagctccaagctgtgcacacgctgaaagagagctagaaatgatgattggatttggtcacacgctaagtaccagcatttgctcaaagagggcaattgccatctccgtccagccattctaggcataccctggtattattgctttccatgattccgattccgtggtcttctatggcatcgcattgaaggccttccttgcagactccatatcatttaacctacagtacaatatggtaattgctgtcgacactggagaattcgcagtaaatccagacttgagaggaccatgtaagcattgatcaagcagttcattcccaaacagactatacgggatcagtgccagtgctcgagtttggcttcaattccaaggccatcaacccaataaacagattaactgatgaaccaaccatgcaattcgccgagcaaacatagattaagcattgtaggcaaccaaatctggattctccatcaagtcaaagagacgccatgcagaattccacatccccgctgtatacaccgagatcaaccggtcagaacatgctcatactccgccaaccctctcttcagaacatgctcatactccgccaaccctctcttctctgcaagaggcatcctccccaattccccattgttatatctgttgctggtaagaccgttgccagcgtggttgtgtcagaccgaacagactctgcactcgccatcctcacgaacgactccagggcctccgaaccaggaagcccggccggccatcagcgtgttccacataacggtatccggcgactgcacagtgtcgaacaccttgcgtgcgtggtcacctctggacagcatgaagcgtacaggctacagcttggccaatgcggacgccacgaacgtgtcggcggcgtaacccgcgcgtgcagcgcgccgcgcgcgggctgcggagtcggttggagacgacacgccgccgccatgagagcaatgagcgaggtggcggcgaaggcgaaggagaagtagtcgaggcaagcggaagagaaggcggcagcggagaaagcgatcggggcggcggaggaggtgggtgggagggagggacgcgtagcggaggtcggaggaggagggagctgaggtttccggggcgggggtcgagagggtagtgtacggaggcgagggacacggcgaggatctggtcgaggtagcgcagtgtgaaggaaagcgcgatgaggcggagggcgccggcgaagagcggcgcggcggatagcgggaggaggcggcgccggcggggtctcatccgattggaaacagattgggaagggggagggggtaggaatacgtggcgtcggcagtattaggtagagagagaaaccctttccatcctttgtctcttagccccgaaggagagagaaaaatcagaaaaaaaaaaccctccgcgtgtgggggaagcagagctccggacgctggcgccgctcgcgccaccgcacccgcaccgccatggcgtcgtcctcgtccaaggcctccgattcctcttcccaacgccccaaggtgcgcgccctcgcctcagtctcgactccccgcgcccgattccccactccgatctccttccccaatctgatcggcctcgctgtgcagcggccggatcaagggccgtcgggcaaggacgcggccggcctcgtcgcgctgcacgggaagctggcgcagctgaagcgtcaggtccaatccacccgcctcgccgcgatcaaggcaagcgcccgcccgccgatcacgcatctctacagtttcagctcgcagggggaagtgtgagtagtcggttggattttgctcaatctggcgtggattggtttggtttgtggtttttgagcaggagagggtggaggcgaacaggaaggcgctgcaggtgcacacgtgcgctctgttcgacgtcgccgcggcggcggaggtggcgtcgcggggcgccgagggcggcaacgcgctgtcgcggggcgcggcggaggggcaccgcaggttcgtggggtgggactcggcgagcgggccgggggagagggagttggtgcatgtgcaggaggagaatctggtcgccgggacgctcgtgctctcgagctctggtggtagcggcgcctcgcataggaccgtcgtgcagcttgtgaagctgcctgtggtcgacaagattccgccctacaccacgtggatcttcctggacaagtataatgcttctacacgctcattgttccaatcagatcacttgtcgctaggttcttgaacttgcagtttaagttttacaagagttcaggagaagttggtatattgccatgtaatacttcttaaataaaaagtagggtatgccatgtaatgcacctagatatgatattgtggaaaatatactactcaaaattcacttatgatgcatgaagcaaaattgaactatttacccatacaagccatagaaaccagacaacattttcagacagatattgcaaacttgggactagtagaaatatttggaatataagtgttagctcaaacattacactcaggtagtggtgttcatgtgtttttatgtttgctgatgagcgagagcactagtttgtgttaggatgatggtcagtttgaaaagattcagctacttgaacgatgtgtcatgctacttatcttcagtttatttgcttgattaattccaaagtggtatttattttctcatatacgtgctgcattggtgtaacaaagaatacttgatccctgttgtattcgatattttactctggtttaaacaacacagcgcagaaaccaaagaatggccgatgatcagtcagttggtaggaggagaatttactacgacccaattgtcaatgaggctctgatctgcagtgaaagtgacgatgatgttccagagccagaggaagagaaacatgttttcacagaaggagaagatcagctaatatggtaaaaacctggacattcaagaattctctctttttttttcattgaatatgctgtgatttttcccaatcatgatatctttctgttgcattttcttttcaataaaatgattcagatctaagttaaacatggaagaaggcccagagccatgaacttacattaacataacaaaccatccgtgcaaagttagttgcgctgtgcagttgttttactcagtctgcatgattaatccacctgttttctaccttaaggatcgtgcatactctaagagcttccaaccttcatgtaccctgttaattctgaaatgtaggtggaaggtaatgtgttgtattaaatcatctttttaggatggatcaacggatgccattttaatttaaccaatgcattattggtgaaatactggctggtttgactttacacttccagttgtgacaataatctgtaacccaagggcacccttcttttatttaccttttacacaatataatcagaataacaatttctattataaattatactggtaaaaatcggtaatcatcccaatactatccgctaccttcagaataaataaacatttttatatgtaaatttatgtctatctgatcttgcttaactatacaggaaagctactcaagatcatgggttaagtcgagaggttttaaatgtcctctgccagtttgttgatgcaactccttcagaaattgaggttgcccatttctcttttatgaacattttagttcgtcattactattttttttaactctgcagctgttttttattatcctacaatgtgatcatgactcttattccgatcaaaatactaggaaagatcagaagttctttttgagaaatatgagaagcagtctcaatcttcttacaagacagatttgcaacttttcttgacaagnaaannccccccaaaaatttggngaatgtggnctttagattcttttgataatctcttctgtcggagatgtttggtatattatacttctggcattctgttgcttacagttcttttttgaattccatgttttaaacccctttgttcaactacattcgcaaggtctgaattacttgttgatatctatttattcaggtttttgattgccgtctccatgggtgctcccagaacttggtattccctgtaagtcataagttatttcctgttggactcttgtaaagttttgatctttctactttgctcatcctatcaatgaatggaggatgttgtcctgccatttggtccaaagtgagaattaaaaaaataccgctaactactaaccttttgcttaccagagcgagaagcaaccatatggtcatgaacttgatgaaaacaagagaccgtgtggcgatcagtgctaccttcgagtatgtgccccctcaagttttgcagttatatcaattaataaagttgtttatgattcctgaatttgcataatttgccagtccccccctgtgggaatctaagtttcactggtgtggaatattgagattgtattaaaaaaacttcgccaagatgtgtagttaatataagttttgccatcccagcagtgttgttcaaagaaatttcatagcctaggctttggttaaccgggtgtgagccttgaccagacctacatatacttctacaatattaaagcaatagaattaggagtatattatttttctaatgaaaaatctaattaactttatgttgaagatatactattagatctgttgtcttgcttgttggacttcaggacccaaaagtagaccctccatacagtacatacactgttatgaactatggatcgtacaagtggcatcagagctaacaccatggcttctgtgggaagtactttttaaactatggtatcatttttctcctaaactccttcactcccattcggccatgctatctgatgtaacttttagtccgtatgcttatcaacattttcattgacccttttaatgggtttgattgatgcaacttctttagtttatttgtctattgaagcgagcctatgaattattctgagaattgcagcaattgctgcattgttgctaagactgattttgattaaaaaattcacagaggagagaagtatatcaagatacgtgcaatgatgaccgaaatgcttgtacaacatataatatggattcaagatcttcctcactcaaagatagtgctaccatattgtctgaatcagaagattcaaacagagatgaagataacatcaaatccacttctattgttgaaaccagcagatcaaaaataactaattctgaatatgctgacaaaagtgtgacaccacctcctggagatgcttctgaaactgaaaatgtgtcccctgacatgcccctaagaactttaggcaggcgtaagatttcaaagcatgcctccaagtttaacgatcattcacctgatgtaaggcagaagatatataactcaccgattgccttttgcaatgagtgtactgaacaagcaatcggttccagaaattggtgagacatgtccagattccatagaatctgcagttgatcaacttccaagtctggatgaccctaacaagaaaatttctaccaaagatatgtgtgctggaagcacaactaacactactgaaaatacattacgagataataataataatttgttcatctccaacaaggagcactctatttctcattggagtgctttagagagagatttgtacttgaagggaattgagatatttgggaaaaacaggtaattcttttatatttcccatgctatttgaaaatattgtttattgaaaaacgtaatttaattttaagttcataatggtatgccacagttgtctcatagctagaaacctattgtctggcctgaagacctgcatggaagtggccagctacatgtacaacaatggtgcggcaatggcaaagagacctctatctggtaaatccattttaggtgactttgcagaggctgaacaaggttacatggtacgtattgactggcctcgttaggttatgcttttatccagatcaaagaagtcaaaagaatctataactttggctagtctatttttttctgaatgttttcagcacgtctgcattatagtggctgtatttggttgttgttcatcctcctgatattcagttctgtagtcgctatattatattaaatttctttcggcacccacaattaagatggacatggatctttttttggaaacaagcgtattgttcctaaaactggctagtgctagaattgtaggttgtctcatgttttcatatattaggcggttaggggaaattatatt

SEQ ID NO: 74151 - DNA, 1065 bp, Oryza sativa
ttccttgctggagcgcacggaactctctcttctgttgtgccataatcccttcaggaatctgtgccttcctgaagctttgacaaaactctgcccaagtaacctccgttgcatctagacgggtcgccacgtagttatcccaccaggcagaagcgggaccttgcaactggtgtgtagcaaaagcaactttctcttggtcgttgcattgcagtaggttcagcttcttctcaatagcacggagccagtcgttggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatgatctgctgccagatgcaccactgacatgagctccatcggtctgctcttcgctgcccctggcgtcgctggagtcacggggatcattccttgtcttcaccatctggaggggataggtagaaataagagaaaggaagaaaacggatggctcggaaactaatttttcttatgaaattaagtgccattatcttaatctggattaaaacactgaaaaagaggcacacaattcctaattaaggctgtcataccactcacacatgatatcgaccgccgactaacccacaagcaacaaacctaagcacggaaactagcaagcaaacaaaactaagaagacgataaagctaagggcggcgactctgaagcttggagcggcgcttgcgatcgaagaacaggtctgacatctaaagagtacagagggataggaaccaacacatgctcaaaaccaaattaaataaagcaacaaatgactaagtaactcgccgagcatgatgatttttatgcatagaacatttttcatgaacccggataaagacactaatgcgactgactaaaccatagcttaatgcataaacttgttgcatggaaaatgatgcgcataaaattgccccatcgaacata

SEQ ID NO: 74152 - DNA, 1851 bp, Oryza sativa
ttgtgggctaagtgagtgacattccagaacactacatattgcctagatggacgatggttaaaaagcctgaattgcctctagttacaagcattggtgaacaaatgcaattgccccctgaatctctgaagctaatcaggtataccaatatgtgcacaaaatttacacatattgcaaaagatgcatcaagcaacgagaaagcctaccatatggctctacagcgtacgagctcaatgactgatgatttagcagctatgaagcagagtagaaagaaacagaaaaaggcacagccagccccagataagaggaatttcagatatccccttggcatcaactaacccaacactacagataaatgacccccccatcatacaaaagcaagggagaccagtttcaacaagacgcaagcctggggtccatgcaaaggcgtcaaagacatcagttaggaaaggcctagctagtactgagaagtgaattagagctacgagatgtaacttataatgttgtgacaagattgttgaaacttacttgcacagttgtattaaattacttttagcttccatagtagttacttcacagtgatatgtaagttctcaggaagaccatgctgagttctttgcagaaccaagatgctattttaatttgttacccaacctaatttatgtggctataatttatgtgctggttcaggaaaaaaaatgcagtgtttcattaccttaccttaagtgtaggatcaagctctttgccccataatacttgcatccattgcacacgattttcttgaaatgagagcatcttgtgtgtaagtagtttcttaatgttggggatgtcacttggttcaaatgctagcaactgtttgccatcccacaactccacaaatttcggcatataaaaaccacaatcccggctgtttttgtttgcaaaaacaaaaagggataagtttgagtaaaaacaataaatgaaaatcactaactaaaaaaaagcatgttacgtacatgttatcttgctttgggccatcaataaaaatcagtgggtaattctggatgattttctttgaagacctcatgtaaaacctatcctacatggtcttgatggatacaacaacaagattagatgctgaaatcagctcttcgtcatcttctcccctcagcgaatcgtaaacctcgaatctttcagctttcagattaaggcacaccacgaaatagtgaccatccttatcattcccattacccaattcctagagaatgggaaaaattgtctgcattcaagtgaaaagagggagaggagtggaaaaaaggtttttctgtaaatataatcataatttagtaagtataaaaggataataaaaagtgtttcagaataacattttctgtcaatataacagaaaaagttacttccacaaacatgctgagttaatttgcagagacatttaagttacttctacaagcagacaggaaaagtaactttacatgtcattgacatcaggaatatatattttcttactaattcttctacaagcaaacaggaataagtaactttacatgtcattgacagctggaatatatattttcttactaattctttatggtcaagacggttcgctctcgtttgatcgaagtgtttcttaagctcattcctgtccaactgcaaatccaacaaatatccctgcaccatgtggaaaaaaaaacataaggtgttgcaatgataataatagtacactaaaaagtaagagatttttgtaaattttatatactcctattctggcaggaaaaattctcttcgaattgtccttgatatcagcagacagaacaattaatgccaattcacatgtgttattgtccagtggggctgcag

SEQ ID NO: 74153 - DNA, 2747 bp, Oryza sativa
aatgtcgaaacgaccctgttctcaaaattgtatatagacccttttgttgtgaggataccagatggtagaacagcagctcattccatgtatctagcttgttacacccttttgttgtgaggataccagatggtagaacagcagctcattccatgtatctggcactccaggaaggcaccagtggctgcaatcctgaacgctcgatgctgtcaaacctaccactgccttcctcccatacacagatggatgcccatctatcctgagcccagatagattggtaatgttcagaattgtcacagaagtcttcatttgctgtgctacttgctccaagatcatgtttatctcaggcaccggccttacacgagtgtcactgagaggcagtgtgctctctctgcagtgtccccctgaattccactccccgccgctgaactcatggataagacaataagttgctatgttaccgcatcaagtttctagtgctacaattgaacagatgaggaagcaaacctgaaatgcgacggggatgagcttcggaagaacactcgagttttccttggattgatgtaatggtcgacccatgatgcccatgtggttagtgctttaaggtaagctgtggaagcatcgagatggggatatacatgatcaccttcttgatagtagttcactctgaaaatgaaatgcagctgtaagaggctatcattaagctgctacatctatataataacatggcctaaaaaaaatgtcaatagctgcatttaccgatcaatttggttgtaccacggtaaggggtgaatgattcattattgcccctatttataaacactcacccagcttttgttttgtgatgcgaccaccaatgagcagtgttgaacacaagaacatcagcacctctccattttgacgaggtgcgatcaacagtatcgatccatagtgtcctcgtgcgctttgagccaattcttgctttgccttcatgcaccaagaaatgcgtcacatggtactccacactgcaattgtaatcctgcggcaaccttaccgagataaatattgtgtaccgaattcaaacaccgaacatattccaacagtagaaattagatcatacaaaccaaaaacttgaagttgtaatctcctctctccttagtaatcctgcggcctcgagcttcatgaatccttgcaggatctgagactgcccctctcagcaagcacatcatggattcccactgatttctgttaatggagtctccgacaaacactagccgttttcctcgcaacatctcaagcattttcctagcatcaaacctaaaatttcattgcattccaaagtcagcaaatgttgagctcaataacctaagcaatcgataaactgcacgaatgcaccgtaacgcagcacctcggtatactgcaatgagttggctgccacctccacttcctgtagcttccatccattcttccatttgcttcgcagctgaatccttcatctatgaacgggcaagaatcactcgtgtaaagtggatagctctcatcgaacacccaccttccatcatagacattgcatagtgccgcatcgcttctcgccgcatccaccttgctatccaccgtttcctgaaccaggtcagtcttttgcttgcttgaactgagtggagctgctccagagctgttcctcactgtcgaatgagctgaatgttccccttgatccactcgttgagaagtatgtgctcctgcagaggaatttccactttctccctgcaagaattcaccgttcgacccgaggtctgaatctcccatggaggaatcgacatcttgcacagacttgggtttcttcggttcctctgctggagcggctgcttcttgcgaagcggatgcattgctaacaagtaggttcgtctccatcgccgaatcggcaacttctttggtggtattctcgccttctgcggagttgccatccccacctccagcaggagctccttccgcccccatggccgaaccggaatcaccattggcaggagctccgccgttttcgcttcccagtgccgcctctttcacctccattgcggaacccacgcctcccgcggacggaaaacctccggcatccgagcggcgggctgcttcccccaagctcccgctcctgcccctgcccggaagaacatccaccgccgcgccgctcgtggagcggcccccaccacctgcagcaagaaccgggccccgcgcaatggcggaggcgttcccggcgagggaggaggaggcgacgaaggggaggtggagcgggcggccgaagcggagggcgaagagggagaagaggaaggagaagaggagggaggaggaggcgaaggagaggaggatgaggcccttggggctcacgacgccgtagtgcgaggtggacgacgagccactgctcctctgcctgtccattcctgcgcggcctacggctaccgtagcggcgccgcggcggacggcggcggcgatgacgccgagcgagccgcgtaggtgaggtaattaaggcggcagcgaggcgtggcgaggcaggagagaatacgaagctggcgttaataacaagtttaatactagtatagtcaattattatctccaaatcatctataactaatgtaatagctaatttatacaatagttgtttattatactagtattaatatctggtttcacctgactatagatctgtagcatgttgctcttatctcttttgttttatctttttaacatatgtttatagctggcttagagcaggtacaatagca

SEQ ID NO: 74154 - DNA, 4049 bp, Oryza sativa
accccccttattggggagagtggtgttctctcctattctctttacaatatatatgttaatgaatctagacacacattaacatatatatatcaatgtgggcaatgctagaaaatcttataacctaaaacggaggcagtaatatatttgttcagaaataacgaaatgctctattctcattcatcaaaagttgcaagtaacgattgtggttacgctgttatacccaaattaattaataatggactaaaaagctatggttatcctttaaaatgatttagtagagcgtgtacacatagatggtaacattatctgcaaacgatatatgtaactcgttttccctaaataaataattttaattaagtacaaagacatagaattaaaatttttatgcaattaagcaagagatctgctggttgcctgggcatataaaaggctaaaacaggttagtgcatactgtgttggagtcatgattgtcaatacacatagaaaggagattcatggactgaattgcttgctccaagtatagacaagcatatgaatcagctccattttagaccagaaaatagtgcactatgcatctcgaaacatatgaaagcccctcattcttttttttttccgggttgaaagcctctcattcttcattgttaagataatgttgtgctgcttttatactgaataaggtgtgtagatcaacgtcagcttacagttgaataggacttagcaaattggtaaatgatccaagttaatgagctagttttgcaatttgcagtacattcagttattcagacgatcgcacccgaacttgcagccatatatagtacgccaaaagaaaatccgaatctcattctgttggacatacctggtccaaatcgaatttctagaaactaatctagacagcaatgagcatttgtttcttttgcaaggacccatgaacaacttacagaaagggcatatcaaacattaaagtatcaaagtaagattaatactattgttttagactaatagagctttgatagccacccatcaagaggtacaaggcaatctatgaattaagaagacctaaattataaaacaagaaacacatatatattacatccaaatcaaggtctccaaaatactgctacgtacttatttgcaaatgcatatccacatgggaaaaaaaaacgtgaacagtgatttgacaaactgatatttgcactaagttaagatagacaaggttcggcaaaaccctgatcaatctagtttgtgaaattaatctgaattatttctctaaaaaaattaatctgaattctgaagctctttatacaaggagcagatcatgatgatatatgccatagacaaatcactacttgcagtgcttctcccctacttacatactcatttactcacacagaactcaacacttcctgaagactgcacagatcaatattcatgtttctcaattctgaacattaccgatcgatttgactttcttaccggaaccatcatacagttttgtagaagtgattttagcaggtatagacaagcacgatataagctagcacatcaaatggtttggtctaaaagattttaccatgtcccagcagcggaacagcacctcgccatggttcgtgtggaagcccagtgggcgtaccttgacaccaagcatcactgacagaacagatcaggaacatgtaatgggaaggatgccacgatccctcagcatatcaacgaattaaatcaagattacagcaaaagctcatattaaaagttgttggcctataccccataatacaaatgaaatgtacattcagactttaattaagtgccacaactccataatttggttaaactatcccattgcagacatatcaacaaaaagaacgccacaagtcttatctatggcaacccgggcggctaggaaattttgcatgcaacattaagaatcaggttaatttgagataaatgtacctgaccttatccgcaaattccactgctgaagcattatgattttgaaattgcaagatcaaattagtggaagagcaagcagcagccgaccaaggactaaatgtggtggggcgttgcgatctattgaccggcgagttgggtagacaaaaaaccgcttatggcacccgagccgttactcgcatcggtgcaaaagggtgcaaaccatttgtgggttgggttggagtctgggcttgggcattgcgcttgaccctcgccccattctctagcaacagatcaatagggaaaggaggcgctatcggctgtatcggtgacggcgaccaacagattttgaccgtctctccatggtcatcggcaaaggacttgcacgtggcatggtgggcagagagggaaacgagggtgtcgtcgcttcgagtgagggcgacctaggcgcaaaaattcgcgagacaatgaggaattgaggaggcgcaatctgtagcgtggaagacgggaaggaaaggggaggaagaatcgcgtggaagacgggagtcgggttggggttatggtgcgaggtgggaggtggagatgacatggagcgttggatttcacagggatgatctcaaccgttgagtgatgaatgtaagagtgtaagagtgaaagatgagtaaaacaagttggtgaattatagggtagatcagcaggtagccagttagcaattccttttattttactggtcgagttatatggaaagggttaccgacaaaaatgaaaacggaaacaattttgctgttatattttactgtttctaaatgcgccatcatatatatgatctaattctttactcaacccatagtctatagtatcgtcaattcatcaatcaaacccctaatctattgttgaaagaagggcaaattgtaatttacatagtgtccttttgattttatttcatcagaacatatagctatgcaaattgaattgtgatttttatggtcaatgtttctgatatttcttaccggttttccgttgataatcatccgtagtatcagttgtttttttttatattttcgataccgttttctttccagtatttatgttttgaattccgtcttcgagaaaatatagtgatggatacgattgaaacgttttctggccgttttcatccgtagatacagtgttgcctcgttcacaggtgtacacctagcttggagctctctcgcacttgctgcattcaaaagcaaaagcaaggtattattacgtctccaagttgcgccgttgcggcacatctgcatctgtattttcggtggtatacactagtcctacattggtacagaacgtgccaatcaatcactcgctctgcattccctctacggtctaccactctaccggcatacgtatagtactactgcgacctgtccagctgtgtagctggcaaaagaaagacaagccgagagagtttggctaaagcgaaaactaggctggtcccttcagaacaaagtgagcatgcaaaagagggatcaaggcgaaggcaagagcatcatctcgtgaccatctcagctgtttcagtattctgattctactgacccgtgatgaggaggggcaaggcaaaagcctggtcagtcctagtactagtactgatcgatgccttatctcttcggactctctcgtcctgcaccccaaacagtgagatctgtaatagtaataatgtacgagtcgatcaaatggaccacaggtttattgtacctctcggtacacctcttcttattactcggttgatctctgaattaaagccatcaatacatcagtgatctttcagatggcattcattgatttttcaccgtgaggaggaccaaatgaatgaatgatggcattgggcatttgcatttcgatttgaagttaaaagtgagcatcgtccagatcggaagactgaagaaatgcagcagcagcagaacagcagtggaagccgagtaacaattttttacagatacacccccacagagacacagaattacgatgaactaccatcacctaagttcatctgagataaactacctgccatttgatttgctaaccaagaaagaaaccagcagttccatccatcgatccatcctaaccggcgacgagatcgacgg

SEQ ID NO: 74155 - DNA, 10770 bp, Oryza sativa
tttgttttatataataaaaaagaggatgactgtactagaagttagcaattgtaaattgtttgtatcaagtacgattgcacccactaataaggaccacaaatgaacagctaactgaaagtgccttcggaaatcggaaatatatttggtttatgattctgaactttctgatggaatcattgaagcgtatcatggatgtagcaccggacacacggcacgcttcggtctccagaagcatcacctaaattactagtaatataccgtactaacggaggtgtcataacatttttcttaataagttattaaaattcgactgcaatgaaaataatgttcctagaatctgtccatttaagcttttagtccaaggtcatatataaaaaattattataatataacttaaaattatttattcaagataatataacttaaaattatatctaatcaattcaatatacactatacgaggacaatgcatatccataccaaaaagaatggttgagttattcctcaagaaatcaagatagataagtatgaatctttttctggtaagtatgcaccatgaacgacccaaccgattactgcaaaaaccattgacttcgggtaaaatatggttgaattttgtcaaaaatttaaagtcagtttgaatttttaaacttgccaaaaaatcaaaaccaaacatttttgttatcaagccagtctaacaagtttgattttttcgtaaaccttgccggagagtaaacatcaaatatttataagaggatgtatttacaacaaaatatacaactcttcttctcattacttcttttgcatgtcttaaatcaatatcctttactgaaacatatattgtcttttcattatttgatttgcattatcaaatactgccgtgactataatactcttttggttatcactgattcaagcattcaagctaagtatttgtcagcaagctgcaagccattcctgatgtatgtttctgctttccaacggcatacatccttcccagagccaaaagttcaatcaaagccatctgaagaataaatagccagccacatcctttgattatagttgagttatcatgtgtaaaaaaaaaacaaatacagtattacctcagattatctttctactgctacaactttattaattttaatatagtttgcttcgtcgtagcatccgccactttggcacaaccttcatttaacatgtcaaggttgtcagcctacatgctacatcacggcctcaaccctggttccatgcatagacaagctctcttccaatgccatttttggccttaaccctgcttccatgcttagacaagctctcttcactcttctaagaaatatatccttttaatataaagagctaatgagtttcagcattattatatatctcttctatataggaaatatgttgttaatcaaaacaatgcaacccttatcagcaagaggcaaagataaacataccatccagtattattacatatctcctttttttagatacatactagtatctcttatgtacaggacatatgttaattaaaataatgcaaccctaatcagcaagagacaaagataaacatgctatcactgaatatgaggaatagattttctggaagttgcgccaaccctgatatcatcaactctaaaaagtctctccagtgtaatttgatcaggattaggaaccaacatgaactcctctgataattccaaaagatcagctatatcaacctcagcacatccaagcaaagaaataagtccagtggccgccccagaattagcaacagcaagaagagttcctctgctaccgttgcaaaccagacttgccaaagcttgtgcagcaaagtacctgtatctgtatgcttgttcatctgacctgaacaagtttgagagcacaggaattgagtgcaatgctgcattagatcgatttatctccctttcttgaaatagcaaagcaagaagtaaggcacagacccatgcagtgctatcttcttcacgctgaaaatatgatcatacatttaagcaatcgcagctatcaaaagaatttggcaagatatataaatagtatgtaaaaagcaacaaagttaaaaaaaatatctgagtagatatctacagtcaaaattagatattatcacatgagaatgaagaatttacggaatcacacaaagtccaatattctgaatactgaactagaacaacaggaatgcacagcattcctgtttcctatatgttgttatttgttgcaatttaaacttgatgtgattataagaatattgttattgaatatttgagtttgtgttcaggaaaccaaccccaacactgggacaaatgttttgttccagataccctacttgtggcatcaaagaatgtgtagcaactacagcagggttgctagtgcaagatagacgatgggtctctagctctctgctgactagaagcaaaaagcttcaataccaaagtaacagatagaactagagataaatggatcgagaatagatacaaaagaaggatgattgaacacacttactgtgtaaatgcacaggtgatgattgtgcacaaggactatattaatccttgagacttcaatctattcacatcaaccccaagaattcaacaatacgcattaacaaacgactattcaatggaaaagtataaatttgttatagggctctgatggtggcaaagggatggaatcctttgaggagttaaattattcactctagcaataaactttaacctggtctcttagctgggttctccaacaacctgttcaatctagctccccactgctttctatatgcgactgttgcctagactttatgcataactaccaaattgacataaagttttcttttccttaaaacaatgaaaaccctggttccaattctcattacaaaagagaaatcagataaaccaaaagaataattaacggaactacgctgcctacgtttattttagaactagcatgatgttaaaatactaaagtgcacaagagatactagcattcacgtaccacatataggaatgcattttgagaaatcttctccataagcatttcgactgctccagcttctagaatttcagcccttgttttgctgtcatggcgtgcaaaaacagcaagcagccatagcggaatcatgttacctgagattacagcagtgcggcacacagtttcatcgctgttgttattttctttggagtgtctagaaattttaatgtctgatatgttttcaccactcccattttcagaaggcaagtttgtcatatgaatcatactgactagagaatggattagttgaatgtataagcttgagtcactgagaatctctatctgcttctgacaatgctctttcgctgcacaaacaagaagagaacatccaccaactttaactttaagcatgttggacccaatgactcgccgtgcaactgatgatatgcagcctgggatttctgaaaccaaaccacccacaatatcatgttgatcagaacagagcctcgataaaacttctatggccttgtcttgcaatgaaggtgctgcatccgctacacatgacacaagaggaagtatggtgtggggattttctgcaagaactgtccatggagctttggtatgcccacttgacacctttggtagttttgataatagcaccagcgcatcaacaacttctgatgttgcggcagcttcaccattcgcagcttccaaaagcccagctagagcaaggacagcacctgaccggttaatagtatctgaaagaggttggttaattggccggcactgtaaaaggcgagctattgctgctgctgcatgagttcttccatcaatagatccctctctaagcacatgtgctatggggaagataatttcttcaaaagatacttgcagagataattcatgatcaagaaaaaggtttgccaaaggtcgcttgttctgctacttctagaactgtagaatttgcaagtgagacaagtggagctaatgcatcccgcccaattgcagcaacatccttattttgcttgattgacagaaaaatggcagcaaggcaagatgaggccgccattagtattttatctgtctgcccatcaatcagcttcatgactgaccaaagtgtcttcactgcaatatgagtttctcgcaagtccctgcgacaatgaaacagtccagcaagagcagatgctgatttagcctgagtttcttctttaggtgagttgagaattttgatcatagtctcaactgcatcatttgcagcacttccttcatgcagaatatcattaaggggtgccacagaaagcaagcttttcaaagcatcaggacatgaacttttgattcaggttgttcactagttaaaagagcagacaactgactaatagttcctgtatctgatttgtgaatgagatgattcagtgttttagatgctatctcctttccgtgtcactttcatttttcagaagccatagtaaagcgggcacagcatcagcactttcaacacatgcccgtatgtcttcactgtggttgcacaaattgccaaggatggttgctgaatcttctttagctttgaatatgtcacatgatgaatgatgaatgagtaaaaccatttgttcaactatagggtagatatgaaacactggcaaatggaatcaacttggactgttatacaagtcaccaatcaaaatacctgttgacaaaataattgcattcttgcgaaatttactctcctacaattgaaactgaaatagtaggactagttcatagtcatacttctattgacaatcaagtgtgcactcttcgcatattaatctggtatttgcacaaaaataacacgtgcaattgcaagcagagattgttctaatttctaaacaaactggcaatggattgcaaaaaaggacgttggacgagcatatgcatagatgcataatcctcaggcataaaacaatcaatctgtcaccgaagtaacacgagatcaaagaaccttgaagcataatcctcaggcgtcaacaatcagtccgccagcgcctacaaaggcgcgaacgccgccttggagatgacatgcgtcttcttgccgagcccgaacccgatgatgtggttgatgtacacgtcgccatccttcaccgtcgccgacgagccgatccggtgagccgggccgacgtaccggccggtgacgacggcggtctcccagtcgtcgtcgctctcgaccagccggctcaccaggccggcggcgaccagcctcgtcggggacagcagcgccagcccgtcgccggtcttcagcgagcccttcaccttgacgacgtgcacgctccccgtcttcgggcagaccttgaagaggtcgccgccggaggtgtggatgacgaggaggtagccgttggggtggtagacgatgccgttcaggccgacgaagttgttgatccaccctggcctctggaagaaggtggcgttcttgatgacggacagcggctcgccgtccgggctcaccttccagatcttgttgcccttggcgtccgtcacgtacgcgttgccttcctcgtcgacggccacgtcgtcggcgagcgttgaatcacctacaaaattatataaaaatccattcatattctcgaaatttcttgaatttcaaattgaatttactacaaactaggaaaatataataatcgttgtaatttgctcagaagagagtaaataaacaatagattggtggctccctttccagtgaacaatgctcgaaatggacgcctagaagctacaaatccatggcggccatagatggcgcggactcacggacgcacctggccggtcgaggcggacgaggaaaaggcggcgccaggagccgagctcgtaggcggccacggcggcgtacccgaaccacggcgccaagtcggtgtacaccacgagcaggcgccgtctcggcgcgtccaaggtgagccccgtcgccgacctcccggccgccccggggtccgccacgaccacccgcgcctccaccttcccctcccccgcacccgcgccgccgccgccgggcacctccacgacgcggccatcggtcatggtggtgaccaggaaccgcccgccctcggcgtcccacctgacgccgtcgtggaaccacccgtcgcccacgtaggacacgcccctcgccgtcccctccaggaacgcgaccaccgcggccgccgccagcgccgcgacggccagcgacgcggtcccgcgacccccgccgccggcgccggccccgccgcggcggcggcagcatccaccgcacatgacacagccactacaagatctggggcgcctcgcgtaattcgggtggttgagtagcgcgcgtggcgtaattgctgctgtcactgttagagctcccaagtgcgccgtggggttaagaggaggtttggccccaccgcgcgctccttgagggacacccatgaccagggcggtgtcaggcctctcacagtggcagtacccttagtttagaaagttggcacaaagaacacccccacctaattggatggagagacaagtaaaggaaacgaagctcacagtgagcgtgacctagccaccaaatccacaacttaatttcccaactacccctctctctgtgttcggccgtctctttttcttctccccggtgcgcaccgcatcccctcccgcatctcgcttgcatcgccaccgcttcgactcccctcctccctccaccgacggccggcgccggatctcctccctccgccgccggcaccggctctgcttctcctctcctccctccggcgccggcagccgcggttgccggctcgcgcggcgaccgacgcgcgcgggaggcgccggatctcctccctccgccgccgccgccggctctgcttctcttctcctccctccggtgccggcagccacgattgccggctcgcgcggcgaccgacgtgcgcgggaagcgtcctcgggaggctccggcgccagcggaagacgatgcgccgatgggatgtggtggccgcggcggcggatgtggtggtcgacgccagatctcctctccccgccgccgccgccgcgaggaggaggaggtagtgttagtcaaggaggacgagcagaagcagaagcactgcggccgcgttctttgatcttttttcccaactcgattcgatcgatcacatcacttgctaataacaagatgggattagctgttcttatctttgcatgttctgttctctaattcttgatgaaaaaaaatcaagaactgctctcgcttcttatctttgcttgtcatgctgatgtttcaagacccagagagatccttcacgtggtgaccgcttctttttgatttttttgcctcttttttctttttcatttcttcaatttttcgttgtttaacctacaaacgatctcttccaatccccaagattttcttgccttttcttgactcggtgacgggaggagatttgctgcggtgccgaggcgggagaaatcagtggaccggaataatgggtggcgggaggagatttgctgcggcgggagtggttttttggagggcaatacggggatttcgcgataagatttctgggcgagggcacgcaagggcgagcaacgccgcccacagtggttttttggagggcaatacggggatacgccgctcacgccctcgaactgacgaggtttcgcgtggctttgtttggtgacgagcttcctagctaaggcacggttgcacgcgacacgttagcaaaattccgacgtggcacacgaggttccccctccagctaggagcactgtgagaggcctcagtggggacgtgctcccgtgaccgcggatggagctagcagagttgcagctcgtgcctcactgcctcggccttggtggtagtatgatcggatctctgcgtctgcgagcagaagagacgggaaactatgggccgggcctcttggttgcctggtttgcctagaagggtagaacttggcagtggagacgacgggcattgtcccgtggaaatttgatgatttgccgcttttagcggctgtgtaaagagtgaaaaatcatcatcaagataactcatctgtgttcgattgcaccatggaatcgcgcctctattctcgtggtaagaggagaagcaattcgctaccaagcctcctctgtcccctcccaagtacgaagtaccaatcacttatcactcactcgttgcttcatgtacatcctccagtacttaagcacatggcgtcctcgtagtcgtaaagatgagtcgcgggaccacaaatagatgcatctaaatcggcaagattaacttcgatggcggcggacagagaagaaattccggtgttccttgcaacatgagcgtcacattggtcaagtgattaggggatggcatgtattgacagcgaaatggagtggatgcccaggccggtctgtgtcatgagatgaggagcaagggaggcttcgtacatcctagagatcaaggggaagaggcagccaacgcgcgagcagtcggtgttactgttaggccaggaaaaaagccacttctggattactaataacttgagtgtgaactcgcagcttctcctcattggtttttggttgattttagtagtatgcgacaatgcgaaaacgagaggacggggagtccagaagtgttcagttcagtcagtaaaactttcgttagatgtaaactggagtagcgaaagatggaagttggtgtttggtgaccaacaatgaaggagacggcatggtcgggtaaggaaaggaaaggaaaagaagcttctgacttttagtggatctaaatggcaaatctagttgggttttaggcctgaaaatatgctgctgctcttcatatctctcttgtcccagagaacccaaacagaagtgcaaccaaccaccattatattcttcatactacctgcgaagatctccattcatggacgttccctacgaattaaatgcacacgagcaaaccatgcagccacagcgaatctgtccccatgtcatactgtaccttctcgtggaaggcttttcgccttttcggcgccgtcaaataccaaggccccaccgatcagttaaaaaaaaatactcacacgatcacacgatgagtccatggaggaggtaaaggtaaagatcgtgatcgatcacgcacctggtccgtcgaggcgggtgaggaagaggcggcgccacgaggcgaggtcgtacgcggcgacggcggagtacgcgaaccgcggcaaccggtcggcgtagacgatgagcaggcgccccctcggcgcgtcgacggtgagacccagcgcgaccctcccggcgacgtcgggatccgccaggaccacgcgctcctcctccttctccttccctttcgcctcggcgcggagctcggacacgccggcgccgaagaagttggacacgagcagccgccgtccgtcggcgtcccacttggcgcactcgtggagccacccgtcgcccacgtaggagacaccgccggcggtgccctccaggacggcgaccgccgcggcggccgccagcgccacgagggcgagcgccgtccccgcgcacccccgcttcctcccgccgccggcgccggccgcccccgcctcggcggctcccccggcaccgcggccgcagcagtcaccacacatggtgcagcgattgggtagcctacagcagcggcgagatttgagtagccaacagcagcggcgagatttgggtagcctacagcagcggcgacgaaggggaggaggatttggcccgatccgatttggtcaatgtagggcgagctggtttgggtcttcccgctattaaaaatgtatagtactgatttagtgaggattttggtgagctggtgtgttttagcgagtattttggtggcattttgacgaccggcgtgggccgcgggggagcggaatctttcagtttgtccctatccatccatccaactccaacgctggttgatctgcgtgagttttatgggacaagtttgagtgcggacggggtaggaacgcgcgctgtgaccgcgagtggcggcgagccgagccggcgagtgcatggagttgacggcttttggcaaggctggctagtggctggctttggaggaaagcaccggaagtcaaagccgtctgtgcgactttttgcctcgtattttgcttccggggggtcacggctttgcgaggtcatggtgtcacacggctcacggggcagggtgatcggtgtaccgaaaagttgaatgctttttgcggtgtaaccctcttaagtacgagaaatcaggtagaactccgtagagaggactcaacgagagtgatttatgcgtagggttggcaacaaggcaggttggaccagagcgcccccgcccctgctccccggccccacagagatggtcgggtgaaaaccatcacccgtcaagtcgctgcaaggacccgtgggtgcgtggggccaggcaccacccggctgacgattgacgagcgaggagccgaggagcagcgacgaagccaacgccaacgagggacaacgacagacaggtggctgaggactgggcgtcactgccaccgccgctgcggatgcgcctccctggccgccgccgccgtggatgcggtgctagcccttgccattgccgtcgcggatgcgccgctaacgccaacacggatggtcgtgcccctggtcgtcgacgccgcgactcacaagaagccgccaccgcctgctgcttccgctgtccgcgcgtgtccaccgtcgatggcttgccacccatccgtgcgttttccgctgtccgcgtgtgatggctgggtggggtgggagggaaatgaggataaggttaaggaagggaatatattaggaattaaggttagagtaaatgggcccttttgg

SEQ ID NO: 74156 - DNA, 12174 bp, Oryza sativa
cctatgctcatcgtcatcttcttctccttcatcatcgtcatcttcttctccttcatcctcatcatcatcagaatctccatcttcatcaatatattcatcttcctcagtgtcttccacttcttcttcatcagcaacaaaatcttcatcatcacttgaagttacatgtaccaaaagaacaaaagtaacttagtgttctgtaggaagttgtttggacaaatgtaaaaaactaaaaattcagttcaaatcatcgtaaaaaaacagtgtggtggaacaatgatactaatgagattcaaattgtgcagagtggtagaacatggctatattaattattctgtacaataattaatagaaacatagtgaaaaaaccaaacctagatcttcatcttgctgaactttttttggcctttatgcaagtttcttccggttctttcgcatttgccttggttggctacccctaggatccacaaaatcaaggccggaaatctgcctcacaaatttcgtgaccaaacctgaaaaaccttcacacaaattttgcacagaggtcacaattctgtcattttcctgtataaaaagaaaaaacagagaagttacatatgcagatttcacaaagttacttttgcagttcgttgatgttacatctaccaagtgtacaaaaagtaaaacagagaagtggggaaaaaatataaacctgctcctgcatagtattgggcacatttgaatttatgaaggttgaaaaatctacattgctcccaaacaaattggtcccttcatgctgaaagctgctcttaagctatattttcaattataaaatccgtaagttacgaacaaacaaaaaactaaaaatgatgcaagtatgtcaactataaaaaaactcactaataaagctccaaaggagccatctgctgatgtgtctgctagatttatcaattcattcgtccaaacagtagctcgataaccctccactggaacattgagatttttaaacgaaagtgagtccaaataaagaatctacaaaagaaattagagcatttagattaagtaaaaaaagtacataacttgtttgatttaaaacctacaaaatatgttaactttcagatgtaatttaaatttgaaaacaaattggaaaaaaagatgtggcagggcatatatgaagaagtaacttaatgtacagtgaagtgacttaatgcacaataagaagtaatttaatgcacagtgagaagtaatttaatgcacagagagaatttacttgacagaaagttatttataacaatttaacataaagaagttacttcctaggaacatgtaagttacttcctggacagcttaacttactttaaaaaacataaaagttacattgggacagtgatcgaataaaaaaaaggtgagcattgttaccatcatgtacaggagacatgctgagttggtattcttcccagctttagtagctttttgcaaagtagatatgacaaacttgcacgaattaagattcttgatatttccagcatcaacaacagaaggatagcatcttgggctgactgttgttgctgtcgttggtgctaaaacagaagaaatggcgtagatgatccacatgcgcaggtacttgtcatctgctaacttcaactcctccaattgaatcccaagagaagtcagtgatggtgatcgttgattccaagcaaattcagcacaaattctgtagcttcagactccatctcatatgagacatctttgtcgcccatagggataccaagcacagacttcactgactccttgttcacatctatggctccacgtccaggaaatacaagctgattggttgctggatcgaaatgctccatcaaccagctgcacaaatcaggtctgagcttcgagcacttgagatctacgaggccatggaagccagcccccctctgttagtcgcttttgttcgccactcatatggggatacaactttataagtttcatagatgaagccctgctactctcttgctgcaaatgtataaacaacaaaaagaaaaataaaaaaacatcagcatttgtttattttttcaaaaacatatataaaacagttgaaaaaagggtaactgaaccaagaagtaatttgccattaagttagttctagaaaataacttgccctcaagcagcaacatcaaaatattttaggcacggcgagaagtaactttatgcacatagagaagtaacttaatgcacatcgagaagtaacttcttacttgttaacagaaaatctcaaagcaattttaacaggaagttacttctaacaaatcagtaagttacttcctatgaacatgcaacttacttccagataaacttgaattcacattccctagttacacagcatgatacattccatctagttgcctctcatagcaatttgaacagaaagttacttgttataaaactcaaaaagttacttcctagaaacatgcaagttacttccaaaaataaacttgaatttgcattccctagttacatagccatgagtactggtgttggaaatctcatagtaattttaacagaacttaatgcacagtgagaagtaacttaatccataatgagaagtaacttaatgcatcataagaaaatgtagtgcattggaaaaggcaaaacactgcttgagggcaaaaaatgcataaaaaaaggtggatgcttaatacctttgctctgctcctttttggaggaggttgctctatgtcatctgcatgatcatctccaatatttcttttcttagcatgttgcgacacccctcttgttttttttacttgactctggtttgcctaacatgccttctttataatggtttttctttttcccattcctggaaatatattttggatgttagtaatcaacttgcaattaaccatcgatcaactaataatcaacttgcaactaataatgttagtaatcactttggaaattcattttggatgttagtaatcaacttgcaactaaccatcgatcaactaataatcaacttgcaactaataatgttagtaataattttggaaatttattttggatgttagtaatcactaataatcaacttgcaaccggaaaaatcaacataagccagagagagaaatttaaataccttcaaatggaacccgagatccacaagccgacgcttgagggggcgaattccactgcaaccttgcgctcgccgagaggatgaactagcacctgatgaatgagggagagagaggggacatgagggaataggggagaacaaactgggaggtttgaggagcaatttgcgcagtgaaaaattgcccaatctccacctccctggcacaaaaaacgcatggaaaaacagccccatcactccacctgttcggctcaaaaaaaccgcaacgaaacagccgcatcacgccgcaacttaccgaaaaaaatggccgccggatttggtggagagaaaaccacctccgccgcagcctacgcttcccaccgcaactgccggcgcgatgagaggaaaccgtcggctccacgcctccaccgtcggctacgccgacgccagcgcgacaggaggaaacagcagcaactccccaccccaccccccattcgccacggatttcgccggagattcacgccgcctccacctctctctcactctccgcctctctctctctctctcgtcgagcgccacccaaaacatttgaacagtaaaccctcgcgtgagctcgctcggtcggccggtcgggacgcgcggcgtgcgccgaatggacgccacgttgccaatcgcggatcgacggctgccacgcgcgtcgcgcgatagcactatacgaaaaaaccgaagattcggtgcggttcggctcggttctgtgcggcctacagttttcggtgattttctgcccagcctcgctgccgcaaagagacttttgtccagttggttgcaagggagtgcaatgtgtttgatggtattttgttatatgcaaggaaaatttacagtggccatagcaaggaaacaatgtgatatactatgtgaggttagctagcttgtcattttgtgcgtgcatgggccatgcaaatatatgaatgtatatgccgtatatatacacaagctagagaatcaaaggctagcatttgctaattggccagtggggcaattatgtacgtacatgcatgctccatatgcatgcttatcgtattaagcgtgattaacggtgaagtaattatcgtattttacgcgtcgccggctggataaactgatcaaggcccatcaaaaaccaacagagaagccacccaaatatttgttcatgcacggaggagataaaatccaacgaaccaagagataatgagcataacaaaccagatgacggcggcggcgcacattgtcgaaacatgatttcggcaataataaaaggggtagcacacgagacctaaaagtggatggatgcagagacaaaggatttagacaggttcaggccctctcaatgagaggtaataccctactcctgtttggggatttgaatccgccgggtgtagtatagatctgacgatcaggttgtgtctcatgccccctagagggcctcctgcccaccttatataggatggggggcaggattacaagatagaaaccttaaccaacacggtatcggtttcctaaatctactttacaatcttatcaagccaggactttaggccgttccataatatacagggaaacgtaatacccaagtcatgatctgttacatatttcatagatataagttatcccatataactagtcggataaccatgccgtgtgggtatggggtacccataatctccacagtagcccctgagaccttcacagtcgaaaagataatattctctcgaactagattactccaaagccgagtgcttcaatcatctttgccatgacttcccgagtacttttaccaaatctaaagactgtggagggctgaaaaataaagtcaggtgcatcgactagatgcacctaataggtgtagcccccgactatgtggttaattgaacaaaccaaacacatagtcaaggaataaataatctaaccaaccgagtggtttcgataatagcatatgatgtgtgaatccctgaataatatgatccaagtgatataccgactgctttgtaaaatatgatgcgtgcaacttaaagtcgactacattattgaaaattcacatagcaaaacagctataaagaagcttgtatgttgtgaataaagaaatttccaaagtattgggcatacgccatgcgcacactgctttaacagatgtgcttaagtccctaaaagacacatggtttcaccacacctgaaaatatatggcatatgtggtgtaaaatccgagtaaataaactcataaaggatttaccaaccgcctagaaaatgaccaaaatatataatcagcccaagccataatattggtcaataaaagtgcacacttacgtggcaaaaaacaatgatattgtatccaatcaattgctttatgaacccaaacaacaccttgacttatataaaaaagtcagcgggcagctatataaagcattactgtttggcaccttttaaaatgcattgtaccaactcctaaaaagttgagtaactgcggtataaaaggattttaaggtattgggcatataatcacgcgcacttttgcctaagcaaaaagatgcctaagtccctaaaagaacgtgacaggccacacctgaaaatatgggctgcagacatattaggcctaggccaaaacatatgccctcgacaccctttaaaggatgacgcatgtaacatgctcccgagtaataaatcttccgggtaatatagaccaagcgtagctcatatgaatagcttctgatctgagtgattatcccttatgggatactccaaaatagatataaaaattgaatcccgactggcgcaagtattcggttgataacccttacggagaaaaataaatagtccagtctttgagcatagaaaatagacccatgatcatgaattcatgttgcatgtaaccggaacaagtccaaattgaaggtatgatacttgtgtttgaactagtaagcctctgagcatatagcttgtccttctttgtagtcacaattgtccatcgatggtagctgacgcagttggcatagagacaagacgaccaatatagagataatattgcccaccagaggtggcaaaaatattagtggtagtgaagatagtgataccaatcaaaagtactgaagtcgcatagccatggaggcgaagaaaccagtcggcggcaaacagatcaactaacaatgaagatgaaggcgcccagcgataaagttgtgtagccatggcagcgaaataatcagtcggtgatagacgaggcagatcaaatgcgatgacgaaatccaccaatcatgaagatgaagaaaatagttgacgatgacaaacgcaaccgacatgatgaagatgacgatgtcgatgatccagtcaatagcagtgtagcaaccaatgataatgacaaagacgctcatcagcatttgcatagtaggtcaaccgtgaaggtgaaataataagtcggcgaaaacataatcatccattagcaacagcggagatgtcagggtcgatgaagcagaggtgctggtgatgatgtcagtgacaataatctatcaaattaatgttatagctgttgtagatgctttacttggaggagagttgatgttgttgcccaactcgtctaaaccgaaatatttgaagttgttgaagtagaatgtctgctccgaagcaaagatgaagataatgactcctggagttgactcgttggctgattaattgatttcttcagcttgacataaaatttgtcaaattttgagccttgtatttgtatagcccccgactctttgattagttgggaaacaactgaacatagagtcgagaactgtagcttcttgtcgtcgaatagttattgcttgattgaagatatgtgttgaagatgtccaagtagaaatcctgaatattggagagccacttgttgtagtaaaataatacggcatcgcatgccgagatgtcgagattcacaaagacgttgtggttggtgaagtagcgaaacttgcgaagtagcagcaatagagtttgccggtgccgaagataataaagatgaagtcgctctaccatgatgacaaagttgcattgccgtgatgaagtgaacacgagtcggcgtcaacagaagcaaactggtagtgaagacgcgcagttgtgaagataaaagcactagttggcgacagcataaccagtcggcgacggaagacgatgatgttcatcagtagtgatagctgtataaaccagatgtagaggcgagggcactagtcagcagcagacgagacgaccggcgatgaagatggtaaggccaatcaacactggcagaatcatgcagctatggaagtgaagaaaccagtcggcagccatggcaaacgtaggcagcttgtattgaagatactgatgcctattagtagtgacagcgatgtagccagccgggaagaagatagcatcagttggtgttataacaggctagccgtgcaggcggaaacaccagtcggcggcggccaaggcagccggtcggtgaagacgtagacacccaacaacggcggcataataagtcagccgtgcaggcggaaacaccagtcggcggcggcgaaggcaagccggtcggtaaagacgtagacgcccaacaacggcggcataataggccagccgtgcaggcggaaacaccagtcggcggcggtcgaggcggccggtcggtgaagacgtagacgcccaacaacggcggcataaaggccagccgtgcaggcggaaacaccagccggcggcggcgaaggcaagccggtcggtgaagaggtagacgcccaacaacggcggcataataggccagccgtgcaggcggaaacaccagtcggcggcggtcgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtatgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaattatattatctctatgcttttgatttcttccgagtaatacttagcaccttgcgttactcggtccatccaacgagcccccgggtgctaggaatcggcccaaaggcaactatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggggacaccactcggcggcgacggaggcagaccggcggtgaagtcgtagacgcccaatagcggcggcttaataggccagccatgcagacggaaacaccagtcggcaagagtagtgccgcggcgttacatgcaaacagcaaaaaataccaagagagattaattctgagacggagcggagtaggcggaggtcgcagtcgcgggcggcgttggtgtccatcagcacgacgcaggacggcaggaaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcattttgttgaagtcgtcggcggcgaggaatcaaggagctcccaaagcgaaggcgaagccggcgactcataaagttgattccatcgcactcgtcgtcaggaaactcggcgtttacccctacctggcgcgccaactgtcgaaacatgatttcggcaataataaaaggggtagcacacgagacctaaaagtggatggatgggagacaaaggatttagacaggttcaggccctctcaatgagaggtaataccctactcctgtttggggatttgaatccgccgggtgtagtatagatctgacgatcaggttgtgtctcatgccccctagagggcctcctgcccaccttatataggatggggggcaggattacaagatagaaaccttaaccaacacggtatcggtttcctaaatctactttacaatcttatcaagccaggactttaggccgttccataatatacagggaaacgtaatacccaagtcatgatctgttacatatttcatagatataagttatcccatataactagtcggataaccatgccgtgtgggtatggggtacccataatctccacacacatgctgaggaggaacgaaggagatggcgccagatgacggcggcggccggcgacttcggctgcggcacctcggcatccgacgagaggacgcgtgtgcggagaaggaggcgctgccgaggaggagataaggctccagtccattgttatgggcactgccctcgtcggagtcaccgtgccaatcgactcatggacttccgtggagagcaccgaaggccatcgtatcggcgtcgccgcgcacacactccggtggctggcaacttgcaccagcagcagctacaccgccaaacgtcgagccgcatattgacggagctaggcgaccggtggtgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttggagaaaatcaacatccgccgctagaggcacccggaccccccttatatatgggaaggagtccgtgttacaaaagataatctatatccctaacggaatatgcagatacagataaaatacagtcgtaaccgactaagtctcaaggtgtttccttgatatacaagttaagaaacaaacccgagatacaaataagatattctatgtatatttggtatcctatattcagcccaaatatcatcgccgtgtagatatgggatatccatgatctccacagtagcccccgagacctttgcagtcaaccatcatagccttctcaaagataataatccgagtgcttcaaaacttatcatgccaaggcctgccgagtagcgaagacgaagactgtaaagggcgaaaagataaagaacgtggtgcatcgaatagatgcacctaattaggtgtagcccccaactatgtgattagttaacaaactaaacatatagttgagaacaaaataatagcacaatcatgcatcagatggcaaaagcatacgcggcgcctaaagaggcattctagccgactgctttttagccataataaaaagaatccgagtggtttacactctaaaaggttcacgaatgaacacactggacaggcatccgaatataaaactctaaagattacccaccaagtattataaaaattatggtaatgaataaatctaatagcctaggctatgactatttaccataatgaaaataggtatataacataccaaggaagtgactatgataaaaacaagtcattccaaattaacccagacagcttttgtagcctaataaagctaacaaaaagcagtataacacctttctgtcgggcaccttttaatttgcattgcaataatttcaaagaattatatgaccgcataaaaaggattttatcagcattgggcaacactattgtgcgcataatattgccaaagcaaaatatgcctaagtccctaaggaacacaacgggccacgctgttaaaagtattgggctgaagtactgttcaggcctaggcccatttgcacctccgatacccttaacaagaaatcccgagatccaagcgacgcttcgtcttccccgccggaactctcgccattttccccactccttgctacagtgcagaactgcgccggcgaactagggttcaccactccactcaaatccaccttcgaaaagtgcatcaaaatccttcccgtgatccaccgcctcaatccctcatttctccctagccatccctcgaatcaaatcagcgcattcgggtaaaatcgatggcg

SEQ ID NO: 74157 - DNA, 8514 bp, Oryza sativa
cagacatggtcaagcatgtccccaacactgcctcgaaaaacgtttgtactgtatttactacagtagtgcatactactaatggtgtcatttaccccagttaatcttgtttaagctaatgcaggatgaagaatcaataatggcaggttcgaagcagatggaggaaagcgtagcgaagcacagagcacagcctgatgcactcactcacatagaaagcagtgacaactccggcggaatcccccgccacgagcttcaggtcggcggtcgccttgccgtacaggaacttgctcttcgacgcgaacccgccgcctgcatccacaacacaaaacattctggtcatctgtcccccaaatgcagatcgagaacatcttcacccattcaccacaaaaacttcaacggcgaagacgatgaacagttgaacacgtaccggacgagctgtcgaggcggagcttgaggaggtcgccctcgtacacgacgtggtcgttggcccagctcggctccaccacgtcgtcgaacttgcccgccgccgccacaccggcggcgcacaccaccgccaccaccaccaccacgacggccagagacgccattgtcactgctcacttgctgtgctgttcgatcgactcgactgatgggctcaatctcaagctgaagctgggtgcgatgtttatataggcgagacgtttggcttacggtggaagggtggcacgtgacacgagggcgccacgtcggaggccaagctagccgttgggcaacgggggacccacgcgtcaggagatagggaccagtggtcagtctagcgctctactactactacagtctgcgtgcacagctcagctgctgtggatttctccaacttttgcggctttgttcacagcgagctttcagcacgcttgggcctctttagttccccaaatttttttcccaaaaacattatatcgaatctttggatatatgcatgaagcattaaatatagataaaaagaaaaactaattgcacagttatgaaggaaatcgcgagacgaatcttttaagcctaattagtccgtgattagccataagcgctacagtaaccacatgtgctaatgacggcttaattagtctcaaaagattcgtctcgcggtttccaggcgagttctgaaattagttttttcattcgtgtccaaaaaccccttccaacatccggtcaaacgttcaatatgacacccaaaaatttccttttccccatctaaacacaccctttctttctttctttctctcgctgagctacgcggctactggccacagccgctgtgaccagtcggggaaagaattgtttctgcctcgcttgctcttgcttgctcagcacagctagccagctagccgtacgtgaaacagtacactagttggttacagctggcgagtgggcccgtatgtaggactagtacgtgcacggtaaagagaaaaaaaggtgacagtaaaaacagcttggcccaaacagagtcgtgcaggggaagtagaagatcagcgatacataaagtgctgcgccctctgttgctagcctgcttgcacttgcattgcacggctagcacggcttgatggagtctgcaggatggcttgcaacggaaggagcattcaaaaacctgatgcagatctattgacccacttacccgtgtggattatagtcaagtctttgattaagtagaactaacacagcagtacaaagtatcactatacggggtacttggattagaaatgtgaaatgctagatgttcagatcagaaatggaatctcagctgcagcaactatactacaagcagtaaaaaacattcaaggatcaggcggtgacgtcgaagcctaataccagcaccctattttaaggctgtcaatccacgtgattagccaatttagttaatgctaatcactcgattaggaacagttccccaggagggagcagggaggcgtaggctccagctgtgaatgagcagggagccatcaccaccctttatcaaaggcgcccccccggttgtgaaaaaaatgctgcgatgcgatcgatggcatgagttttggtgcagagaacgacgatgatgcctctcctgccccgtcgattttttactgcagagaacgaaactcatgacgcatcattccacgggctctctcctcctcctcctttcgctttcgcgacgccccagccgatgcgcataatcttttgtccttgtcgagttcacacaaaagtcacaaaaccgctcgtgttaacgttacagtttttaccgcgccatcagagtttaatcgtacgctaagcttccattttagtaggactagtgggcagtggcttactggctttcatcccccgcaaatctgcattgttcttcaaggaagatacagtcggaaagaggtgatatatggctcatgctggtatggtacggtatggaggatgcgcataaccaatgcgtgcttgcctggtgtccatttcaatcgtgattagctttcggaaaatgatactctcttcgttttaaaatataagtatttttagctatgtaaaaattattatattttaagacggagatagcatattacagtattccattcgaattcaaacggaattatacatcagagatagcagctgatattaggtatcaagcttttgtccaaacagaatatcaaccgataattattggatacactcatttcgtccgaacggtttaccattctgtagtattttccttataacctttactgtactccagtaaagatatttactgaatgtggggacattcctttacagcggataatagtgacatcacccactgaacctgcaataattatgcttttctcccgtgtacaacgcgagtactctccccgtctcccgtgtcccgtccgtggaaaagcaaaagttttgggagtttggactcatcttttcaatccgcaacttttcgaagtgaaaaccgcaaacctctcctgctgctggaccccctctccagctgtcaggtctcaagtgtttgatttttgttttcaaatttaaaaattgtaccgttgatggtagagacaacgtttagggcgtttaaaggatttctaaatgttttccttttaaaaattgaaacctttggattttttagtattaaaatggatcaaatcttatttaacttattttgagacaaggggagtagtagtaaaattgtgtgtcatactatctcatactcgtatctcattctaaattagtttaatttggaatgtaaggagtactcttgtcaacattagcactgccgcactaaaattgttacgtgctccctctgtcccattttaagcgtagtcataagttcttgtgtgcatctttgatcatatatcttatttaaaatactttttaaaaaattaaagaacataagtcatacataaaagtattatttatattttatcatctaaaaataataaaaatactccctccgtcccaaaatgtagcagcataggatgggatgagacccattatatgactatgaatatggacatactcattacaaaaaaaggttaaataagacagaggatcaaagttgaacacagaaacttatgactgcacttaaaatgtaatgggggaatatcattttgtgtggtactgttactagtgtgctaacagctgtataagactatgtttagttcacactgaaatttggaagttggttgaaattggtacgatgtgattgaaaagttgtgtgtgtataaaatgtttgatgtgatcgaaagttgaaagtttagaaaaaaaactttagaactaaggctgtgtttagttcagcgcaaagtttggattttggttgaaattgaagatgatgtgactgaaaagttgtgtgtgtatgacaggttgatgtgatgaaaaagtttggatccaaactttacatctaaacacagcctaaacagcgcctatgtatacgagaaatgaatgtactcgtacgtacatatacggccaccgtatattatacaattatccgcacagcaccgtgcatttcacagcataaatggccgtccaatcaacgtgacccgaatgctctgctctggacgctgcagtttttgagcccattttttacctcgtcgtcgtcccggtgaaaatttgctcccgccacggtgcgtcgctgttcaccgcggcattggataggttgatatggacttgctcggcttgtcccgttgcactcgtgacgcatccgattcaagtatgcagtataccacacgagctgcaaccgctgctcgacaacgacctgaggctggctgtaaacgtcgttcgtgcacgcttcagcctgcagctcgcactgtgcttctcccatctcttgtactactgataattgtgttcagcggagcacagtaaactgcccccacggtacggagtactacgtacagtaactgctctagtaactttggaagtgtggtttaagactgtcagtacgtgaagctaatggtgctcagaggaggattaattagtcctaaatgagttgtactacatgaaaaaaaaaagaacacgtgatggttatggctagtggctagcccttggccattggcagcatcgtgttggcagtgacttgacagggttggctcggcgtgtgtggtgatgatgtgtgatgagatgatgggcttctgtgtgtcaggcgtgcgaaattattgcgaaccagctcgcgtcacatcgcattgagcacagtaccgagtgactactcccgcggcaatggcgttgttgttggccatggccgggaaatggatgcatggggaagaagctggacatgtcgttgcttccatttctgaattccttcagatggccacttgcgtctcaagcggtcacgcatttcgcatcggcatggaaggtagaagtaggagtatactagggtggtaagcaggtgatagagatcagatgtcccgtaggatttgatcaaactattatgatgcacatttcaggttattcagctaaccgatgtccccagtatataactgagtctaccgttgccgttgcagatccaagatgtgggttaagggctgtgtttagttggatccaaagtttgtattttggttgaaattggagatgtgactgaaaagttgtgtgtgtatgacagattgatatgatagaaaaggactgaagtttgaatccaaactttagatctaaacacagcctaagtgcacagttagtattctgaagtagacggcgctttatagtcttgtaccggtgcagccaacagcggctctgttcctgctcgtttcagtgtttggagttgtttcacgagtaaatacggctagtggctcagttaactacccattcaaacgacaatgaatttcgatcaggtactcacagtagtagttactggtacgaagcaggtttcatgatggaggctgatcggttcagcgttttcattactagctcctgaatgagaaaggaagaaattaagacgggaacagagcaacacagcaagtgtagtcaggattccgaaagaaatttgctgtagctgtactgcttagtagacttgctgtggtagtagccagggcgactcatgagcgtagtcacaaaagcccagcccaaacacggtgtttccagcggaaaacggcccaaaatcaatttgtctccggttgcacgagcgaccaacacgtagaagaatccaccaattcccgccgattccgagcagaatcactcgcatcacatgcatgttttccatgatcattttaggagggtcttctccccttcctccaggccggccatggtgtcgtacatgggcttgttcttcgtctccggcaggcagaacacgaggaacccgccgacgaggcccgacacgccgaacagcgcgaacggcacgcgctccccgagcaccaccaccagcggcgccaggatggcgcccatctgcgacgcctgcgacgtgcaccccagcgccgcgttccgcaccgccgtcgggaacagctccgccgtgtagatgaacagcaggttgtacgtcgccgccatgccgaagatccccaccaccccgcacgccagcctcgccaccctgccctctatcgatcagaaatttgttcgcgtagctgaatttgattggatgattggagattacgtatacctcatggcgccggcgccggcgatgaggctgccggcggagcaggagatgccgctgagaagcatggtgccgatggcgagcggcttccggccgaagcggtcgaggagcagcgcggtgaggaggtaggcgggcatctcggcgagcgagttcaccaggacgctgacgtagaggttggtcttgaggttgacgacgttgaggctgaggccgtagtacaccaccgaggcgagcaggttgatcaccaccgagagcaccagcctgaacctcgtcgtccgcgaccggaacacgtcgatgatggagcccgacgccgacgctgacgagtcgacgaccttgcctgcgccggcgccgttgtcgtcgtctccctcgtcgtcgagcttgagggacacgtcgtcaggaatgctcctgccattgctggacgcgatggcgcgcacgacgcgcatcgcgtcgtcggcgcggcggcgcacaaggtaccaccgcggggactccgagacgaacggcagcacggcgacgacgaacacgagcgacggcagggacgtgaccacgtagagcatcctccaggacgtcgggaacagcgccgcgatgccggcgagggcggcgatcccgccggagaagaagtagaaggtggacatccccccggccccgcgtcggaagggcccgacgggctcggtggcgaggacgaagaagcagaggccgacgctgccggcgctaaacccggtaagaaggcgcagcgcggcgtacgcccagtagttgggcgccatcgcggtgagcatgccgaagacgccattgaggacgccagaccacctgcagcgagcccttccgaccgaggaacgaatccgataggtgtccgaacacgccggcgcctgccaagacaacacagctaaaattatttctacttcttttttttttctttttctttgtggaactcagctacaattacttctgtcaccaaatcaaaaaggaaaggaaaactggcccatcgactgtgtcagctactgggccaaggcccagcctaataactagcctacgttgatgatgaaaattaggcccaaatgggccaccagcgccggcgatcttgactggttaatgccaccgccgaaacagacatggtgaagtagctattagtagttctaaaaaaaaaaggttaggagctattgatcactaccaggattcgacaagcttgattttggtgattatgtagtaaccgatataatgcgattcaaatgatttattgatctcacatcttggcttccagtccccatccaaaattccaaagataccggtgtcaggcagggagatgctagtaccagtcaaaagattcgaaagtatatcttgttctggccaatccaaacaaaaagcttgaaaataacagctatttaaacatgcgctgagaaacaaggaaggaaatttctgcgagacacaatctgcatccggcctattgccacgtgatttagatcagatcagccgaactagacggctagcttttcatcgagcaccgtgagataacgtaatcaattcagtgacctgatcaattatattgacagtaggttaacaacagtgacaggttgggctaaagcaaataacgacagtgagcgcagccacgcatgcaggaacccacggctaacagggtccaggcagcatattgggttcgatcgatcgacagcttttggaattaaagttagcgaaagatgatgttaagacggtacaggagtcaagcaaaagctgaacaccgaactgtccggaacctaattaattaatctcccagccgccagcagccgcggaaagataagggaggcattggcacggcgccgcttgtgcagataatgctcagtaatttacatccattatgtcgacgatgctaatgctgagtggctgatggcataaagttgacctgtcaaatctaatctcatgtgtaatgacaaccaatctaaattgttaacgagtgtgatgcaaatatgcaattgttcagtagtaaatcggaccctttatctgttactagtagaaaaattaaacggatgggacaatgaactacagtagcacacgctgggatgttggctggctggctggctggctggctagctagctccaagatgcggccgtatgcaaccaaactagctggagccacacgtacgattccgggctgcaaaaatgcaccaccacgaaatctcccggaacgtcgcggtctgcaatccatcgtccaatctagtttgaaatgctagcctatttttgtttcacggattagtctcgtatattacgtattgcctctcacgtcgatgccacaattaaggcaagcgcttcatccaatcttagtattttgcattttggcattccgttgcgtaattcgtcaaaaaaaaaaactacttggaaacgaaggttatttggacgagaattggagcactgaccaatcatgcattcggcgaagaagatggcctggacgaggccgaccttgtaccgttcggcgtaaacgaggccccactctgacaccg

SEQ ID NO: 74158 - DNA, 2812 bp, Oryza sativa
attaaggttagactagatgggcctttttggctcataatatgctagtatcaatagtctaacatacatcctccggagacccgcgtgtcgcccgcccctttgccctggctcatgatcggggcccggccccaactccccgcgggttgaaatccacacccgcccctgcccccgtaggggcagatccccggccccacgggggaaattgtcatccctacttctgtcagatcgctcaaagtgtgcttagcttattttttgacgggatcaggtgtgtttaactaatgcttattagtaatatgcccgtactaaacgctacggtgaaattctatgtctttaattaaactttaaaatggattcggatgccgtgaataaaaaagttatatagagtacaagaaaatattttttccgcatgtcacgaattcagatgttccatttcatttttgttatgtgtgctttttgaataaaattaatacaccctgttcggttcacaaatggtaattggttatatccctgaatgaaatccacgatccgctggcaaagatgtaccattctttgttgcaacaaatcatccaaatccaaatctaaatgtaaaaattttgggaatattgtaccattcattattgcaaatttatagtgcttagattacttaaaatttatcaaaggactatgtttagattacaatccaaatgtacaatggactcatacaaaaatatggtctcgggcttaatttgataaaatttcttctatccacatcagcaaaagaacatcagtgcactgtacattgtctatattgtactatacaacaagaagagaccgatccgaatggatgatgctttctggtaatataaacattacatcaacttaacacggtgagtacgtcttgccaagacaacagattgcattttccactggacattaggatatgatacagctgattgcctgattctatgctacaagaccaacaaactgatttccatagcccatcgagttggtcgtaattcttaacacaaggaacgtacaacaacacatggagaaaactgtccaactattttccggtgtccgctgaaggcccaaatctgaaaatgttcaacaagcagcaactcaaatgttaacatgctggagtttgcaccaaattattttcttttgctttcacttctagaacgacatggcaaatgctaaacacaaaactcagtaagttctgctgggatctttataataataaatcaaaatgtccagatgattaagtagtggatgcacattagtggatgaatggaatagtacagtaaactttataataatacaatctacagatgattaaatattccttgtataagttaacaatcacatccacaacaaaaaggcagattgcaaagttaatatggcaccgagatgaatttgcaaaaagaacaacttaagaacaaagtggaaaaggtgattatcacagttctagtgctaccaaagtggaaaagaacaactttattttttttatataaatcaaaatgtacagatgatcaagtagtagatgcacattattggatgaatggaacagtacagtaaaaaggatcacgttgtcgaatgcaatatctcaaagcggtacattgaaaaaaaaagaatccctgatacaggaaagactcccaaccacagaaagtaaacatatgacaagcaaaatagttgaaatggtcctgatccttgcttaaagaagtagcacaattttattccataaatattttctaatgacatggagacatagttcagaaagtcaggtaataacaccaagcagagtgtggtcataggtggtcacacttaattgattcctccatagtatataaatggatctaagtttctaaattacaataaaggacaggacgttggtaatttgaatagtaatttcagtaatcgatgtacgtgcagaacaatagtgcagttatttttaggaaaaatctttatcctgaaagccatgaacacatatctatctcatagtcaaagtgcagtcaagaaaggaaaagaacatttgacattgaagtggtacaaatcaaccagaaaaaaaagtaagagggggaacatactggatgccgacacggtagtgtggatgttgaggaatcgcctctgacctgatggatgccctatagggcgacggcacgccgcagttctggcggcgggagttcctggtggagatcggagacggtgcagagaaaaccggcgacgagcggcggagtggtgcgcgacggcggactggcggtgttcggcggggaagttaggtttagggtttggagagcgatggaggaggcgggaggagcgagaggcagagggggcggggcggcggcgcggtggggagagcaatgcccgcgttgcggtgctgggggaggagagcggaaggatttcgggggtatgggagcggagtgattttaggaaggcgcgtgattcaagagtgctgggtgagggaaggcgacgcgtacgcaggagctaatcggcacgttagattgagataatctggaccgttcagtgaagaataaaagaatgagtgatgagtgaaaagtatttattgaatgaaaaagtccactttgactcccttaattatcggcggaatctaattcgtaaccctcaaccgcaaaaccggataagacgactccccgaattattgaaaccggtgcaatttgactccctcagcggttttggagggcagttttgctgatgtggcactgccatgtcgatgttgaactagtcttcgtctcacgtggcgtttaagtggcattcaaattaaaaaatatatatatgtgggacatgtctgtcattcacacacagaaatagattatggggg

SEQ ID NO: 74159 - DNA, 5534 bp, Oryza sativa
aataaattcccaaagcgtaccatgcccaagaaaaaactggctggccgtcaaatgccaaagattagaacatcttccaggtataaacctctcagtaccatctccctttgacatgtttctctcatagagattacgccgaatatcgaaagaacactttgcaggaaaccatctgacatagatccaactggaaaagatcctaatccggctgtgacggaaccaaatttatccaaagacgctgagccgactgccgaaaatcagccgactgccgaaagccagccgaccggcgcccatgctttgggtgataaggccgatccgagtgaccggccaccaactggagaccagtcggcaacagctgaaactgcaacaacacaagagcccccgactggaaaccagtcggatgtaggtcccgatgaagaaatccctgaagttgaagcgcagacgacaacttcccaaggaccagaggctggtaaagactcaatgattgggtctctaaataaagaacaaggatcacctcatgtccagccaggaacatcctcaggtaacacatcctctcaagtgatgccgatttaaataacttcagcttactcgtctaatgtcttggaaatacatcaggaacactaggcgatgacgaagaagcaattcctcgcataaaggcggctgatgactcccgtcctcctatcttgctcaaatggtgggacgagaactcgcaagttgccggcatcgttataaatcgtcaaaaagaagatgaggaagtgtgccagctgaagaaagcacttggagaagccactcgcattgtgaatgtaaatcttccgggtgactgcctttaataactttgttcttctctttagcagaactgaaccatgatccatcatgcagagaatccatcttcgcaatgaggccaagactacaactttggaaaagctggttcctcacttgggaactcttgaagcagttagggaccagctgcatgaggccaaggagtatgccaaaaagacagagaaggagttaagggaccgaattgcccagctccaggattcgaacttcgagctaagtggttcatcaaaaggtaatcttctagatctgtcccattaatttatgctgtcatagctgtatcctcaaacatttggatttcaaacagcgcaagctaccaggatggctcaaatggagaaacagattgaagccttgaaaagagacaaagtagaactagctgcgcaaagggactcggccttgaaagaggttgaaggtactgccagctgacaatttgaactgtcctctctttaatgcagcagattcttattataaaatgtgttttgtagaccgtaaaatcaaatctcaagctcagtttgatgtcctggttggtaagatcaagaagcttgaaggagcaagagacgaagtcgccaatgtcgctgcaccactcgtccaagctatgttccttaataacagtggtccgagtgcacttgacgcaaccgaaatctttgacaagctgagagttgcaccggatgtatatttcaagaatatcaagaaagctggaagtatgggagctagtatggcattggcgatgaccaaatccttgtacccgaggattgaaattgataccattgatggctttgcagacgggacaagtgaagaagctgctcttgatcttatcagtaatgctcaaagtgcagctgacaagattgcaagcgatgttgtagagcaattccgcaacaacgaccttcagccgagcgataataactctgatggtgaaaggactgattctgactgagtgtaaatgtaacaaatggaggctcaatttgtacaatactggtgtatttatgctgtgcttgatagttctagccaaatctttgatttcttaaaagcttttatcaagctttgttgagcctaaaacccaaagaagctattaaaaactttcagtcctcgcagactaagtagaaaaatcgaacaaggcaatgataaaccaagtaagcaaattgaattgataaaagatcacactccattattatgataatagcccccgactgacgacttcaagaagaaaacttgatgttgacagtcaagatagggaggtacaatgataaacttaagcgtagaaacgacgaagatgttcaatgttccaagagttgtcgacgagagtaccgtcttcgcgcttgagtcgataggaacctggccgggtgacttcagagatgataaatggcccttcccatagaggagataacttgtgccgatctcgtgtagtttgaattttccgcaaaaccaggtcgccgactaaaaaggcacgagatcgaacattgcgattatgataacgccgcaacccttgtaaatatcgagccgaccgaatcaaagctgcttcgcggacttcttccaatcggtgcaagtcatccactcggtcctcttcgtagcgttcttcacggaaatttcgaaagcgcaaagattcaaattcaacttcactcggcaacattgcttctgccccatagacaaggaaaaaaggtgactggcctgtggcccgactgggtgtagttcgcaaagaccaaagtaccgatggcagctgttgcacccatttgccggcatagggttttagccggtcaaagacacgcgctttaatcccttgcagtatcatgccattggctcgctccacctgtccattgctcatggggtgtgccactgaggcgtagcaaatcttaattccaaaatcctcacaaaagtctttaaaaactccgccagtgaattgtgtgccattatcagtgatgatccgattgggtactccaaatctatgcacaatgttgatgaagaagtctcgagcgttatctgctgtgattgtgacaaccggtttagcttcaatccacttggaaaatttatcaatggccacaaagagatgcgtgtaaccgccgactgcctttttaaacgggccaaccatgtcgagcccccaaaccgcaaacggccaagacagcgggattgtttgcaactcttgagctggtagatgaatttgtctggcgaaaaattggcaaccttcgcacgtgcgcacaattttgtcggcgtcggacactgcagtaggccaaaagaaaccctgccggtaagctttgccgacaatggtgcgtgcagcagcatggtttccgcatatcccagaatgtatgtctttcagcaattgtctcccttcctctaaagatacgcagcgttgcagaattcctgaagggcttttcttgtataactcagcttcatgcataacataaagtttgctccgccttgaaatccgctcggcttcatctttgtcttgagggagttcttgagaagtcaaaaatcgtatgaggggctctcgccagtcggcttcaaccatagctacatcatgggtgcgcgcaacttgagtagcatctttgtgaggtactgtcggcgagtagaggtgttcgacgaaaacatcagagggcgccacctcgcgcttggatccaaaattggcaagtctgtcggcggcttcattattgtgtcgaagaacgtgactgagctcgagtccatcgaacttatcttccaatttgcgtacctcttgtcgatatgccatcatgttgtcgtcaaggcaggaccactctttcatgacttggttgacgaccagctgtgaatcgcctcgaactattagacgctttatccctagggaaattgcaatccgcagcccatgaaggagggcctcatactcggcgacgttgtgggacgccgaaaagtgtatccaaagcacatagcttaatctttctccagttggggaaatcaaaaccactcctgctccagtgcccgaaagtcgttttgatccgtcaaaatgcatggtccagtgctccatcttctccgcaggggtatcctcctggcactcggtccactcggcgacaaaatcagctaacgcttgggacttgattgaaattcggggcttgaatgatatgtccaaagacatcaactccaaagcccacttagcaatccgtccgtttgcttcgcggttgtgcaatatatcaccgagcggaaatgatgtgaccaccgttaccgagtgaccttgaaagtagtgagatagcttcctggcagtaattagaataccatataacagcttctgaacctgagggtacctcgttttggagtcggctaggacctcgctgacaaaataaatcggtcgctggactttttggacatggccttcttcctcgcgctcaacgaccaagactgtgctcacaacctgggaggtggctgatacatacagcaacaacggctcctgcgggcgtggtgaggctaagactggtggctcggtgaggagtttcttgaaatcttcgaaggccttctgtgcttcgggtccccactggaagttatctgttttcttcagcagcttaaagaagggcatcccccgctcgccaagtcgtgaaacaaatcggctgagcgccgccatgcatccagtcagcttctgaacatctttctgggtacttggcggtttcatgttgaggatagcagtaactttctccgggttggcttggatgcccctatgagacaccataaagccaagcagcttccctgacggtactccgaaggtgcacttttcagggttcaatttcatcctgaaagcacggatgctcgcaaaggtttcttctagatccgagatcaaatcatccttttgcttggtcttgacgactacatcatccacataggcttcaacgttgcggccgatctgcgttgagaagcatctctggattatacgttgataggttgctcctgcgttttttagtccgaacggcatggtgacgtagcagtatgccccaaagggcgtgatgaatgaagtcttcaagcagtcggattccttcagtcggatctgatgataccccgagtagcaatccaaaaaactgagaagctcacagccggcggtcgagtcgactacctggtcaatgcgaggcaacccaaaaggatctttagggcaggtgtcgcgaccgggaaaattgccttttcccgaacgctagtgtattaatccccgtcccaggaaaagccggggtacaccatacaaacatgatataaaagacacatctttattatatcggtaatatttacattattacaaaggcacttaaggcctgacaaacaaaaataaacagcagcggactagcggcctacggctccatcttcacaggcgctcaactggggtataagccaggactccaccaaagacatcttctccaaagcttctcttactgaagaggggaaggattgagcaagaatgagtacaaccacagtactcagcaagccacaccggagatgcataattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgattcggaccgaactggcaacccgacctgggttccagctcgtcccaagccaacccaggccaaccattccacattttacttgttgagcaaattt

SEQ ID NO: 74160 - DNA, 5671 bp, Oryza sativa
gcgcctccgtcgacatggctatccgctcggtcggcgcgcgcgtgtgcgtgcgtgcgtgtcgctcggtggcgtggggggcgatgcgtttttgcacggtgcgccctgttgtatttgtagggagagcgagttgcctgtgtttgtgagttgtgtactttgtgtgagttgtgtgtgttttgtttgttttatttggaagttatttacgcagtttcttaactctgcttactgtcaacagttgcgacaaaatcatttttctggactactgctagtacatgctcttccgatccaggatttggatctacagcgtatttgtcacatctggcgtggtgattaccatcgttggatgcattagggctgagtttagttctaaaccttttttttttcaaactttcaactttttcatcacgtcaaaacttttttacacatataaaattttaactttttttgtcacatcgtttcaatttcaaccaaatttttaattttaacgtaaactaaacgcactccaaggtgaagtatctttggacaagttggaattggaagactgtaattgcgattggctttgcattttacagtcatgtactagtacttgtgtgctttttggacaggttgccgtgctgcacaaaaatacctatccgataaggcgactttgaatctaacatggattaagtatggcaatgcatgccgtggctgatatgggcgcctgcgtttggttgtcttgagctgtttattagtggcgtatatatgctcaagagaaatgtgcgtaatgtatttggtctactcatagtccaaccagatgatttgagaagtcaattttttatatctacaaggctttatccggctgagaagaaaaggattgccatcgatgtatcggagtggggcagtgctgcactgctgcccaagtgcccatagctggccatgcccgacacatccctaatgataaggtttttttttttcatttttatggagaactatgattatttagttcggcagctatatattgagagaagatttctctttaagaccgtgttatgcagttgtacactgagaaaagatttctctcattctctgcacacacgtttcccgaactattgatggatttttttaagaaaattatatagaaaaattattctaaaaatcatattaacttatttttaaattcaagatagtttataattactctccgttttaggttataagacgttttaactttggtcaaagtcaaagtttataggtaatatagtaatatttataatactaaattagtttcatcaaatcaataattaaatatgttttttaataaatttgtcttagtattttttttacaaaattgttcaaacttaaaacagttaaaacgtcttgtaatctagaacagaaggagtaataaattatatactaatacttcaccatacgttccttctaaatcttctcttttcctcgtgtccaccatgcgctcccttccaattctcccgtcatcgatcgagcacgtacgatcgtgtacgtttttttagtcccacatggtgtccgcccgggcagtggcgttctattcgctcgcgacgtctcaagggttttggcatgcagtagtagctgctgccaccacgtcagtccaagtccagcacgtgtacgtacgtgcaggatgtcacgactcctgcgttggatcttaacgccgcacctcactcgctccgagatcaatcgtcgtcccgtccggatcccatcccggccgcgcgcgatcgattctgcacgcgtcgcgtggcgtcgcgcgcgcgtggcgcacgcagattcaccggtacgcgggggggctcatcgcgaacagcattatgtggcggtttccgctgcgatcgcgggtgcctgcgtgcggagtgcggtgtcgctgttgcccgtgcgggcgtcgcgtcgcgtggtgtgattcagaatcgtgcgggatatgacgcttgcattgtgatgggcctaatttgtgcggccgatccatcgcttcgttatttgtagtagagcccataacaatagaagtacttatcgtatcttgccataccgtgtgtcgtgacaagtactaacacaccacgacaatgacttcatttcacacaagagtgaccagtccaaactccaaagtgaaggagcatcatcagcggttcattgcggtagaatccccaggaccttgccatactcgatgaggtcgtcaaatacctcgtccagatccgtccacttgaactcgaacccttccctcaccagcttctccgacgaatagcacactctcggcttctcagggaacccttggaagctgccaatatacgcatacaagagacgatcaccgattcaccgtcagttctcttccctgattcaccgtactacctccgtaaaaaaaaacccaatcctgaatttatgtccagattcaaatttagaattggattttttttaaaacgaatgtagtagaagtttgtgtcgctataactcgaaactgagagtgccagattgccagttcgtacgtaagtacgtacccgtcagttttgacgttgtaccgagggtgctttcctgccacgaaacgggcgaatgccacgacggtggtgctgaggctgctgcagatgtacctccccgacgccgactccttctcggcgacgaatacctcggcgcggcagaggtcgtccacgtgaactgtcggaatggggccggttgctgccaggcctttcagggtttttagctgcgtctcatcacctgaaaaaacagaaaacagctagcatcgatcagtcgaatttgtgctcgctgatcttcttaaactaatttggcgcatgtctctcgatcaggttctcactagatagcaaggagagcatagctgagacgcttgttgcggccgtcggcgtcggcgctgcacccaaagtgaacaccgggaacacggtgatgaggctgatgttgttctcctccgctaatttgcatgctgccttctccatgagcacctttgagacactatacgcctgcgaaaaacaataatggggtatgctaacgttagtatagatgccaaatagatcgcccggcacagccatgcctagggtgaggtcagtcgggccggcctggccctacacaccgggacgtgccgtgccagctcacgggctacacacacggcccagtaagactcaagccgtgctgggctagcccgaaggcacgacaacctatcgtgcttctctacagaataagtctatttttcctacctaaactctgtgggctgtgttcatatggctgaaaaataaatctattttgtattcctcttgtctttgggctagcataagtctattttacatccctccactatttttgttcgatcatgccgtgccggaccggtccaccgtgccaagggagtggcccaagcacagcccggctgtcgggtcaggccggcacgagcacgaccccggttgggctgtgacgtgcttgggccgggctaaattggcatgccttgggctgggccgcgggtctcgagccatatggccatctataagcattagggcgtcatcatctttatggagtatactagtcttctagtagtagcattgtttcttctttttagagtttaagtacttctattcgtaacgtttgtttgagtggatatagagatggatttctatgcattatcaaaaaaattgtagggatgagatggaggctcaaaaaaggtagaacgtgacccaagctggtggcttctctttcgtcaggtactcgacgtcggaccaggaatcctcgtccaggacatggccgtcgccttgcagcggcctgccggagacggcgggcgccgacgatgtgaggatcacgcgcttcaccgtgccggctctcacgcacgacctcatcacattcatggttccttggacgccggcttcaataagctctttctgccataaattaacgtacaaatgcagctttgtcatcgtagaaatcaagagcaaattaatttcagaactggagacttagagagcatatatatatatatatatatatatatatcatcagagatgagacaacacaacatgcagtggtgtcgattagagaaagcgcgctaattagctagctgttcacctcaggattctgtgactggaaattcaccggagcggcgacgaggaaggcgtaatcgcagccggcaacggcatcgtcgaagctgccttcttcgtccatgtcagcgcggaagacctccaaggggcctagtgcttccaagtccttgagatgggaagtcttcttcatgtcatctgaatacacaagagtaggatcttcagaggcagaactgaactctggaaactcgtagtagcgtcgtcttgagaattgagatcataacgatttgcatcctttccagcatatttcactatatgaattaggtgcgactatcggtttgaacatgtaaatattttctacattatctaaaaaaaatattttctacatggtgcaggtaagagtggcatttggcatttgctaagtagaagggaaaattctattcatcctcaggaccctggtgctctggtctcttggcagccgtggaaggaacggaacttctgggtttttgactcggtgctctcttcagtccctgtggtcctggaatccatcctctcggagggtcatctgtggtgccacttttggggattttttgggagtgtagcgtggctatgccccttcccgctgttaggagttgcgtttagccgccgtagtacttcctaagctttagtttacttttttttttttttgcttttttcctctttccttggcataagccagtctggctgattgtgttgtgtaacaaaaactcattttcttctaatatatattgaagtgcaatctttttgcgcgttcgcgaaaaaaatattcatcctcgggaatgttctctcgttattttgcatttcgccaaaaaaaatcattatttttcttaaaaaattaacaagattgatcaatatgtgatatattatttcacaaacaatacaagttcaaaatcagcttacataagtagaaatgaaaacgacaaatttgactcaaataaaacgtgtaatttgcaaccaaatttgttatttttgttctaataattgtataagttgaaatttgaatatatctctggattggtatatatcttattatttttctagaatcttttttatcacaaagtaggactttctttctgttgttcatgacgacaattcagaaaatatgctactgcggaccaaagattccacccctgaatctgaaaggaaggaaaactttaactgtgcttagttcacgtcaaaattggaggtttgcttgaaattagaatatggaaaagttggaagtttgtgtgtagaaaagttttgatgtgatggaaaagttggaagtttgataaaaatgtttggaacttaacaagggctgaatacgtatgaacagaagattaaaacgggaaataataccacctgggtttctgaccgtcgtgttgacagcatatcccttctgaagcagcatcttgatgagcgccgaagcgatatacccgttcccgccggtcacgcacgccgtcttcatctcaaccgctgacatctcgtcgggaggacacgccgcctacttcgacccctcccagtccgcctgagaactagctaggacgacgatagttcagttattaccggcgttcctctgatctgatcgcctgtcgctaaatgcaacaaccagagatggtatcatatcatcgctgtttcaattt

SEQ ID NO: 74161 - DNA, 10546 bp, Oryza sativa
  unsure (1)..(10546): unsure at all n locations
tcccacaatatattgtgtgtaaatgaccgatgggttccacatatatttttttaattcgaatgctacgtaagcaccacgtgagacgaaggctaggccaacatcgacacgtcagcgccacatcagcaaaaccgtcctccaaaaccgctgagggagtcaaattgcactggttttaatagttcggggagtcgtcttatccggttttgtagttgagggtcacgaattagattccgccgagaattaagggagtcaaagtgaactttttcctttgttgaatagggtagatagggtagattatgaggagagacaaggccgtcccatcctggtagactaacgagtcgtcggtatttgtgggccttgcatacggccttcaggcccgtctgctctatgaatctaaattggaaaaagtccattttaattcccttcaatatatgccgaatatgattcgcatcaatcgatcgtagaaccgggtacgtcgatactttcaacttttaccgtgtaaaatgactcattcaactgttttaagagcggtattcaactgttttaagagcggtttagactgacgtgacgtccacgtgacaacctggtcattaaataaattaaaaaattgggtcgtgtttagttcgtgtgccaatttttttttaagtatacggatacacatttgaaaaattaaacgtagactaataacaaaacaaattacagatttcgcctataaactgcgagacgaatttattaagtctatttaatccgtcattagcaaatgtttactatagcatcacattgttaaatcaagacgtaattaggctcaaaagatttgtctcataatttacatgtaaactgtgtaattgttttttttcacatttaatgcttcatacatgtgtataaatatttgacgtgatggaatttttggaagtttgaagggaactaaatattgccttagttttttttctaacgtgcctttggatggctacgggacgttcgttagtttgtatccaacggagtatattcagttctctacttaaaaaataatttttcatggcgtcacctataattttcgctggcggttatacgtgaaaaccgctactaaaaatgtaacaaggggtgaggggttacagaccgccagcgaaaatcggttttcactggcggccacgctaagaggtccgccattaaaaattaaaaatagctttattttcgctggcggctactctaagaggcccgccataaaaaattgggttttcgctggcggccgattttcgctggcggcagctaacttgcacctactgtgaaaaaaatattccctctagtaaaatctcctccaatgttatcccttcccattcacctctcccattccttctcttcctcctgcagcctctccacctcctgtcctccagcctctcctcctccttctcctccaccacctcctcctcctgtcggcgtaggaaacacagcggattagcgacggtgactacggcgaccgggaggggccgggaggggtgccgtgatccacggccgggaagggcacgggcgcaggtgcaggcgtggcggatccggccaccgcagagccgcgggcggcggatccggccgccggaggaccgcgggcggcggatccggccgccggagggccgcggggagcggatccgggcgcgggcggcggcgcgcggctgatccgggcacgggcggccgctctcggacgccggcggcggtgcgcggcggatccaggcgcgggcggcggctatcaggcgctggcggggaggctagatctgccgccgccagatcggcggcgcctggctggtggtcaccggggagctgcatgctagctgcagagaggaggcacgaccgcacgagaggatcctctcttcagttcatgcgttttgttctgatctgtttgcacgtggtggggttcaactgctcattatgtttgacgtttctggatcatcattttcttctgttcacgtgctcattttcttccttcgaattccagaaaccatttctgcagcgggctgcggtggaggctgcggcggggctctgtgcagcggcggtggaggccggcggggctcggcagcggcgtcgtcgaggcggaggcagtggaggcttgaatgcttgaatttttttatgcttgaatgcttgggggaatagaaatttttgactgtaaatttaaattgtgcttgtgtgaattgaattttttgactgtaatttctgcttgggtgaatggaaatttctgtggatttttgaatggtggagcgtcgacggaggcagacggagcggtgtcgctccgtctattattttttttaaacttggccacgattaacactggcgggtgacacagtgttactcgtattttcgctggctggccagggaaaatgtgtctttgctggcggttgggcttaagacgactgacagcgaaaataaattatcgctggtggccaaaaaccgctagcgaagatagtgattttcattggtttttgttttttggcggctcaaaattctgtcagcgaaaatccaaaatggccgctatgaaagatggttttcgtagcagtggttatactacacactgtaaggcgtgtataaatctgtgaaaggataaaattggcaataaattagatgtcactagagtaaattagtaggtccaatcaaccttaatctaataacgttagcacatatggcccgccctaaacttttgtttgtgtcaaatcgaaggccatgccagttcaggtagacgattcatcgtccgccatggacacttaggccgtgtttacttctttggctaattatttttaaagtataccgacacacatttgaaatattaaacgtagactaataacaaaacaaattatagattccgcctgtaaattacgagacgaatttatcaagcctaattaatctgtcattagcaattgtttaccctagcatcacattgtcaagtcatggtgcaattatgcttataaaattcgtctcgtaatttacatataaattgtgcaattattttttttcgtccacatttaatactctatacatgtgtctaaatatttgatacgatattttttgtcaataatttttgggatctaaatacacccagatctatggatagttgcaagttgggcaatttgtcatttattttatcaatatacacgcgatcttcaggaaggcaaagtggtgcccaccggccaccgtccacttcagcaccatccgggagtgaccatacgcgagaagcatgaaatcggccttgccaagcgctacggaagcgtgaagcgcgccttattagcacgcgccgcttgcagcctcctctgtccagggctccaggtgttctaccggacgcagaatgcatccaacctaagctacccaacacacctgacgacttgctataagtatcccctttacagccactccatagctcatcaagcagttcgaacactccatttggttgtcattttcaactataatccaccacaactcgtgcaacatcagctcactcgtgttcccaaccgcgacaaagcttcacagatggaggctcagaaccaagaggtcgctgccctggtcgagaagatcgccggcctccacgccgccatctccaagctgccgtcgctgagcccatccgccgaggtggacgcgctcttcaccgacctcgtcacggcgtgcgtcccggcgagccccgtcgacgtggccaagctcggcccggaggcgcaggcgatgcgggaggagctcatccgcctctgctccgccgccgagggccacctcgaggcgcactacgccgacatgctcgccgccttcgacaacccgctcgaccacctcgcccgcttcccgtactacggcaactacgtcaacctgagcagnnncttcgtctttctggggcgctacgggcgcggcattgcccccacccgcgtcgccttcgtcgggtcnggcccgctgccgntcagctccctcntgctcgccgcgcaccacctgccggacgcggtgttcgacaactacgacccggtgcggcgcggccaacgagcgggcaagaaggctgttccgcggcgccaacgagggcctcggcgcgcgcatggcgttccacaccgccgacgtggcgcccctgacgggggagctcggcgcgtacgacgtcgtgttcctgccggcgctcgtgggcatggcggccgaggagaaggccggggtgatcgcgcacctgggcgcgcacatggcggacggcgcggcgctcgtcgtgcggagcgcgcacggggcgcgcgggttcctgtacccgatcgtcgatcccgaggacgtcaggcgtggcgggttcgacgttctggcggtgtgccacccggaggacgaggtgatcaactccgtcatcgtcgcccgcaaggtcggtgccgccgccgccgccgccgcggcgcgcagagacgagctcgcggactcgcgcggcgtggttctgccggtggtcgggccgccgtccacgtgctgcaaggtggaggcgagcgcggttgagaaggcagaagagtttgccgccaacaaggagctgtccgtctaacagccggacgatcgaaaggcgcactatattatggcaataaatcatttgattatacttatgctgcatttgcgaagctaaggtatactatgcaagccatatgtttgtgttcgtacgtgttgtttgggacgtacagttgtgttgttgtacgtcgtgaagtactgaagtgttcacagtagatcacaagttcacagcaatcaatgaggaccctgtaagccagtgtaaacgaggaacatgccatctgtgtatgacagtgagaaattatataagaaaaacattttgtgacaaaagtaatcagggctacctttttaaagtgctgttctggcagcccttcgctttttctttggatttttagagtgttcatttatcttgtgctgaaaataaatggtgtagcaaaaggtacagatttaaaataggaaaaataatatattttactccctcaaactatttcaccggagcacttagcctcctaaattattttttttggctcattttacatcccgaactactgaaaacgatataccttatcccttacattgtttctctttgtgtaagtcaaattttccactaacgtttttgtaggatgatatatgaattacaactatcgtctcaacatttttataatttttttctcactgtttacataggatgaaaacacctaaaactaattttatcatcaacattttaaagttcaattaaatagtaatgaaaaaaattgatttttttttgaacttagataatggcgtcatctatgattgtaaaaattttcagcttagaatacaacttgtataaagcgtaacataaataaaaatattactattaggtaataaagtaaactattttcaatagtttaggtttaaaatgaggaaaaaaaatagtttaagggttaagtaatcccatgaattagttcgggggagtaaggtggattttctttttatttaaaagtctgacgccaacgatgtcgagtggcgctgagacgacgcggcgctgcagattgccttggtgacacgttatttagctaaccagtgcatgcaatgttgtatagtaaattctctaaaaatatttatatgtcagaagtatgcaaaaagttcccacatattaatgacaaaaggggattatatctttgagctcctttagagcacaagattaaaaaaaactaggaatatgatagagattggtgtgtaaatcagaggattaaaatacagagaaattttatcgaatagaagtatgtgtttggatagagcataggaaaaacatagaattctttgtaagctttcgggcaaaggaaaccgaaaggagagctcggagtggattgttattgtcctgtggaatcagtagcttaggaaatgttctttggttttccgttgttttcccaatgagcaatttttctgatccaaaggacactatagtaacttaattcatagaaatacaaatcctctaattttttattccctttgtttttcctccgatcaaaggaggcagggagctctcccaaaaagaggaatatctataccattaactaacgagggtccatattatatatagaaaatccaatttatttttttcaatgggtaacagtctatcttcactgtgcgtgaaattcgggtagttttaattagagtaaatttcacaaaactattgatacttttactacaaatatttaagatggtatatcaaaaatttagtaacaaagttatagaaaaaatacaaattaatgccaatatagcattagtgcaaagaatttaaaatctaaaaaatatattttgtaaaagctttttatactattttttatgatgctctgttttaaatatgtagcttcgtgataaatttgatgttaaatagtttcatgatgtaccgccttaaatctctagctttgaatagtttgatagttttgtaaaatttatttacaaaaattatgggtcttgaagtggtaccacacgggtacctactcaagactgtcgtgatcgaagttcacgtagataacccttttacattattatttcagacggtgacaaacacctcttgctttctcagcaccttactcgtcgttgtcccctagagttgcaccgaaacacggaatgcattggcacggatcaatgcccaggcgcctagcatcatccacacaacaagaacaagaaccccacagaagcacaaacacaaaccgataccaataatgtttcagccggccgatgtcacggacagcgagacacagccaggattactatgcacgcactcagacggatagcctcttggcggcgaactcttccgccttctggaacgcgccggcggccgcctccatcttgcagcacttgcacggcgggctcaccactggaaccgcgccgcgtgcgccggcgagcccgccgccgcgacgcgggtcggccttgcgagcgacgatgacggagttgatcacctcgtcgtcggggtggtacacggccagcacgtcgaacccgccccgccggatgtcctcgagatcgacgatcgggtacaggaacccgcgcgccccgtgcgcgctccgcacgacgagcgccgcgccgtccgccatgtgcgcgcccaggtgcgcgatcaccccggccttctcctcggccgccatgcccacgagcgccgccaggaacacgacgtcgtacgcgccgagctcccccgtcagggtcgccacgtcggcggtgtggaacgccatgcgcgcgccgaggccctcgtcggcgccgcggaacagcctcctcgcccgctcgttggccgcgccgcaccggtcgtagttgtcgaacaccgcgtccggcaggtggtgcgcggcgagcacgagggagctgaacggcagcgggcccgacccgacgaaggcgacgcgggtgggggcaatgccggggacgtagcggacgaggaggtcgtactccagcttgctcaggttgacgtagttgccgtagtacgggaagcgggcgaggtggtcgagcgggttgtcgaaggcggcgagcatgtcggcgtagtgcgcctcgaggtggccctcggcggcggagcagaggcggatgagctcctcccgcatcgcctgcgcctccgggccgagcttggccacgtcgacggggctcgccgggacgcacgccgtgacgaggtcggtgaagagcgcgtccacctcggcggatgggctcagcgacggcagcttggagatggcggcgtggaggccggcgatcttctcgaccagggcagtgacctcttggttctgagcctccatctgtgaagctttgtcgcggttgggaacacgagctgatcagctaatgttgcacgagcacttgagctgtcagtggaaaacggcaagcttgtggaatgcttgagctgcttgatgagctttgaaatgggaaagaatggggcaatatatagcaggagaattgcctcaaagattggctaaaagcgtagtcgaagaatgtggaacgcattatgcatgcatggaaaattggcaaccttcttcatgcgtgcatacccaatgaggcttgtttcatgcctctgcgcacccctggctggtgttgaagaggacgacattttcctttgcttattttgtcttctttagatcgcatatgctttttaaaaaaaaaaatcttatgattgtgctagatgtttgtgaaacgtgatcgatttatcccgggccccggtttagaagctaaaatcttgcaaggtttgggattgcaacggtaagtgaattggattcatgtgggtaggcaatggtgagtggttagatttaaatttccatgatctttttcaccttttacagtagtttgatccgattagctaaaacaaggtttgaagaaattgaagagatcatacttccatgcccccaatgaacgagaggtgagcttctattaataagttgtaagaccatcttccctacaattctacataccggccaaaaatgattgtttgtcaatatggtatgatccattattaattatgttgctgtcaaacaatagcacactgcatactgatgcaagcataaagctgactaacaagttcaagacaagtggatccatcgtctatagtcctagtaggcactagtttatatatacttggacagactacagagccattattaggtgagaatatttttagatttaactggtttctataccaacagaaaacaattgagtaaaatcaatcagggtgcaatatccatcatcaataaggcctttccatcactggaatggcaaccttcagcaaaaatccaatcgaatactccataatgtagtgactccttgccacttgcagcaagaagaaccagttctggttcaagcacaaaactgcatttatgatcctttcaggcttgtacaaactgtccaatgatgagctcacaaacagccaaccgaaaccacttcatctgtgtgaattcaagagaatatgtcagtcattttcttggttaaagcatcaatgtttatatagagtattggacaaaaaaaaacagggttcacatagccaaagcaaggcgatattctgaagactgatgcagcataaataaagtataaaacagaagagagtatagaatgaattctcattataacagtatcaaaacgatttttgctatttctaagttgcctaatttttctgtctttggcctcggtatacggattgatttctcatttcaatccaataatttagaaaattaacttatatcgtgaaaactcattttcccatcttcaatagctatcctgttattaaataatattattcatcaccaccaaaatgttaggctgctactagatcagatggcatacatttctgctgcttaagacagcactgttccacctctgcttcatgagaaaacaccaggataggtaaagagccacagtaagcaacaaataattgtattctctcccatgagaaaagcggaaataaaagagaagttaccacagaagcgatctttgcattgatgagaacccctcggcctcaggaccttcacatggtgctccaccaccactagcggacactgtcttgttttcggtgtcagctactgaatctgaatcggttttactactaccgcttaagcagtacttctgcagccatctatcagtctcccacagaacatgcatgatgctctccctcgcagaatacccatggctttcaaaagggagtatcaccaaacgagatagtgcgccatggcctttcaaggcattgaagaatcggtctgactgtaagaaaaatatcactgatataattagataatattaaaccattagccaatcactggaatcataatctacgaatgatccactaacaatgaagtaagacggtatcctggatagagatgatgtgacgaggtcattccaggggttgctagaccataaaattcgtaccacaataaccatgtaagcactaaggtgctgaaaaacagtcgacctaatttcatatatgcaaaattacggccctgctacagtgcatgtttagtactccctccgtcccagaatataagaagttttagagttggacacggttattaagaaagtaggtagaagtaaatggtagagggttgtgattggatgagtagtggaggtaggtgggaaaagtgaatggtggagggttgtgattggttgggaagagaatgttgatggagaagttgttatattttgggacaaatcttgagagctaaaagttgttatattttgggtcggagggagtatttgcattttctaattctatcatactattgtaaaggttttggatgcttgtaatactttcaaatgggatactaatacatttactaagataaactatgtacatgcataaataatttttgggggcagaactgtaaaaagtccaaacttctgaggggcaaaatattaaaggtgacacaactcttctgcagatctaggtaatatgttttaccgcataagagtaaatcagttacatgggactttacctgcatcgtaagtgttccagagttgttgtcctgctctccatgaataagcaaaattggtttcttgatcttgttggccgacatgaaagggctcatctcgacataggtgttagtcgcctcccatagagttctgtcctcattctacagaaaatgcaagttgttaataagggctg

SEQ ID NO: 74162 - DNA, 11751 bp, Oryza sativa
gagagagagagggagagggaagtgggccgagccggcccaagaagggaggaggagggggaaaagacttcttttaggattttctttttataaaccttttcaactttgtttatttcttttcaattattatttgtgctctgaaaattccactaaaatttgagggctccttttagaccaaggagaatttaacaaaaattctccgggccatatttgaatttttcttgtacgtattttagtgtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtttgacttcttccgttgcgtcttgacgaacttccagcaaaactttaccactcggaactgcttggcttgacctcctgttgcggatggaatcttctcttcacctgacttggaccagggtgcaccttttggctgactcagactaggttgcggtagttcagtgatgcttccgttccagaacttctcatgattcatatcttcggagtcaacctcggacaagttatcaacttcatgtcatgcgtcgagatcagctcgtcattactaagataccatgcttgtcatttgcttctaactcgccaccaactgcctcatattagctttcctggtctccgggtgatagctacttctgctatttgatgcaagggtcgataactttgcctttgaattatgcttcccaggggagccaacttatcctacttgatatactttgacgtcttcccaaatggctttactgctggatttgttattgtctaattattatcctgccaaatctgaagcttcgttgttagaggtgatcttaatctgacctctgtagactatcttcgaacatatcacttggttcataactgggaatagctcccacgaacaagcaactcggattcactttctttacattcagtttacttcccattattatcttcaggttgtcctcacttagcattcaacgtattcctttacacctttaatcttgatgtgttctttcccattggatcatctcccaagacatggcattacctggtaactggtgcttgcacttttcactccgtgtagcatctgataccgagttgaagatttcactccttgccttcatagaaacatttttacctaggtcctcttgcttacttaatgacaaggtggctgttgtggggcaattacaattaggggtcttccttgagcgatgcagagcatgtttctgtttatcaatcacctttcggcctacttcttttatgctagagaacatctttgccaatctcttttatcaatcatctttcggcttatctctaacaggtggtattctttaatgtggattgcggacgcttctggggatgatgaggtcctttggcttgctgcctttcagtggaaccttgatgtggttcgtcaaaagctgcactgactaccttcagggaaatacattgcctgctatctgtatctataccactagggtttaattgccgatggtcatctttagtgcttcctcgagatggggagcatccaaattgttcttctgccacatcacctttgacctttttctgataccagataaactaattaccaaccctcgactattatgttctcaaatattgatgtctcctggatctccttatctgttggcaggtatatccgatcttatcaacgtagaggtatggcaggtacccttatgggtttcatccaacaatccttatcttgatctgtaaaaggcgtatcccaactcctatcctcaactactgtctcgttggctttttaacccaacacagtttaattggttttcttttccatcaacaggttggttattaactcgaggttggaacatagttcctctgaaatgagaccctaggtctcctatgtcagtaaacaattatacacatgatcacatatccgcatcttccaaaagaatcctcttaggacttgtttttattacaaatttctcccatattacatgaatacaaggcactgccttaaacaaaaagggacggtgcttaacatcggtacattgtatcctcaacatgaatcatccataagcatagcaagctcactgtttatagacatgaatatatttctgtattacatgattgctgcaaactttcgattacaccatgataagtagcggactgaaaaccacaaacatggctgctcattttgattctggagagatatagctggcattgttccagtgactgcatcctcgattggttctgtgatgatgtgataggactgcataatgctatcattcacaggagaagcttccttctgattgctggttgaagcggatgacggtcttctgcttggtatcgccctccggaggttgattgcccttggctcggcctgaagtaggtcggggagagacacaacttcttccatctacgacaattctttgctgaggctgtcgatgcagagaatggttgctaagatttattgccaagtcaggtgcagcaggaggagcattggtgcattgtttctgctatgggttctgattaacacgaggccttacgggtacggcgtttgctccagtgaccacaatacgattggaatgtctgcttcgtgtaaattggcggtaatgtggaggtcgattttgccttggttggggacagtttttggagtaatgcccttcttcactgcagttgtaacaaacaataactttcttacactcgggttcttcatcttgtacttgatttctcagctgctgtattggaacttccaaaggtacaacgcagatactggcctctgtcttgtcagctggtggctggggctgaaattgagcattgacaccttgtggtagtgcactcattggaattggagttgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaatggtgatcttggcggggatgtgtgttgccttgatgcttctctccgttggaactggcgggttggttggccatcttcttcgtcagcagaaaactgaattgacaatcttttggtacatgatcagttccttcacagaagaaacaagtgatcctgctcgttggacacctgtcgggcggatggtcttcctcacaatgaacgcatgtagaggcacacgagctggcaacatgaccgatttctccacaacgagagcatgccttaagttctattttatcttcatcatctgaggagacttgatctgaatcttcactatcagacactctacctccactagctaaaagatgctctgtcaactgttgtgcacctcggaaggaatctcttctctgatgttttgtcattcctggtggaggccattctgtgctggtaatgatcatcttacggacttcatcttcggttcgcattggtgcttttcttttctgctgaggacagttccttgcatagtgcccttgctcatcacacataaaacagatgatacttgcttcttttgggtcaacatgtggcatggcatgaggggccttctgggatgttggcggtgcgctgacttgtggtgtgagtgcttggactgcctccaactgcacttgaggttgcatctgactcgggttcaaaattggcatccgatgctgctgtagtatctctataagcaattggttctggttaatcaggtgttggaccactgccacacaactggtgtctggtgcttcattcactcgggagcttgaggtaccaatgtcctgacttctgaccttattgcctttctcattgtcagccatctgttgcaaaggtttggagaggaagagagggaaaacgaaggggagagacagattagaaactaaggataggaccttaacagatctaagtcttttgctgttatgatgtatgttaggcttattctgcaagttgattaagcaaacaacctagcatggttacatcacaacccaccgatgcaaaccacgcgctacacacacaagcaagaaacacacgactaacgacactaccctagagggtggcttaggttctgcgacgggttctccaagatcttcactcctgcttcttctcagctggcttcactgcttcctccacttcgctagcggatcctgcagccttctggagcttcggcagacaattgacgacatcttcttctttgcaaaactaaccatctagtactagttgaaatttgaagaaggaagaaaagggtaaaccttttgcaaatagcattaggggaagaagaaaagaggaactttcgcaaatagttttatttataaaatatgtccttaggttttatccacttggcttatcctacagtcgagacggctctgataccagcttgtcgcgaccgggaaaattgccttttcccgaacgctagtgtattaatccccgtcccaggaaaagccggggtacaccatacaaacatgatataaaagacacatctttattatatcggtaatatttacattattacaaaggcacttaaggcctgacaaacaaaaataaacagcagcggactagcggcctacggctccatcttcacaggcgctcaactggggtataagccaggactccaccaaagacatcttctccaaagcttctcttactgaagaggggaaggattgagcaagaatgagtacaaccacagtactcagcaagccacaccggagatgcataattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgattcggaccgaactggcaacccgacctgggttccagctcgtcccaagccaacccaggccaaccattccacattttagttgttgagcaaattttaagaattagaacactgacttgggtacattgctcggcttgcccatatccgagggctcggctattcgaatagatttactctgatcagaggtgtacatctttacccacaagacacatctccctcacgtgcaaacacgtgccacataccaccacggtatacggacggaagacgtgacatagttcccaacccatcctagccataaacaagagtaccgacccaatcccacctgcggccgggatacccgggacaggcaggcagaactgagcccctagcagcagggcaccaaccctctgccgtatgacatctcgactaccgggccgcagcccgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccgcaactggcatgcacccaaaccccaccgaaaacaggttttaggggttttgaaagaggaagagaggtgtgtgtccaattccacattaaaccaaccattccatagtgtccaaatgatatgagaattcccaaagtctaaagttataaaaaccacctaatgttgtcctatttaatcagcgaagcatctacctaaattcaaactagtggaaccaggaatagagtgtccactagttggggttttgtttactctagggtgaacaaggaaataataacaataacaataataataaggtcataacaaaggtaaataggtatggctagataaaacagtgataacgcgggaatttaaataaagcgataatgcaataatttaaatcaacataattttacaaactgggattcgatatgttcaaggatgatgcgacttgccttgctcgctttcccaaacgacggcttcgacttccacgaagagcggatcttccgaagctgcagcgtctacacgaccaacggaaaagaaaaggcttttactctaataaactccaaacaacaagcaggaacaaagcacaaaaatgggttctttacatcttaaggaaaaattagagacttgaacggtccaattccgagttcaaatggccaagatatggccatttgaagtttatatgctctttaaatggatatttacgaatttcttcatttaaattttcaattaaaaaaacccatttattgcgtcagccaagggaggggacgcgcggaccgggtccacgggggtgggggcccacgcgtcagccgctcggtccacggtggaccgggcgcacgcggctggcggcggtcggcgccgtgggtcccacgcgtcagccgcacccgcgggcgcgggcggctgacggccgggcccacttggcagccgcgagggcgcgcccgagggcggcctcgccggcacggccgacgggagcggcgcgcccgcgccccgatggtcaccgccggcgaccatcggcgcggcggagcggcgcccgagagagaggagggaagggggaaggcgaacggcggtcctcggctcaccccgggacaacgacgacgacgagaacggcggccggagcggaggaaagcggcggcgcggctcgggatgacgatgacggcggcgctccgacggtcggcgggcgaagcggaggcgcggacggagtcggcaaccactcggcgaagccgaaggaggggtcgccgagtcggaaggaggaccggagcgacggcggcggcggaacggagctcggcggcgacggcggagagagaggagcacggcgcgagcacgattccgacggcgagagcgagcggtgaacggcggaaacggaagagcgaagcacggggatcgaatatatagcaacgggagggggagagcgcggccggggagagaggaaaccgcgcgcggagatctcgggcgccattgaagacgccggcgaacttcgcgggatgaatccggacgaatccgagggagagagagagggaaaagagggggaatcgggagagggaaacgcggggagtaattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagtggcgggcgggcccgcctgtcagcggcgcgcgcgcgcggggagccgatgggccgcgggagaggagagagagagggagagggaagtgggccgagccggcccaagaagggaggaggagggggaaaagacttcttttaggattttctttttataaaccttttcaactttgtttatttcttttcaattattatttgtgctctgaaaattccactaaaatttgagggctccttttagaccaaggagaatttaacaaaaattctccgggccatatttgaatttttcttgtacgtattttagtgtttgccaatttcttttcgaattttaattaattctattattccttttagaagatgatttttattttgggatgaatttatcaggacgtgacagcaggacttgttgaggtcagtgtaatcaacacacatgcgccattgccttgttttcttccggactagaactgggtttgccagccagtcgggatgaaggacttctttgatgaagcctgctgctaacagcttggttaattcctccttgatcgcgtctttcctgtcttgtgcaaatcggcggagtcgttgtttgataggcttggcgtcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagagggatctaggggaatcttcttagtcttggcttcgctttctccactctttgaaatcttggtagcgggcacttctccttcgctcgccgtggctgcagccagtcggatatcctctcgggcggacgccatctcgcgagtttgggccatgtcgcaactctccttgtcgcatgtgacggcttgcttgatgtcgctccgtagggataggactcctcgtggaccaggcatcttcatcatcatgtaagtgtagtgcgggacggccatgaacttggctaacgccgggcgtctgagtatggcatggtatgctgtctcgaaatcggcgacttcaaagctgatgttctctgtgcggaagttttcccgagtgccaaaggtgaccgggagggtgatctggccgagtggagttgcggataatcctggaattactccgtggaaaggcgcattgcttggttttagctcggaccgagggatctgcatgtcatccaaggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttctgcttccgtttagactcataagccagggggctgccgaagatatggttgagctccttgcggtgatcttgaaaacctgccggggtgtcgccgtcgtccttcttcctcgacgtgctttgttcttcgtcagagttcttccgtgcagtcttggtgtattgatccgcgaattgcttgtagacgaaacaatctttggccacgtggttggagttaggatggtgcgggcattgggagttcatgatcttgtcgaacgtgttgacgcgcgaacgctgtcgagaagagtgactggcggttgcaacaagttccgcaggcttacgcttgcggtccttatgattgttacttccacctcctcccgtagccggcgtatccttttttggcttccaactgggacccgactgctttgatgcggtgacggcgtcttcagctttggcgtactcgttggctttttcaaacataagcttgactgtcctgggaggcttacgcccaaacttgccgactagttcttcgtggcgaatccctttggtgaacgcggcgatgatgacgtcgtcggtgatgtcggagatcttgttacgttgttcagaaaatcgccagatgtaatctcgaagggattctccggacttctgaatgacgttgtagagatcatattgtgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgctgtctcctcctgctgcgcggattgcgagaccgtagacggtaagccacgattcggggttagtggtgccgtcgtacttctctattccagtcggcttaaagccggctggccaatccactcgacgcaggtcgtcggtgaaggctgctactccgtcaaggtcgtcgtcgtggcggtccggcgagtgatggtagcctcgagctgctcggcgctgtatgattgtgtcgcgaagatcgatggggcggcgacgaggtggtgagcgaggtcgttccactcggcgctccctatggtgatcgggaggtgagtgaacggaccgctcgtcgtgacccctgctcctgcgattggatcctgcgccggtaatgctgaggcttggatgacggtagtcatgagatcggaagtgggggactcggctgccagtcggcgtgtggacgctttcggagttaactgggaccgaagccgcaatcatggtcttcgtctggttcaagatgttgacgacgtggtcggattgattgagctcgttttggttgaggagggtgtcgagaagggtgatcgcggcaaccgcattctgttgaggggtgcggaaaaccggtgtcccttcgacatcttgttggccgatgagatcacgcgctcggcgccctgcttccaaagctcgctgacgtcggtcctcagcctccttcgcggtccgctcacggtcctgctgctcacgccgtagccgttcttgttcttgtgcttgatgctcctcctccagtcggcgacgttcttcggtctcccgggcttggcgttgctcctccgtctcattattggccatgaaaacgccaaagtagagaggggtgtagttgtcatctaggcttccgtcgaagtcgtcgaagtcgtcgaagtcgttgtagcgagaactaaattcgtcgtactccacgatgtcagtaggacgtgagtcgacggtgggagagctgttgtagtcatccagctgatccgtcgaaaccgtgctgagtggttggaggatgacgccgacttccctgaagctaggcaaaatcggtgttgaagccgacttccgcctaggcctacgggatgaagacgctgtcgtggtggagacggccgctaaatcgtcggggagcttcatcaggactggtgggtaagccccatcatcttgatctggtgtcgttgaagaaaatgcgatctcggccgagtggtttgaagccgactcgattgagatggtcttgaagtaactttcagccgtgtttgggagtccaaacggaactgaaagccggttctctcccgactggtctgattccgagtcgaggagggagatcttgccgaagttgttggtgacgaagtcgaggctgccgaaccgaaacgcctgcccgggtgggaagacgaggtcgtcgatgccggagatgggacccattgcactgatcggcgaaaagcttgacgcttcccctacctggcgcgccaactgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttggagaaaatcaacatccgccgctagaggcacccggaccccccttatatatgggaaggagtccgtgttacaaaagataatctatatccctaacggaatatgcagatacagataaaatacagtcgtaaccgactaagtctcaaggtgtttccttgatatacaagttaagaaacaaacccgagatacaaataagatattctatgtatatttggtatcctatattcagcccaaatatcatcgccgtgtagatatgggatatccatgatctccacaggtggtgtcgcgcacacacctcagcagcaagcaaacaaggaggaacaagctgatggcatctatcgtggatgcctctccaagctcatcttcgtccatgtctcgccaacctgaggagtaaccactgaccaaaacggtgttctacgctgcgcacgccgtcaacatacgggatcatgcgccgtcaagatgaagagagcactggccgggagatcatcggagtagtcgcggacgccgtcgagccacccgtgtccacagctaggctgctgcctcgccgaagatgctatttcgggcac

SEQ ID NO: 74163 - DNA, 2799 bp, Oryza sativa
ttaccggcgttcctctgatctgatcgcctgtcgctaaatgcaacaaccagagatggtatcatatcatcgctgtttcaatttagggcgatgatgcaatcatgcaaggcgttgtttgtaattcattaccgaaagagtcttgcatccacaaactagtcccgtgtgtcccctgtcctgtccaccccttctccactgtgcaccatgtatatttctttttcaggtcaaagtacgtccaccatgtgtttatacacgtctggttgtacgcgcatggctcgagcagtgcaggacgcccgtatcaagattgctagttcccgcaagtcagcgagcgtttcgcgacggcagcgcctcagcttcgcgtctgacatgggcctgctgggcctagtgacttttcaacggtgattaacgatgattcagtcatgtacgtatatatgccccatatgcacgttgagtaacacactcaattagtaatagtatctcctaattgtaattggacaatccacgtacatacatgcacgcagtgattagaacatttaactaaactttttaacagaagattaaatttttaaattgaaaattttgaaaactttcaactcaaaatttgaaaacttttcactcagcatttgaaaactttcgatttaaattttgaaagttttcaactcacaattttagaattttcatctcaaaattcaaaaactttcgattcaaatttgaaagttttcaactcacaattttagaattttcatctcaattcaaaaactttcaactaaaaattcgaaactttcaaatcaaattacaaactttcaagtcaaatttcaaaactttcaactcaatttttgaaacttttactcaaatttaaaaactttcaacttcaattttgaaaactttcaactcaacttgaaaacttctatatcaaaatttaaaaagttgaaatcaaaatttaaaattttcagctcaaatttcaaaatcttttgactacaaatttaaaactttccattacttttctaaaaaaaactggtaactgaattatttacgttgttactgttttaaaaataatactaatgacagtaattaacactaattgccataattagcggcggaagcgcgcgtacaagacgtcgaggagacgcgcgcggctgcgcgaattaagcagtcggcgcgcacgcgcctcctaggaacccccggtaagtccgcgctaatgctagttagcgcgcgtgctgccggcggcgcgcgtttcaggcccaaaaggcccagcgccgctgcgtcggcgcacgcgcgacttctccgcgctttttttcgtttttttaacctttttttccttttctttcctacttttttctgattttttttatctttatcatgttttgagtttgaaagtttataaattttgagttgaaaattttcaaacctaaacttgaaagttttcaaatctcgactagaaagtttacatatctcgatttgaaagttttcaaaattttcaaatctcgagttgaaagttttcaaatctcgagttgaaagttttcgaatctcgagttgaaagttttcaaatctcaaattgaaagttttcaaaattttcaaatctggacttgaaagtttttgaatctcgattctcgagttgaaagttttcaaatctgagttgaaagttttcaaaatttgactttaaaatttaaaacttaaatcgaaagttttcaaatctaacctaaaatattttcaatctgttagtaaaaaaatctcccaaaaaatctccagaatctttcctagttaccaccattagtgttaactatattaactaatatagtggttaagactaaaggggaggagggagtgctcgctgttggcgcgcacgcgccagctagcagcccccgtatcgtatagttgtatgcgccactgttaacaacagaatttggtaagtattcgtatcagtaaaggggatttggtcaagaagagttggaggcggagatcgagttctggaacagagcaagaatcggctggagtctgaatcggctacggttaggatcggctatggctaggatcgcctaatgtcgggttaagctaaataagccgatacagtcgattctgacaaaagaacttgtgcgcgacgtccggctcaggttgatgtgcttcaagatgattgccacgcatggatagagtcctgggaaatcaattgtatctattaattaggattatttatgtaaattccttatagataagtgtgggcaagagtctgccgcaaagacttgtgatagtttagagtttgttagagataatagtcgtgtccggtatgggcatatcttgtaatcctcgggtataaatagaccccgagccctatgtaatttagacagacacattcaatataattccggcgcatcgccaccttttgctttagttttatttcgacgagttcttgctttcgggttgagctgcatcggtttcgatcttcgacaagaggtaaaactcgttatgacgaattatgttcttagggattagcgcttccatcttcatgacactcgtatctcatttatataattcgtcaagttatcatatattttacataatctatagcagtatcattgtctaatctatcttcggcagacatttgcacgcaaaagacagccgattaggttagatctcaacgttgatttagattatataagatatctaccattctatgaatcttctagcggcttgattgtctagatattgttcttcttttcatacttaatgctgcatcaatcgagtttgatctattaagtcgtgcttagaatattgatctctagcctgccacctagttgttgattagaatag

SEQ ID NO: 74164 - DNA, 2978 bp, Oryza sativa
ttgcgtgggcagcacttcggtcattacgccggcgctcgatgctggtgcgggcgtcctgctccccacgcagatcttcccgggtcgaagaagtcgacgaaggagtgacggccgaacggcgaacagcggctgccgctcgtcgtgccctccgtcttgacgacgcggagccggtggtagcagcaccagaggccttggtggcggaggaccgcccaccagcatctaggcgctgccgcgccgtcatgaccaatttggccacgtcgtccagccatcgttgggctggagactccgggtcagggacgacaggcgggtggcgtaagagcgcgcccgtagcttggagcgcgccctggggcgtgctgccgtcgccgtagacgaggaggcgacgctccccatctcgccgttcttttccatcgcccgcgatcggtgaagtcgcggatctttcgaccctctcgagcgcctccccccgcttaggactttggcgtgaagggggcggtggagtacgagctcgacggcgtgggttcggctccccgtcgtcgccactcacactcggagagaggtcgtgcgcctttgcttgctcagccatgaggctgaacaggaaaagcttggtgcacacgaaagagcgcaagagctcagaagatcactcgcagagtcccctacctggcgcgccagatgacggagcgtggggctcctcaccgggagaccgcgctggcccccctttgccggttcggccggggaccctgggtgagactctaagctcccaatctgtatgtggaaggttcgcgagaccggaagcacagaagacaccggcgatgtatacaggttcgggccgctgagaagcgtaataccctactcctgtgttttggtggatctgtgtatgaagcagctacaaagtgtgagccaacctctcccttgttctaggttccgaatctggaaaaaatcaatccaagaaaaagctcccccttctctcagtggtcaaggtcctccttttatatcttaaggggataccacatgcaccatttccctcttttttctgtggggatttcccccaccttctcagaaatagacggagatttgcatggttgccgttcgagtcaccttctgatggaacggcccgcacctacctccactttcgccgggagcaggcgcgacgtagaatcatggctgtctgctggcgacatgaccggtgtcagaatggtcacaaatcggtcattcttgtccaccacgcgtcagcttagctatctgcacgttggctctccttcacactacattttgcctgtaatggttaggatgaagcctggcatatatctgatcagggctaacgtgccatctctgggaggtaacacgctagctccagctggggacgagcgcctagaagccctcgacctgacgggatggggcgaggcgtgcgtcagaccgcctgccgccacctaacccgcgatctgaccggtctgtgactggtcacagaccggataaacgagtgcactgcactgcgctacatgcggtgtgacacgctcagccaaaccgcaattaatgtggttaggtgagccccggtgggctcacctaacccatacacgcggagcgaaaacccacgaggggtcagggcgcctcggccctcggggccgaggggggtgcagcccgaccccctcggggggactaagaggagggcgaacacatcaccctcgggcccgacgtcccccgagggtgccaggccacgtgggcgattgtgtctgcctcaaacctctagtcatgatactcccgatcccatgtcaccgacaacctgatttaagtatacatcgacataaaaattatatatcgttaatatctacacccgatcaagtagatttagtttttccttaatcattcacgattgccgatcgatacacagatgacatcggctcggatataaatgatatgtcatcggcatctggccgatcggctatcatttatagatttaaccacggttcttttgtctttatttcttgttgattgcaggatcaaatcaactgacacgctcacacatccgaaggcgagttttggacctgcactggagttaagtagatctcccaggcctcgtgttttctgtcaacagccaccccttctccccaccgaccaccgccctcctccacgctgtccgtcggccgttgcgcctggagggaggagaagagagaggagagagatacaatgaagagagggagatggggagagaggtggaagaagaggattgtgagaatgacatgtggggctcacgtgggccccaccggtcttaattatttttttctaactaacatgtaggctaacagtttttattattttccaaattaaattgccacgtaaatgccacgacaatgccacgttatccaaaaacctaattaaattagccacgtaggtgccacgtcagcgaaaaatgagaacaatgttggtgatggatcttgtttgcactggttttgtaagttgagggacccatcatacctagtttttccagtacaaggacgaaaatcagattcaaattaagggactttaaatgaacttattctaaatttgctatgggccaccttgtttacgggttagagagcccataacaataatggttaattggatccagccatgcatcgagcctttttatagatcgcaagtggtctcaaaggtgtggtttttaaaatgggattggtgctggagcactcattggtgccgcatccctagtgtcggttgagaaaaccgataccttaagaggtttttcacatgttctgtggtagtgaaagggtccgtatcataaagagattaccataccgtaacacacaacaatgacttatttcacaagacaagaggactaacaatttcacaagagaatttttatgtccaaaactccaaattgacggagcaaccatcaattcagtgcggtagaatccccagggccttgccgtactcgacgaggtcgccgaatatctcgtccagatccgtccacttgaactcgaacccttccctcg

SEQ ID NO: 74165 - DNA, 4693 bp, Oryza sativa
catacctgtatcacatcagaatccctttgtcttggaggccacatatctgctgatggaagacgttcatgcataccaccttcaacatggattgctctaccctttggctatatgaacaatacaagttagctatggcagatagcacataaagaataaattgatccattcactccaaaatatgacttcataataccttagcaatcccatttccttctttcaatacagaataaatctctgactttggcactgatttactcaatccaagattgtaatggaactcctgaatgcagagatatgtaaacaattcttttttctggcaaatagaatgattgaatgaaatttcaggttatctcacctgttgcaatcctgacaattcatttgcaagtgttctggttccatgcctgaagtgttcctacaggagagaaaaaggggctctattatcatctattggactaaaaaattataacataaatgtgaacaaaataatgagtcaacaaaacattaaagcctaccatgtcaaaacaatattttctccagctttcttcatccagaccgaaattgaagtagtccgtgagatccacaccatgctgtctccagggcttctcttgaaatgcttcaatgtctacgtcaaaaactgtcctgaagtaacataccataacgtccaaatcagaggtcaagtgcaattgcacattctagttatggtatgcatatagacagaaaggccaacttatgcagctagtaggcataactaataactctgcagttagcaggaatatcttttaatgtctattggccaaattaagatcataactatcatgtcagagagatcatgactttaaacgttgaatattccagaaaactacgacgagaattacaagaatcagttgtttgttcttgggccaaagacagaatggcacctgttccttggtaagaaaaaattgaattccttttgaaatgcatgctggtggcttcgatcaccttgtcctgtgatcggtgctgttgttttctcgaaaagccccttccggtgaagctcaccaagctggaacacggaacaccacataaaaaaacaaatgtcaatagaattgctcccagcaaaatcaaatacataactcaatgtgatattgtgatataccattcatcctaattagtaacagaaaagagatagaaaatacttgcaaataatacgatggaaatgaaatctgttaggccttgttcagttaatccccaagaggtagggatcgaggggattaattcacaccttattcccctccaaatccctctcaattcccttgtggggtgggattaactgaagaagtgagctgtgccacagactaatgacagacgattctggaacttcccctgcactttcgatttccaatactgtctacaatttctacgaaattttaccctacgggttattcgccaattcgtgaagcataccttgccccgaccgccatcagtagacaggcctttcacacagctacccgaaacctccccttcctcgctcccctcctcgcatcggccagcaggaggaggaggcggcggcgcggcgccatcctcgttgagcacgatatggaggtcatcctcgctctcctcgtcgctgctgatgtagcccgcagtcccgtcgcccaagtccaccgcctcgttcgcgtcggcctccgtgtggtgggctcccggcgcctcggcctcggcctcgccgtcggtggccgggttggagcctccgctctccccggcggcggcaagcgcggccgccacctggtcgtcgaggtccgcgtagaggtcctccacgtcgtcttcattcccggcggcggcggcggcggcggcgtcctctgggtcggccatggggtaaagcagatggattacgagcgacgccggagtggtgagagcttgattgctgctaagccattggtgatgccggctgccgcgaaaacctttgccacgctgctgctacagaagctaaaaccctaagcccatggagacgcgctggttggtgaatggtgatgatggatggggcttgcaactgcaggttgttgcttccgggttctcatatcatgggcctccactgctgcatcggttcggtttcctttgggcctcaaatcaaccataccggtaatgggtattgtcaaatttcagtacatttttacgtggaactgcctgacaaatcctatccttttgcgggtgatttctaaaagaacttagatttttttacctttagatttacatccaacagactacaaaagaaaataacaaatatatatttgcttacacaacatttttatcaaaattacagtacacttacatgttatatcaattgaatttatgttatatcaattgaatttacgaatgtatttacaaatgtattttaagttataggactgtaattttatattttaaataaattaactaatacatatttacttacacaatattttttatcaaaattatagtgcacttgcatgtcataggagtgtaattttatattttatttcttcaatctcttcacctagccgcatcgacgtgcaatgtgtgtactcatcaatactgtgccaagctagatgttgctgacctcatgcgtgcgtgggaaagaaacgcatcacagccgctaactaaataatgcagagactaatccaagggaagcaaatccgagtgatttcgggccaaaaatttgtcgccagatgtttacaaaatcggttttatgtttacaaaaatttgatagtgctagatacgttctttttgtagccttatcatttttattttcgaaacataatataaacgtagacacccacgtacgtgcgtacactcaccctttatcaaattttggtagtgtttatatgtaagaacttctaaactactaaattttggtagagtaacaatggtaagagtatgtttggtttgttaataacaaactgagcatgtccactctttcccgttcagtttaagaacaagtaaatcaattaaatgagtaaagagggaataattgtcttttgaatggtaaaagaaccatgctgtaggaaaagaaactttgttcagccatcacatgaagcacttcaacatttgtatgaaaatcatctgtgctcaaatttaagaacgtaaaagtgtaagttctagatgtgcatgtagccgacatacatcatttacagaaaatgaaccgtacaggtataaaaccaaaatctagtctgaaattctgaatcgtatgtattttcagtgtcctacactagattacaaagatgcaacacagcaatccctcgacgtagaagtgttatgtaggatcatgaaagtgcatcagcaacagatgaaatagcgtcccttgtcgcatcacaaataatgaaactcgagaccatcaaattcttttctccagcaaacgaactagatctgctcaagtggtgtaaattggacgctgctcctgttcttagaagccccgtagcccacaaaaacggatatacagattgctactaccgaaagaagcaaggcaaaggcagttgcagcatcccatgaacgatttggagctgggcggtaatgtgcagcttccatggatggttgaatatcaagaaccaaccagtcgcagctggccgaataatgctcggacttgctccatggtttgccatcgtttgggtaccagaaagccacagccatactgttgggcccacctatcgtgaactgtgcatcctgcatggccaaaggaacatttaagcgcaaaatctagtaaaacaaatttggtaatgcaaccataccaaaagctattccatcccgtgggagcgattttcaggttgggtaaaaagatgtcactcgctagtagtgggctgagcctgaaagcatgggttaagggcttaattcccgaaccacagggggcggcatccccatgtatgaggggggccggcttctgtgacctttcttggctgggctccggttgagctcttctttgtgaaataccatggggggcaatctttcccccaccagccaagttttttactcaattcaaccttagataccaagtaatcaaagctatcatatgagtatatgaccaaataatcgataatactactagacaactatcctgtgtcacaaaaaaaactggcatgtatcatcctaatctgaccaccttgcaaatgcctggttgtacaagtaacctgaataatcacgtggttaaaacaattactatactcatacgcaaagaggttacatgttaggtcaagtagagcagtgtttagaaccttgctaacggatcataataaggtgcacgcgtcttagtaagaagaggatgagcaggatggccacccaactatggcaatgttatttagacacaatcacagttgcaatactggaaaattgcagacctagctgtcggtacattagaaatataatgtataactatttgttggtaacttcatatatgcatttatgcacatgtctctaggcatgctggtgctcatggaatattgggaagaattgaaacaatagtagataactacctgctgtaatcgatccattgttcttaggggccttgaaaactcaaaataatatgtgcccttctcatcttgttttccgtaaggactgtcatcatccacaaagcctggagaggaagaacacatgatagtcagacaatataattttatttgggtagatttcccttttccatcaaagcttatgcaatgataaaaaaatgtttatttgttgactgtctgaatggtcttaagat

SEQ ID NO: 74166 - DNA, 6074 bp, Oryza sativa
  unsure (1)..(6074): unsure at all n locations
cgttcgtgctgaatctactctaacaaatgctcttgccattccgccgacgaggcatttacttcttgcaaggtcgtcgttgttatcggcaccctcatagagccccttttacgggctcgtcatcatattaaccggatcaatagtagatccattgtccgaaggaggtgccaaagccacgttcgtccggctgctgtctgcactgacttcttcatcaacatcttcattacaagtccctgttgtataaggggcatgacgggtcatgaggtgcccagccatgtttaatccggcagccgtctacaccaactgtcttcgtcaactcttcgttactttgatctcacctagccaggaggtgcccagccaagtatattcggctgtcgtgtacaccaactgacttcaccaactcctcttccctttaacaccattccgacgctgctgctgtgatgtctctaccgtccaagctacacgagttccatgcatgtcgaagatcaacctatcaacaccagcacgtcgcttaagactgatgaggcggaacgacgagggcgggcggagtctatatgaaggctacgccactaacaccagcgcacggaccgacgaggctgtggatgcattgccggcgcccacatatatatccaccatcttcaccaacattcatcatgcatggagaacgggaagcgaagacgacgagacgaccacaagtagcttaatcggaggtgctctgtaggcttagacatgtggagctaattaaccaggagcttctcaaggccctaggaatcagaaggccacatcgttaatgtcaagatctgtccaacgacaggcaatggcgcgcgtattttatattatacatggaaactgtatcttgttaattcaattaataaagattgcgtgtttctgtgtcccttttgtgtttgttttacattgtgtattttgatacactggcacgcccgtacttattttctttttaaacatagagggatacattcgtatttttctatcctaaacacagtgccgctccaaggtttgtccggctccatctattcgtaccacagccaccttagcctgagtgctcgagcgaaccggtccaagtcgagcacaccgaggccacccagatgtttcggcctgcaaattctgtcccaattcactttgcattcacccccctccccctacccgagatgtcctctcctcttgcccagaggaatttccgtctcatcttgtcaattgaatggagcatgctgtccggaactttaatggctattaggtgataaatggtttgtgccgtgaggacggatttggtcagtgattttctaccggtggtcgtcatcatcttgccttgcctgggcgccagcctggtcttatatttatccagcagcggctgaatgtggacctttttttttttttagcttggagaccgttagatggaggccgacatactttatccgaaagccggttacgttagcggggaagacttatagtatctcttggaggtctatgccagtgcaatgaaaggacgcaatttgacttttcgatatgtttatccgaaatctggttacttctccgaaggaatgaagaatttgggtaagatgtcgcatatcattgactgttggtcggacgaacatggcaacatcattcgcataaagggatgtacgaaggtgtgctgttctcccattgagttgtgcgagcatgccgaagtcggttgccttcagtagcactgcctttaaggggtcgatggctaggatgaagaggagaggggagagcgggtcccctgcccgcatccaaattttgaacccttgattaggatgatcattttggagcacgattttagattaagatctaattgctgatggtgctttaagtccgagggatctgcaccaccaatagttaaccatatgtgcccctgaagacacggaaccaaccagcaaagtctcgatagctgctcgcagcatcaatctggaggaatagatcatgaccaattcctgacagcctgtttccaaaatcagtcagttgacctctcgaccattagaaattaaaatacaacttaagaattgatggtgtaaggaatatgcattatttaccatggactcacgacaatttgagctacggctgatcagctgcgggggaaaaaaacaaagcaaccttttatttatctgtgctgttagcagtttagaagccaatcagaaaaaggactacaatttaaaaatttccaaaactaactctaaaattaaatatgaaaattcaaatctggaatgtggctcataaggtagcagaaggtcagtggcaaaagtttcaaatttttttactaaagtcaccgtcctgcagcacatcatgacatcccacctcaaaatttttacaccctatcacatcggacgtttgaacacctgtataaaaaatattaaataaaggctaaaaaaataactaattgcacagattgcgactaatttgcgagacgaatcttttaagcctaattgctccatgatttgacaaaatggtgctacatcattcaatgattgcagtttactggcggattctgtaattagtttttttattagtacccaaacacctcatacgacaccctatataatatcggatgtgatacgcgaaaactttacaccccttgatctaagcaccccttaatacatggtatttggtaagtattcccaccaactaagcacggctgatcctctttaaaaaaaagaaaagaaaagaagagcacgctgatcctacaagagtggaaataaatgggacgaggtgaagaattgcatagtttcaaaaatatctgtaaagttgtttcgatattaaaagagtagttgcagcaaatcctttctttctatatagtcacccaaagcttaactatggttaagccacgtcaccacttaatcctcagccgttcgatctaatatgaatggttgcacacgcgtgaagcccagcccacgtctctttccggagtttgttggtttctccagttgtcgtaggctctccggacctctcattatatttgaaagatgaagtgaataattcaagtcatcaaacaaaaataatgaaatatccgacgcctagagagaaaaatattggagacattgttaggcctttagcttctcagtcaacttcagcctgagatgtgcccgtcaaaccactcaaaggcagcgaccagatgtgctacacattcaggagacttgacagaatggctaaagatctacaacatctcaaatattcttaactcatactcatgtgaatctagttcccaggatgtgcgaactagattcatactttcatcttaaacatggaattacatagcaaaatacatttaagacgaaagtgatctaagatttacaactatttatagttataaggtccgaccggccaaatatagatatatcagagaacagcggaagcttgactacccaaatacaagcacaccgactaggggtttacccaagtaagttcaagtcctagaagaagcagtcgaaacccgcatcactcctgcacaaatggatatttcaacatatcaagcatcagtacattaatcaaattaatgtattgccaagcacaagataatcctacatactacatgtaaggcatatattcaaagaaaggcaatatgtagttcaatttcaacataaagcaagttttgtttcacaattcttctgtaaagggagttggtgattcagttaacaaatcatttttgcatgtccatcataaatatcattatatcatcataagcatactcttgttgtcttccttggcaacaagtcatataatcatcatcacactcacacaactcaacataattaacccatttcaatctcaagttaaacacacacatttaaaaacataagtctatactcatgacacttcactatgccgctcatgaccgtgagcacgactaatcgattagttttagactctgtagagtttgtacagctttatccacatgatatgaattcctctagtttatccggtacccgtcagtaccaccacactctacatgttaaatgcggtctagaggtcataacgaggccgtattgcctaccgtctaaccttgcttgagcacgatgcgtgttattccacactaagcctagaagcttagtgtcgtcaggacggctggcctaccgaccctgatgccgtggcatagcattccctacccacgaggcactacactgttgtattggacacgcgcagacgcccatgccacaaagcgaacatcagttcctttgctagaaggtggaggaaggaagaaaaaggaggaaggagaagggcttcccctcgaccacccangggtcggcgcccacgtccacccaccgcccatcgaccagggcaacaacggcagcaaccatacctcgcttccccttgaccacgccggggtagacgtccacatgccggtactcgcccaactcaccaccaccgggtttcacccccgcatctcgtccacgcatgggtcgtcatccaccaaggcgaaggtgacgccggccgacattgatgtcgacgacgacgacaaggccgacattgcagatacggcccgcatcaacaaggttagtcatatcaagctctcatcgccctagataatgttcattcatgtatttatttttatggtttggagtatgtcaacaagtaattcttgtttcaatgggtgatgttgctcatcaatctacacaagtacatccaatttcatggatgagtgaatagccatgatcagtgtcgaaaagattatattcatggatgattgatgatcaatgcatacaagttaattgtcatgaatttaatgtgctatggaatgcatttatatcttttttattgtgaccctgctttgctgttaaatgaaggataatgaatacctttatgagttcatctatccacatatgaaaatatgtttaaaagactttgatgacgacgacaagggtctcgaaggggaggttccatcttacaaggaggtgatgatccttctcttaggtattatatatatatatgtatatatatatatatatatatgtatatgtatatatgtatatgtatatatatatatatatatataggtttacaaacgttacaaacttggtaacaccttacaataaaatcttacaacattaccataataaaataaatattacacatacttattgacaaacatattaaaaacttattgaaatataacgtcatgcagcaaacatatcatgaccgaacataaataaccggacagtgtaggttataactactgcaggtttccttcctccctatcgtgagcaccctaagagccccttctattcctcctcgcacgttgtttcctaggttccatgcttgaagatgtaccctccttgttattcttgcaatctctagtgcggtgcccgtactgaagacagtcctcacatcgcctcacaggccctcccgttttgaatgcatccatatcacttcttaagcgtcgtgtttgtcttctacccttaccagccttcaacaaatccaagtctagcacatagatccttttatcacccccagtttcgactaggtgttggagggacctccacccgaggatctcagcactccatgcattcagaactctatcctttagggagaacgtctacacgtatgatgttgaatcaagcttaattttagcacacgcggccaggacatggctacatggcttatgaagaagcttcggcttattgcaagagcacgaacatgtgttatcagattcgtgccctagagtaacttcatgagtgatgaccccagtagaagatccaaaaccccccttagtgcgacatgtgacttcccaccttagtctggcgttcccagtggtaatgaccgtgtgaaatcttgccttgttagccttctcttggaggtactctgccatcctatgggttgttgttggtctgctcatcgaactttgtagactgatttgccttgcacaaccgcttgaatatgttcatcagccgccgactgttgaattgtttgaaaaaattggctcccatgtgctgcatgcaccaacggctatgcatgtaggccagtagtatgcgacatcaccatcctcctggagttctttgattgctttcaacagaccggcattccggtcatggatgatgcatatcgatgtg

SEQ ID NO: 74167 - DNA, 2881 bp, Oryza sativa
cgaacttatttgtgcataaaatcctcgtccaggaatcagccgaggtacacaaattgacaatttaatatacagattcatcaaattaactaaaacgataaatcttacttaagaggcactcagtcctcaccaagaagaaaattacagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcgaaagcagcatttagcaaagagttaagagtagtaaaacagtagagtaattaatcagaaattttaatcaacactgaacagcacacccatgctgtacaggcccaaccatcctgaacaaccatacccggctgtacagatctaactccaaaccaggagctaagcaaattgttaccagttataacatccataattattgtgagaggtgtgggactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgctccgtaatgaatcatgttatacaaaaggtaaagccgttgcccacgctggcttgtggttggcacggttaatgtttcacaatagtagcttgcgaaccggtccttaattgtcatgagcacgactctcaaaaccatgtgctcacaacccaccattatcaagttttagttggcaagtaattaattaaccaatcacgattaaccatcgtgaactatcattaaaccatcattaaataacagtgaataataagttatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacactttcgacgcactcacgaaccttcgcaacgacggaaacgacaagctaacacgcaaaacgaggaaaaagactaataaaaaccaaataaacaatacaaatatgtagatcataattttagatgaattatgagacttgaacggcctcattctgacttcatatgaattaattatgaattttacaagattaaattccaattaaacctattaaagaaaagactattccaaattaattaaacaatttacaaatgatttataactgagagaaaagattaaagcaacctccggaaaagattagattatattggtagatgacatatgataaaaagaaaaaggactaatatgccattgaaaagatagaacgaatttatattgattttggacggctgagattaatcttgaccgagagttgaccaagatcggatggcttagattgatctggcaagcgggcctcacgagataccgactcaacgagtcaattctacgtgacacgggatcacccaaatgatcaaccgaaaccggcgaacggaaccggcggctctgaactaaaggacgactcaacacggacgaacgaacgaagcacggggaacacctcattcgaacgaacgagcgaacgactcaacaacggctgcggctaaaccggtggactagaaacgattcacggtaaagccccggtacgacaaacgatagaccggtaggaatttagggatgcacctacggctagacaacttgactaccgagcaacggctaaagcgacggctaggttaaagcggcacacagctgcgacacggcggcactagggcgacttggcttggctaggcggcagctcagcggaaacacaaagctagggttagggtgacggcacagccgatagcgatgcacgacagcggcgcggcgactgcagaacgtgcactagggcaacggctacgcggcggctagcagcggacaacagcgggtacggtgcacggcaatgaccggctcgacgctaggaccaaacaagattagattgaattaagaccctagggataaagtacaccggtgaacgacaaaggagcggcggttgccgacgaaataatgcaatcggagggcaccgggagaaagaggaggcaacggcgattcttaccaacacttacgcgacgacggacagcgacggaagatggccggcgacgcgcttcaaagggcggcgaggtactgtccacggcggcgacgactttccggcgatgtgcggcgacaacagaggggtggccgggcttcacttcgcagctgcgaatccaatggagtcgatggcgacagagggcgatgacgggaggagcagcagggcttcgccgaagatcaaaacgcgacggcgaacttcgggttgacggcgacgatggagctccggtggattttggcttcggggagatggctgccgggcttctcctcactgctgcgatgccgacagtggatacggcgtggtccggcgaccacggagtcgacggc

SEQ ID NO: 74168 - DNA, 2316 bp, Oryza sativa
aatcacagcctgtaactgaaatcatgaacaacaaaaaagggggaagaatctcaccagggtttctgactgtcgtgttgacagcatatcccttctgaagcagcatcttgatgagcgccgaagcgatatacccgttcccgccggtcacgcacgccgtcttcatcccaaccgctgacatcgccgtgccgccggctacttcgtcccctccaggctccactacgtcctcctgagagaaatagcttactggaatgaagacggcggttgtaagagtacaagagtacagtcactgtcactgacgttcatctgataggatatgcttgtcagttgtcaccaataagaaatctttgttatttagatgcaaaggtatgtttgtattcagggagtaaactttattccatgtcacattggatatttggatgctaatttagagtattaaacatagaataattacaagactaattgcataaatgagagttaattcacgagacattttttaagcctaatcaattcataattagcacatgtttactatagcatcacatagactaatcatggattaattaggctcaatagattcatctcacgaattagtccagggttatgtaatgagttttgtcattagtctacgtttaatctatctattaatctaaagccagtggttatgccagcttttgattgggccacgtggcgcccctagcttatcaaataaatcatgaattttgtctaaggaaaaaaatacagaagatcaagcaaaatagaaaactacagtgttatgtgataattctaaaagcaagtagtaccttagcagtttcttttaagaaaaagttgtaccttaacaacacagcatccagaacatctagctgttcccacccggtaaaaaaaaaaatcagcttccagaagcttctaactgtacatcacttcgcaataaacatagagactttctagaaccactcaaatataaatcataatttaagataagtctagttaaagtatctagatccatagacttatacatctagattatagtcctttgcaacaacatcactcctagaggcattcaaatatccgatagaagaaaactcagaattattaaaaaaaaaaagggaaatccaataaaaaatatgagcaacagggtcctcagctatcgtatcaccgtgtagcaccaagtcaattgaccatttcaattcctccttttttcagtttccagttaccatcgtatcttatgaaccaagtgtacttcctccactaatataaaatattcccaatctttttcttagagagataagtatggagtgaaaaaactataatgccatttattaaataaaatatagttgaaaaatgacagaatggttagaagtaagacatgaagaaaattaaatcaagaggtgagtgatacgacacgcagtgctcaatttggcaggaccttccagcttttctgtagctaaagctcaacaaagttttttctgctctataaaaaagagagtggagcagactatagtgacctagaaaaatgaggggtggagtgaacacaaagaccgtcaataggccactacttaacttcaaattctacttctagcatttaggagttggatccttccacctaatatttgtggacatcaagagtattatggattattgagagcaagctttgtaagtttacgattttctgtaacttttttttattacaatcactcctttttttaaaaaaatattaatcttctaatatttttttcagagaaccttctattatttaactccacctactttctactttcttaatactttatagtatttaattatatcaaaaatttgttagaaactcaacatctataattaatcgtccaccagaaacatagagaacacacaatcccaaattaacattacaggagattatgctcagaacgatatgcaagagaatacaatatttaatggaacatagaagttgaacgaaatgctaaaaatatcttacaaaattttcatgtttcaaacacacgctaaacaatgtatcgggctataaagaaagtgtgccaaccggcacactaatgttctggtacttctaattagtgtccaaacatccgatgtgacatggcttaaagttttagtccctgatccaaacatttcaaattattttaggacgaggatgcaacactatgtgcggggttggaccatctatggaaagaaggatggaccatttacggaactgtccttacagaactgttcagttgatatgaaagtgggtggttgtttggttgatatctgattgaggagtactcctttcgtctcataaaaaatcaaccaaagtatcgatgtgacacatgc

SEQ ID NO: 74169 - DNA, 9865 bp, Oryza sativa
tctgatacgcatttgtttttattttgcttgggaactgttcttattctaatacacattcttttttattttctcagagtttttttttttcaaacaaggtgaaatagaacattaccatgtctatttacatcaaataacatttttcagtaaaaccaatagagtaaaagttgtaacattcaaagcttcgaaacccacatactaaataatagtcccaacaaaagggcaaataaaaaatttacagctgcgataaaagtttgcattattgtctcatgtaaccttaagttctcaacctgctatcctcttgatgaaaggatagactctaaggaacaatccaagcaactagtgtctgatcagattggatgggcctccttccagatctgctcctattttgatatgtatctactccttcgcttattattacttaattcaattgaacgctactatcacttgtacaaacacaaatagaacggtttaagtttgaaacaaccacataatacacaatttaggatgtctgagacatgaaagctactttttggcatatgggaattaaattgtctgatgaatgttattttttcagatgtgaattaatggtgtggtctgtgttaaatttgttttcagatgtggatttcatgcatacataaattagtagctagcctgaactgaaaatattgtctgtcagtaaaaaaaaaaaaactgcacttaaaaaaactgatgattgaaattctgttctacataccagtacagcatcgcaggtttatctggcctccagtagattgaacgctttcccttgcggacactgcttgttgctattggaatgtcctcagcaaggggcaaatcacaaagttccctaatgaattctccatctacagtccataattcaactttcttcggaaaccttccacaaggtacaatataggaatatggacggtgaatagaagaaatcattaagtatttgtcatctggtgatgggtcaatagatgtatatacagcaggagggccaattggctttactgttccatcaaaagaggccaatacaagctgcgaggtcgcataataatcaaacagatcggcatcatattcatctttcaaaagatcctggaaagttctcacttggaccacatttgatgtctcattggactgaattttcggaccagatggaactgagggcttctgcggtggagctccacgtgacagagggatagtgcagacaagcaaagtagaattgttaacccatacaaagctgcaacagcaaaacaaaagttctttagaagtaggacaggagaaaacagcagaaattgatattcaatttcacctgtcaaaaatagcatttaagtatatctcaggagatttaaaaagtggtcttgcttctccagattccacatctgcaatccacaaacgtagcttgccgcttgtgttgtcctcctaattgaatccacactagagttcattatatctaatcatttgaacaaatcacatccatttttcaaaggcagccaaccaattacctcatcaactctaacgctgaatgataaatggcgtccgtcttgtgacctaggtcaaatggttcagtgcatagagttaggaataaagtaatccataatacaagtaaaaatcatttctgaaacagctaaaactggaagcaaggcaattaagaaccagaaaaaaaaatccttgaagttccttgatggaaggtccagaaaattaccaggtgacaaaattaatccttgcgccttcaggatatccatggaccactttctctggacccaaagtcccatcatccatcagcttatggatacctattccagtgtagaaagacctacaaattatgtatatcagatttccaatcataacatgtcttggacatagtactaaacttgtcacagataaaaacgattagttagacaatgaaaatttacccaaattatttattgtacttacattctgcttctagtattagaatagccatcaattctcacaccagcaagtttctcttcaggctttgcgagatccgacaatggtggcagtgctcggcgcttcaggaataaaatcttgtccttgcttggcgagaatgatagcacgggtagcggtggtgcatcaacgatgtcttgtatttcttttggaggaaggcggtagcccatcatcgctgatgaaaggtctgcagagcaattaaatgcatcaattgttggctgtaccactggtctacattatcttttctcgttgacaaaaaagccaggacagaatctgctcatacagaaattaaaatagatgttcaccaggcatatacgttaactatgtcaactaagacaatctatcattgaacaagccaagcaagacaaactaacctatatgcagctctaacaggtctgtcaaacctaaaaaaataagatgccaatcaacttcttttgatctttttgaaacatgagaagctaagcgctatggccttcaccaatctatctagcgttaaactcataccacgaacaaaacctaaacaaatttgaagcactcaaaatcaccactaaaaaaatccacgatctcttcacgaaccgatcccctaaccaaagactagtgctccaatctcgtctccatcaaaaccactcaaaatccgctcaacccacagcctccccgcgattccactcactacaaaagcaaaaaaagatcacgcaatcaacgaagtcagcacgaaccatcgtcctcttgggcaagaccggacgctgcagccgccgccgccggcggctcgctggactccccggccgcaccaccggcggcggcgacgatgtgggacagccttgacgccgcggaggaggacatggcgctccggcgaggcaggccgagagggcggcgaggaggacgaagaggagcacgcagaggcgggactgggagcagagcgaagcggaggcacgccctctggaggaggatggtgagggaagacatgatttttaggtctctacctttcttctatagatagcattacaatagtggggatggtgggtactcgtggtcgtgggattgatggaaccgggaaaaagatatttctgctgttttgatatattcaactgattttctttctatgcttgaaaattgaatttcgagtataaaagtttttttttttggcttttgtcgcaaacatagatgatgtactccatccgtctcgtaatataataatctatgataggatgggatatttcatagtcgaatgaacgtagacaggaggcaggtacagatttgttgtactatgaatcgttttgttatattatgggatggatggattattactagtagtagttttaaatttcaaataattttggtttcttattggcctaaattttgacacttttattgagtgtgatgtaaaatttaagtgtgtcaatgaatgtacgccgaattagtactcccttcgtcctctgaaaaacaaatctagaactggatatgaatctggatagagatatgtttagattgatagtacatggaagagctatttggcaaagtctcagagcccctgtgaatcgcagggtagaaaaaacggagtaataggaaaaacacaggattctgacaggaattgaagtgtaaaacagaggattgcaaaacacaggaatggtcgtttgattggagcgcagaaaaaatacacgaatcggatgagagagatagactcaaagaaaattttccaagaggttggagctcttgctaaatttcctccaaaatccacatgcaatgtgtcattccataggaatttcataggatttggaaagctacaatcatttgaatcaaagggccaaatagaaaaattttctatgaaatttctatataaattctttgattcaaagttgaccctcgtaatggatctatcagacatggtctatttatctcttcgatgagggtcatggagaggataccgatgtatttggcagctagcgtgtgagacatttcagactgtttatgtggcgatatcgcactgccgcctgagcaattaccggatgactggctagaagatccccgtttatttttctcccctgctttattcgcattccactacagatcgtccagtcctagtgcgtgtgtttctggaacgcgacctgcaacgaaccgcccgccgttagcaaagcttgaaggcttgaagtctgtccagctttcaggtactagtacagtttttatccgtccctgtccctgccatatagtagaacaatatcttgtcagattatctgaaatctaaacgagtctagaaggctgagatctaaacttcaactgcaaactataacttcctcgtttttcattagcatgttttctgatacattttgtgtaaaagaaaaatgtatacaagtgtttaattttgcatatttataacaattaatttataattaaccatgcgctaatgaatcaccatgttttgtgttttgtgtgctgcaaatatactactccaatataaagtttcaaacaggcctaaaacttcatattgatggtaaaaaaaatggaaccagctgaggagtgaggactggagctcagaaagtcacaattctgctgctctaatcaaaatcttcagtaactgagaagtcaaaaaaaaaatcttcagtaactgaaatgcttggcatttgctcaactttgtcaaattggaaactatctttgaagtggaacaggaatacataaacaggaaacaaacgttggagacatatgctccctaaaacatatctgaatatgatatacatccctatgttattctgtagacgttcaacatcactgctatctttttaccatttggcaggaccgcaagggtttttatatacagtggctgaaacaagaattacatagaagaatcatatcctcacttaaaaataccaaaaaaaaacctaaacgtgttactcaaaaggagacatgctatgctagtatcaaagtttgcagtctcagaacaaactgaacccctgcgattcctcctgattctcttctgatgtctcataatatgttggctcctctctttccccacttctataactatatgcatactctgtactctcttttgaataatatgctgatgcttcatactctggcttgacaaactgaagcatatacttcaagccatttatgacatcgtaaatcatcaatccaattcttccaccaacccaactgcccagatggcttcctgtaagataaccaaacctccccagcctctcctcaccatggaacccacctacataggttccaaatagggtgccggtacctcggagaaaaccttcagtcatgcttccaccgaagtacatggcttcaaagaagtcccaaccagaagaaattatcggccccaatatcctcttggcttgacgagctgccacttttgcggctttcgcaccaaccttctgagcttgctttgctgcctcagcggcagacaggccttctgtcacagcatcagccaatgctttctcaatggcccggtgcctcaccctttccgtatgtgcagtttggaggttgtagacatacaacttgatgccctccttcactgcgcacgcaaggctgcctgagcccatatcaaaacagttcatgaacgtaaactggccactctttgatgcttcctccttcccgacaagttccctgaacttctcagctgtaaaatgcaaattttcagagttcaaaaaaaaaaaatcaaaacatcaacagctaacagctatcaacatagaactactactaatttttttcatgttcttatcctggtgtacccacttatcacaagctgtgttttcaagtcgtccgattagtcgtccttatagctaccctgacctcgatcaggaacttcgaagtgattagttcgaccagaaaacttattgtccgactaatcacgactagtcacgattagtcgatcaaattagtcgtggacgactagtctgttagggctaaaaatatgtgttagactttacacttcagtggcaggccttttgcccagcccaagaaggcctttacccctcatctaaccgactaaccctgaccagacatctagatctagtcacgagagagaggggagaaaagatgaaggacttattgcaactaggacaggtaaatgatttaacttttaagaccttaagtcaagtgtgaactgtcaactgtgaaaatctgattatccttagtttgtactatactatactagtatactatggtaattcgtacttataatcatctatatattatcctgggcacccctagcctatagtcaccgactaatctcaactagtcggtgcccttacgactagtcccgactagacgacttgaaatcactgatcacaagatcaagggattggttggcagggctcccaacttagcttcttaacaagacttcaccattaaaaattgatatataacacatggatttagtatttaaactatgaaaaagaagaacttgatatatgatgaaatgtctgcaaagtgtgcaccataatatcataacacacgtacaccgcggtcggccacaatatacaagggtaggcaagatacacctaacaatcataattggttcagctgatagacaattttaagaatataactgaatatattggcagttggcatccccagttcgtcacagtggtaatattctaaccttcaataccaagattatatacttgtactgcttgttcaatgttccacccatccttcctatcttaattacattgaatgacctccttcggtcattccagcaaaaacatccgtacgcattaataattaaataattataccaatttagtaccaatttcaaccaaatttacgccttcctaaattatggccaaaagaattatgaaaacaaggactacattggcagagcatctttttaataggcactcaaagttcgggctgaggactctatcctagctggaccaaatgaactaggctcgacctaagggcacgataattattagtttttgtttacctctaattcgaaattaatacaggtaccaatcattttcagttgactaccttattctgcaatctccacaactacaatgacgtcattagttttgcaaacgagacggtaagaaaaccatatcatttggagtgcctcctaaagctatggccttcactcttcgaagcaattaccaatcgcccaaaagcccatcactaaaattctctccactcaaaaaaatcaaccaaacaacacccaatcctgcttgacaagaacagcgccctccttgtcccacccaacaacaatacgcgaattacaggatgaaacgaaaaaagcagacatggaaattgcacatcaggacgtccccaatcgacgattaacctactctccacgaggccgtacaaatccacagatcaagaacgggaactaaccggtcatgctgagcgcgaggacgcccacgatgaacagcagcagctggacgcgtcgcttctggatgtccagcatcttcgccctcctcctacgccccttgcctcagacgctgcggagatcgattgccctcgcggatcgcatccaccggaggaggaggaggaggagggaggaagggaaaaaagaaagaataaataaaaaagaatggtcgcagcgtcaactccgcggttgccgcgtgttactctagaaacgaagaagacgatgcgcgtccagctcactggcacgtggggtcgtgggccccagatgtaggaaaagcttggaggactgcgacgtcacggggctaaaagctcgagggcctaagtgaaaaaacttcggggtattgagctgatcagctgaacagaactgcccccaagacttgtggagttgtagcgaagctgcaagagtgacgcggcggcggcgatggacggcggcggggtcgaggcggcgatggacggcggcggggtcgaggcggcgacgacggcggcgtggatggcgcggcaccgggggatgtacgagcgggccacgaggcacccgttcaccgtctccatccgcgacggcaccgtcgacctgtccgccttcagacgctggctggtcagttcctcctctcggtctccaaaattcccccatcgcttattaggcagacaaaagatctattgtaattctcgtagaaatatcaaagttctaaatggtctgaagtgacaccgttcaattgttccttctggttagcaaaagtcctagttggtattagctgattagccaagattggaagggaggcacgatgaaggttcattgttagaatttgcagtaaaaactgtgagctgcgagaacattgttggattcagtaattgaccctattgtgttatcttgagtgttggatacttagaagatgttggtacctggccagtccagtaatagcttcaggccctagcatttctttcaattatgagcatctgactcattcttaatattgtatgaaaaatgaaaaaaaaaaagctttattccaacgactgaacaaaaaaacaaatagataaaggtggttcctaaatgggggaacatatcctatgcacactcacttcccatgcacatcaactaataaatatcacggaaaattttagaaaaaaactgatatgtactcttaatagtattacacgtatctacaaaatcttatattcaaattgattatattttaactgtaacaaaaaggtgaaaaatctaacagttttaagagtaaaaatctatcagaattttgtcttttttacgactaaaatataatgaatttgaacataatatttcatagataggtgtaatactatttaaagtatgtgtccaattttttctataattttttggacatttgttagttagtgtgtacggaaaacttgtgtgcataggatatgttcccaatggatgaacggaatacaataatcacattttcatgccttactcagggccaggactacatgtttgtgaaggaatttgttgcgtttctagctagtgtactgctcaagtgttgcagacagtcagatggctcggacatggaaataatactcggtggcttagcttcccttagtgatgagctctcttggttcaagaaggaagctgaaaaatggagtgttaatctagctgaagtttctcctctgaaatccaatacagaatactgcaggttcacgcctatcaaacttttgcataactttacagctatagcaacctgaagaattatttctgtggttctaatcaggtttctccaaagcttcagcgagccagagatcagctacgttgttgccataactaccttttggataattgaaaccgtgtaccaggatagctttgctttctgtatagaagaaggcaacaagacgccacctgaactcctggggacctgccagagatggggaagccctgagttcaagcagtactgccagtctctgcagagaattgcagatcgctgcctcgcagaagcgtcagctgatgctgcgaggagtgctgaagaggccttccttcgggtgcttgagctggaaattggtttctgggacatgagctcttctcgatcatgaacggcaacagcatctcgatcatgaactacttgggagaaataatcgaataatggtgcagccggttccataccgaaccctgcagtgtactactgtgttttcctcttccttttatccccatttctctccttactcccatgaacattgatgtatcatcgtaactatgaaataaatgaaataatgccgtttcctcctaatcaaaatcatcgtcgaatttcaagttcctggatagaactcatatatcagtatcaccgccggttgatctgcctgagacagctttgacactgctgaatgctgatcatcatcaattgacagaattccatttcaacgtggcaaatatacgatggaacatgtattccaaaagcacatcgtctcatgcacatgctcctaaaatgtcaagccagagtatgaatttgtattccaaaggatcgcttgtcctgcaatcgcggttactgaatactccctccgtattttaatgtatgac

SEQ ID NO: 74170 - DNA, 5907 bp, Oryza sativa
ctctccgcctctggaacaccgccgcctcgtgcaccacctctctcccccgccgccgccgtcttcagccggccgctgctgccgcgttagtcgtcgccgcacctcgtcgtttgcgtcgtcggcaacgctgtgccaagctctacctcggcctctgctctgtttccccatttcatcgccgcaaccacctttccgccgtcgacccgagctccgctaccgccgttgtcgtctcaaaccaccgctcctcaccgctccggtcgcctatttctctccctaaccgctccaatattttccctaggtcttgccggccctcggccgcggctccaccgtggtcgggcgtcgtcggaacgccgttcccgtcgcctcccgtgccggtcgccgccatcttttccgccgccggccacctccccgtggtcgtctcgccgtcgccgtcctcggtgagaatccccaccgccccctctcctttttccccatccgccgctccccatgcccgccaccgcgacgcgctgccgtcgccggtggtcgtctggccgcgtgcgcgtagccgccgtgccatggccggccgggtcggtctcggccgcgcccgtgccccagccgcgccgcctcgtggccgtccgatcggctttgggccgatccgggccgtcggttcccgtggaccgacggtggaccgcctcggtggtctcggtccacggtggaccggcgcccttgagccgctgccggtggggcccgcctgccagccgccccctctccctttcttagtgccgctgacgtgtggggcccgcgtgtcggcgccggccgcccctttgctgacgtcagcgaggtcctttttcctttgtaaaaataattaataattgcacaataaatcgagtttagttctagaaattcatttaaatggctcaaaacttctaaaattcatatctaattcattcgaactccgaattgagccattcaacttgcaaaattcatctaaaattgagctctacatgtttgtttactttttatgtactgtttcctgggtttttatgagagtttttcctcgttttgcgtgccagcgtgtagtttccgtcgtttcggaagttcgcggtcgcgaggaaaagagttcagaagatcaaagtgaagaagcaaggcaagtcacacattccccttgagcatgttgatcccaatttataaatgttttaccgtttacaaataaatatgcatgttttgctaattacacggggtcagggtttacctatctgctcgcttgtgccatgtttacttgatatctgtcctttgtcaaccttgggtgataaatcgactagcttgtgttacttatgtgacctagctagaactttatgcttagccatgcttaattaccactagctcagtcgatgggataattgcagtattagacattctagtatcttgttgagccgcgtgctcgagacatctggccatgtttcatggtcgtaattatccaactaaaatgcgactgaatggtgggcagtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtggagatttaatattactttaattactcaacagttttactgttttgcccaataaaatgttttacaaccgcctttatgcaaatagccacagaccatccttgtatccccttgcacgtccgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacatgctagcctcacggtatgttgtgtttggcagatccgagttggatccaagaagccgataggttcttttgtcttcttagcatccatgtattgcatcctacagaagaagtttgttagtaacaatcacatggatttgtattgtacatatttttcatataattaattaaaactcatactcacatgcaccaaacaccgacgtagttgacgtccatcttatcccaacgatatatggcgtggagatatgagaaatctagccatacgtaaccttctttgccgaaacaatctgccggtgatcgagctgttatattgcccaagcctttcttgctggcctgcatgtagaaggtatgtaaccttttcatctcccatggtacttcgttcagtgcccattccggcaagagtgctttcccatgttcgtactcagccgggcaatcatcggttgtgaagtatgttggcccggctagttcagcggccttctgggggtcatcatctctaggcttgccacgttccttaccccctctgaagacggttaccatgaacttctccttgttctcatctttggacttggagtcgtggctcctaagcattctaggcacctcagaactggtagtggccttcttagggatagtggtctcttgcacctcggggtctttcgcaggagaagggtcatcaaatatttctggctttgtaccgtcccattccaatcctggtacttcttctatttcggatccgactgatgccacaaattgcacctctggttctgccactgtaatctccatgggcacttccggcactggaatctccatggctgcctccggcactgcaatctccggtggcacttccggcactggattatccttttgcatctcgggttcctccgccttatcagtcaccttcctcttaggaggtctcggaggttttcccaaccccggttttggcaccacaggtttttccgtggcgtcggtgcccaatccaaaggatatgtcattcttgtgccagagaattacaagatcgaccgcatccccaagtacggatacaccatctgcagtcgggaaatcaatgtcgtaggagtcaaacccttcatggaccacttgcggctacaccttggcatacgcatcgggtatgaactcttcgttgtatgttctcccagggatagcaatggctgtagcagcctcaagagttttcccggagcgtccaatgggaacatgcaatctgcagggcgtattctccttgaggtcatcgaaggggtaatctggctcaggttctttggtttcggggcgaggcaaaatcatgtgcttgacgcagaaatccatcatttgcctttcaaactccgcagccccttcgtctctaagtttatccttgtacgcttcacgcttcttgtgggggtcatgtttgaacccttccttccaactcatcttgctcgacacacctcgaacccttcccccatgctcaggagtacccagcgccgtacttagcacatctttctccctcttaggcttgaaaaatcctttcttctgtgaactggataaattctctattttatcagcaatgctctgcaactccggatcttcaaacgatacttttccttcatccgtgatcttaggagttctagctcttacccagttccttgatctttgtgtccattcctccattggtaccagttgccccttcttcctcatttcctcctcctcttttgtttactgctccacctttggtgcgtatcccgtggagcctaagcgatgaggaaatttgttctttttggccaaatctgcatacttttggctcctttgaatttcttccggggagttcttcaacgtcagaaagtcgtccaactgattcgaggttatgttggcatacgtcgaaaacggtgtgcgtcctgtcttgacaaatttcgtgttcaaggtggttttccaaccacgccaagacttggccattgtttgcagtgcacaattcctcactgctacctctgatccatccgtgaactggaagattttcttcaactctttccataggacttccttatccccattcgatacatgatcccagtccttcaccgtgatggggatcttttcccttactattatgccacactgtgaactgaatttcgcacgtgccgtcttaggggcgagcggctctccttttggcgaaacatgggtaacaacatggaaaccttcatcctttctattcacgcttctctcgcccttccttttcttcgccttagctgaccgttcgcttttctttgagccggttgtgttagctgttacctcgtcaatttgcgacggaacttttttcttcggctgccattttgatcgccgtggcgccgtttcctacgagaaggtatacatgacagtttcgaattagctcgggctaataattatcacggtgaatagtttacatattacgtttacttaccccttctttagggggaatgtagtctttgtcgccttcttcactgtcgccttttttccttctcttcgggcttgggcttggacaaggatcacttggcaacgagtactcatcgtcttcgtgagctatgtcgctgccggaactatcttctggtgggaccgttggttccgaagcaaccacaacagcaagggactgctcttgctcccctaaacccttctcttcagtccctttagtactatcggccatagtttcaaacctctaacataaaagaaaaagttatcctccacattttaaattactcaaattagtacaaacaactttaaattgcgaaattaattaccacttactattatgctagaatagatatgttattaattagtacttatgctattaattagtacttactattatgctaaattaattagtacaaacaaatttaaattgcgacatgtaattaattatacttactattatgctaaattaattagtacaaacaaatttaaattgcgaaatgctattaattagtacttactattatgctaaattaattagtacaaacaaatttaaattgcgaaatgttatatattagtacttactattatgctaaattaataatgctaaattactatcatccacaatttttttaaaaaaatgttaacataccctcctacatgttatttaaaaaatttgacaaattcacatatcatgcaaaattaaacataccctcccaatttcattcacatatcacccacattcccaaattcacattcaaaatcacatataacccctcattcacatatcacccacccctcatttccattcacacccacacgcacacacatatataccccctcacacccacatgcacacacatataaaaaggaacacccacatgcacacacgtccgtggacgacgaacgaccgacgacgagcttcggtcgtggacgacgaaggaagggccgacgacgaggttcggccgtggacgacgaaccggccgac

SEQ ID NO: 74171 - DNA, 601 bp, Oryza sativa
cttttttttttcatgtagtacaactcatttaggactaattaatcctcctctgagcaccattagcttcacgtactgacagtcttaaaccacacttccaaagttactagagcagttactgtacgtagtactccgtaccgtgggggcagtttactgtgctccgctgaacacaattatcagtagtacaagagatgggagaagcacagtgcgagctgcaggctgaagcgtgcacgaacgacgtttacagccagcctcaggtcgttgtcgagcagcggttgcagctcgtgtggtatactgcatacttgaatcggatgcgtcacgagtgcaacgggacaagccgagcaagtccatatcaacctatccaatgccgcggtgaacagcgacgcaccgtggcgggagcaaattttcaccgggacgacgacgaggtaaaaaatgggctcaaaaactgcagcgtccagagcagagcattcgggtcacgttgattggacggccatttatgctgtgaaatgcacggtgctgtgcggataattgtataatatacggtggccgtatatgtacgtacgagtacattcatttctcgtatacataggcgctgtttaggctg

SEQ ID NO: 74172 - DNA, 12832 bp, Oryza sativa
aatttgacgttaagattttaaccctaggtgtaatacaattgaaagtatgtgtatgattttttctagatttttttgtgacattttttagttggtgtgcacgtgtgtgcacgtgagggcctgtgtgcataggatatgttgcctagttaaattgtatgcatctcacctatattgtctctcatttttcccttttataagacaacttcctgttttgatcgttcttattaatctgaacgaaaacagttcattacaaaaacgatgacaagcttttaaatatatgctacatacaaactcataatcacacctatccatttgtatgcatctcacatatattctctcctttttcccttttataagacaatgacaatattgttgttacatgttgatctagaaaactcaatctgttgtttattttacttcctgtcagattgtgttttcacgatcgatgaaattttcatggtttgattccctttatgatcatgcttacctatgtactactaatctcaaggtgagcacaaaaaacccgttttgttgtgtccaccatataccagtttgtatgcagattccagactttcagtctagaatttgtatatccttttgaacaggtaagcataatccatgatttgatgattatttcaaatttattactgattttttatttacctagctctagcttacgttttttttaatggtttacagctaacaatctaactgtctttgtaactctatatattgctgaacatttagtgtaacccagctttcccatatgcatcgatttggaaaaaaaaagttgctcacttaggatcttcaaaaatttatatgttacatattattttcaactaacaattatttgtagataaccttggcttattgattgcttttacaacattttacctcctgggaatgtaaaattagaaatggcatgcttctttgttaccttctcctatgatcatgttcagctgatttgctgccctcctcccttttccccttctactttgaatagctgaaactcaagctctcttcgactaacaatgaagacagataattgacctatgcttaagataatcatatactatcatcaccatgctgttgtatttggctaaaataccaggaacaagctccatagcttattgaattatattgtgataactacattagtctgtaagtcaagacataattccaagatatgatgcatctagccaaaaattatttgaatatagttgcagcctcttattcttatgcacgcgcgcagcgtagcgcgcgattattgctagttactctgaaacgcaaatgggaagtgaatgtgttggtgggggtcagcatgagaagataacactgtttaatttattgtatatttttgttgcttaattgaatgagtgcttggagcactcactaaaaccagcagcaacatgcatgctgatttggtagcaataattatgatagcggttttcaactgaattcctggattccagcagtttgtcatttgacagtgctagtaaaattttcagtggcatgtcgtatgttttccttcactccatttattccagggatctctatctggacatttgtacgtgcaaataaagaggcaaaacaggtctactgcaattgacgagcgtatgtgctgcatggaaatttagaaacaaatatgtgcagcaattgctttgataactacaatctgatcttggtcccgcagtttccacagaaaaaatgggataacttaaatccttatctgcttttatatggaagttgattccttctcttaattatttacctctcttattattgttatgaaaccggcggcacatgagaagatctaacccggttacccactaattagcccattgctaaatatggattctatctattgttatgcctaaaagtagaggggaggttgaattagtgaatgagaaagaagtgacaccctcatatcttgtatctctttttagatattatacaacccctctgaactacacgtgtacattggttgcataataattatctcaatgatatatatgtgcatcacgcgtgaatatgtcatatgctttgataaagtaagaaataatgctcctttcatccaaaagcatatttcttttgtcactaaaactacagaggaattaacaaatcgaccatgtaacaaaactaagaaatcatatttatacatgcaatcactgagtaataagatatctctctttgagttaaaaaaattaatttagcacggcttatactttttgaaaatcagaaaatgaaatatgtcttaggctgttggatggagggagtatatttataaagctgtagtaattaagaattttacaggaaatcaactgacatgaaaacaacgtacattaaaaaaaaggtgtcttgctcactcctcactctaggcatgttgttacttgtttctatgtgctttagttagttcatatcagttattagttctgaatgatatgctacttcaaaaagaagaacaattaacgacctccaaccatccatccatccatgcatcagtgcatgcatgttggtctttagtggtcaacaacaaccttctagcttgctgattttattatatgataaactgttgctctgggtgctgcatgcttaaccataacataaacaaattcagtgccactttgcacatactgccagacctttttttagaacaattaatgaaagaggttagtgcaagaaggaaagcaaggtagctagtagttaattccagttgaataaagaggtgtcatctattaattggttcatgcatgctgccgtgagaagggaggacaggaaattcggtttgtaaaagttagtctagcaagtagcaattgcccacaaatataagtacaataatatggcttccttcgtggcagtagctgtgagagtatatactgattggctcaacatgtgtaccatgctttaatttgctatagtcatatcccaccgagagtgtgtgcctcacgatcaaattgtgtacgtacgttgtatatataacttttcatatttatgtacatctggtttgggaatatgccagtcatgtgtaacagtttcttccatcggatctaatgacactttggagccagtcttcactcgtgcttattcatatatttatattttttttattcaactgaagtggccgtccacttggaacttgcacttagagcaagtttaataatatagccaactactagctagctccaaaaattaacacatcattcatttatagctaacttagtatatagcctactaatacaatagttaattatagatacatactacaccaataatgctttccccatatttctctctcacataggttatcagagtttgtgctatagttgattataaatctgtagcccacttttactctctccttcacacactactggagaactaatctttaattagctcggatgccaaaaacatatttgtcccggttcgaataggaaccgagactaaagattatatttagccacggttcgatagctgtcaggccatgtcagacccccaacaatcattagtcacggttggcaaggtgttaccaactgagactaaaaattgatctttagttccggttagagacaccaacccagattaaagataattttagtcctggttggtgttaccaacctggactaaagatgcctccacggttaaaaaagcatctctatccaagttagatgtgtgtagtagtgggggtggtaacgcgcgtgagggtgttcacggctattaaatgccaattctatgccgccaatacctgcataaaacatagttaattaaacatccaacataatgataggatttaattctaacatattcaacgaatgttggtgcatatttggatgcaggtactaaaccgtcaaagttgggaggaaatttagactaaagtgaagaagaacattagaaaatgggcccaattaccgagaaatggataaggcagagcgaggaggaggcccagaccaaatctaggagccatctggcccagcccaggttcggtcaaacccttggttcggccgaaccttggtgatcgccattggatccaggttttggtatggacgctccagatgctctcctgatggcggttgcgaggcaattcgaacaattcccatagttataaccgccattacctgcctataaatagagctcccattctcacttcactcacacactccaagcttgagctgaattataagagactctattgtactttattgtatactagaattagggagagagtagagtagaaaaagtcggaggaattccaaagttgtcagtaatcctctcttatttcgaaactcgagttaaattttaactcatggtgatgtggacgaatctcggacgtccatttctcgatccaactgtagtttccaagtttcgactacatatgtagtttgcactgtatattttccctaattactctgctttaatagaattatcattctgagaaattaagatttgctcggtgagaattaactcttggttagttcctaattagcatgcggtatcattgatcactatagttcaataaaatatagtggctgctttagtgtttagctagctctaaaatagttattaattgcgttgacgtggtgtccaggtaattaattgtcggtggttgtttcgtatcccacggtaggtttgaggtgggtgtagaggtagtgatagccctcaattacactgaagttctccctgtccgggtatgcagtagagcgatatttgagagcagcgggctggccaatacctgaagtatcgcgttaggattaaactgagttttacgtatatgttgtttttcgctaggaaatcctctctaccattttcctacatgtgcttctcccttggatgaacctaaagagtatctgaatacacacgttgcctgaggaaattgataccttggaatactcccgggtgaagtgctacatcggtatcttccgtgcgcttgcagattttatctgtgacattaagaaataccaacagagggctgaggtttgagatctcgagttcaaatcccacatcccagacattttttttgacttggtatgcatctttactcccggttatttcaaccgggactaaagatgggcatctttaatcctggattgtgtgtcccgtttgcacaaccaggagtaaaaacgattgcaaagcgggactgaagtccctttcttcagcagtgacatgagcaaaaatacgatgtgacaacatgtatagcccacttatatcatcctattatacgcgctcttaatttactagtaataaagaatcaatatgttgtatgcatctaacatttcgtttaatcccctttcatgccctagttccagatttgaggaatcaacactatgacaaaaacctccatttgtagaggcattttgtatattgcatctaaaatctggagttttaaagtgtggagacacattttataattatttaaaaatttacaagaaaacttttactctaaagacactcaacatttttagtatatttagttaaattttatcttgtagagatattattttggcacaataaaatatgtatggcatgtaaaggtattttcttaagccattttaatctacacttgttagaataacaatgtatgccaagagactagatataataaattaaacaagtcacaaacgtacaactaataatatgaggttgagttagtgcattgaagacgatacggtttgccaaaggatttctgagctcaaggattgttaatagcaagaaaattatttcattcttttttatacattggttagatattggtttcacagctaaaacgaattgtcatatatataagaaaacaaaatagaaattagagggcatgcatgtagggggatgataaaaaactactcaaggatatagtggggatcgagtgagaactgagaactcaagagtgtagatataattttttttgttactaatgtacttactctgtctcaaagtatatgcatttttagcatagtgtcaagttaaatatttttaactttgactattaatagaaaaaataaaaaaaagattaatcatgtaaaattaatattattatatttatcattaaaaaaactaacataatatgcaactctttttatttaaaatatcttacttttataaatattattgatcaaagtagcatctcgaagactatgtcgaagaaaaaaatgcttatattttaggacagagggagtaggttttattgatgggattgaagatataattaagcaagtgatcgaatatttggacgataaaaaattattccataaagaatttatggaagatatattgacgtgacggcaaagtgttgaagcagcatttgtgggagttgtctattttgccccatgcatatgctaatccaatccagtggctagctgttatagttgttgtgagccaggccagacatcaacttcaggtgttatggtcaaacatgcacgtctatctccatggagccaaaccttccaactgccattgatgttgaccatacatccaagagaagccatggactttgtactagtagtaatcaacaataatgttaattaggtcactatcaaaacctaactccggctgggccggcatgcgaacacgaggtcgatcacacggatgcctgcatcactaagattctcacaggaaattaaggccaagttaagcaaataaaagccgttattggccgcatgcatgcagatgtcaccgttgcctttgattgctcgtatctccttttgacgctgcaaccgacactgacagacacgtctcgtttttgtactctctcttcttcattagcgacatataactaacctttccccccgtaagtacaactccctccgtcccaaaataagtatagttttgcattatttatgttcaattttaaccgttcgtcttatttgaaatttttttatgattagtatttttattgttattagatgataaaacataaatagtactttatgtgtgactaattttttttaaattttttataaatttttcaaataagatgaacggtcaaacgtcggacacggttcctcacgactgcacttattttgggacggaggtagtataacactcagtttggatttataattattggtttaccataatctatctcgttactaattaatgtagtaccatacccttggtgttaccgcttttagacatttcagctagcttttggtaaactgcaaggtttatatatgacaaaataataatattattattatatattattttaaaaatattggacaattcaaagggatctttatagttgtacaccaatttcgatcacttaacttgatctgttaaaaatttatagggaatttaagctattcattttcatatcaatatcaaatagatagcgtgccataggttgtgttcagcacacagggttgggaacctttccttcccctgccacgtacaatggtattattgtgaataagcacatgattaattaagcattagctaaaaaatgaaaaatagattaatatgatttttcaaaaccgataactttcctatattttttttcttttgcaaaaaacaccctaagatcgaggacaatcagttggtcctaacaaaaacacataacaaactattgatttaccttattcaaagaaaatacattgggttttgtatgatctacatggtttactgtgaattatgactttactgggtatttgaattcggatggatagattccatttaaggaaacttgttgagcttagctagcctaagtttgtgtcaccttaccaaattttgccaaagaaaaaaataaagcacaccctagacatgccaactatgcaaaatttggtagctctgacaacactaacatttaggccgaggttagttccaaaatttttctccaaacttccaacttttctatcacatcgaaactttcatacacacataaacttccaacttttccgtcatatcgtttcaatttcaaccaaacattcaatttagcgtgaactaaacacacccttaacatgaggtgtgtacaccactctaaagtgaggcaagtcattaattagaccaaaatataccttggcatacctatccacttttccaaaatttagcaacttggtgtggtcgattttggcaccaaaccaacactactggagaagaggtctttggagggtcggccgatttccacaatagtcccggttccaaaacgaaccgggactaaagtggcttattagtcccggtttattactttaacgggacgaagggatctttagtcccggttcgcctcctgacagggcatgtcagacctctgtcagggggcttgggatctttagtcccggttcgtgttaccaaccgggactaaagatcatatctttagttccggttggtaatacaaaccggaactaaagtgatttgagatctttatgcccggttggtgttatcaaccgggactaaagttgcacagctttatataccccttcttcctcctccagcccgagccattgcttcaaaattaagctttgagggagggaggtgctgccaaaattttaagcaaatatttttggtggtaatatacaaatttgaggtcttcaaaaggttagcaacttcatcctactctttcttttgcttagcatctacatttggagctattttttttacatatttttccctctagaaaatgtgatggaagatgatgagagagaaagtgtgtgtagggaataaagaagattataaatacttgtttgactaattacatataattttgtatgaaattataaaactaagctaatttaatattaaaataagaaaaacatattaaatatttgtttataatgtaattaaaacatgaaaaatatgtacaatgaatttaataataatgattaattgtatgaataattatattcaattattgtattattatgtaattaccttttaaatcttggattttgtataattacgatttatatgtatttcatatagatggatcggcaacggatgtacgcggatcggcggtcgaaagtgtttgttgacggcgtgcattattttttgggtgtggccaatgataacaagcgtaacggttttataagctgtccatgtgacaagtgcaaaaaccagaaggagtattccaccacacgaactattcatgcctacctgtttcagtgggggttcatgcgtagctacaattgttgacctcgcacggagaggttggggttgcaatggaagaagatgaagtagaagatgagaacattccggactgggctcagtattgcggatttgaagaaaacacaatgggcgaggcggagctggatgttgaagggaatgacggtgctgatgaacttggtcaaatattgcgggacttacaggaggactgcgaaagtaaaaaggaggtgcagaaactggagcacatgttagcggaccacagaacagtgttgtacccaggttgcgataagggctacaaaaagttgagtaccatcctagaattcttgcaatggaaggctaaaaatggtgtgagtgacaaggcattcggcgagttattgaaactcgtaaagaacattcttccggaggggaacgaattgcccgaaagtacgtacgaagctaagaagacagtctgccctctaggtctggaagtacagaagattcacgcgtgtccgaactactgtatcctgtatcgcggtgagtacgaaaacctggaagcatgccctgtttgcaaagcactacgatacaagataagacgagataatctaggtgaagttgacggatagcctttgaagaagagaattcctgctaaggtgatatggtatttccctataatatcaaggctgaagcggtttttcaggaacaaatcacatgctagaatgatgcggtggcacgtagaagaacataaacaggatgggatgctgagacaccccgctgacgggtcgcagtggcgaaatatcgacagaacatttaaagacttcggcgaggatgcacgaaacgtgaggttcggtttaagcacggatggaatgaatccgtttggagagatgagcagtggccgtagcacctggccagtcaccatgtgcatctacaatcttcccccttggctatgcatgaatcagaagtacatcatgatgccgattattattcaaggcccgaagcaacctggtaacgacattgatgtgtacctaagaccattggttgaagatctgaaagtgctgtggaggaaagagagcgtccccgtgtgggatgaggacaagcaggagcaatttaacctacgagcgttgctattcgttacaattaacgattggcctgcacttagtaacctatctggacaatcaaacaaggggtacaatgcttgcactcactatttggatgaaactgaaagtacttatctgaagcattgcaggaaggttgtgtacatgggccatcgtcgattccttgctgcaaaccaccctgtacggaaaaaaggcaagcattcgaacagaaggcagaccatcgtactaagcctaaacatcgcaacgggaaagtagtatttggaaaggggcctggcagccaacctatagagagcgaagatggtcatgcggcgatgtggaagaaaaactctattttttgggagctaccctattgggaggtcttggacgttcgccatgcaatcgacgtgatgcacctcactaagaacctttgcgtaaacctgctgggcttcttaagtgtatatgggaagtccaaagatacactcgaagcacgcaatgatctcaagcatatggaacaacgcgagggccttcatccggaaccgaacgagaaaggaagccattacttaagtccggcgagctacaccctaagcaaggaagagaaggagagtatgtttcaatgcctaaagagcatcaaggtaccatccggatactcctcgaatgtaaagagaataataagcacgaaggataagaagttcacaaacctaaagtctcatgactgtcacgtgcttatgacatagctgcttcctgttataatttgtggtatccttcctgataatgtgcgggtaacaataacgaagctttgtgctttcatgaacgcaatttcacagaaagtcatcgatccagaaagtttagccgcccttcagcatgacgtggtgcaatgccttgtaagctttgagttgatctttccaccgtcattcttcaatataatgacgcatcttctgtgccaccttgtaaaagagatcggtattctcggtcctgtgtacctacacaacatgtttcctttcgagaggtacatgggcgttctaaagaagtacgttcgtaaccgttctcgtccggaagcaaacatcgcgaaggggtatggaacagaggaggtcattgagttctgcgtagattttattgaagacctcgagccaatcggagtacccgaatcattccatgaggggagactacggggaaagggcacacttgtaaggagagcaattatgactgtagacaacgatttattccgtaaaacacatttcacggttttgcaataatcttcgttggttgctccttacatcaatgagcaccttgcgattgttcgctcagaaaacagtggcaagtctgatgcctagattacacgccatcatattgatactttccccgcttggctgcgagaacacctcctgggtaacgagacgattgaccgacaactagccttcttggctaggggaccctccggctcggtaactacattccaaggttatgaaatcaatggatacactttttacacaagagcccaagagaaaaagagcacgaaccagaacagtggtgttcgtatcgatgccataggacacgatggtccaactagcacgtattacggtgtcatcgacaacatttgggaactagagtatggacccctgaaggtccctctgtttctgtgccaatgggttaggctgactggtggaggcgtaacgattgatgacagcgggatgataacggttgacctaaacaaggtaggatactcagatgaaccattcattctagccaatgatgtaacgcaagttttttacgtgaaggacatggatagcaaaccaaagaaggggaaagggcccgatgagccaagacgccatgttgttctcccaggcaagaggaaaatcgttggagtcgaggataagactgacaaaaattacgatctgtttgaggggcaacctccgtttgcagtgacggttgacccgagcatcatactatcaaaggaggacacgccgtactcacgcaacgatcatagcgaaggaacaatagtgaggagaaagtacgtgaggaagacagtgacctaggttgtttgatggaagatgtaaattatttgtattgtattgaaggtcgaacaatttggatcaatatattattctcaactgcttaatttgtaatgtattactatttttcaaccatatgatatttataaatggttacttccatttatttacactttgaatacaattaattaggcaatatgttatttataactgattattggtatttatttccactttgaaaacaattaagtaggccatatcttaattataaatgataatttctatttatttacactttgaatataattaaattggccttatgttaattataaatgattatttctatttatttataccttgagaccatttacttaggcatatcttgtttatttctatttattaaaattttgaaaacatttaattcggccatacgtaaattacgtacgattttggtatttatttggactttgaaaccatataaatcggccatgtgctaattatattggatttattggtatttatttcgacttgtaagacaatttaagaaggccataaatcggttttgtgtacacatctttagtcccagttattaacagtatccgggaccaatacaaattttggaatagcgggaaaacatcttttgtcccggtccgtggcttccaccgggactaaaga

SEQ ID NO: 74173 - DNA, 15530 bp, Oryza sativa
ggcgtcatacattaaaatacggagggagtatttgtttttgtaattaacaaataaaaaacctcgcattattgcagactaagacaaattaacgatcaaacttacacgcccaagaggcaaagtgtacaccccagtatgccatgctgctctagcttgcttagagctgaaatgtgtaacacagtaacagcaatggcgaaagccatggatgaactggtggcgctcgtgtgggctcagtcttcgtaggtgcggcactcgtcggtctccgggttgtccttgcagtactcctcgagcgggtcgctgtccttcttgcggtcgcgcgcgtggctggcggcggcgctgagctcctccacctcgtcccacgccgccgcgcactcgccgccctccgggtcgcccgcgcacgtctcctccgcctgcttgatgctctccgacaccttctgcgccagctccggcggcgtcggcgagcccgccgcgaccaccaccgccagccttcccagcgcgcgcccctgccggcggccggcgaacgacacgacgttccggcgaaccggtagcgtaggagccaggggccccgggagggtcgtcggagcctggaaggtggccatggcggccacggcgaggatggttgccatggctctggctgcctgcaccccgaagagtgttgcagtgaggaaggagaagaagaaggaggttttgggttggggtttggttgtttgggctaatgctgtttttatggctgcatttatcttatctctatgtggccaatagcgttgtgacaaatcagccttgccagatttcctttctagaaggcatcgtccgttttcgatcgaacgatcgagcagcacgcagttcgtgcacaaatgcttagtactagccccattagattaacacgaattaatacaatgttgaagatatcgcaaaatgtacactcgctagctgccaaattcgtagccgtaatactgtgagtaagatctcgttgaaaccggcagttattagctctggatttcctgaactactggccgtgtattaccggtgggtcacatcaacgagagaatagtggcccgactggccgtatgtgcttatgtggcgagcgcgcggccggcacggcacgcgtacaccgtagagagccatagacaccggccgtggaggcggggaagacgacgactcgatcgacgaattctatggccgtacgtggtggcggtagtagccagaagcagatggtttcccacagccaggaccggcgttacgtgccgccgctgatttcgatcgacgtacgtacgccgcgagggaatcactgctcgtcgccgtcgccgtcgcgccacgcggaattaagtcgccaccaccgccaacacgtactacgtacgtgtagagcggccggaccgtgaccgtgaccgtgaccgcgcggtgccgtgcgcggccgatggatggatggatggcttagctactggtggtggctgcgggttccgcggtgggtgatgacgcatgcgcgcggccggcgggtcgtcgggatgcgcgcatgccccgcccgccgacggcgcgcgacggtacgtacgtccacgtcggcgtcgttcgcgtcaggtgaccgagctggcctcgtctgagtcgtctctctcctttgtttatttcctttcttttctgcagcgcaccgagcgacccgggttaattcacaggatctttttgccgaccgcgcaacatatatgtgctgggtgtcaccgtgtccatgtcaggtgccttctttttttaattacacaaaatacgaacacgcaccaccgcaagtgtgctctaatacatgttcaaagagacgaattaagaacagtgacacatcacaacctctattaaaaccctattaaaagtactactgtgcatgtattatttgggagcatcagggttttgaactatagtagacgaaggctgtgttctttcccccactttaccaactcacatatctcgttttccacgtgcaagcttttcaaatggctaaacggtgcgtttttttataaaaaatttcaatatgaaagttgctttaaaaaatcaaattaattcattttttaaaaaaaatgctaatacttaattaatcacacgctaatgtaccgctctgttttccgtgtgaaggagatgggttcctaacccaaaggagcgaacacagccgaagtcatgttcccaaaactctaccataccatagtagcataatttaatcttcttgagctacgttcggcagtagaacaaagtaagaaagtttgtttcgttttccgcgcgcacgtttcccaaactacttaacagtatatttttagcaaaaaaatttttatagaaaagttgctttaaaaaatcatatcaatccatttttgaaatttaaaataattaatactcaattaatcatgcactaatagctcacctcgtttttcatatcttcccaattttctctatccacttcttctcaaactcattacttctgagagcaggtacaatagtagattataaaccagctataaacatattttaaagagataaaagaagagagagaagagaagtgggctacagatctatagccagctgcagcacggactccaagacgtaatgtgtgtatgacaggtgggaccatgtattaataatgtagtaagcaactattgtatgaattgactattaagctgactaaagataatttagagctagtagttggctatactattaaacttgctatgagaaagatcacatgcgattgtcaggcatttcggattcttatttctcttgggatttgggataaaaaagagtacacttaacggttaaacttgtagaaaacttattataaaactatatttttttacaactttaaccataatttatgattgttctgaaattttctttaaaaaaacaagtcttaagttttgtaatatgttcaaacgtggagcgtacagttcgtttgaaagtaaatgtataactgatgtacaactcttatttttattcagtactactctatttcatattacctgtagtaatcaatataaactgttatagcaacttaaaagtcattcgaaatagctttttttatttccatcaatgtttgtacagggcttttggttccgatccacaattcatattgctccatttcttcctcttattatatgatagctcacttcagcaagcttatgcctctgtgaccataatagacattaaggttttatatcatggtctcttgtaagagttaaccatggtctctaattttatataacaaaaactcatgtagctgtggtggattgggtgcatcaatgcaacgaggtaaccatttgggagacaataatcgaatggttatgaggcagcaagaggaagtgcaagtgaattaaagggcacttagtgagctcttggagaagacgatgaggaccacatggctattttatgggggacatgcaatttgaaatttaaaagttattgctagtgcatagaggctgtcaagacatagttgccaccctattatgttgagcatgtggtggtatttgttggatgtaagatgtggagataggttaagtttagggcattacaaagttgaggggaacctagatggttggatcttactccaatgataagaaaccagtattggggtatcactattatagaacatgcatgcatcgctattatttggagagacatcaattagaagtttttgaaaaagttggtcacttttcccattacttgcactattgaaaaggttaaacaataaactacgctaacctaaacacaaaaataaattgataactagtaaatacaatcatagaattacaagtaaaagtatccaaagttagatagagaacaacataaaaccatatacaatgataaagctttagttaaaatgggctaaaactgcagattgcatagctctgattttaggcttggaaatgtttagttttagatgactgttaaattactctctttattttatattataagtcgctttgattttttttctaattaaacttaaatacgtttgattaagtttatagaaatactcagtagcatattcagcataaaagaaatatattatcaaaatatatctaatgttagattcaatgaaataaatttggtgttctagatattgttaaatttttctataagcttgattaaacatcaaaatattttactaataaaaagttaaaagcgatttataatataatatgaaatgaagggtgtatcaaatcaaataccacgagaacacattacacaatctaagctaactgaagtttatacaatgttcacacactttatttatttctccactcttgtacctcgcaacaagctatactttttactacacaatcaaaacaggaatatggatcgtaaaatcaacaacagtattaacgtacagtagctagatcagaccatacaaaccgaagacacgcatgtggcaacaatcataagtcaagtactttatgtagagtttcatatgttttcgtagccctgcagcatactgaccggatccatgaccgagtctggctggaagtacagcatctcgatctgtggcggcagcggcggcagcagcggcggtggcgagagcggcgtcatccccaggtcgccgccgtagagctgcacgaggtggtcggcgacgtcgggcacgtcgaggggcacgcctgccacctccccgagcaggcggagctgcgaggcgcggagctggagcgcgctgcacagctcgcgcgcgtgcgcggcgagcacccggttctcctgctcgaccaggcggcaccgctgcagcacggcgccggcgccggcgcgcatggcgtcgttctcccgccggagctgctccgcctccacggccagcccgtccacgtactgctgcttctttatgcgggacctctgcgccgacagccggttcgacctcttccggttgcgctgccgctcctcctcctccgccgccgccgccgccgccgagcggcgtgcggacccttccgtcgccggcgcaactgacatcttgaatgtatcacagagcacaaagagaaactaacactcaccgtggaacaccgatcgaacacgtactaggcagaaatatttcgtgctccaagttgggcaatcgcgtgcaggaacaaggcgatactaggaaaggaacaagctagaacacatttagtagaatatatatttttttggatcaaacaaagcttcagtttttggtccttagtttcagcgaagatggatcgtgcacgaagctttgtttgatcaggtttggagaggaagcggatgaggcgaatcaggaaatcacgtagaagaagtagaggaacacgacggagagcgagtggaggtagcagaagtggaggctagcctccgtgatcgacatggatgcggctgaacccggcgaacaagaagccacagggagttcgtcgtcgatccttcaaatcaagaactacacggagtgaaaggatcgaagaagaagcaaccaagatcggttgatcgatcgagaagctcagctagctgaatcgatcgagccaaccgggaggagaataattcatggtgctatgtaatctataacctgaccaaagaggctagctagagctaggaggacgaacagatcgaaagggagggaggaatggggaagcagaagagtagtagtggtgcttaggtttgcgaagttgattgtggttttgcggatacacaagattgtgtgggggagaggggatgatcaatgaatacttatatatgtgcattgactagtactggagctagtactgtctaatatagttcaattacgtgtgcaccgactagtatcttttggaaaaaaaaagttcatcttttgctctaatcaactcggttggttaagtgaaatgaaggttttattgattttaccgcgcagatctgaaatttccagagatgagaaagaagattcgagtgaaatttccataacacaacaagagaggggcttcgttttcctccccttatgatgtgttttcacggctgctctgagatattcttttttcgatccacaaacggacaaggcatcatgcacataggttagtaattaactccagcaatggcagcaaagacgtattaagggaagcattgccacattgacactctcttcttcttttgttgtctgaccagaagcgagccggcagctgcgcagcttaaccagcagcgtcagcacgcatgctttcagcaggatgaagattgcagagtttcagaaagagacagacagcgctggcatattcagaaaaataaattcagaattcagaacgcgtttcctcctgtgccgatcgatcgatgacttcgtcgcggtgaagttagccccgattggtcgctctagcttctgggaagcagcccagggcaaaagatccaaggagtatgacgaatcaattaacggctaatctagcacttatttgtcatttttcactctctctctctctctctctctctctccgacgtagcaatgttaggacaggtggccactgcgtttgctccaacctgaatattcggttgtgagattcagatgtcctagttgcttctgttaattagagtatggcgtcaccgccacgagataacattaacaaaactgcgtggccaatgcccaaatagtttttacctgaagggtgaggaaagaaacagtacatgtcattttcgattagtagggcaccacttcgccgtgacatggctggcaagttgcttatgtgctaagggaaacagaagtaccaaatgtttgtacttatgcatgtacagttgaagaccctgattagccaaaaaaaagtgtgtaatttgagatcgattagctgaaggtaattgcttgctaatgtgtaatcatgttgcctcatgtgatcgactcgtgtcttctgctcctggtagcctggacgctgatgctgttggggatgaaaggttgagctctgattgaagcttttggaggctcaattcgtgcgaccttgtcggagcaaatatgttcttctaagagaaagtgaagtgtaactttgtttatgatccactgaactttgtctagttgatgtgtgctttggctgcatgcttgcagatattaaaggtctctctcgctgacgaattagctgactttggagctaatttactcatgaccatgcatatatagcatatcagtgtgtacctttcagtttccttctacttaattggttccaacaaagcagaggtgattagatgacctataaatttatctcttctttttccaagatgacatgaacttcacctttgccccagcacttgtttaccgaactaccgtgacgtcgcgaatgatgtaaattggcatccttgcgtggattcgtatgatcttattaatacttatattacacagtaaaacatctcactgtcaatgaggggcccaaggagaagcagaagaagattctttctaaactactagttgggtgttcattgtaacggaaaaaaccacgtcgagtgaaatgatgttaaataagtgtaaattgactgtataaaaaccttaatatagtactaataataattatataacatatttataattttcacatctttatagtattaacatgttagtaccatataagtagtaatagctaaatgcacgtgctttgttatggataaaagaaaacatataaatgtgttgcctatcttttttttttgttatagggaatattcatcgtactctaattttttaatgtgactatccatttagatttgatcttttttaatattaaaaaaattagggttaacttttaaaatttacaatggaagtacgtagggtgttactcttgctaccatcaggatagatctgtccccttcctcggtttccccccacatatgggatattttaagaaataaacgtctttcttcatagcagggtcgggggaaagaatggaaaagacgatttcactatatttcttaccgggaacagggcctatcacaagaatatttttttattgggacgataactctgaaaagagagatttcctgtcttttctttcaactcaggagaaatacggtcgggcggcgctaattcgaatccctcgggcaaaaaaactacagttaccgccatagacaatgattcatttgtgaatgctaaatagtagttgcccataagaagatccattattgggtgaatggagaatggatccaaggggctcgccaaatcagttactggtcctaaagaatttgtgctttccgcatctgataaataatttggtctctcataggtcacagcatcagccaataaatcctgtgtcaacggcttaggttggtttaccgatgagcccgacaggagagcctttcactccccactgggcttgggctccctgcgtcattcccattggctggggcaggtccatctccctctttctctaaaagctctacagcgcgaataagccctatgtatgggctctgcgctattgtatccagatttttacttgcgaaaaaatcctctatttcctgctctatacttttatcaaactggagtcccatagcaaatacatatttttatgctccctctacttcaatgaaagctcctcctactactcccccttatccttctcactcgtcgtttcattggtcttttatatacccattttcattccatttggacccctagcaaattcgaactttcgttgaaattgtctctattcatatgtatgaaatacatatatgaaatacgtatgtggagttcccgagaatttcatgtgatttagtaaacaaaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggtttggcagaagaacttgagaagtttccaacaattaaagatccagatcacggaatggatacgaaatctagaggcggcaggtaaactagggaaacagaaactattgtttttggtgaattatcagtgtgcagatgaatttcatccactgctattgaagaagcttttagagggatatcttgtcttgtcgggctaagagctcttatctctttcttttcccacggtaactagagattgaataatagaagccagattcaataatagaagccagattcaatatcataagaaaatagagattgtagcgtagagtcaggctatcccatgtttgcaataacagctttgggatctttcctgttaatgatgaatagcttgcctcaacagagaatcagaattctttttattcggtataacaaccttaaaaacgaatcgatctagatgccccgctcttgccatctttgatggaattgaatcatcaactgacttacttgaggaataaaaaaatatgcagctttcgattcttgtctatcggattctattgagaagaagggacaaccatccatcctccccgaaactagtttagtgcctgaacgagattggtggcacttatgacgagaaaacaaactctttcttctgttcaaaagctagtagtgccatagtgccaatctactccgaagaacaagcttctttgcaaaactactttcttctacggagctacctccgtctcactcttgtaccgaatgctacctggcataacatccttacttaaatatcttccgctctccagacttcaacagtgccatcttccagtaggaagagaatcttttcatcctcccacccaaccaagtaggtttcttttctataagaaatgctgtcaatatttcctgctaaatcctgcttatccaataagtttcggatatctatatcctggagtaagaaggattcaccttctttttagtggtgttcctttagaaaatttgttaacgttagggcccccaatgaatgttttcactaacacttgtgataaactcatcatcaaaagtaaatcctcttgttctttgagccaatacacagctatccctaccggattattattttcaatcaactcttccagccctagatatcctctatcacactccatatgaactagcttatacatgaaagcaggaaaagccaattcatttattctctaataataaattaccgataaagggtagttgtttcgtagggataatacccttattaattgatccttacagaatggaagtaagccccttcttcataagatcaagaaagtacgagcgtctttcgaagattggaaaatctaagtcgtatcgaacactatgtcctaatagtaagggatttctttcaacccggtggtaagccggtggtacccggagaaaacgttgcccgaaggaagggactaaacccatctgttcaattagtagccaagtagtaccgaaggagtatctccgagttaaggagtaccgaagggaaggcagaaaaaccaagtgaaagaaagagatcgcaatggtctaagatatagtcagtactgtgatgggccgcaaacgtaagttggttgttagcgccaactgaactgcgtaaccaaagcgattccccttattggaagatagggttaacctatgtcagttcgactccggcgagtcgccccccattattagtttggcgtgctgtcagttccacgggcctaatatatgatatttagcatatacgagtgctgctacaacctcctcttctattcaattgtatctttatacctatccttcgataaggggtaggtaattagaggggagaatgttattaaacataggaaaaagtttacatcgtgatgtgcctcgagatggccgtctcctgtctccctgctcgtggggaatccgctcctggggcgtcgctctgctgcgtctggcccgtcctctaggcacctttggggggcagggagtgtgacaacgtacacgcttccctttactccatagggccttttcctcagttgcagggtttggtggcccgaaattgacttggcttcgccaaaaggcctcatctccaaagcctggctcgcgaggcgtccctctcgctgtagggcggagccccctcgccttgctcttgtgacatgctatgtttcccttcttccattctcaagtcaagggtgagtcccatgcgtcagtttgtggatcgcggtctcacgcactaatctctacaggtgcccatagtaggccggccgccctacctaaaccaatcatcatatcggtccctaggccccattgctggaaaggctcggcttcaaaaccgtacgtggagcttctgcctcatacgactcctcggctggtcaaactataggattaccattcacttagtcaacttattggatagacgggtcatccacttgaccgaggagagtaaggttcgtcaccacagtcccgagaagaatggaacgctgcttcgctctgctggatgcgtcggatcccatataagaagctcgctctttacccgatcattcaaacattttgtgggcggcgcgcctgctctattgttgcgtagcaatagaagcctgcttatgctgcttcggcggatagattcactgccaccactactacaatgttcttctaaaagagtttctaaaagagtatagatatatctttctcagttccgagggggtgagccggtgagtacttcatcttcatgtattagtccatctggtttgatgggctccgagatgggccaaatctcacctcaatctctccaggcccaagctcaagacaacacatgacaagaggctccatgtcattgctggcctgacccgtttccaagtgagattaggcagtgcccgttttctcgtaccgatcgatgttcagacttcagagtcgagataatcacaagagaagaatcagctgatatgtctgattctttttttacgatttttttggattctctaaaaagggaaacaattttggagctgtccgtggtcttaagaaaagaaaggttcttacaaaaatttgggcctgtcgaccagaatgttgtaccactactgcatgccagaagaacctgacgatgtcttgctgagttgctctatcttgaaatcaagggaaagtacgaatgcctttgcctcgtgcttctcttttgcatctatccctttctttctttgtgatttttatttttctttttgaacgaagctatcccttactttgtccaaatgacaaaaaaaaggctttgttggaccatttcaagttctcggtaatcttccgagaaatccaatttcacaagagactacatccagaatcacactagtgtatatatatataactcaaatgcataatttggagcacagtaatttgctagaaaaaactgtcaaatcgctctaaacaatctgaagaaatcaacccgcgcgcggatacagagatcaacggccggcaaaaaggtttctcgtcgacgaaaccgccgcggccgccccgaagctatcgggcggcaccgccgcaatgctgcgcgccgcggccgccaccaccgccgggttcctcccgccgcgtctggccgccgagacggcgcccgcggcaagggttgtggcggcggcgggtgccgaggtgaggtcgtcgccgctcctcagggctctaggggtgccgagaggcggcgccggcattgggagcgccacgccggggaggaggatgtacttcgcctccggctccgactcctccggaagcgccgccgacagcgactcggaggcgtcgtccgccgctggcgctggggaggaggagagcgagggcaacaggtcgtcctccgctgtcgctcccgccattatccgacccgaggactgccacacggtgcgctctctctctctcgctaaaaatttgatcagcattgtgttgttctggtgtctgttcggattatttgctaaggagtttgtggggtttgaacttagcctaagcctggaagtagcttaatgggaattcaaccagattagattatcctttgaaacttctcgcgttctagtgctgaaaaaggtatttggaaaacagtatgtttttagtggggtatggagggaatgaggagctggctgtccagagaaaccttctggatcctttctattctatctatgagcactaatgctctgggaattggaaacatcagaattcagaacatgtatgtattgctattgagtgagttttaccaaatttctattgtgccatttgggtgaaatgtgtagtgagattttcagctttgatgtgatgttgtgactttaagcataacttatatttttgcacatttgcactaatttttttaataagattaatgttcaaacgtcatgtccaaaaaacaacagtgtcatatattttaaaatggagggggtatttgtttaggggttgttgctgtgaacttgctcaattcgcatggcattcagctcacatgggtggaggtctagcaacaagatttgtacaaattgaactttgatgtttatttaactcgttgagaacttgttgctatttttaaatttttatctctgttccacctggtatgggtctattctaataatgcgacgttgagattaggctttgtgcgtctttgacacaactgccggtttatccattatcttaaaacttaactcaatttgcatgccgagaacagagagtggcaacttgcctctctaaaaggctcaggaagttgaagccctacctacaacaaatattattttttgtagcaacatgttactatatctagaaggatcttttttcccctatacaatggataattcgtcgcctgcttattttagatcattcgcattacttcatttcttcaagttgtcacttttggtttcagatgagtatatttagtttagcctgtcatttaacataaaaatgcaatatatatactcacactgatgaacatactattcatgtgagatccatttagtatgatgtgactcggttaatcatctaggtctctctctctctctctctctctctctctctctggtgattcagttaatcatctacttcccaactacaggtcatagctttgcctttgccacatcagccactatttccaggattttttatggcaatgtctgtaaaggtatcttaccgaactatttacaatcactcaatgagcatatcactttcccaattttatttgctttagtgctgcgatttttgttcctttctgctactaataatttatcatattttccccctcaggatccgaagttgttgaaagctttagttgaaaaccacaaaagatctttcccatatgctggggcctttcttgtcaagaatgaggaagatactgacagtaacactgtcacacgttcagatccaaagaaaagcattcatggtctgaaagggaaagaattattgaagcatcttcatgaaattggcactcttgctaaggtatttagctatttacctgggcttgggggtagcatagaaactttcattgcatcaatctcaaactgttctgtctgtcattccatgtagataacaagcattcaaggagatcaggtgttgctacttggtcactgccgtttacggataactgaaatggttagataccttggactgcatgctattcagtttctcttgaatcttttgaatttttttttgagtttttttgtcaaagaatgcaggttgaggaggacccacttacagttaaagttgaccatctaaaggtacatatgccatcactattattttcttctctgtctgtcttccactgtacatatttcaatcctaccaaacccctgccaaactccttccctctcaaaacaggattttatttcattgtgtgcctgtgtttaaattacaataatataccataaaaggttgaacatatgtcacatttgctttcttgaagtgtaagaggaaatgatcttttagttcaataattcttatttctgttgaagttggaaatatcagctgcttccagaaacaatacaagtattacagtctagtaaaaagtggttgcatttattttctaacttttggcttgatttgattttaagccactgtgtaataacttttcatacctgaactgcagcacacatttcagattatatgactttaactaaattgaatacattttgcaaatcttgtccttgatttataccacctttcagtaccagctgaaaatatttagtgtacaattgctttgcactgttgagaagcctttgattatgatctcttcatactagcggagcttctgcaggaaaagccttacgataaagacaatgattccataaaggcaatatatttcgaacttctatcgactttaagggatgttctaaaaacaagttccctttggaaggatcatgctcaaatctacacccaggttgccttactatttttaactcctttagtgtacatctgaatctttcttatctatttgcatgtaaactctgtttgaaatctacttaaatatttctactgtaatgattaattttacaccatctattcactgaacttaaaactttgtgtttcagcgtggtatatcattgtgttatcatttactttgggtacatgtcacttgcaattcttaacgtcattattccatcattaagttctgaatgtgcaaacaatatttgatcagcacctactatagcttttttatccatcaatccgatggcaaaggggcattttttccacactcattcccttactaacctacttatcatggccggtctatgaattataccaacatgactctataccatgatc

SEQ ID NO: 74174 - DNA, 5193 bp, Oryza sativa
agattaccgggtataaatatccactgcatcggcttccccgcgccacacttagacttctccacgatcgatcttcttcctcccgcgccattaccgccccagacgtcaccgccgcctccgccgtcatcatcgtcatgctcgccgcgctcatccgcccttgcgaacgccaccggcagcgttgccttcctcaaggtgaggggcgcaaatcttacgcctccgatctcgcactctctctctctctcgatcgatcttgacacgcgccggccgaccgaacctcgccgccatcgtcgtcgccgactccaccgccggccgccgccgccgccgcgcgccaacaccactgccgccacgcgccgactccacctccaccgccgccgccgccgccgcgcgccgactccacttccaccgccgccgcgcgccacctccacctccaccgccaccgccgccgctgcgcgccgactccacctccgccgctgccgcgcgccgactccaccgccgccgccgccgcgcgccgactttacggtggaacgtttgaacgagaacgttttagcgaacgacgacttagcgacttagcgacttagcgagaacgacgtcttagcgacttagcgacttaacgactttcacgaacgacgacttagcgactaaacgactttcacgaacgacgacttagcgactttgacaggcaacgacttagcgacttagcgactttcacgaatgacgacttagtgactttcacgaacgacgacttagcgacttagcgactttcacgaacgacgacttagcgactttgacggacaacgacttagcgacttagcgagaacgacgacttagcgacttaacgacttaacgagaacaacgacttagcgaattatacatgtatacttgtagggtttagatgtatgagctatacatgttgatgtccatgacctcaccgtctttttttctttgcacgcacagatggcagaccgcgatgacgaacaaatcctgttagacacgatcgcagagggcagcagtcagtactgggtggatgatgaggggaacgaggatcccaaccaatacctgaacgaggagggcaacgatgagggtaaccaggaggctaaccaggaggggaccgaggaggggattgatagtcaaccgttggccggatagaagaggccacgcgggaaaagaggtcctgcgaagaagcttgagggaaggcacatcgttactgagattgccccagacagtgaaccagtagccccagcgggtataggacgaaagtttgtgaatcattgtggttgggtcgtgagagacaacgtccccatcagcatagtgtactggcgtcgaactaggtcacgcggggatgaagatagctttctccctgacacagagaaggacatgttgtggaccaccatgctggagacattcacgatccctgaggcagattgtcccagatgcaaagaatggaccctaaagaaaatggcagaactattccagagctacaaatcagatctgtacaagagatacatcctcaagggcttgacacctgatttcaacgtgcataacaagcttagggatcactaggatgcgtttgtggcatacaagactggagcgcaagtgcaagcacagatagaaaagaacaaagccaatgcagctaagaagaaataccatcaccggcttgggtcaggtggatatggaaaggcaatccccaagtgggacaagttggaagctgacttgatagcaaggggtatcgagccggccatggctaattggcctgagcgatcgaggaactggttctatgcacagggtggatcgctcaatccaggtgatggctccctcatattcagcgatgagattcgagatgtagcacgccgacttgcggatgcaattgaagcctctacgcaggggactttacggcccgacagagagaaggatgagctcaccctcgcactacagaatcttgagcatccaggacgaacgcgaggaaaaggcgtccttccttggaaatatggattcaaagaggacatccacacgtataggagtcggatgaggagcaagagggatacagaggctaagatcgtcgatcttgagtacagggtgtccacctacgaggcaaggatgcaagaggaggtgacaagacaggtggaccaatgcctggccgagtagcgcggaatggaaacacaagcgcccgtcatggtgagcccctcgggcaaccgcagcagctgcgcttcaatgggccaagttggatcagagggcattgaggcagtggcagctcacgaagcaacctacttcccggttgatgatatcacgcagcgaacaccctgcgatatgcatactcccttcaggaacttgtctatcaaggtatgcgaaatgcgaaatttgttacatatatatgttgattagtaattaatgaactatatttcttatgaaggttgcgtcgggcatggccatacccacggacccttcgagtacataccattgcaggcccattccacatggatatgcgaaggtcgagatagagctggtggaacgaacctacgaggatctcgagcttgacatcctcggaggagacggggagaagaaacttggagacacagcccacgccatcatactctggcataagaagtacatcgtgtttcccgggcaagaacggccgcccgctcctccttcccggccgcaagcatagtctcctccgccatcactgcctcgttagtctcctccggctccttcccctgcaccaccacctcctccgcgtgcaccagctgccaagtctacaccgtcgggcccgcgggcaactactcctccgcgtgcacctgctaccaagtctacaccgtcaaggtcccgcccatatgaacccgcaccttcaaggccgaagaagaaagccagatctgacgagccacggctccccgctctcaagaaaagggcgtacgacttgactccggaggagctcgatgaagccgttagagcagaagttatggagcagttgaagccacgtagtccggaaaagaagatccctatagccccggaggttgaggatcactttattatgatggccgaaccaggcaaaccggttgaagtttctgactatgatcgaacattgaggaaggctcttaaagccaagccttcagcagtgaagtgtggaaaggaagtccctcagctggggcaacagccacgacaagaggttgaaccgttaatcgtagaaccggcacaactagagatatgcaacttcttgaaagatacgggactgagtatggagcagttgctagaggacgcacctatcgaaacggctccggtcatgtacacgtttaaactcggtgaactgctagtcacgcctgataagatcagagagctacctacacagatgtaccggttccatcaatggtacatggacaaatcagggatgggtagagagatgttcggagctagggtgcgaaactcagattattaccaaggagaagatgttatttggatccgctacaaagaagtcttcgacttataccacctgaaggccctcgacgtctctattctcagcgcgtggactttgtaagtactgtttatagttcaattttgttcctcatttgaacgttgctcacacacattccttttccccgttgtagaatggagattcagttatgccgtcaacacaacaaattcaatactggattcgtggacccatgcaaagtgaacacgctgatgatacaacaatacgagaaacaaactaaggacaatatcgtccatttcctggtgcagcagcattataagaggttcatactacttccctacaacacatcgtgagttcctacaatcataattaacttcaattttgttcctacaaagttcctacaatcatactatgtatcatgtaatgcaaattgcagattccattgagtccttcttttcgaccttgagaaatccaaagttcatgtctacgattcaatggataaaccggagaaaacttttgcaaagattttcgaagtgatagataggtattgtcatatattgcactgtcattatgaatcattgtataactactagatctcggataataaattaatccttcctaacaactctaaatagagcatggattcggttccgtacattggtccgcgggatctggaatgaaaaactcacccggaggttcaattttctggttagtacatgctagctccaattttgtattgaatcattctttgttctaaatcagatatgcatactaaatctcttgttgtttctctttcagtgtgcaaagcaggaaaaggggactaacttgtgtggctactacgtatgccattacatgcactgcttagcacaccaaatcaggactggccaggaccttgaagtacgtaaatttattcttccgtcaattattgcttactggtttcatatatataatcccgtttttttccaaattacagatgatttacctgatagataacaccacccacgatgatttcataagggctgttcaagaacagataatgggattcatcaacaagcatattctccatcccacaggagaattctattatgatggatcgactattcataaagccggtccttcttcttcctatgtcaccaagtcgtagtagcaaaaacaaagattacaacgtccaaacgaattgtaatatatatctatatattcatatatgcacacatgcatttacttttgtgtacttggtttggtaatatatgtgtatatttacttacttgcaaactcatattttgttaacatatatatgcatattgcctctaattacttaagtgcacacatatttgtatatacatacatacatacatacatacatacatacatacatacatacatacatacatacatacatacatacatacatacatatatatatatacatgatatatattcatatatatatatatgtacaccaggcagcacaatcaaattaaaaaaagagtaaagtccatcgccggtccctaaacttgtgccgctgtgtcatcccggtccctaaactcgcaaatcgaccgttcaggtcctcaaacttgttcgactgtgtcatctcggtccctcagatcactcgtttaggtcctccaacctgttcagttgtgtcaccccggtttctaaacttggatttgaatattatatgggtcaaataggacggtcaaaagactttatattttaaaatatataattcattaaattttcatgtgaactctaatgaagacaaactttatatcaaacttgta

SEQ ID NO: 74175 - DNA, 8682 bp, Oryza sativa
caaggggcctagtgcttgcaactccttgaaatgagagttcttctccatatcatctggaactcaaaatcacaatgcgctgcagtttcagaggccaaaccaatggtgttcttgtgaattcccgaaatagttttcttcggtcatatcaacttgaaacaaatcaaacatcagcatttatcttctaccaaacagaacaccgcaaaatcttctatgcacacagcatgctgttactgcccggatctatcgtcaccgcatacacacaaaatcaatgaactgaagacgatctacagaccattgttggggtgagaagtaagaagaatctcaccggggtttctgactgtcgtcttgacagcgtatcccttctgcagcagcatcttgatgagcgccgaagcgatatacccgctgccgccggtcacgcacgccgtcttcctctcaaccgccgacatcgccgcggttagttggctacttcgcctctcctagtagacgaagaaagagtgagaattgcttcacgcaccaaataggagcagctaggaccccaagcactgagcagagcgtactgaggttgcttttggtcggggtcattgttggtgttgtcatgtctcgtggtcatagatcatcatattgggaggtacaactactttgagaaaagagtactccctccataaaaaaaaagacaaacaaaccctgatttccgtgcctaacatttgaccgtccatcttatttgaaaaaattataaaaaaaagtaaaaagacaacttacgcataaaatattaatcatattttatcatctaacaacaataaaaatacgaattataaaaaaatttcatataagacggacagtcaaagttgaacacggaaatccagggtttgccttttttttggatagagggagtatgtgtattagaatatatcacatcatatactaagtgcatttatattatgcattaagtgtatttatattgggaccaaaggagtaggaatatatacatagcatgctcaatgcttacaccctctgtcctataaaaaaacaatttagcactggatgtgacatatctataactataatctggagatacctttgttcatgtttagattcgtatacatccattactagatttatttttttcggaacggagggagaacgtgtcttgtgtgggtctttgattagtagcaaacgtaggtaccctgatttatcctagactgagatcctttgatttaaatcaagtgattttaggatcactaacatgtggatacatactctattcgttccaaaatataaatatttttaaacttcgacacagttttcgagatgctattttgatcaataatatatatatatataatgttttaaataaaaaagagttgcatattatgatagtttgtttaatgataaatttagtaacatcaattttacatgattgatcttttttctactaataggtaaagttaaaaaaaataacttgacactattctaaaaatgtttatattttggaagtaagaaggatctatatgttggtgactcaaagtactccagtagaaaaaggaggtcgagagtattcgttcaacgtgtctttttttttaaaaaaaaaatccgggaacagcaattaagccatctaaccaacatcgttgctcctctccccacccaccctatagacttaggggctgcttgaataggaggcacttatatttctgtgaaatcagtctctcccattcaaatagggcattatgttctaacgagccatttggttctgatcaaggttttgaatatcagttttaaagagcacctaaaaatcagtttaaaaaattattgtatgaagtagtatatatgcatctcatacaattaatttttgaacttgaaactgttctcgctgttgctgctaccggtggtaatgtacgctaagatttgcatcttttcgttgtgatcactgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgtatccacgtcaagccgcgacgacaacgacgatgtccggcgcctcttactacacgaacttctcaaccggtcggtatctaaaccctctccctttcatctacaatgtcgttcatcaaacccaaatagaaccacccgactagatctaacctaggtgatcctagagcaaagtctaacaatggtatcagagcaaccctagtgttagatcgtttcggggaaagaaatccaaagaaagaaaagcacaagatccgcacggatcaaaagaaccaaaaaccctaaccctaattcttacctcgtcgccggccgtcgtcgacgccggcaacggagggggggaggggcaaagaggcgccgcctaggagccactcgacggccgcgcgcgcacctgcacgcgcgtgccggcgagggggcccgcggcggcgccgccatctccgtcgtcgccatctctctctcacacggtgggggttagagacggtggggggagcggataaaagaaaagaaaggagcgccggccatggcgcggcggcgcgagggccgccggcgtcggcgacgccgctcggcgcgaccgcgcccgcccgagagagagaaagagaggagaagctagggtttcggcggccggccggggcacgaggggttttgatccccgttttcggcgcccggccgtccgatcgcaaaccctaagatcggacgtccggcggcggccggaccgaaatcggcccaagtggggagcgcgcggcggcggctttcccggcccaggcccaggttgcggcctgggggaggggagggggcgctcgcccgcgcgcaaggtggccatgggccgaccggcaaaggccggaacaaagtccatataaggtccctccggggccgaaaatgaataaaagagaacagtagcaatttttccattttattttgtcaattttcatgcaaatttcaatagaattttgaatagatttttgcatgttttacctctgtttaaatttgaaccaacgggagaattttcacagagagagaattacagagatttagctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtaccatggaggtggtgttagagaccacatacttagaatgagcaacatggcttccaaattgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcaacaacaacagttcgctgttgagaaagatcaatgtctccactgcaagaagacaggacactacaagaaagattgtcctgactttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaaggaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcgggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggtgcgcagcatgatgagctactccacactaccactcggtttatggatggaggcgttaaaaaccgccattcatattctcaacagagttccaagcaaatcggtgcccaaaacaccgtatgagctatggacaggaagagtaccctcgctaactcacctccgtgtgtgggggagtcctgcagaggccaaagtatttaacccaaatattgggaagttggaccccaaaacagtcagctgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacaccagaggaggagctacaacaacctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatggaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcacaaccgaaaggttttgtcatgaaaggaaacgaaaatatgggatgtcgtctaaagagatccatttatggattaaagcaagcttcgagacagtggtacttgaagtttgatgggacaataaataaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacgctcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctccctttcatctacaatgtcgttcatcaaacccaaatagaaccacccgactagatctaacctaggtgatcctagagcaaagtctaacaatcaccaccagagaaacagatgatatacgaggggaacaacatcgttatcagtatggcagaatcccgagggctctaccgtactccaagaaggcatcatcgtacatctcgtccagcgtcctgttcttgaactcgaacccttctccggcgagcttctccgacgagaggcggatcctcggcttttccgggaggtcgccgaggctgcatgaaaggtcaccatcgtcagagctctcgataagatcatggagacgcatggggaattattactcagtgagatcagctcgatcttacgcggcgacgtcgacattgtacttccggtatttg

SEQ ID NO: 74176 - DNA, 4133 bp, Oryza sativa
tcatctcctggtcgcctgaaagaaaatcaagagatgaacaaataaatttcacaggaattgcttttcgttgccgcatttgccatggaccggccggttcttgattcgattagttatcaccggagagcaaggagaggacggcggcgacgcacggtttggcctccgctgccggcgccgggccaacggtgaccaccgggcaaacggtcaccaggctgatgccgttctcctccgcgaccctgctcgcttccttctctgaaagaaccttcgaaagcgagtacgcctgcattgcatccatgtcttaatattttcgatatgcacaaatctatcagggacccaaaaaagtttgaaatttaaacaaatcttgaccgaatttaaatatttttttctaaattaaaaaaaatatgaaatatttggatgaagtaaatgcttgccggaaatttcgaaccgaaattgtaaacgctgattgcatcagcacacggagctgttctcatgtggccgatttaatgggctctgagcctctgattgactgacctgtgttaaataaaatctgtaattttgtgtgtacctttccgggagatgtcttgttggctggtgagctgaggtagtcgacgtcggaccatgacgactcgtcgaggacatggccgtcgccttgcagcggcctgccggagacggcggccgccgacgatgtgaggaccacgcgcctcaccgtgccggctctcacgcacgacctcatcacgttcagagtgcctcgtacaccggcttccaccagttctttctgtcattaccatcaggctgaccaagtaaaaaacaaaactactcccttcgtacaaaaaaaaaatctataactgattatgatacatttagtataacgaatctggatagagatatattcagattcatagtattaggatatgtcacatctagtactgattggtttctatgagacagaaggagtgcgtgtatgtgattctgtgtatgtgtctgtgtcatcgcaacagaaagtagcattgtttcgcttatttaaatcgcttattagtaaataaaaataaactatgatgagaaaaagatcaaacttaaaattaagttctaaattttaaatgttagcttgtaaatgtaagcataagccaacaatgaagagtgaagtgcaaagagacatttttatggaggaatacttagtatcattaatggcctggcaaccataagagacttgaggagtggcaacccccatctagctaaatccataaagataatcttaaaatatgtttccccttcctccgttttatactataagatgatttaactcttttctaattatgttttattatgataagttcataaaaaaaatacagaacatttctcacatataacaaacataccatctaaatacattcaaagttatttttaatgaaactaatttgatgttataaatattattaaattttctataaacttaatcaaattgttgtagacggctatgtaatacctgagggttctctgacttgaggggtcaccggagcagcgacgaggaaggcgtaatcacagccggcgaccgcctcgtcgaagctgccttcctcctccaagtcggcgcggaagaccgccaggggaccaagtgcgtgcaagtccttgaagtgggagttcttctccatgttttctgcgactcaaaattgcaatgtgtagcagcagtttcagaggctaaaaccaaattcctttttaaaaaaaaaaagaaaagaaaaacgaggttaaaaccactgatgctactgcaaatctatgcacgagtatgcacgaaattatgaactgaagaagaagaatctcaccggggtttctgactgtcgtgttgacagcacatcccttctgcagcagcatcttgatgagcgccgaagcgatgtacccgttgccgccggtgacgcacgccgtcttcctctcaaccgccgacatcgctggtcagtcggctcgatttcctactagcagagaacgatcgagaattccttaacccaatagaacaccaagcactgatataatggtagtggtttgatgattgtgctaaggaccagtctcatcgaagcaacaagagggtgtactatgtccgtgttgaatccggatcagctgcagtcgctactgggactgcaatttaggcggtaccagttttcatcaacggatgtagatggaacggtccagatcagcgaggtgcactattcatcgtactgtagcataaatactgtagcacagaatataagttgcagtaatagctataactgcgcatgatctgaatccgtctgtgtgtatagatccaaagtttggatctaaacttcaattctttttcatcacgtcaacctgtcatacacataacttttcagccacatcatctctaattttaaccaaaatccaaaatttacgctgaaataaacacagcctatataggagaggtgaggttgctggcctaatcgaaacagtctcatcaaagcagaaacagagacagcatttatcatatcgtaattgtggctctcgctggagtcactgcaacgtatagacactgggccaggaggacacgtgatgctgaaccttctggatacgagtactgtccaaattcatagagcaaccactgtgagcgatgatataccggcttcattctctccactcacaaaagaatacaccagcacttgaaaaatcgatgatacacggtttgtgaaaccatatttgtatacgaaaatcattaactgaaggagtcaaaattttggccagtagaccacaagaattggcaaacgcaagtacaaaaaatccctcatttccacgccttccgtcctctgaattgctttcccgagcgcttttgcagttttttcttctcctgtcgagaacgcgctgccttcgctctgcttgcagcgaggggcattttcttcttgtgttgtttctgcctattgctcaagccaccggtctaaaacgcaatgagaagcatataagtagagaaggaataaaagcaactacgaaagaacaattcatgatcagatttcacaaggttgtgccatatagccaacataggtcaaaataagcaccaaaaaggaggatcatataaacgaatacctttttctgtttcacagctgttcttgcttggtattttcctctatcctctcttccagccttcaccatttctaatctctcctctttcgtaagctttctctttatgtgagcctacataaaggaagatgttcatataagcaaagtgtggatgtgtgtgcatgagcgcgctggcacgagtgcaatgcgggaggggaagagagaaaatgcacctcaagcttggatgggtcaacccgtttcagactaagctgatcagaagaaggcattttaaaggttactgattttgtgtcatggcccttgccgagtccatgttgtgccagagccagttttgcttctttttttgcctgaaactcataacaatgtcagatatacacaacttcactttctttcccaaaagaaagctccacagcatgaactacagctggaaaaaactcccatacctttagctccttaatacgcttaaaatcttcatcagataagattttaccagcttcatcgcacgaagcttcagccttcttggctcctgccaacttcttcagagctcgaaggcttgcatctgcagcattaagttgccctatataatcactcaactttctcttatttgccttgcgactgctgttttttgacttatcatcctggtcactgtcatcatcctgatcagagccttcatcagaatcatccaatttctcactgagttcctcatcatcatcagattcagatacatcattctcctcatccatatcagagtccaattctagctcatcatcattttcttcactatcattgtcagagatgtcttgatcctcatctagttcctctgtatcatcttcatccccagatagttgatcttcctctttcataccttcatctgtgtcaagcttgtttgcttcagacgaaccatccaaattttgtttagtaccacgagcagattgcaactctttctcatcattagaatcaaaagcatcagactcatcgtctgagccttccccttctgatgaaaaatcttcatctagcaactcagctccaggcacatcagaagcgatagttgcttcgccgaatgcttttgg

SEQ ID NO: 74177 - DNA, 643 bp, Oryza sativa
ctactgcatgccataagaacctgacgatgtcttgctgagttgctttatcttgaaatcaagggaaagtacgaatgcctttgcctcgtgcttctcttttgcatctatccctttctttctttgcgatttttatttttctttttgaacgaagctatcccttactttgtccaaatgacaaaaaaaaggctttgttggaccatttcaagttctcggtaatcttccgagaaatccaatttcacaagagactacatccagaatcacactagtgtatatatatataactcatatgcataatttggagcacagtaatttgctagaaaaaactgtcaaatcgctctaaacaatctgaagaaatcaacccgcgcgcggatacagagatcaacggccggcaaaaaggtttctcgtcgacgaaaccgccgcggccgccccgaagctatcgggcggcaccgccgcaatgctgcgcgccgcggccgccaccaccgccgggttcctcccgccgcgtctggccgccgagacggcgcccgcggcaagggttgtggcggcggcgggtgccgaggtgaggtcgtcgccgctcctcagggctctaggggtgccgagaggcggcgccggcattgggagcgccacgccggggaggaggatgtacttc

SEQ ID NO: 74178 - DNA, 2774 bp, Oryza sativa
ggtgggaggtggtggggcagggcaggcagctgctactgttcgttttttttttttttttgccttttccttgtctgaaacgtcttctttaccatcctttttccctgtgctctttccattgatggtaaaaacttctgttcatctactgtttcggtttgcactgcgttcttggagctttgagcagtttgggtcaggggtggaccggggaagacaatgtgcttttctaggagtactttggagtgggagttacttgccaattgttgaaatgcaaggtcaacactcaatagtaagggaaaattggaaccatgccattataattttacaaaatttaagatatgccatcctgacccacatgtcattgagataccgatggcatatatcaaactttgtaaaattataatggtattacatttttttacccatagtttaaacctttagtttataagcataggtgaaattctgaatttttaaaaagtcccctgaaattgagttttgggtttcaaaacatttaaaaatttgaatttggaaaaaaaaagttgatttggggtattcatcttagtttattttctagtatttatttttaaatcactacaaacaagtatataaaaatttacccatcaattgatttttaattgctaatatccgctcaatttagaataagtataagcgaaattgtgtgacatgttgaattgatgtatggttgttttaaatgtaataaccactgtcgttttaggttttaattttttttattccacgaaaagacacacgtacacacaccactgcaatgtatgtaacacatttgttcttaaaaaaaagtgacgcattcacatatgtaaatgccctcttaacaaacatttaaagagataaaaagaaaagtcaatatactaagttcactgagttcccattaaaaaaagtgtaatatttgttggcattagaattcaagtctcggtagaatggtagatatatatgtcatgcatctgcaattttatcaccatcgtaaaatagtgctttcgtgggttatgtattatgtactagtattgcagaattaatgtcctatattgtgttttgcttatgaccaatcgttatttaattttgtcaccacagtatgaagggattaagggacatgacaaatatccttactcaagtctatagttacaaaaaaatatccttggtttttggcaattaatagaagaattttgtaaaatacacatgattcgatagggtaaaacacgggtaagaaatattttgaaatgggaacagtattttttattttaaaaattaagaaataacattttcaaatcatataatagttcaattaatagaacaaaaggagttgtttttctattttaaatcattgcaatttgaactgaaattatcaaactcgccacctcttgaggtgtatctatatggcttcataacctagaaatactttcactatcaatgacatttgaaatcattagaaagatgaaaatgatacacatgaccttgtcttgagaagtggacactttcgtattctcagaaacttgttacttccttaggacataaacttatgttctccgactacttgttcttttcgacgtgtaacattgatcaaatattttattagaataaggtcataaataagaagtctaagatatcgtgaaaatattttacaggagaaatctacaaatatcaattttatgttatgaagttaagtgtttaaaaaaattattgatggccaaaatttgatagaatctattccgaagcgtccaatgtttatgaccggagtggatagattttacgaatttattctaatatgaatttatggttgaatacttaacttaaaatccaaggaacctaaaaaaaactagaagaaactagtactaacaaaaaaaacactctcaattataggaaaactaattactgactactttctccatccaaaaaactcaatctagtctagcatattatggaacaatgaatctagataaaaccttacctagattcgtcggtttggattttttttatggaaggagtccatcagggaaatgattttcttaagacggaggggggatttggagattgcttgatccccatccgtgtgattcaaaccgatcccaatcaccaaactgcgccgccggccgccggaatatgcttgtcactgtataacagctcaccgctcgtcactgacaacggcatcttggactccttggaggcacgacaaatttacaagtcagttgctgccactgttttctataaaatcaaaacttgcacggaagtgaagtgaagcgagatgggatcttgaagttgaagacaaggcagttgttcagtctcctctagcacagcactagcgagtgactgccccaggcggatattctgaatccaaggaggaaagatgaggccgcggctggtgctcttcggcgactccatcaccgagctctccttcgccgacggcggctggggcgccgccctcgccgaccacttcgcccgcaaggtacgccacccttccctcctcctcgcgatccggccgctgtcccatccccgcgacacgcgtacgtcaccgtttctttggataggccgacgtggtgctgcgcgggttcagcggctacaacacgcggtgggcgctgcgggtgctggcgagggcgatggagggcgcggccgccgccgcggacccggcggccgtcacggtgttcttcggcgccaacgacgcgtcgctgccggaacggaagcaggtgcaccagcacgtgccgctcgacgagtaccagagcaacctccgctccatctgcgcctacatcaag

SEQ ID NO: 74179 - DNA, 5901 bp, Oryza sativa
gaaatcacaggaatatgcaaaatgataagaactgacctaccggaataaagtacattagagaacgagcggcaatggaaacagctttttcatgggactttttgtataaaacaagggcctggagtagatcttcattcatcaactgcaggtataacagaacgattaacagaggcctgctagatgaataaaataaatagaccaagaatatcttcctaaatatcttacaacccgcacagtacctcaggtggtaatgtagtatacaaacctgcatgtgtgttctcaacttctcatgcataagtgactaacgtgtcaggctacacaagactaaatgtggcctggtaaaaccatgtttataccttttcaattcttcattaagttacacttatatgcttaaaacctgtagcaatcgactatcacatccttttggagtttggactacgcaaccagtcatttaagactagtaaaaaaatgaaatcacaatttctactagagcatgtccagggcacaggaattaggtacaacaaaacatgaccaccataaaaatttaatgaatccatcacacaaatttaaggggtgtctggtcagaggtcagtagcactagaaagcaagagtacagatttgagcaaggtaagtaccaaaggtattctcatgcagatctctcgcacaacattcaagccaacagcaatagcctaaaatgagattggttagaaatatgccatgttagttggaaaatacttaaatatattagatatgtgatgagtgttatgcaaacctctgggcgagaacgatcatgcacaaattgatttactatctgcttaaacagtggttcaactgcatcaggaggcacctgaaattgaagcatattaatttagctgaatttggacaaagcaaaagaaatgatataagtagtgaaatataggagaagagcaaaagtgtttcaaccatatcatggcaagcctgtactgctgcagcaagtaaagttgttacatctcgttgatgaggctgcatcacagaaaggtagaaaacttattatcaaaactagtatgaactagtataatgcacgtgaggtgcaacggtttttttttctaattgtctattatattatcattatgctaattttgctgtcatttcgtaaagatgaaaattttcataatattctattgtcatattttcctttcgacgggatctatggcatgtgggggctaagagatacgcaactcacagtccgtgggtccaccaccactaccatcttttatattagtatagagtatagataaacattatatctaccataaggttgctacaagaagaacacatgccaagttaagaacatacctgaacgtatctttgaagatatggatagaagttcaacaaaaccaagtgatgcagcccaatagtcctcgctataacctttaacatcatcatccttacctgcaagcacccaaccaacattctctaaatttgaattaacgtttattttcgtttaaccatcggatggaactcacaacagacattgtgtttaaaaaataaactattgcacatctgggttccaattctcctacttgaatgctggttccaactatatacactcatgtataaaacttcagcagaaagctaaaagtactaagtaatgatagttctgacaattatatataactttttaaatctttacagaacaaggaatcttcagaacaaggaatggggccaacctcaaaccgctcattgcatttctggagccgagagaagagcttctcagcaaaaccctgtcagccaaaaaacgaaagcttcaatataacagtcaatatgtaaatgataacactctgaacaattatgggattacaccatttcccacctgaggatcctttaaatacgtcagtggtgaataataattggagccagtgtcctcagtggatttacgttgttgccttttcatactacgaatcacacgctgcaatttagctttcttctttttcttagtagcagcagtgcccttgtgatttgcctgagaaagtaatatgacaataaaatacattatatcagaaggcacgtaacagaaaaaagatgtaaaacactataaatcgaaataatggtaaaaattcaaataaccttgtaaacatcctctttactaagaataatttgagggttttgagcttcatcttcactgctggatgcatcactatcatcttcttgctcaacgttttcatacccaagaaggaatgaaatagcggctatcataattctgcatgtaaaagatatattttagatcaacacctattaataaacacaaagatgctggcagtatgtacctagaagaaccatggaaacaagcattgcatatagcatttgctgtgcggtcatcaaaccagacccttcgacggtgaagatcacatagaatagtaaaggccctctttgctctcgactcttcctcgccctgggaaacagcgaagcaagatgcataactaaacgaggtaggaagagaatcatgaatgtattcttgccactatgttaaacccgataatactaatcagtgcaagtgtggtatagtggtatgtcacaaacctgtaggaatgtgaaaaggatgttttgcagtttacgattcctggcttcattcttgtgggtctgattcattctcctgatactgtgtacaatatgtgagaatgctagttttttgacagcccggtcccctataacttgaagctccataaataactccattgtgtcctccagatcaacaatctaaacatcaaaaagcaatgtatacgaggagaatttactctacagtcatacgataatcccgttccaatccacacgatttgaacaaaatttaacttaatgtgaaatgaacagatgaactaaacaggcgtcaccttccgattcaccagtagtatcagcgcctgcacgaggtgcacacggagcccggacggcagcgcgcgcgcgttggtgtcaagcaggccaccaatctggtcgggcaagtcagcgaggtcgtccgggtagaagggcgcgacgtgggcgaggaacagcgcgaggtcgccgagctccttggccacctcccctccgccgccggacgaggacgtggaggccagtgccgcctgctgcgggaagaggaacaccgatgactcgaagtggcgccgcagctggcggagctcctcctcgtacccctccgggtcgcgcttcatcttcgcctgcagcgccgggaggctctgccgctccccggccccgccggtggccgacgccgacgccgcctccggcgtgaacgccggcgcgtgctgacgaggcatcggagcggaaaatccggtgtcccccgccgccgccgccgctgaggtgagaatgctaaaaccctaggccgccgcaaaacttcccgggagaaccgatggcaagaggtagtcgacgatgcgagtgactgggctggccagttacagtacacgtccggcccattaatctagctaaatttggaccagtaaggcccatttttcctccctctagcaaagaaaataagtctaatttgaaagacctcggtcaaattgcatcaatcaaccgcaaaaccgggtatatcgcactctccaacttcaaaaaccggtataaatcgactcctttgatggtttgaaaatcgattttctactgatgtgttaaattaaccgtgatcaaacttattatatccgaattttactattgaaggagacaattcaattagaagcaagagatgagggaagaaaaatatacttagagcctctttatttagggaattttttcttggatttttaagtcgcctttttagtttatatgatttataggctaatggattgaagtactaagtttaatagtagggtcataactctatctagcgtaagaaaaaaaaacttcttcaacataatttttgatgatgagtacaaacgaaagaactgcatatttgttaagcttagactttccagctcataaggttaagagcctactataagcttcaaataatctatagtcaatctaatagttaatttatacaatagttaactataaatatacactaggggtgtgtttggttggacttttcaacctgcttttccttttgcaaaagtcaagagtcaaccaaaggacccaaaagcataagtgcttttgctccaagtgcttttgagggaaaaattacccacctctgccattatgaaaaaacggtccgatattcttttcctcgtctcctccttctcgcgagtcgtgacttcatggggcgagcgtcggccatcgggcgcattgggtgtccgccatcggcgcggcccccgcctttccccaaccgacgccgcccaacctgatgtcggcgcagcccccgcccttccccaaccgacgacgcccaacccgacgccggcgcagctcccgtccttccctgatcgatgccgcccccgcccttcctcaacagacgccggtcaacgcgacgccagcgccgctcccgcccttccccgaccgacgcctcctcctcccgacgccgccgccccttcgctcgtcggccatggaggtgggagacgaaggtggtgaggtggccgacagcggtggcgtcaccactgcctcatcctcctggcgccaccgctcctcaccaccgtgcgtcctcttcgtcgctgaaccgccgctaccgctcctcctcgccgagacgccgctgccaccgctgaggccgacgacaccgccgttgccatatccatctctccctcttcttttatttcaacgtgtgtatgacatgtgggggtcgctgtcagcgggactagttatttcaaaagccacagctattgaaccaaatgagcttttccaaaagccaccgtacatattccccagctacttttaagaagggagtacctatacatctttcgaaagatttttataatcgtatcacacagatttttaatctttatattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatgcactgtaaatttgaatgagaaaatcgagtgagagataagaaaaaaattttcgagtgagatatagcaaaatcgtttaagaaaactacagcccacagatatttttttcaaagccagagctcaactaaacacaccttaagagcttagactttccagctcataggcctaaacaaagaaggccttcttcctctcgcgaaccacgaggcccagttggctagtaatcgttcgcggctagccggcccaccggaccagcgcttcccccgccggcgtcgcgcgtacgtaggagacgacacgacgacttctccgtgagatcgcgcgaaaatcacgacctcaaccgtgcgacggggggcgcaagcgcgacatcacgcagcgttttctccccacccacccgccacgcgcggcaccggcaagcggcgacgcgcgacggctgcgcggtcgttttcggcggcacgccctgcgcgcgcacataattcattctgctcttcccccacggtcgcgtggtcctttccgacgcccccgtccgtgacaaagccaggtttggtggcgagcgaacgagtgactcgatcatgccccgggtcgccgtcacgcagcagcgccctgtgtctgcccccgctccggcgatcgacggcgaccgatcgatcggcagctagcgacgcccgagcttacatgcgcgcgccgcgtcaccttcccgcgaccgatcgatccgtcaatcttccgctaccgtgtatacgcagcagtgtcggctgggacatgtacatacattatactaaaatacagtactacgagccgctttctgaaaaagaaagcgaaggccattatt

SEQ ID NO: 74180 - DNA, 14465 bp, Oryza sativa
  unsure (1)..(14465): unsure at all n locations
catatttggtttatcgggtatatatccagtcaccacttggtggcccttagcttgatctgaagatccttttttcaagttacaaataaaacagtgtgctttttttttgtaaagaggatttgcaaactgtacttattgtccctgtctttccttgcagggacatgtatggagaagatgacccttcaaaactacctgaaagaaccaatgaagctgctggcacttatgcacaggcatgcctgacagttgctaaagaattgaaccatccagtcatagacatctggacaaagatgcagcaatttcctgactggcaaacatctgcattatggtatggatctatttcaagtgaccttatacctaaacttgatgtatggatgggcttaataactgttaagggcttccatttatgctaccagtagcctactttgcagattgcataaacaatctgatcaaacataatggttctgtacttctattgagagtataaaagttctataaaaaatgtagattcatggtaaactgttctgcctaaagattcttgctgcttactaagatagggaatcaccttcctgttatcactctgtctaaagactctatagttaagatatttaactgaacaagacgaacctgacactctccataacagtcattcagttttcttgcttctgaattgtgcttagatcaaaagattctgtactctgtagtgaaaattgttggaacaaacttacgaagtgcgttttgcttagttttcatcttctcttctgatctgtatatagtaaaatggtactccatgctatgtggaccagaacatagtagtattttgttttgaacttgggtatatatctgtgtacatgtatttcttgctgaggaaatgcgttatgccgtgatgtagctgtgaataaacaattgtagagtttactgcttagaatgttttttttcctgatgacaatcgctatacaactttcttttatatcatgcagtgatggactgcacttcaccccattgggaaacaaaattttgtttgactgtgtgctggagacactggaaagcattggtttcagccaagggagtcttcaaccagatcttcctctcttccatgatatcgacccaaaggaccctttgaaagcctttgaaatctgaagaaggtcccggccggcatggtttgttcaggcacggatactcgttgtaacagggacaccttatgccatcgtgttgtgccagctgtatgtgcttgaattttccattataagatggttgaatttccatgtagaacataataaatggtttgtatttccatgtagaacataataaatagtcatacaattccatggttcacatttaaaaagaaagggaaatttattttggatctgcaaatatagaagctaaaagaatttcccagaaaagaaaaggaacatattaaagtttttttcttctttttaaacaaatacgcacacaccagccatgttcatgcatccctgaactttttcaactttctgcaaacgattgttgattattctgcagaatatatatgctgcgataatgcgtgcgtaacattttctacaagaaaccagacatttgcaaaaagacgaagtagggaaatgcatcgacttgggcctatgagtggaggcccattacgcatgactgatgaccctaccttagaaaaagtccattttgactgcctcgtctattagacgacatctaatttgcatcatcagttacaaaggctctcgtaactttgaaaaccaacataatttgactcccctggtgattttgatagtgattttgaccaacgtggcttattgacttggtccgtccatgccaatatggcgattgtgtgacagtttttatctctactatcataaaaattgaagttgttttcgtcaataccttggcatgccgttcatatttgagtcggtttttaagtctgttcgctttggaaatatataaggagtcatataagaaatccttttaaaaaactcgcatgctaacttgggacgaaagtcagactcctaattgtttcagaattcttgccaggccatgctattataaaaattgaatatttatttgagtccttttttaaaagttcgctcgcttttcgaaatacataaggagtcgtataagaaatctttttttttaaaaaaaaacttgcatgctaacttgggataagagtcgaactgttaattacttcagaattattgcttggtcataagaaagcaacgtacataatatggctatcatcctaataaaagtttcgaattagatatcaatactatcgaaataaaaatcccatatactttttagacggctaggcttcgtatctctccagttcaacggtgagaggtggaggagaggatagacaaggaagaagtgatcactgacttctgggtcccatgaatatttttctttagttttttatgattgtaatgccatgtagacgtcacatcagatgaaggctagttcaatgcgacaagtaggtgacatgttagccaaaaccattgtcaatactgtcgagggaactattttacaccgattttattagttggaggggattatgtacccggttttgcagtcgaggggtgggaatcagattaggccgattgtggagggtgtcaaattggactttgatgctttgcacccctcttcagccaattatagatgttgtggccttcccattcagtacaaaagatggggaataagttcactttaggtccctctatttgtcggtcagtctgattttcgtgtcttgatggcaaaaccgggtaagacctgtctcccaacttatgaaaaccgggcaaacgagatcccttggcggtatggaaggtagttttgggcgacgtggcgcctacatggatcctttgactaggtcttcgtcccacgtagcattgacgtggcgcttacatgacaattttatctgaaaaataataaaaatcgtgggacctatatggcagctatacaaaaaaataattaaaaaaggtggggcccatgtggtcccacctattggcctctcttctctctatccaaccctcactctcccctacaagggtggagtggcgggactgagcgaggcgggcggtggagggcgcggagcggctgagcgtggcgggcgacggccgacctcaccctcttacctcttccggtggtcatagcggcagcggcagcgggtggacgcggcgcgacttcattcctgggcccacctcatcgtgatcctctgggtccgcgaaggagctcttcatcccggcgaggggttgtcgccgttgccgctgctgcctggcgcgcgtcggtcgaggcggcagccatggacgcatgcagcgggtgatggaatcaggcgctgacgtcggcgatgggttttcccaaatccacatccgtcgtcctccattgatgagctcgggcagcgactcgccgccgcattctcttttccctccttctgacgcgcggacgaggagtcgctgcaggagaggagtcgtggtggcggccagagcgagaggagtggcgcacggcggcgggagagaggagcggcgcgcggtggcgggagagagaggtggcagtggaggagaagaggagcacgtcgtggccagcgggaggaaggagcggcgcgcggtggccggctggccagagtagcgtcgtgtggaggctggcgggcgagaggagcgacacgcaccgacgggcgagaggagcgccggcggccggcctccctgcctctcccagtctccgtctgtcatccgtatgtggtggaaaaggtgggacccactaacatgtgggtcccactttttattttttgtttgactgattggtgggtcccgcatattttgtattattttttttattttgcttctttacttttttttctgaatcaaaactccacgtaagcgccacgtcaatgccacgtgggacgaagatctagtcaaaggagccacgtagacactacatagaagccacgtcagccaaaaccgggatcaatactgccgagggacctcgtttgcattgttttataagttgagagatgtattgtatcttgttttctggaccgaggatgaaattagactgagcgataaattgagggacctagagtgaacttattctaaaagatggtgtaccctgaatttccattggagctccactcccctagaagcccagttgcctagttgggttgcaaagtatatgctgtccatcagtaagcagaaatcttactactagtagtatagtattagtactaatctactactactcctgtagtactcctatccaaatcaccagctcatcacctgggagtccacaatatcttccctggctttaacgagaaacaagatttcaggaccccaagaagaggatctagcttgtgcaggagtacaggtggtgagatgggcacgatcacgcgtatgcccagagagctgtacaatgccgttgtcactttcccaactctcaccttacaaaagacagaaagtctcacagacacacacagaggcggttttagcagagagggccattcccgttcatgctcagcaactgtcactcactctgtcagcctcgctggggtgcgaacaaatggatccatcatccatggcatgcgcctactactgctacagcgaaaaaacaaaacaaaagcctgggacaaccctactgttatgggttactgatccctacggcctaggttgattaacttaacttataaacccaagctgatcaaatcctaacgataaaacaagatagggtttagccttaggcagcgttaaaacaacctgcctatgtgtacggcaaagatcgcctcgtgaagcgtggatctcttttactattcctaccagctcagcctataccgctccacttcgctcactgacatgtggggccctggctgccagtaatatgttcagctgtaaagatccctgctgcaatctcctgctcttgcctgcttaattaattaactggcctgtgaagcatcatgatcagtagtaaatcagtggagtaattactttggattcagctcgcagcgtggttaaattcgggcgctagctgctctgcctccttttgcctgtgcgtgcgtgtcgtggaaagcggggactttttatcgccggcatctgatttgctgcacatctggggagaagcatgcatgcgactgtactagagcaattatttatctctctacacaattcgcatatctactgtttttttattagggattgctcgattttcggtcactggaaaatttcacagattttaggtctggtttagttcacaactttttcttcaaacttttaacttttccatcacatcaaaacttttctacacacaaacttctaacttttccatcacatcgttccaatttcaatcaaactttcaattttagcgtgaactaaacacaccctagtcgaatttctcttgtctgacgatgcttggcggccggccgggaacatgtgaggctcaaggattggaatgggaggaggggttatagatagtggaaaggggcagtgaagatgatggatacaggcgagtggtaaggcgatgttgtctaaggctgtcaatgagtcgagcgtcaacgagtcaagctcgtatgtcgtttgagcttgacacatgcttaagccaaacttattccgtcttcgagcttttaagcaggctcagttcgagctcgatcaagcttgagcttgactatgagtagtatggagtatagcactagatctaattacgcacaaaccggagggtttttttctaaaatttcaccccttgcactatagctatctgacgtggcattgtctagcgtccgcgccatcggccacccttaatattctcctaatgtattttaatgatacttttagataaaaataactattttctagtaaatcacactaacaatagaggagataacacatgttaattcattgtgtagatacgtactaatatatattttatttattagtttaattataaaaaataaataaacaataaaatccatatacagtcaagctcgttaaaagtttgagcttgacttaacaaagctcgagagctttagattgggatagggttagcttggcttgtttcttgaaccaaggtcgaattaagtctaagataaatcgtgctcgagtggcttgtgaacctcgagctgttataacaactctaacgggggctctatatcgaagccgctgggaagaaagaggttggtggactaggatggacgggtggtgacagcaatgagttcatcatgcaaagctatgaaaggagatgcatggtgttgaggtcccattggcgttcatctcaggaagaaagcgtggaggcggtctcgctggcgccgttgagacagaggtagagtagtgaatatagccatggtgtagcattcggtggaggaagtaaaagagataattgagagattactgtagtgcataaatcttggcgcaatccatgccatctaagggcgtgtttggcgcccctagctcccaacaccaacactgtgcacagaaaacagagcggtccattagcgcgtgattaattaagtattagctttttttaataaaggattaatttgattttttaagcaactttcatataaaaactttttataaataacacaccgtttagcagtttaaaaaacgtgcgtgcggaaaacgataaagaggggttggaaactaggggtgccgaaacacaccctaaagtgagagtagcaaaatttgagtctaaagttttttttttgaaaggaaaatttgagtctaaagtggagtatggtgaaatttgtgagtacgacgcttctcttcacctcgctgtgttccgttccaggtagtagtgctcataccaaagatgggtactagcgctgctgctactgcaatatttttgctgggttttcgccatgcatgctgcagctagctgcatgccgtactgcagatgaacctttttagggccagcgagctacattgccgtagcctgaagaaagataagaataggacatgacagttcgttcatcattggccactggctactctagtactaccatcccctcatttactggcacagttgcacccatgcatactcccaaatgacagttgctgggaaaagaaaattaatttattttaatagtttaatcctaaatgacagtttctgggaaaagaaaattaattgattagtaattgtttaatcctagtactgcatgagcaccggtagtgtgatctcactgccaccactgactggatcctctgtttaggcatccaatgaaatgaccatctatctccatagtacaacatcgcataaaatataggcacaaataataatctgagaagtttcaacccaaaaaaaaaagaacgcaaaagcatgcggatgcacgaggggaaaagaaaaaccaaaaaacggtctgcatgcgcgagtgcccccagctacagttgtttcacacacctccagaaatccgtactacgagtgtattcaattcgatgcaagcatgcaaaagaagaaacgcagctaggagtaggagtagcatgtatagcagctagtatactgtactaggagtagctgtacgtggccatcgccgtggttggggcgtcgcgaatcatttggacagatcgatgcacgcacgctgcacgcgacgccacccctcctcctcatcaggcatatcgcgcgcgcgcccacgcccggacggcgccggccggccggccggccggtggtcgccatgtgtacagcgacgtcgtgcttgcccaatctgccaatcattcctacggcgatcgatcgatcgagctagctagccgattccccgcgcactatactagctttaatttagccaggatgctttgccaagatgtgtgtcgtccagacttcaagcacacacaggcctgcgccgtgtatacaaatcaactcctgattacgaatctgcatatatccaatgttaagttttgtagatagaaatttaactttatggaatgaaggaagtatgttttgctacgtcactactagaaaaataatttattgccacgaaaaaaatcgtagcatcaatgctaaaattgttgcaatagatacatgttgccacaatctaaaaatcgttgctagccgtagtaataaatagtgtggtaataggttattgcaacgatttttatttagttgtaataaattttgttattgccataaaatgtatgtggcaaaaaatatatattgcaacacttcacatcgttgcaataaataactattgccaccactccatatgtggcattagttctacgtaccaaattaaatgtttcaatattaatttatcatcctaactattttcttttgatatcttgtcatggctaggattcgaacccaagatctctccctcacgcgcgctcttcatgaccaactcacctacgcatcaattttgtttaaaaatgcatataattccatttgagactgcttaactgagatttgaatcataaatttgagtatttaaaagatttcaaatgaaaaatttaagttgtagatctcatcgagaggtataaattttatataaaatttgtcctaatccgtgtccatatgaaaagaataagttgaattatgagatgataaattttttttgttgtaacgaatttgttgatcatggcaaatagaaaatagtgaaagtaccatgtactatgcaaattgccataaaaatttaatttatggcgatagaacatgttttttttgcaataataatatttttgtggcgatagcccatttcctattgcaacaaaaatactgaataaaacaacgattgtaaatcattgcaacaaattatagttatttgtcacagaaaaattatcattacgatagtataatatattgccacgaattatttttcattgcaataaattgatggcgatatctcaattatcttgtagtgcgtgtaacgtgtgtggcgctagggtcacgggnnnnnnnnnnnnnnnnnnnnnnnnnntgactgaaatcgatcgatcgatcatatacgtgttccgacggcgaccggccggccggtgcaggagcagccgagggggacaccgaccgtgcaatctgcaatgcacgcacgccaccacgcgccgcgtggccggccacggcgagcaaaagcgtactagtacgttcgtggcgtacgttggagcgtcgccgtcgtcacctctcactcacctaggaaccgtccagtttggtacaccaccaccactcccagttagtagtacgcaatgcactgtggtcgaattgaactcgatcgaaacatttgtggggacgtacgtacgtacgtacggtgtctgtcacgcacgatgaaggacgacgacggtgatggcggctaaggatctgtttaggagaacttaagattctgagaatcaattgctgagaagctagctggtgagaatatggagaagctggtgacccagcttctggcttctagtttatttttccaaattctacaaagagaaactgcagctgctagaaacttacctaaacaggctataagatcgatagataacccgcgctgattattggtgtggactgtaccggaatcgatcatcgattagtactactggacatgcaagcatccatgcatgcacgcgatcgccaataatcagtgtggcaggcgcttgtaaaaagccatgggactttacgagatggtagctagctagtgcgcgcgcggcgcggagggctggacgacggatggcatgcactactcacgcgcgcgcgcgcgcgcggccgccggcgcagataattgttgggggggaggtagctagggcccaaactgtaaagagcacggaaagctggcatgcatgcaggccggcctgcacacacatgtactgtacacacaagcgggggggcggcggcaggcatgggggcatgcagatgcaagcggacacggccggccgggcgccgcgccctgtgctactgctctgctgcgaaggcacagcatcagtactggggacggggagttggtttgtgcgccacatgtgttgatccggcctactgctagctacagccaactgctcacagtcagagactcagaggtcctatttaatttgaagaaactgattttagtatgctcgcttctgataatttagagaagatgatttttctagcttctgaagtactagtagttattttctagatcatatagttacagattctcgtaaatatgatcaaaattcgtattgtttaggagaattagagcttttaaaagaagttgcaactgctaaaagtctacaaaacaggaccagaggcttaaatgtataacttcttattagttactactcccttcatcatccataagtagtacaagtgattttaaacttctccgtagtttcatttcgcaaatataatgaaacttgaaggcattgtttttctaatctatccaatcactgtaatagttacatcgcacaacatgattttcttttctaacgaagtcgtcaaagaaatttcacattaaccttaaactctcctaaacaatctacaatcccctttatatactttaccttaaacgttgctaaaaatctataatcccctttatatactttatggaatggacagtaactagctagtgagtgcgcagtcagatggtcagagagatcatcggtgatgaggactatagctagtagatcatggcatcgctttctcagcatgcagtggccaggcctgtgtccggccgaacgggctaacatgcctaggcttctgtggcatcattctcttgctgcaggctctacatactcctatatgcctagcatacggagtattcctatgtgaatcgtacaacgggatggccatgagccatgagcccatgatctcgtgaccatcctctccatctggttgcatgcatgcatcttgatttttttttaacagaaatgggtacacggatactggaatactatatactccctccgtattttaatgtatgacgccgttaactttttgaccaacatttgaccactcgtcttattcaaaaagtttatgtaattatcatttattttattttgacttgatttatcatcgaatgttctttaggcctgacataaatatttttatatttacacaaaaattttgaataagacgaacagtcaaacgttgataaaaagtcaacagcgtcatacattaaaatacggagggagtatatgtcatgcatgcatatttcttcctatacaaaatctttgcaatgtatacataaagaaacaatgtttctaagtgctgaatacaagtagccaagggttgtataacatcaaccaataactaataattagcccataaaacagtcagctgtaggcaattttgttgatggggatgtgagagggggtaaggagagagaaacatatatttggggtagtgatcagctatgcatgatatatattgctctacagcgttgcatataatagctatggcatagctgtgccagcacaaaacagtagcgccactatacagtggctgcagatttgctctatatagtgaagccgacatgtatgcccattgactctcgaagtacaagatatgatgcgctacgcaagacacaacttgggaaaaaaaaccaaacctagtggcggatccagaaaaaaataacagtgaggtctaaacaaactagatagagttacagtccctcctcccatctacatttggtaaaaaaatttagtgggatcttcgtgggggctctcatagtcttcacgctagtagtgggggctcgagaccccgccaccctcatgctagatccgctacatatgtgaggtgatatggactaattggtagaacttactagatgtccgtacagcacatttgtgggagtagtctctggttgattaatgtggacttatatataagatgaacaagccctaacaaaaaaaaaaacaaaaaggtggcttcttggctcctgatcaaacaaatttaaataccatcttcctaaaatactaacatatataaaaaaacaaataaaaaattatacctacaaatcaattaactttgttataatttagattgagcatgttggaggccctctaggttggagctagcgagcgtttgtggggctaagttctggagctacacatatagtatatgggttgatacatcatacatgcatggaacagaaaagttttgtcctagaggccggaggggagaaaggggactttgtcacaaaccctcccgtgaataccaagcaatgtcagcagcgaactgtaccgtcgtcacatagtgcatcatatcaagatatgtgcttttttttacttcaacggcctgcataagtgtgttcagccctgtacagttttctgcttcctatggtacgtgatctgttgcctccacattcatcagtgtccatatagtagtagtaatctacttactcctatttgatttatcgtaaaaatagtcaccggttcatatatattggtatatatatatatatatacacacacacacacacacacactcaatttcatttccaaacctttcatgtagaccccaactaactcttcaccataataattcggaccgcacatcacaatcgtcgacaatgcatatatatatcttctttttctcctttaacgtgatactagctttctattccatttatccattttgaatacaagtatttctaggttgtttagcaaaaattaaaattgaggagaatttttcggtgcgctttattaaatgagagatggttgagggtaaaaaaaaagaaatttaaatgtgaggtaattaatgggataaatagtactctaaatagttcttgaagcactaatactttggtacaaatttaaaatgttagaaatacttatatttttgtaattgcgggaattttaatagacccaggaattaatgaatgcagtatagctagtttcaggcttctgttaatttggtggccctggcatgacatgacatggcatggcaagtgagccacaaacattttttaaataatggaaatggaatactgtcgacggtgtgtacccgtagaccggatatagagggtattgaggtgtacgaggatctacttagtacgacatcaaggaaacaagagacaaatattatactcgttcaggccccctaataggtaatagccctaatccagttgatatgggattatatggtgagaaccacagattacaaagggaataaaagaactcgacgataccgacgagatcgtagtcgagttggttcgactagaccacccggcgacttggctcctgtagacttcggcttcgtaggttgtggtcgttgtattggctatgagattcgatgccttaggtcctcccggggggtcccttttatatcgcaggtcaggtggtatccaagtaggactcggagacatcggaccctgcacgatacagtgacgacccagtcctatacgagtaggaatcttttcattggtggactccgtgatgaatttccttagcgtatacagagaacgtctgtacacgcgcagatgtaccatattgccgtatagcgtacatccaagggtagagggtataccttattcgtaaccctaacaaatacatctccggtctctgcccatgggtacacaaccaacaaatcttagaaatattggtcgcagtccaaattaaacatgagaataatagtaatatggagcattttaaatataccctcagaaatggaacagatgtcttaagttggcactaaaatatgaataaaattttgttacacaaaaacattaatatgcatgtgagatattccaatccaattaatcaggtcttacacaacaattttgaggaaatgaaattttcatttttatcaatgaaaattcagtactatataactaaattagcatttcttctgtgtaaccaaagaactattagtgtaccattgcgcacaaagttcactatatgtatttgtccgcaaaatagatccggagccaggagcctcgcgagtcacgagtcacggcctacttctgaattctgatcaaaccacaaaagaaatgaacgcacgatcaataattaacaaccgtttctccatgcaaggatcgatgcaaatggatctacacataattaaactaaggttttcggtcaacctcaaatctcacgctgcataagaaaatcccaaatagctagctagcgaccacggttagcggagagtacattcatcttgctagcaggttcagtcgatgactaaattaagctagcatgctactgttcatgtggccaatttgcatggagctgaaagctgcctttgtttaatgtgacatccacatgtaaaatattacactccttttcgaatgtcggcatccactcgttttttatggtcccagttagttcttttctgcaacgagcacacaacgaatgccatctcggacgtgtgtgtgcacaagatatataaaccaatgtatgtacgtataaagtggtagccagaagttttaataaagaaaaaaaatcgatgttattgtcatagtgtaacttgaggtatatatgtaatctacgtcaaccatatatatataggccatactaggctcgtctttccgtctaggtggactataaagtggtggggaatggtggagaggatatggaaagaaataataatatataaatagcgtaaatcaaatatctgcgaatcaatta

SEQ ID NO: 74181 - DNA, 5867 bp, Oryza sativa
taccaagtggtctttaccaatgtgggggtatctacaaaatgagcagcataaacaaaagtatgtgaaatgctcagtgtcatgtgatcattgagaaaataaagcagataataactggtctgccacggcaagggacagttgtatgtgtttgttcatctgttatgctcaaattatatcctaacacattaacaaactagcagcagtttaagaaacataaagcttcatcagttcaatatttgtcccaaaaatacgaaaacgttgtatgttcaccttctatgttatacaatgcaacctttgcagaatacaggtttgagaacataaagtttaatcaactctaggtaagttacacaaacactgaaaaacatactagtattctttctgttcactcccattgtgaaatgttatatatgtaataccattacaaaaaatctgacgtttcagaaatagtatgattcatcagctctagaatctagactagcacaccagggaagagtgatgaagtatgaactccacaggagaagacaaatggatacaataccagatatttttcaattgtttcccaattttactctaagaaactgagaagcatctccagttcactacaggcataatattatttttatgtgctccgagcagaatgaacctctagtttcttgcgtcataaaaatccttaattaacaataattaatataatagcacaaaactggtctggaaattttcactttgaattccagacctcaacatcctgatgatctttcagaaccaacattggaatgaacggataaatagttacctctcaactaactttaggtatcccaaagggagtgatatgccatcatcattttcttcaccgctatgaaaaccacctcgtgaataccaagcatgatatcttctaggtagcagctgatgttcaaggagctcattgcagagttctccaacagtccgcttaaatggaccatgtgataaaaaatgcatgatgagaaagtaaacttccctcatatcaacatcaacatcagcctcaggtggaacatctgttgctaccactggattgacagaattaaccttctcaagttcctgacttggaaaatccaggggcaccatactaatggaggccgcattaccagaaggttggtgttttctaagagccatgtatacagcaccaactgaagtgggaaataataacaaataagcatatacaagctttaattactgaacaattatgaaaatccacatgtcagaaaggagcttaacaaataaagaggtaatgaaaatgtaagaatatattgaaggacatgaaacatggagaaataagacttctaaatattacaccaataacatgttttagaccgatacagctgaattaacttttctagtgaagtaatatgattgaacttagttactagcaataggttcagatgcagccactcaacagatccaataagggttttagctttgagggatcatggtataacccaattataatgtttagttggggaccctgacgctcttttcctttttcgattagccttgcgttggtgatggatcaaaatctatctattccacgaagtgtggagttagatctgatggcacaatcatcctctagttcctcatcaagccatacacactattagttctctcatcactaaaaccctaagttccagagcatcagaaaaccaagcagatacaacattcaaaccaggcaatcatgtatatcatccaccaaagccccaacgactacgaacccaccaaggtcatatccaaaactatgacagcgaacaccccccccccctatacacacacacacacacacaaagtcctcaaccctagccgtagtacccgccaaattcgtcgcaattctctgcaaatcggggttctagaacgtttccgacgaccgccacaaccggcatcaccacatcctccgcacacaaacgagcaacagagagcccttgtgggggaacaaaatcaaaataagccgacattacaacgaacctaatcaaatccgcgactaactgggcggattagggcacctcgagaaggaaggacacgatctcccgcagcgaaaaccacaccagcaacagcaatccaggcaagctacgttagggcatccgtaccagcgccagaggaggaatcagcccggatgcatcgcccgtccgtcctctcccccccacacgccggcccagcggagacgaggagggcggggtcccccgccgcctccgaggtcgccgcggcgtcggtgcccgcgcgcgcgcttcctcctcgggcggtggcgaagggaggtgggctcggcggcgacgggctcgcgcggggggttgggccaaggggaggagaggagagagagggacgagggagatgggagagaaggggggagggggtgcggtgcggaaggggatcccctctctgcgctcggactacagtgttttgtgttacgccggatgcggccctctccaccgtccgatcaagccccaccgcaacatcgaaggctaatagatgcggtgcttttattactgaaatttttacatttggaccctttcgagaaaatttcaggttttctaatggcttgttttagtacggcacaggactatgtcaaatatggtccaagctatatattgggacggagtaaatatgaagtaaactgatataaaatcaataataagtacataccatgtatgtcataatttacatgcttacataataatgggccgaatgagaaaaaataataatgggccgaatgagaaaaaagaatatgatggtatgtgggactaacatggaccgaattgatttcggtatttttacataaatggaataaagtttaaggtataaatatggtcttttaatccttacgaggtgttgcgtagaaataacgatagctattaaatgtaattgattatagggacatagtatttatttgtgtagaatagtggggccacttagaaaatagtggaatggcatgtgatccttaggagtatgcatattagtagttcatgtggtatagtgtttttaagactttataaatatattgaataatattttacaaaatataattttgacgagaataattgttgcatttaaaaaaatgcgagcttttttaaacatgttatgggcatgtttgaaagtgttgatggataatagatgaaactgagttcatggtgattattcgatggtcgaaatgaatgtattaaatattagaaagatgataggttgatttaaaaggatttttctaataaatgttgagagaaagtgtttgcaaaaaccacaccgtttaagattttgggaagtgtgcttgcggtaatatggtgaccataataataaaaaatagtcatatgccttgttggttagttgtaaaaaaaaaagaatcccatggtgctactattccaggttcctttggaagatgggattttgtaggattttcaaaggactaaaatcccatatgaactattcctgcatgctcctttggattgtaggattggactagcaaattttcctatggcaccattcctttcctccaccttttgaagtatttcaaacatgagctcaaaccacatgttttgatttcctttgggaagtcaaggcaccttttctcttcatctattctctcaactctaatctgataatatttctcctctaaaaaatcatgcaagtttcctatggtgtatccaaacaacatgtttgattaattcatttatttttcaattcctataagattgctcgtgtcatgacattcgattcctgcattttttcccattcctaagtatttattagtgatatactgtagatttatattgttgtatgattaagtaaccggtacaaatacatgccttaaaaagattcaagacaaatgttaagcactaaatttgggtaaatccaaatgatggattgctatacatgcaaaatggactaaaggcacattactaatgtcattttagatattgccatgatatgtaataaataataataaaataagaaagtttgactggagacttgttgaaaacaagaagtacttgtgacaaaaggaagtatttattggtataactaattgataccctacgatgtgttgtgcgatacgtggatgaatgcatgttatacataatataaatagtaaatgtatatgtttaaataatgcaaaaatgatgtggagataatgatttgacatcgtttgcatattgagttctaaaaatacaacaaaaatgtaaattatgtgtcatgtttgcatgatatttaaaatactcaagacaataattgctaatgggtgatgatgtggcacacttgtatgtgatttaaaatactcaagataataattactagtgaatgatgatataacacacttacatattgagctttagaagttagtggacaacaattttattgtaagatagaataactgataaatcataaaacccagtaaacatggaggggtgaattgagtgattaacaagtctctgaaataagctagaacaatatagcaaagaacaaaccaaggctacctttcgctgaagaaagtggataccagctagtaggtgaccaaatacaatatgattttcgtactacctccatggctccgtcccatataaattgtatttataggttgtttaacatatattaaggtttaagaaaaaaaatactatgatgtcccttattaaatggtgtataggtgagagtggaagagtagttgaggataaaatacggagaaatttaaataagaagtgattaatgggaccattagtactctattgtgataattattttaggacaaattcaaatcctaaaaatacaattattatgtgagagaggtagtagttttttttttaactacgcaagagagttgtgtgttatttgatcaagtggtggaaaataaagtacaaaaggtcaagatggaagtaagtttgcaagtccttttgcctcagccaagcacccaaggaagccttcacgagagatggatcgcaggactagaactagatagatgctaggtgttgtcccatttaaaacgcaaccaccccttcacccttgcacacgtagttcccatgtaacgagagtgacaagagtatgaaaaccctttctgagtttgtcaagtttgtctgggacttgcttagcagcgccacaccatcaggtagagaaatagcagtatccaggcgagatgtcaacaacacaaaaaccactcaactgataaatgctcccttcgtttcatattataaaactttctagcattactcacattcacatagatgttaatgaatttagacgcatatatatgtttagattcattaacatatatatgaatgtgggcaatgctagaaaatcttataatataaaacggaggaagtatcaattataggcattgacccccccaaaaaagtattgtgtttttcttaaccacattatccttaaatttagctagctcagactttgcataatccatagcaggtccttacagaaatgccagatgctacagcacctttcgttctcaacggcacattgtattcaggagtcatatttatgcaacttaggccaagttaatgtcacagaatgcctgaacttgtgagctccagaatactgaaaagaatgctttatacatgcatcagaccctacacgggtgttctgttcacaattcagagaatgtctaaaataatgcattctcactgtttctgaatttacacatggtagttgactaacagaaaaggagaaaaggaacaatctatagattctgtacaacttgccaagctatatttgggaagtgcgctcttgtgagatattctttctgtagattctgtataatttgccaaaggaattgcaagcgacaacgaatgaactccatattctggtcttcaccctggtcttgatgcaaactgctttgtagagcatgcgttgtcgataca

SEQ ID NO: 74182 - DNA, 6187 bp, Oryza sativa
  unsure (1)..(6187): unsure at all n locations
catcttggcaagaggtacaccggtctaacattgactataccattgtcacgttttgcgtgaactgcaagagaacgcattactgggcatcgctaggccactatcggtgccattatgtaggagtacaaggtaatcaatacactccctaatcaaaacaggattgcaatccagaacagcggtgacatctgtattaagctcgcagatactgtaccaattataactcgattactcaaacaacaaagcactggcacttcagtggaccacgtttggcaaggacgaaacgtggttttaaggcgaaaaaactcaggagctttgagaggggacagcagcggtcatgctcttttcccccaactaataaagcaccagaaatagtaaatggctagctgacaacgtacgccaagcatcattacaccaaacccccttcacaaatccatctttaaggccctcgtctgtgggccaattgtcgaaaatacgtcgtacggcgcgttagaaaagaatagtttataggttaaatttttctatatactagaaaaaaatgcccgtacgttacaacgggtgaagtcgattttaatcttattattgttatatgttttagttaaaatgaaattcactgtgagagttcgctttatatatttttagaaaatcatgagctatatttaggagtctaatcatctcaagttagcatgcaagttttttaaaacaaatttcttatatgatttcttctgtattaccaaaagtggacgattttaaaaaccgaatcaaatacggatacatatttttaaaagcaaacaaacttaaaaactgacgtatacacatatgacgtaccaaaataccgataaaaacatcttaaatttttataatagtagagatatgttcaatgaaaaaaattaaaataaactctaaaatttaaattttgacagcggttaattctatatagaggaaccaatgggagcctaagctcttttcagttactgtctgttggcttatgatgacacgctttttatactgtttgtaaaaaacttctctatatatatttttaaaatagtcttttaaagaaactataataattaagtatttaattaattataaactaatgatcttctcgtattgcgtaagacaaataagatttgaatacgctctaccgaacgcaacctaaaccggtaaggcacaaggcaattaagacctaatctcgcaacttgacgagacgagacaccaatttactaatactaacaaacagcaaatttctaattagcatcgcgtcgattgtccgatcattctcaggttccagtgcgcgaggtgactgacaagctagcttaactattcgttgagatttcaggaagaaaaagctgtcaaaagcttaataacaagacgtggcacctctaagctgttgattcccgaaaaggacaaagaaaacgaggagagcaacgtcgcaacatgccccggcccggcccggcccattatcagcaaggcccaaggcgacgcgaatctcgaagcccacaacatcgaagttgaccgttcaacagaaataccgaaaatacccctgactaaccaatcatattacgcgaatgaccctgcccgagccggccagccacttagacctggtcaccgccggcttgggctttaaactaacaccagtggcattgggtgtaaataaatcgaaatcggaggggtggggtgggtacccctgatgcgtcagcgttcaaaatatttcgaaatagctcggccgcctcgtcctcttcttctccttcctctctctctctcttctcccacacatctctcgctcagatccgagcgaggcgagaaatccatgaaaaatcgagggtaatctccgctcggtggcttcaaaaacttcgaatccttccccaatttcatcggctccgcagtttttttctcgaggtttttcggatctaaagcgcggctttgtccgcgcttgtaagccacgagagagagagattcttgtgccttcgagctcactccatccggccccaagaaagcttcccttcttccacccaccgccaccactgaggaggagagaaccctaactataacccctaatcctgccactaatcccagttcatggcctcctccctcacgccccgtagcccttacccggtaattttctctcttttgtggaaaagaaatcgcctattttgggggagggttgattcatgggagcttagttcttgcgatttgtggggtgtggttgttgttgttgttgttgcaaaagaaggagaacttgggcaacgcgcggcgggggatgggggtcaagcctggcccgcgccgcaatgtcctctcggcaatcaacaatggcggtggcacgaacagcgacacggcgtcggtggacggcggcgaggccggggctgggccggcggcgcctgtgatcgagttcaccgggagggaggatgtggagcggctgctcgccgagaagatgaaggggaagagcaagaccgactacaaggtgggttcttttgggggatttcttggcgttcgttctgtttgagaatttttggggggcgggtttcctgaatttggttggacctgtgcaggggagaactgagcagatgagtgagtacatcaagaagctgagagcttgcatccgctggtacattgagttggaggacggctacttggtcgagcaggagaagctccgtagtacgatggatgcagagaatgcccagcacgccaagttgggtaatgaattcgaatgcacttctcttttttttgtatttatttgatcacaccaagagaacaagatggtactcttttgggttttgagcattcatgtgtgctgtttggtcatcagagtaccatctcatcgtagtgactgagtttattctggtcatttatgttcttggggtactgtacttccagaggcccagcttagcagtgatctggaagagctgaaagctgcacacctgaacttgacgcggcagtgcgattcgttggaggaaagcttcaacaaggagaaggccgacaggatggttagaactcatctatcgcataataagctgcatagttatgtactgttgctgtgtgcctgtgtgattggtttcagccacggcttacacttgttgacctttaaactggcagcttgctgtggagtcctacgagaaggagaggcagcaaagggaatcggctgaggcgtccctcgacttgctgtcggtggacctggaaagagtcagccatgaagcaaaacggtttagtgagcaagtacgtgttcagaaatgttctattagtcttacatgaatttgagtcatatataatgtcctttctgatggatggaaattgtgaactagctgaaaatggtccaagacacgaacaaaagactgcaggagtacaacaccagcttgcagcaatacaacagtaatcttcaagctgatgcctctaagagtggggacatcatctcaaaactgcaaaaagagaagagtgccatgatggaaacaatggcttctctgaaagatttaaacaattcaatgaagaaccatttggattcttctagggtgagttgtgttttttcgtgaattgataatttttttgggcagtatagttcttgtttcacttaaacatttaattgttttgatttctgttagacttctcaacaagaggccattagaatgaaagaacaacttatgaaagaagtggattgccttagaattgagctacaccaaattagagaagaccgtgatcagtctgtttctcaagtaaataccttgagtgctgagcttgctaattacaaggaactagcaggcaagtctacaaaagactgtgaaagcttgagtgtaaaagtgtcagcctttgaggttagtggtttcagattaaccaaatcaatactttctgtgcgcaactatttggctcaccattatgcttctgctcaggaaacatgtagtatgcaacaagaacagattcaaactttgcagaaacaacttgcagttgcaacaaataaactgaaggttagaaataatattttgtcagtgctgatttacatgtgagatatgattatatgacatttgatctaattgtttacttttgcagcttgctgatgttactgcaattgaggcgatgacaggatatgaagaacaaaaggtgataataaaagatctggaagaacgtttggcatccgcagaatttcaaattgttgaagctgacaagctacgaaagaaactgcacaatacaatattggtaattgtttcagcatactagcacttcttactaaaaacaatttctctattttactgacagaagaaatttttgagtaaatactgaaattttttcatcttgctattgctacttgttactgattagcctttctatttgcaggagcttaaaggaaacatcagagtgttttgtagggtccgaccacttttgcaagacaacgattctagtggtgcagaagaagcccttatttcatatccaacatcagttgaatctgccgggcgtggtattgatttgatgaaccaaggtaaaatcatattcattgttgaagctaaacagaaactatgtttcccccactaagttttcagtggtaaagttaatcggagacttcattttattgttttgtgttgatgtaagtcagagattttccttctcatatgacaaagttttcgatcacggtgcttcacaagaagatgtgtttgtggaaatgtcacaactagttcaaagtgcacttgatgggtacaaggtatgaatatttcactacaacaatgaagtattggtgaataatctgttcatgaggttcctgtctctaataactcaaatatcctaactttattttttttatttcaagaacaaatgaaagttgttttaattgatatggtggcaccccaaaatttatctcttcagcaccaccacataagcacaaatacatgctaaaagccgtgaacatcttacattgatgtttctagtatatatcacctgcatcctgcatttgtataatcaccattattttgaaactctgactgatgtttctagtttaattcagttttgaagtacttggcaaattggtatgcttaagtatttnntgcatgatgcaggtntgcatatntgcttatggtcaacaagggtctggtaaacttatacaaatgatgggtccacaagggcgtgatcagaaaggcatcatacctcgttctttggagcaaatttttaagacaagtcagtctcttgaatctcaaggatggaagtacagtatgcaggttagtatccatagtgcaatgcagattctgaagtgtacattctatgtagtgttgctgagagtttttcctatgtgcaggcatcaatgttggaaatatacaatgagacaattcgtgatttgttagcacctggtcggtctaataactttgatctgtctaccagtaaacaatacaccataaagcatgatccacaagggaacacaaccgtcactgaccttactgttgctgatgtttttagtagcgccgacgtaacttctcttctagcgaaagcatcccaaagcaggtaaatacgctttattcatttttaatcattcacttgtgccttgtaactgtttgctctaagggtattgaccattatcagtttaatgttatatttgaaatagcaatgctttggatatgtctagatgattctctcatctatcactcaaatatattagagagagcagaaacataagagggtttaccttttatacaagctagcacttattatctgaattcacatgtgtctgttagccacctagtctacatatcaacagtgagtctaaattttttttcaccacattgaaccaggtctgtgggtaggacccaaatgaatgaacaatcttcccggagccattttgttttcacactgaagatatctggatcaaatgaggtactcgcttcacccatattttagaatattaatcacagtgctgaaactttacaaactggtcacaatattttttttttcattttcatgctaactaaacagaaccactgaaacttgagcaaatgtatgtcactaattttcttttgatcttaatgcagaacactgggcaacaagtccaaggtgtccttaacttgattgatttagctggcagtgaacgccttgctaaaagtggctccacgggtgatcgtttgaaggaaactcaggtgagtgtgttcatcacaaatttacaatattcttatttgataatcacattgtcttatctgtttgttttctttatgtttcaggcaatcaataa

SEQ ID NO: 74183 - DNA, 1999 bp, Oryza sativa
ttatttggttctttctcatgtaatatagatctgcaaattgtatgtgcaatttgagcactctctttcatgacatctccaagctggcctgtcaccacaagtgcaccttttttttgccgtcctcaacttttgctgtctcaatatacaaggtagaaccacccatagcattccaagctaaacccatgactaccccaacaggagtttgatcgtatatacgctctggttggaatacagccttcccaacaaagttatccagatttgatgcatcaacaactactttctccacagtcttgtctacaagtgcttcatctacaagtgcttccattacttcctctgtgtgttcattggccttcagaaatagcaaacaacagtttattagaactaagccctaagaaacaaagaaacataagtctatgaatttatgctaactaagatatattcatttcaaacttgaaatatccttggtaacaaagtttgtccagggtttagtttacttgacatctttcaaaaactaacaaaaagtcagcaccataaaaaccagcagaaattgtgctatcagcctatgaatcttccttttcttacaggaattatatcataattttaacacaaaaacttgaccatgagaaatgcctaggggtcttccggctagctccataaggtggtgggctagccgacctgggttcgaagcctcaccccttctaattatttgatattaggtcattccctaatattcgtgttttttttaacacaaaaacttgaccacgcaccaatagtaatagtgtcatgaaagatcaattccttctttttctgacttaaagcatcactttcatttaacctgtcacttgcctgtctgatagcaagtttgacttcagtcagtattcagtgcacaacgttgtaacactcaaaaaattcatgggcggccagaggtcagcctggccactgcacatttgtaatagcttctcacgcatttaatatagagacttggggagatttgacatacaagatagttagattacctccattttgcctgatgtattcgttggtgtagctttgtcatctgcagaagtttctttagatactccttttggatgctcatagtggtctacttctgacttggttgttaaggatactacattaatcttctcacaagaaatatcagttggaataacatgcactgaaacatcttctgcaagactgtccctctggctcttgttttccacttctgttgcaatgctaacaccagtaggttgttcacttggttccaccaatgtgatctcccgagctggctcatttgataccccttgacgaacaagttgcagagctatctgcaccagaggcaaaggttgaacagcaaaagctgatcacaagtctatcatggatgaatggatccatatgaacaattctgatcattggtagaataaatgctgcgagataatggaatgcattatttgataaatatgagtcttccaaaagctattttcttgccattttgggggtcttccagaatattaaaatataataaattgcttgccacactaccacattagaaacaacgcctcagtaaaaaacagcagcagtgattgtggagggttagcatggcaggcaagcggtgcttgacaggattggaacagagtgcagaggtaatactggtgtgcacagggaaggcaatagcaagtgcagggcatatggagtgtggaccgaagggtggggagaacaatgggatgcaagaaaggaccagtttgtgcccttatgctgtagaaggacaggacacatcactcaacactcaccgatatgctgttgttagtaaatataatagaccccagtgggagatgataccttaagaaataagaatagaatctacctgcttatcagtcatagacttgtatatactatcaaggtatcaactactggtgagttgcaggtctgtcaagagacttgagacagacaaatagcccccgttcttctccacactaaacattagctacaaatgtcaatattgttt

SEQ ID NO: 74184 - DNA, 5241 bp, Oryza sativa
atgtgtccagatttaggaagcgtatcctatgcacacaggccctcgcgtgtacacaccgtgtacatcaactaaaaattatcacaaaaaattctaggaaaattcatacatgtactttcaacagtattacatctacgtgcaaagtcacatcttcaaattcattctacatagagaataacaaaaaagataaaattctgacaaaattataaccttaaaactgtcagatttttttgttttttttgttacggctaaaatataatgaatttgacgttaatattttaaccctaggtgtaatacaattgaaagtatgtgtatgattttttctatattttttggtgacattttttagttggtgtgcacgtgtgtacacgtgagggcctgtgtgcataggatatgttgccccagatttatagctaaaagttgttatatttttggacgggtagtgagaactcatgtgaataagcacatcagttttttttctgttgtacatcttatcgaagtacctaaatgctcaattctctaatggtcgatataggtggtggggttttgttggcttaatacttacaaaagtggtcatttattatttgtcactataacctttccactacaatcaaaaaagacacctggatatattattgtaccaataaattttgcgcctgattttttttctatgtatgtcattttcactgatcgagtccacacatgcaacgaaattggcaagtgcaccgtgcaatgcgcaggtgttgccgagacatgaaaggaggaaaaaaagagagggagaaggtgacaagagagggaaaaggaggcgcctgccagcgttgcggctgtactggccggattctgttgggtgcgccaccgaccggtgcagaatccggacgcaagtatagtccagtccaacccatcaaatcaaacaaaatcgactaatcaaatcgatttgacatgacgcatccttaagaaaagctacttcagctaaaggcccttatcacaactgggagtaacagtagcaagtactcgtactctgccttttcctttccttgatgaaagaaagaattgattgcctctgtaattaggtgtaattaacaccttctctacgtcgttagtgcacggtttggttgatttgactgggcactaaggactggacttatttttatcatctttccgacagaaattctttggcaatgaattgtcctttgcaaaaatgtcactccagtgtttgtactactaccactacttttcccataaaactgtacaagtaaataagcttgtccatgtacgagccgagtacgagccatcttgactgaaacccggttttgcagacctgtgctgagtatcacccggttttgcaaaaaaaatcagggtttagttcccttcaaacttttaaaaatttcgtcatatcaaatatttggacacatgcattgagtattaaatgtggacgaaaaaaagcaattgcatagtttgcatgtaaattgtgagatgaatcttttaagcctaattacaccatgatttgacaatgtgatgctaccgtaaacatttgctaatgacggattaattaggcttaataaatttgtctcgcagtttacaggcggaatctgtaatttgttttattattagtctacgtttaatacttcacatgtgtgtttatatactttaaaaaaaaattggcacacgaagtaaacacgccgtagatactcgttgcagatcaacttggatgtataatatagtagtagtagtagggagtatatcactgtgaataaaaaaaaattactactcctatgtgagttttctggacagccagcgatcacgtgagccactgagccagccggacccgtacacattcagagacagagggcccaatgcagcagccagccagcagcagcagtagggggagtactacgtagcaataaccatctcgatcatgtggcaaggacagggtgttggggattttaatgctgagtttttcattccactggaatgtcccttgtctggccggagaggagagagagagaaacaacaacaccacatgatgatacagaagggggaaacaaacacccaaccatagcagcgtagtagcatgcatgcatgctgcagcagcggcaaagcgagatcctgatcgagttgtttattaatctcctcgtttaattagctgtagagctacacgcattaatgccacctatgccatcgaggagcaaactgatgagcaagtgcatctctctgttccagtgatcgatcggccatatgcatgtgtgtgtgggatgaaaaggccacgtctctttcggcaaagcaattaaaggctgcccccggaggaggccaaaagttgtaagagatcacaccacagggacagcactgcacacatgcattggcaggcaaggcagggagggagggagagtgtgtgcgcgcgcgagagagatttattggtcgtgtgtgcacagagttggtgtgttccacggatctcgcgcggcgggacgggacggcaacggaacggagaagggggctctcgctagctcttgcttgttggcttcttatgcacagccaaaattttaaaaaaaatttgcgggaaaacaaataattttacaattaaagcttgattttatatttgattttgggttctgtcatcgtagtctatttttaagacttgttattaatttaaacggtaaacaatactcactccgtcccataacattctcttagctaagactataacttataggttgtttttttggatggatggagtacatacataacattcttacctataaattatattttttttatcttgtttattttttttcacgccttatcagatgcatctcaattgatccgaacaaacaaagctagagaactaatcgctttatttttttttctatacttctggtcatgaaaacatgttatgcggtactgatagtgtacataattttttttaaaaaaatactaagtacttgtggctgagaaaaatctgtggtgaaagaagtttttttttctttattcctttagggtgtacagtagaagtgagtcaagtgacatccattttgtaactttgatggagtgtgtattactctctgaaatggatgaagtggtacatttcgcatgcattacatgtcctttcaatataattgcctctttaactatgacaaatcaatctatcttcagttaagacatccaactatgtactccatactgtacatgtcatttccaaactctgttcatgtctagcaggttcaaaacttcaccacatgtgtgggctcggcatgattgggtagctggttaattgctcttagctatagttatgatcatgtctcaccaccagacttcttgaaccatcgtacaacattataaattggccttttcattctcatatagggctgaattatgtttttagcattcttccctttgagatgtactacggcttacccatagcagccatgaaattgagcactccaactaagcagaagaactagggaaatctctctctctctctctctctctctctctctctcaaaaaaaaaagaataagaagaataaaaactagggaaatactccctccgtttcagtttataaaacaactttggtcaaagtcaaactgtttcaagtttaaataagtttatagacaaatatagtaatgtttataatactaaattagtttcatcaaatcaataattgaatatatttttagaataaatttgtctttggttcaaaatgttactacctttttctataaatttggtcaaacttaaaacagtttgactttgactaaagttaaaacgtcttataacctgaaacggaggaagtacaagtttacactatcctgtatgtagatgtgccaatgaggggtgtttccttctatcttttttgaacaaatctatgggcaccatctcggtccctcgacccgttatgtttttggcatcaaatgaactaaaaatagcttgatcttatttccatgcaatggatcaaacttggggcaagtttggacaatgacgccacataaaaccctcttttagcaaggtggggctacaaataaaacacaccatcaatctataaacaagtatctcaggggaaaggtctcacatttgaaactaatattgcaactctcgactttccaaaaaggaaaatcattaaccattggcatatacccttgaaaaagctccagttgccatcttacttgcctatgcaactgcccaactacaagaattatagtacaagcactctctaagaataccacaagttagcttctgaagagcatagatattcatgtcatgacaaacatgtctactgtacaacaaaaaagaaaaatcggctaagtagatcactccacaattgtgcgagtagatactagcggttacatatacacgaacgtatatataaacatagttaaaattgctatatattaccataaagctatcgagatgcgcttaattccttatccatggagactagggtgtgtgcctccggtttttattttttttcccaaaggcacgtacacgtgtgtgtgttcgagtttcatcgcgattcgatcgttgtctactgttttttaataatacaacagatgtcctaatcatccacgcatgcataacccacaatcccccagcatcatccatcccttcccaattcccaaatcaccacctctcttcatcacttgggctccagcctcctgcagccccagccaagctaaggtaagctccatctgcttctgatacacacactcacacacaaagcagcagccagcatcagcagcagcagtgtgaagcaaaaatctctatctctctctctcctcactaaagcacaaatcctactcttatcatcctgtcttcttgcctcccttctgcctcctgctcaccaagcttcccacacaaacccaacaagagagtgagagaggagcaaaagctttggctggccgtcccccctgttaaaatgtgatgtccaatccatgggattgcgtctagtttagtcccccactcctctcctgggtcagtccctccctggccaccacctcttcttcttgcagcctcctcctcctccggggccttcttcttgttgattcttttgatggtttttgtgtttcttgtcgacctagttatgggatccggcgaggtggatggacgcgcattggagcagcaacagtagcggcggggaagaaggcggcgggggatctggatccgaggcaccaccaccaccgggtcacccacggcggcgacggcggcggcgtaggaggaggaggaagcggggacaggaggaggcagatgagcagca

SEQ ID NO: 74185 - DNA, 1292 bp, Oryza sativa
ttcaatttttctcagactattatgcccctgagactctttcttctcctcggttcaatctagcgagcgtgagaaggtgagaagagaatcggcagcgacaccggcgcccgccaccaccactgagccaccgttacctcagctccagccgccgcgccgaggtcctccccagctgtgccgatcgtcctagtccgcccaattgtgccgcctcctcgatgacatacaccatgagtccatgacatacaacctcaattcatgagttcatatatataacttgcaagcggtttaattttcatttaatttcgcatcaagcagagctgccgacttgtttaattttgtatgagcaagttcgttcgctttggttaacccaaacgaactttaaaaagaagttgcaaaatgtttttcgaacatacaagaagatactactagaatagaagtcgctttgtgcttgaaaattatacacagttgttgatttcagaatgtaaaatcggcacatcattgacacaaaatgtgaacaaaaatatttaccaggcaccagaggaaattacacaggaggcaaaaaaaccactatgaattcagagaagagaagaaaaaaaaatgaaagctaagctcaggggtcctcagtgatgcacgagaggtgcggctgccacggcgaggcatggctcccggtgctcatgcgccgccggtgttggtggtggtgttgcttctgcaccctcatcatccttgtcgtctccggcgacgcgctgcactggctgcccaaccaatcggcgacggcggcgttgccctccgacttgctgcggacgtggtgcccgtggccggcggcgccgccggtgctcgtccttctcttggcgtcggggacggaggcggccgggatgaggaagtagatctcgccgcactccagcttcgactccggcgacacgatgtgtatccggcccatcgccccctgctgcgacgagcactgccggctaagcacgtggttggggtgcgccgccagcacctcaccggcggacacagcacggccgtacgcgtcgatgcggccggctcggtgcctagggtttcgctgaggataggcggcggctggggaggagactcaccggggagaggcggcggcgcagctgttggggggcgggaccggtgaggcacgccgcggcggcgatgcagtggtggtgggcggcgccggtgtcgctgccgcttctcttctcgacttctcgcgttcggtcgctagattgaaacgaagagaagaaagagtccgactgaatcagttgactcaggggcataatagtccaagaaaaattgaa

SEQ ID NO: 74186 - DNA, 3595 bp, Oryza sativa
tgggctacgaccgcccgagcaaggcggggactggctcatcaagaacgccaaggacgccatcgacaagctcgacgtgctgccggcgtggcagcccactgccggcggcgcaggcgcgggcaatgccgccgcgccgccgtcctcctcgacccaccccgactccgccgagaactccgacgaccaggcgcaggccatcaccgtcgcgcacaccgccttcgacttcgccggcgggggcagcggcgggaccagcttcctcccgccgtcgctcgactcggacgccatagccgacacgatcaagtccttcttccccatgggtggcaccgcaggcggggaggcatcgtcgtccaccacggcggcgcagtcgtcggccatgggtttccagagctacacgcctgacctcctgtcccgcaccggcagccagagccaggagctccggctgtcgctgcagtccttaccagaccccatgttccaccaccagcaacatcgccatggcggcggcggcggcggcggcaatggcaccacgcagcaggcgctcttctccggcgccgccaattactcgttcggcggcggagccatgtgggccaccgagcagcaggcgcagaaccagcgcatgctgccgtggaacgtgcccgaccccggcggcggcggcggcgccgcctacctgttcaacgtgtcgcagcaagcggcgcatatgcaggcggcggctgcggcgctgggtggccaccagagccagttcttcttccagaggggaccccttcagtccagtaaccagccctccgagcgaggatggccggagaccgtcgaagccgacaaccagatgagccaccaccaaggagggctgagcccctccgtgtcggcggccatcggttttgccgctcccggcatcggcttctccggcttccgcctccccgcgaggatacagggcgacgaggagcacaacggcggcggcggcgtcaatgacaacatgccgacatcgccgtcgtctgtctcctcggcttctcaccactgaccgcagcagtggcgagcagatgacttcaccaccaccaatccaccatgagcaaacaccacaccatgtaccagactatcagctagctcctccacttccatcacggtgagaaaaaaaaaccgagaattctcatggctaacctgcattagttcagaatttttctcgtgttagttagctgatcaatcttgtgctgctggttttggtgttcttgacatgcaggaattgtcgattgcattcgggaggagcaaagtttggaggtagcacaagtgcactactactgatgctactacatatcggttggttggttggttggttttccatcgatctcttctgctgctgcgcatgtcattggtttttgtttcaagaattcactcggagcttcttagaattaggcttgtgagaatgcagcaacacgatggcaagctttagcttagcttagcaagcctctgtgtctgttggctgttgcgttgcgctaggtgtagttgatcgatgtaggttcgagcttgctttgctttgttttgatttttactcttttgttgctgatgcatggacatgcttttgcttcctcctgtgggttcaggagcagttgctactagaccgatgttgttctcaaaactgataagtgggatggtgatggattgggagaggagcctatctttcatcttttccaaaacttgtggcctcttttctttatactgtagtgtaggctggaaacagatggtgcatgcatgcctgtgcaacaaatctcccccgccctaagtgtttttctttatgcaatccaagtatctccagccatccttattatatcttgggctttcttcttttttcaaagccttgtttggaactgagaaaaagagccgcatgacaatgcttgctggccctcatatataccttcctcaaaacaaccaaaaggtttggatttaatgcatgctttaagctttgaaaagaattgcctcactcacctccccccatggccgcacacaccctcacacacacacaactgcaatttcccctctcccctatatccatgtgattggttgggtctctttccctgcttctgcatcagcagcagcaggcagccacagctttcctttgcaccgtgccatgctgccatctatcccacctatcatcactgggcatggcaagaatgccacaaggaaaaggttttatgtgtgtgtgacattagtatcctgtctgtcttacatgctcttgcattgccaccagcggcacagtacaagccttttttaaccattttacctcaggctcttcaggccttggcctgctgcctgcactcactgatgcagcactctgtgacagatgccagagaagagagagagagagagagagagagagagagagagagagagagagagagagatgaggggtcggccatgattgctcacttctgctctcttctctgattggcttccacatggacactaccttagcttgtgtactgtaagtctgtaactttaaggctgggtaattagttgtggccttgtgggggaggggaagatgagcttaggcatgcatataccatgatttgagcagctagctaaccctctctcctatatatccctcttctatggggtcgccattaatgactgctttgcttgtaagatggaaatcatggaatgaggcaatgagcaatgataggactaacactgtgtacacccactatactcctaccataggagtacgttgtacaagtggttatcacaagcatgcatgctgccatactttacaggctttaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttatctcgtgaattagcttttatttatgtaattagttttataagtagtctatatttaatactctaaattaatgtctaaagacagggactaaagttaagtccctggatctaaacaccaccttagtctggcctcctttatttgctactccctacttgtcatgactcatgccatgcatgtggaagatatttttggtgtggatatcagaattactacatgcaaatttaacaacacgtagtagtattaagcacttaatgtgttcttttagctgaaagtgtggaagaacatatataatactaggatttgtagtagcagtatggtaaaggcaaggcttaactttttttagtttgggattgttaaggtttatatctagaagagtgtatacttggagagctcttctaaagcatgtcaatatcttgctttattcttgtgctagatttattaaccatggtttttcatttttatttgaaacttcaattttttgcaagtactctaaactttgaattccaatatgtggtgcaacaatgggattgttggttatttatgaaaattggtgtcgttataattgttgccaggaaaaaaaacgaaagtatatatatggagagttttttttaagacttatataga

SEQ ID NO: 74187 - DNA, 768 bp, Oryza sativa
ttcctgcagccctgttgaaaccggtgcaatttgactccctcagcggttttggagggcagttttgctgatgtggcactgccatgtcgatgttgaactagtcttcgtctcacgtggcgtttaagtggcattcaaattaaaaaatattatatgtgggacatgtctgtcattcacacacagaaatatattatgggggccatatgtcatcctctctctctttctcttcttttcaccggtctgcaggggcgagagctagacaagcggcggcggcggacaagcggcggcggcaggcaagtgacactagggcggcggcggtcgagggagtggtcggcagcggggccagatcttcctcctccctctctctccctcatccctttctccctagtttgtgtggtcggctggaatggtcggcggcggcgggatgacgacgggacggccggcggctgacgcctccgccatgccgcgcagcagccggccagccttgtcgcggcgcaccgacaagaacgccctcgccacgcacggcgacgacaccaccacgacgccgcaggcgcccatcttgaggtacacatgacaggcccgtacttgcgcactagcgacgcctggtcggcgtgcggggccaggccgacgagcggcagcgcgccgaggacggggacgcccggggtcccgggggaggcggcggccgccgccggggaagggcgggcggtaggagcggagggagaggtggaggaggaggcagaggaaggcggcggagagcacgacgaggcggggcgg

SEQ ID NO: 74188 - DNA, 6162 bp, Oryza sativa
agagatgacgacccccagaaggctgctgaactagccgggccaacatacttcgcaatcgatgattgcccggaaaagtacgaacatgggaaagcattcttgccggaatgggcactgaaagaaggaccatgggagatgacaaggttacataccttctacatggaggccagcaagaaaggcttgggcaatataacagctcgatcaccggcagattgtttcgacgaagaaggttacgtatggctagatttctcagatctccacgccatatatcgtcgggataagatggacgtcaactacgtcggtgtttggtgcatgtgagtatgagttttaattaattagatgaaaaatatgtataatacaaatccatgtgattgttactaacaaacttcttctgtagaatgcaatacatggatgctaagaagaaaaaagaacacatcggcttcttggatccaactcggatctgccaaacacagcatacgatgaggctagcaccagggtctgaccagctgaagagcaagaatccaaaagagatagcagaatacaagaagggcttgcacaaggagaaattgattactgtcgcacagtacattggacgagccttcttgcactttcaaaataagagagtcgtcatggccgcttataattttaagtaagtctagtacatttatcttgtatacatatgtcttattttagctggtactaactaactatactgttgttaatatgtagcgatcattatatctgtttactcatccaccctaaagacggaaccgtggtagtcttggaccctctcgattacagtcacaagcaatataaagaatttctaataattttacagtagtaagtgattatgacttttgcatttgtatatgaatgtattataaataaatatcctccttactgtgaaacggtacgacatccatacagtgcataccaatactataagttcaagggtggagaacagacccgaataagggagaagctgctagtacgtacctattggccggtaatactccactcacttaatgtattccaattgattcactaattgcaaattttaactacttttttctatgatatgtcctgaagtgtcacaagcaaccgcgaggaacggtcctttgcggatattatgcgtgtgaattccttagggttaatggacggtacaggactaacgcggaggatgtaagtctctatactatgtactagacagcttcacatatttatgatactaatatattgattaacttcaatgcatgcagttgccaagattagaatgtcgaacaagctttgacgatacaggtatcccaaatgtccagcgtgatctgtgtcacttcatccaccatgagtgctgtcatgtgaaagaagatttcttcgacccagagggtgtcccagcgacaagtgacgaattcaaggatcttcgggagtggaacactgctatgccataatgtaactagataacgttatttgaagtgacaatgtaaaaaaatattgtaatatatatattttggcaatacttttgatttatgcaatatatatatatatttctcagtaccaaatgcttgataatcttccaatatatgtacataataatctacctgcaaaaatttctattaaataatttaaaagtaatttacgggcaaattattattaaatttcaatattttctacctatctttgcaggcggaagtttttttttcaggcggccgattcctattttcgtaggcggaccggactagccaatgtccgcctgtgaaaattatcttcacaggcggacggccgcccagcgatcttcacagtcgttggcttacaggcagacggtcgccccgcctgcgaagacccttttcgaccgcttgcgataatgcttttcctagtagtgtactctatgctcatcatttaatcctgatcccaacattttatttttcatatttatccgtaccaaactcttgacgtcacttgcaacatgtaccgtacgtgcatgcaatgtacgtacacaccaaacgttttattcgttattactttgtttattattcagtcctgatcgatgagccgcgcagcatgtgtgcatgtaactcaacagtaaaggttgccacccgggtcaacgccgaattggcggcagtagtctttgtagtagtttacccttgcgttgacggcgccggggttcttgccgttgcactcgagcgcaccgttgatggcccggatggtggcgccgaacccctgcaacatcacctggtgcacgttgttcatccagaaccagagcgccgtcttgaaggagatcgtcgggtcctgcgccaccctgtccgggtccctcagcccgtcgaacccgatgttctgccccgcaggcccgtagttgtagttccacgagatctgcagcggcccgcgcccgtagtacttcttccccggctggcacggccactgcttgttgttcttgtcgcagtagtccatgctcgccccgtttatctcgttgatgtagcacatatctgcgagtgcattatcatttatcatcctcattagttacatgcatatatgtacaaataccaggagtatgtaattaaatattttccttacgtccggtctcatgagtgacgtgggcaaagaaggcagcgatctcacgcttggagtcatcgttggtgcggtccctggcgaagcccgagtaggagtgggcagcgttaagaaacgactgtcgtgtgtaaaagttcttgccggcgcaaccgttcggggcctggttcttgatcccattgaagaacgcctcggtgaccacgctctctacagacacgccgctgcctccgcctccgcctccaccacctccgcctcctcctcctccaccgccgccgccgccgtagcacgggccagagcggcacccatctccgcagtagtccttgcccgtgccgcagtacccccatttgctgcagcacatgttcgactggcagccgcagttctgcgcgctcgcctggccggtggcggagaggaggagcgctagcccaagagccaggaacgccagcattgtcggcgtcggtgagttcgccattataggatatggtgtgaaagaggtgatggttgattagatatcatgatcaccagcccggcttttataaaacgagcgccagcgtcttctctacatacgagacatccgtcgtgtacttgtggtgtacttgtgcgacttgccaaactaatcgagaattttagcatatcccaatacttgtggagtcctaggacactagcgtgcgcgctgcggttgctgcggcagaagggaaccgcgcgtgcgccgccataatggagagaggttgaaagtctgcgacccggtaccttcctatccggtggaattccacgcgaagccgcggtttaatgccactatccgctcgctgtatattggccatatgaatcacagtgtgtcagcaagctagcatgtgaagatttatggtggccttcgtattcaacaatcgactagaacgatcagtccagaaacaagacttccacgttcaattgacaaaaaaaaaccacaagaagacgtactacgtacgtgatcgttgagaggttggtttgcggcatacaacgttccaaacttggacgaactcatgaacgtcggaaaaccagaggaatgtctggggatctctgaaaagtttgaactctgaagttcattatggatcagctccgtgaatttgggccttgagctgtcacggcatgatagggcatatcgcctctcttacccgagtctgattcacacccctgaatcacaaaactagatatagaagctccctaaactattaaaactggcttatttttgctctccgcgggatggtttgaataggttttgtcctatatggtccttacatgatattatagtcaacgttttttttttctgacgtggcatgttaacttggttaacctgtattgacgtagtgctaaaaagaattaagagaagtttgtgggggcccatatgctagtaacatggaaaaaaaaggagatgacggtagcccacatgtcagagagtaggggtcggtgagctcgagatcgagagggctgaaacttgctatcgtccgaagataagagaaagtggtcgcaatgggaggccaccacgccagatagttgctgcccatccctctgccgccgaagtgttcgtgtttatcagccaaatctgtccaaactcatgcccgtcgtccgagctctgtagttccagaggagtgtggaaaatattgaatataggagcaaccgtaataatatgctctattccattgtattatactagaaaaaatattcgtgcgttgcaacggattaaaaacaatttcaattatatatagactgtggtggataaatagttgaatatggcatttgtttctgtttttctttatccactctaaaatgtatacgtattggttatgagccttattcctatcctctccacacggtcaacctttttacctcatctatctttagtcctctctacagatctacacacggagttgtacggcggcgagcggcagcgtgaatgcaaagcaactaaggttatgttcgggaggaggggccctcctatccagtacacaaaacgaagcatacattagcgcatgattaattaagtattagttaaaaaacttttaacataaattaatattattttgttaaaacaatttcctttcatattttttttaaaaaaataccgtttagctgtttgagcgtgcgcccgaaaaataagagagataaagttatgaacaatgaatcccgaacatcgaaccttgggttcgtaactaattcctcccgcacgaaaaacaatgtggctcattagcgcatgagtaattaagtattatcctaaaaacctgaaaaaatgtattatttcgatttttttaaaaaatatatagattctttttaaaaagcatcatttaataaaatgcattattacgatttttttcttaaaaaattctatagactttctaaaaaaatacagtgtttaattgatcggggaacgtgcgcggaaaaactgaacaacataagttttgagaaaggagagtgttgaacgcaggctacggaggccaggagtgtttgagaggggagagtgtttgagaggggaggaaaagagaagattgacaagatacgtaaaatgatgtgagtcattagcacatgattagttgagtattaactattttaaagttaaaaatggattaatataattttttaaagtaacttttctatagaaaaattttgcaaacaacacaccgtttaatagtttgggaagcgtgcgtgcgaaaaacgaggtgttttctccctcaattgtgtagatcgaacgcacccgtccaacaaaaaactggacgtttcaccgccccagcactgtaaaaaaaagtgtcattttagcaatttacaaagaagtggtggggccagtttattttggtggaaccagaacataccgagtttttttcccaaccgtgatggcgtctcgtggatggatgagccacacgcgtccggtctctctctcttcttatcgcttccttctcttctctccctctccatctccactgctctgaaatttttacaatttggtcctttttgaaaacttattttacaaatagacccctggaaaaacttaaaccggaaatggtcttttttggggcgccagagtgtctggcgccgtaccccaacatggcgacgccagccacactggcgccgtgcctgtgccaccgtggcactagggctgtcgtggaggtgctgactgggcagaaagggggcgccagccacactggcgccgcccctcataccacggcgccagcatagctggcgcgcccctcctctgtgggccgacccttaaaccccgtgggccccaccacctttctcctccccactcccattttcgccattcccagcccgagcagcgagctgctgttcttctccctctctctccccctcacctctccacctcaaatccactcaatttgaagccgtttttcgcgggattttttgtggaaatcgaagagaaaggtagactctttcattcccccctcttttttttcgtttttattggttgaatttgtagatcggtgggtaaccctagaacccactttttacccaaatttgtaatttttagcatttgttcttaggattggcttgttgtagtgctacatgtttgcaatgtactcattggtgtcatgatttttttaaccatatatgtggtaatgttaattt

SEQ ID NO: 74189 - DNA, 6019 bp, Oryza sativa
aaatcagttttcactctaaaattctcctagctccctccttgaataatcatgatatagtatgttatatgaacggtatttatattttttacttaattcagcgtgaaaagtagccataaaaatttacctcgaccatgagaggtgcataattcatcattgtagaatcactaacccattgtaatatttgatgatgaatatatggtattgatctttttggaatttactatatcaaaacaaataaacaattattttaatggtttccaaggctggttggtaaaggaatatgtattatattaatagtacatatgattcatccaaattcttacaatgaggaaagcattgtaggttgtagttatactaggattctaatggtgagagacaaatgcacaaaattgaaagacatcattgcaagaaagcacatgtagtgagtttgatcatcacactgccatgacatcaaacttcaatttcatatatattcttagatgtgcatagagcttggggttagtgttactttttgtgaaagcataacattaatttagttaagattcaagtaaaattcaaatgatgtgtttccatgattacacaatattcaagtacaatgttctatcacctggcttttgcacataaattgtggcttaaactgtacaaataggacactctacaatgaattctttttactcaaaagtctctctacagctagcatatcctgaactaggagtacctatctaaatctccttttaggcaacaattttgcataacctcaatcagtattcatagcaccaatttaacaagctagataaagcaaacatatcaaaaatcggttcaaataagtaaaacattaatacgattagtgtactctaacttatgaagaactaatttaggattatatatggtttccaaaaacggaaaatgaacttaagtaaaacagaaattttgtagtaacaagtatagatacaacagcagggacaaccattggtcgtgtgctatctattactatatattatccaaagatctactctctagaagtttataagttttgtgggcctaaaaattgccactttaatcaaagatgtaaaatagagaaagttatttgcctttaatcatggtcaatctagattataactatagattgactgatggttgtatagagaacatgtcgtcggttggatatctatctttcgtacatggcccaccaaagtttagatttctaaatttgaagtagtttttcaacaatataatttagtaatcttagcaatatatactatacgagatcttctttaatgcttgaaattaattaggacccttgatcagcaatgatctaatggatagagagagaaggtacatggaaaaaggtattaaaagggtatgccaggtatggaaggtggaagggtaaaatggtaattgtttttcattaaattatttttcggtaaagggcaaaagcgagagaagctacaaacgtttcagcaggaggaagaaaaaaacgagaggaagaataagaacgcgtgcaagaggaacctacatgaactacctgctgatcgtcgctgccgtaaaagcccgccgctcgcccaggccgcacacgcctgccgctcgagccggataccgctgtcgcacgcgcccgtaacgcccgccggtcgcagctgaggtacgcagcagcatgtcgccgtcaccgccgccgcacgaatcctcgggctgctatctactctgctagttccttgctcgttctttgtcgtcatgccttcatgcagccagcagttgtattccaggttctgaagatcgattttgccagcaaaaacaaatcaacaatgccctgtgctgcgcatccgatcccctgctggtttctgcgcctaatttggctatttgatcactacgtacatattctgaatatcgattgaggtgagccactcgccacctgcatgacatcgtggatggccgatttgttaggcactcgacggggtgggaattaagcaattactaagctatccatgttaataaaaatttttgttcctaaattagcctttaaagattaacggtggataacaattcgttaaggaggtacctggagtaccttccaagcacagtaaaagatctctacagcgtccaggcgagcgcggtttgccgttagcaagcatcaaaccgactatagcgctgccgtccggcgactgtagctgaagtgaacagctcctcagatccgggagcagctagctcccttcaaatctttttttcctctcatcacatataaaaggacgtacggtacgggccctcgagacatatgcagccagcctcgccaaccaggcttaactttcccaatccacagacagcgatcgacgatgccgctgccgccacatctcacagcatgcagctccgctagctcgccacccacctccgacacaatgatggccgccgcccatgcacgagaggcggctcgatcagcccatgttcccatcgatcgatcgatctcgccggccgcgcgcgcgcgtccgcggcatcggcagatcgggacgtggcgaggcacatgaggctataaatgcgcctccccctgcctgcctgcctgccgggcccgccctcgtacgctgcccacccgcgattttcgtacgacgaaccactggaagaaacgcgataaatgcgatgtttgctgccgtcgttcacccacccgtcgccctcgccggctgccggcagattgatctgcatgcccgggcgacgaacgcggctgccggccgcatatcgtgagcaagtactacttggacccctgcaacgccggcagcggtacgtacggccgcgcgcgaggtgcccaaacgcgccggcgcggcgtcgctgtcgatcgtgccggtggatacatgagctagcacctactagcagtgtggtaatccatcgatggatggcgacgggacgggacattggtattagcggacgaggctactgccgcaccggcgttagctacaggggactactgcatataccgatctcgcggacaggtagctagcatgcagggtcaggtcagtgctgtcttactccaagtcctcgtatgtgtgtgcagctagtagctactccatcggtcccaaaatataagtatttttagactctgacacgatctctgagatactgctttgaccaataatatctataaaagtaaaatgttttaaataaaaagagttacatattatgatagtttgtttaataataaatctagtaatataaattttacatgattgatcttttttatttttttactattaataggtaacgttaaaaatatttgacttgtcattatgctaaaaatgttacgcttgacatgatggtagtcctgtagggattcaggctgctgacagctgccatctcacaagtcacatgcgtcgacatgacatacatatatgcatatgcatgctgacaccacgactccgcaacaagcaaagcttgtctcatgttattcggttccacttgtagtactgtaccactgagcagtggcactgggggtatgtgtctagtaggtcaccaaggaaacaagagtcttaaaatgtgtatagtatctttccatcattatgtttgagtagttcaatttaagggactgtatataatggcagctttgctgaagaaaatgtgaattaaatccacggttgtagcagtgacagatggataaagctgtaaagaaacatagctcgaggcttacgagaagctcaaactcggatcatcctaggctcagttcaacctcggatcgagttttgaatgagctgaccccgaacctaactctaaggctccagggttgcgggctttgtcggatgagctcgaatatcttgcgagcccattgttgtgtgcaatttttattatttatgtgatgaatcagtacatcaagtataaattatattcctgctatgtagtacatattggcatcacatatttatctttgtacttcttctttgttagtgagattagttagaaatttatttttcataaaaatatattttttaaatgtgtgttgtaatatttgcatgccgagctcaagtccacaataaagttgagcctacttataagctgggaagtggactaggtttagctcgaggggctcaagcttgtattgagcttaaggctagacaactagggtcgctcgagcttagcttgtttactgcccttattaaggaggcactagatgagccatatctcatacccctcaagtaaaaacacgcctaaaggtggactcaacactagaataatgcttaggacaaccaactaattttggcccacatcatatttaatatggtaaattttaatataagtcaaacaccttacgacgacgcaggttctgcactcactgcgtccctccccacccactcctagctacctcccccatgaatcccatcgacatatgccactacccctaccctcaaagaaacaaacgagtcttgtcgcccgatgagccctcttgcacaaatctacccacttccctagcaacgtaaccatcaatcaccttctaattatcgtcgctacttatggttgcccctatccgcaggtacatatgtgccctagacatccttctaaaatccacataaacatttgtcttcccctcttttatactaaaccctaacctgatgatctcactagagttgaaaagatgtcatccaagagtttggagcacacaaaccgccaacacacatgtggtaaatttgattgattttttttgtaaaaaaatagtcgatggtctttttaactcacgctgcaataatcgacttgttgacagatcatgctaggcgctgggtagagcagaaaggtgccatatcttggggggaaaaatagtacacgttagttctttaatttgcttctgcttccacaccacgatcacctgtgcaaaaagaagttggatgccattctttcgctttaagatgttatcgacctacctacatatatgttcactttatcacacaaattgtgtccaactttttctccgagaggacatacgtacataactaacaaagctaacaaagtgcagctccacttaatccgaagaatcctgcaaaaagaaatgggctgaaatgtgctccctgtccccttaaagaagcgagccggaatctaccatttgacactttggtaaaaaccccctcatttcatcagatctacaggcaaagctcaacctgtagggttacatagggcaatggggtccaagctttttttggcatctatgcttccatgcatccgactggtagatggtcccccgtagtacgttctctccgtcgatcgccgtagtgccaaatcatatcaatcatgcgcggcttcatctcaacaagaacatggttccctcctagtagctagcagctgcttgcattgcatgcaggtaggtacagtttagcacggctttcagttgacagcaagatgcatattttcgtgtagccgggggacctctcgaatcgctgtcatgcatgtcacaggggagcaacgggacgacgacgccttaactctcgcgacgacgaaagtatcacgataccagcacagtttacagggccggccggggggcgtcgtcgcagctggctggtggctgcgcatcaacggacaacgggatcagagtaaaagacgtgcagagcgcagttgaaagggagagagaagctataggtgggaaaactcgattcgtcccttaaggatatccctcattttttcatgtcacttaaaaagttactaaaaaattgaaaaaaaattagtagcatagatcagtatatgatatgtcacttcacaaacatacaaattcaaattcaacttatacacgtagaaataaaaataacaaatttaactatgaatataacgcataattcacggtcaaatttattttttttgaattgtattagtcgaattttaactcgcatgtttgcaaaaatatatattatatattgatcaatcttgacaaatatttttgaattttttgataactttttaaatgacatgtataaaacgagtggatgtcctctcgaggggacaaaaatccacttccctataggtgagtgagagtgagagtgagaagtcgatcgggggaagtatcgggtgc

SEQ ID NO: 74190 - DNA, 1604 bp, Oryza sativa
  unsure (1)..(1604): unsure at all n locations
gaccgggttatggtcgatgacactgtccatcatctgagagtttgcaagtctctgaactctgaacattgcccagaatctcttacaggaatctttttgttggtcttctcatacagtatatatcattggccccttgcaagcagaggacaaattctctttgcattcgtatgcattttaattctgcgaaacctgtagcttgtcctgtgtataaacaacgagaatatcatctgtttatcattccaatttccaagtatcaacttctacctcgaccaggagtaatacagattctgaagtttataaacacatctctgcctgaacaagatggacacctactgttttcagttcaccatttgatctttaccagataaacctgaagttcaaaccgtgcagcactgcagccatgtttcccaagatagaatgacgcgtacacaagcttccagcgtgtcgagggcgaggtcgacggcggcgccgcaccgcgtgtgccagcaaccccaggcgccgcaccccgggagcgggccgctattgggagccgccaccgacgcctgcctgctgtacagaaactgcagcacgagcacgagcaccagcaccttgtaccgcaccagccgcggcaaccccctagcctccgccgccgcgcccaccttttttctcgacgccgaggacgacgacgacgacagtgccacgaccttcttcttctcggcaccggcgcccgccacctcttgcgcgtgccccacgcagcaccacccttcccggtggcgccgccgcgccactatgttcgttgccggccggcttccaacaggagaaaagagtgagagagagagagagagaggaggaagggaggatgctgacggcggcgttgcctccgccggcgcgacgccggctgccggaccttctnctctcccctccccccggcgcctcctcccccacagcgccgcccgtcgccggctgagaaaagtgagagagagaaagggagaagaggggaaataagaggaaagagatgaggtggcgtgggttccacgtgggtcccatgctgactcatccgctataaaccgccgaggaatctcgtatgatcggttttgtatagttaaggaatcccgcatatctggttttgcggttcgaggatgattttgtatctcgctgacaagttgagggaccttcggtgcactttttccgaattttttttatttttaattttttttattaaaagttttacaaaaataatttttcattttgaaaattgacagaagtggtcgcctaccgccctctgggagggcgatttttaaaaatcgccatcccagagggcggcgaaaatgacgtggcagacggccgttcgctctcgggcgacggccgtcaacgaaatttgcatgcggcccccttgccgccctccgctagggcgattttgtactgtgcggggggccgcctgcaaatgggcggcgagggggcatggaattttgcaggcggcccccttgctgccctgggggagggcgattttatactgtgctatatttttttttataaatatcaatagttatcaaatctttttatattgaaaactatacaagattaaaatctccaagactggtaaaatacaattttattattttttaggg

SEQ ID NO: 74191 - DNA, 657 bp, Oryza sativa
tgtgtggaatataggatggactttttgcattgtttgatgtgtgggatatgtgatggacttttggtattgtttgatgtgtgtaatatgtgatggactatgtgaggactatgtgatggatttttggtattgtgatttgtgaaattggaacctgttttagtgtgtaaaaatttgtgaattgtgatttgaaatgcgaactgtaaagtggtagatttgtccaatatggatcttcaatttgcagggaggcagagggcggcgccaaccacctggcaccgcggttgggaagggcggcgccagccagtgccgcgaggcagaagggtttcgggctggggggcgctagctaccctggcgccgtggtccatgagggcggcgccagccgaggcccggaggcagaagggcttcgatggggggaggaggggggcgccagccaccctggcgccgcggtcgggggggcgccagccgttgcctggaggcagaacagacttggcgaaaattttgggggaaggggagaaagttggtggggcccgcagaggaggggcgcgccagccatgctggcgccgtggtatgaggggcggcgccactttggctggcacccccttcggcctagccagcacctccacgacagccctattgccacggtggcacgggcacggcgccagt

SEQ ID NO: 74192 - DNA, 4178 bp, Oryza sativa
ataaaggggtatgcggattgggtggtaaaaaaagttaaggcacgcgaatttaatggtaaatagtctatattctcccgatttagtagaccacattttggcatcaaaccaaaatagaccctctcccagaatttgtaaatggctttgtggttcgtgatatcactgaacctgctgggtgaataaagtaaaaaaaaaaacccataaattggccttctgcaagatctcgtcgtcttgcccaaactatagccttcgatctttccatcaggaccgcatggggggagagcaggggcaagtatgaaatggagttcagattcagattctagaacagtctgaacatgcgacgacgacgatggcgatgtatctgaacaatctggtcctctccctctcctcccgggcgggcttccacgcggctgagtttcaggctcccaatctgcagctcctcccagaaccttactctgattgattggttcatcgtttccatggctccaatgaatgcaacgtgttgttcagattttctgaatcttgttctcaatccggagtacgtgctgtagcagcagcaatctgtccctgatctgagaattttagacactcgtagattcgctgatcaatcattccgttcccttcgagtggtctagattgagcttaatcatcctgctactcgaatcaaatcttcagcaagtgagagctagataattcagaagaaatcaacatattcttcgcgaaaaaaagaaataaccgatgaaaccacggtaattaggttcttcgaatcaccgggagagtaggaaaaaacgagctaaaatcccacataggaggaaacggttaaaaacggccactccgcgtctccgccgcgagactagctctcgccagtccacgtagcccaatccacaaccgccacgtgctccgacaatcccgcccgtccatcgccgcggccccggcctcatctcgaccactcgtttcctcccttcacaccagccacgtggcactctctcgagagctcccgcccgcctatataaacttgttcgcgctcggctcctcctcctcatcgacctccaccccacattgaataattatttttaataattttagttttttttttttggctttagatatattcccaatccccaacctcccaataatccgatctctcccagttctgttcggatcaaggctgtgtcgatcgcaaaaaagaaaaaaaaaacaatttccttttggggtggttcatctgttgatcacttctttgtttcccgcgttttgctggggattcgattttcgggttaagattttctacacgatggccttgaacttggctcaaaacgccgcggcggcagcgtgcttcgcgaccgccggtgatgcgcggcgagctgcttcggtggtcgccatgccgtcgtcgtcgtcgtcggccacgacgagcctgaagatgaagaagcaggcggcgtgcgagccggtggcgtgccgggcggtggccaggcacgtggcggcggcggcggcgagcagcaggaggaacggcgtgccggtgttcgtgatgatgccgctggacacggtgagcaagtgcgggagcgcgctgaaccggaggaaggcggtggcggcgagcctggcggcgctgaagagcgccggcgtggaggggatcatggtggacgtgtggtggggcatcgtggagagcgagggccccggccggtacaacttcgacggctacgtggagctcatggagatggcccgcaagaccggcctcaaggtccaggccgtcatgtccttccaccagtgcggcggcaacgtcggcgactccgtcaagtacgcatctctcgtctccttcctcgatcatctatctcatccttctcctctaacctcttcttgttgttggtgtggcgtgcagcatcccgctcccgaggtgggtggtggaggagatggagaaggacaacgacctcgcctacaccgaccaatggggacgccgcaacttcgagtacatctccctcggctgcgacgccatgcccgtcttcaagggccgcacgcccgtcgagtgctacaccgacttcatgcgcgccttccgcgaccacttcgcctccttcctcggcgacaccatcgtcgtaagtaggaggaaggactcttttgatatcgttgccgtttcgccggcggcgacgacgacgctgatcatccgtgcgtctccttgtgcaggaaatccaagtcggcatgggccccgccggcgagcttcggtacccgtcctacccggagagcaacggcacctggaggttccccggcatcggcgccttccaatgcaacgacagggtaactaatctccgacgagcaaaaactccatttgggtcgtcatggattcgagaaaaactcttatctggataaattttgacgtcctgtggtgcagtacatgcgtagcagcctgaaggcggcggcggaggcgaggggcaagccggagtggggccacggcgggccgacggacgccggcggctacaacaactggccggaagacacggtgttcttccgcggcgactgcggcgggtggagcaccgagtacggcgagttcttcctgtcgtggtattcgcagatgctgttggagcacggcgagcgcgtgctgtcgggcgcgacgtccgtgttcggcgacggcgccggcgccaagatttcggtcaaggtggccggcatccactggcattacggcacgcggtcgcacgcgccggagctcacggcggggtattacaacacgcggcaccgcgacggctacctcccgatcgcgcgcatgctggcgcgccacggcgccgtgctcaacttcacctgcgtggagatgcgcgaccacgagcagccgcaggaggcgcagtgcatgcccgaggcgctcgtcaggcaggtggccgccacggcgcgcgcggcgggggtcgggctcgccggggagaacgcgctgccgcggtacgacggcacggcgcacgaccaggtggtagccgccgccgccgaccgcgcggcggaggaccggatggtcgccttcacctacctccggatggggcccgacctcttccacccggacaactggcgccggttcgtcgccttcgtccgccgcatgtccgagtctggctcgccgcgggaggccgccgagagcgccgcgcacggcgtcgcgcaggccaccggctcgctcgtgcacgaggccgcggtcgcgctccggagctagcacggtcagacgctcatatacaccgtcgcctcgagtcggattccgatgtgggatcattcgatctcccttttttttttcttctttttgccattttgtacagccttttggggagctttggatttgtgctttttgtctcgggaggaaaaccgctctggaggtcgaagagagcgtcattttcctcccgttgaagatcacgaatcatttacgttagagatgatgtaattaagcagggaggggaggggaacacacacacactggcactcaaaagttgttgtcacgcttggggaatatatccatttccagccaaaaaaaaaacgcagaaatgcgttgtgttcttgcgctctggttcgttgctgctgtgggtcagattcagctggtgaaaaaactacagtactactgaaactgaaactactagagcctagagggagattaagctaagttaattgcacgagtaattactccacggttgtgtttagggtctacgtcggcagattttgctttctggtagatccctaaccttatgtttgttgggaattttataaaggagctaagtttgcctattgatttgcaatctacacatatctcttgtgtcacaaaacattggtgccttcacgtctttggtctcccctctaaaaacttgcctggcgaatttcacatgaacttcacacgaagtcgttcatttcttgcaagaagtagggaaaagaatcactgctacaaatggtgtgaagtaattcatttcttgcaagaaataggaaaatttccctgctccaaactaaagagtttacaagaagtagggaaaagaatcactgctacaaatggtgtgaagtaattcatttcttgcaagaaataggaaaatttccctgctccaaacgataagagtttacaagcgtcgaccttgagcggattactatctttggcatgctagtttgtggaaactgaaaggattctgcaacttacagtgtgggactccagtaatatgacgcagcaagttggcaaaatggcaataattcagtgatta

SEQ ID NO: 74193 - DNA, 7744 bp, Oryza sativa
tcctgcagcccttaaaatcattcaaaccttttgttcacccacgtttctgcccaaccctctcaccctagcttagtttgccatgacctgtacccacttggcagccactctggctcgtcctcaccctgtgcaaatcttccagccggaccaaagacagccgagagagagagattggcgccggctgtgtacgacgcgtggcctcgacgtggcagcgccgaaccgaggcttcacctccacccagctgcgtcgccattcttcacccaccatcccagtgccgatccaaccgagggaggaagctccagctctccctctccacctctctttcgtcgccggccgccaagaagagggacatcgccaaccgttatcgagccctcttcatctctaactcatactcgttccattctcatctcaccatgacgaacaactttggttttgatcccattccatttcatcttctacagcagcgggaacaccgccatgtcatggtcgctctagagcgcgctctgtgcaccgccgcagcgacatcatcgccgttcccgcttatctggaccaagccgggccaagctgtcgcgccagcttcttcgcctcgacctcctctccatttcccctcaagaatctcgaaggatggtgctacgagtgtggagatcgtccaccgtcttctccacctccggtcaccgtcgccgttgccgaatccaccccctccggtgagtaccaacccaattccatgcatcagtagcatctctggggcctctctaacctcatggacacacatgcatgatagttcttggagctgattgagccatcgccgttcacccggaggttcttgccgccgccgagccgttacacgagccaccgtcataaacctagctaccccagccatgtctaccatctcggtgagcacccttccgcctatagaacatacatgcatgcacccaattaaccaatacatgattgtagaagcacatgcatcaccacccgaaaacatcctcctttcggactcgccgccggcgttactccgatgtccactgaccgagaaaagtagaggaatggaatcgcaataacatgatcttcattttgtattttggttgcacccccaaacgagccatcgtttgtcgccggtgagctcgagatcgagctcagccatggctgttctgcctctgtgcgtgagaaaagaagtcagggaccttgtttcgagaatttaaacaactataaggtttaatgtgcaacttttcaactcactgacatatgaggctaggtcggcgggttgattcttagaaacctcagggatctttttgtatattgatctttcactgacagtggaccccttggaaacaaaaatctgaaattataaaaggaaagtacctaaaacttgtaaaatccatataaaattaaatatagctcattttaagatgatacaaatttctgtcaactcaccaaattgtgaactatagtgttatggaataaaaacttgcactcacagtacaaatttagcctctaaaatttatccaagttaaatcacacataaagcatgcacaaatttataaaatgcatacaaaattcatttcaactcattttggagcaaactcagtttctacagatccaccaacttatgttctcctataaagcaaaatgaaatagtatacatactatacatcgaatgcctctaaaactattacctttaaaatgactagttttacataagctgaactttagaagtttatataaaattcatcttagatcctttttgagtaaacccaaattcagtagaatcatagggttgtgcacttcaatgttataaaataaaaagacatacttacagtataatgaaaacccctaagtatttaagtaaggaataagcaacatggagcataccttaaattgtaacatttgtagaaaattcatctatagtctaaatgaagtgaaccaaattttctatagaaccagcaagtaatatacttcaacctagtagagtgaattatagcaccctcttacagaccatggctctgaaccttaatttggtagaataggtactaaacacatagtaatggttaaacaatacatatgaaaaagtatatatatgcttggtagctccaaataaatccaaataaaacttgttgaaccagtgaaggcatagatccatccccttccaccaaaacttagtatccttaacttatataataatctccagattaatatgttaagtttctaacatagaacatcccctagcttataaaatgtgaagtaaagtaatttgaacactaaaattttataaactaagattagattagttaactaaaatactcattttatacaacactagcaagttagagcaagttctggatctaaatctccaaagccatgtacacatagggaatatatgcctagaacacgttaaaacttgtaaaatacataaataattcatattaactctaaaaattatgaaaccaaatgtgttagtcttagaaaacaaatatcttcaccccagcaaacataaacttaataagaatcaccttacaacagcatttcacaatagtaactaagtaaatcctacactataccgacgaaacttctaaaattcataactcccaaataaaatgagataaaatagaaattctttcacctaaattaattttagaccagtacctattcactgtgcacaaatcatccattttagagcattttggatttttcgcatatttcggtgtttaattgcataacgtgtactttgtatagatgattgcttaatcggtgaagaagtgatttaggtgctgacattttccagttgcaaggcaagtcccacctccctctctttgatcactttgaacctatctttggaggttattgaaaatgtttgcaaatcttgcatgtcgattgtacactaataaattaaaattttgttaaacttgttagataaactcctattatttgcattatcaccttaactccacatatatccatattcctcattcctaaccttaggaacaatatggctataccactttatatatgagttttggtgacactaggttactataaagcatagccatgcttagaatggtcttccttgtcattatgggctcatttcaaacatgaaaattgatttttaattaatctggacagaactttaatacttgtgattttgataaataaaatggtggaaagcatggattttaggtttgggcctcaagtggtgcacatatggtgattagttgtgtaccgatagggggagagtgcgcccaaaccgacctaaggacttcactcaatgtcagttcatttcgtatacagtacaaccacatgtgctagtatgggatagtccaagcttagtaaattatttatggtttagccttacattctggtaggccggtgtgtatgagttcggataactcagaggaacttcctatttaccacgacgtggtagtttaggtgactaagtctgtccaatacaatggtattatgccacgtgggtgggttcccgttgtgtccgccaccacggcgttaagttcaaggcgtgggcccgccacttaacggttctaggtcatatttccagtatgactaggatggaggaacacgtatcgtgctggtgtaaggctaaatcatgaattttggaaaagctttgttgcgggtaataaatcgggtacttatgtatcgcgtgccatgctcttgcatgattattatttcgcatcatgtgggtaaagtgtacaaactctgcagagttaaaactaatcgattagccgtgctcgcggtcatgagcggcgtgtggatatgtattgagtatagacttgtgtttattctcctaaatgctgaaatttaccttcaaattgtgatgagatttgagaatgatctccttgctgccatggatggcaatgaggtgaatatttatacatgattaatgcctactttgatgcccatatgctaagtactagcttgctgaaattttatttgaaagcaaatccgttttgaatgtgttttatgcaaataaaacttgctttatgctaaaaagaaccatactatgccttccttgattatataccttgcaagtagggtgttaggcttgtcttggtgcttgccagtacattatttctaataatgtactgactcttgctgttgaattaacttttgcttgcaggatttagacttagtctttgagtgatgcgggttatcgactgcttcttctaggacttgaacataatgggtaaacccctagtcggtgtgcttgtggattgggtagacaagtttccgctgttctattatttatttggccggtcggccaatgtaactaaagtagatgtagtttataatcgctttcatcttatttgtgtttgctatgtataatcatgcttgagatgaaagtgtgaatctagtgcacatcctgggaactagattcacatgagtatgagttaggaatatttgagatgttgtagaactttagccatttttgtcaagtctcctgaatgtgtaacacatctggtcgccgccttcgagtggtttgacgggcacgtctcaggctgaagttgactggcaggctaaaggcctagcaatatctccaatattcctctctcgaggcgtcggatatttcattatgcttgtttgatgacttgaattattcacttcatctctcaattataatggaaggtccggagagcctacgacaccctaaatacatgaataacagtgatgccactataccgataaaaaaaacaacaatgaaataaaataaacagtaaaacaacatgtcatccatacctccggctgtttaccctatcattcccttctttctctcctatacgatgacaatccaatccatggtaagaaatcacatgttgtgtgatgatagaccgtggtgaaggtaggatttaagatttgaggggagccaacttaagctaaatatagtaatccaaaatgcttaagtgttgaaagcttaaatggttacaccaaaatgcttaaactaatcgtgtaatgtagttagagaattattaacaagttctaatataaacagaactagttggatggcccgcgcaattgcgcggctagtatcaatttaaaactatccttttttacacatgattttatttaaaattatcgttcccgtgattataataattttatagttttaaaagccacgtcagtcgctacctcttactcctttatcacatttttatgtgcttactcaatctgccactacttctattcatgctttttagaactttaaaaattaggtcttatcgtttttagagttcattgtcttgttgggtttcgttttatattttagaagtatcgtcaaacatcgacaatttactattctacggcccatccgctgccacctctctttattgtcactaggattttaaaaattgaacacaaccattgtgtgtgttttttactttctataagtctcgtcaaattgttagttgcatcgtcactatactcctgtataacccgcccgctgcctcccctccttattatcattgagattttaaaaatcgattatgataatcactggagtttatttttactctccataagtcccgccaaccgtcgtgaccatgctgcttaatggcatgcccattgtcactcctcttaatcgaattctatttggggtttccttatagtttttagataccccataaaccgccagcactctcctcatttacaggcctattgcttctcccctctttattgtcatttgtcattgttgtgttctagatagacttttttttttaaaattatacatttttcactctgataacttttattcataaattatattcttacttgaactattataattatttttatatttttaaaatttattttatttgttatttagaactttaattattttcgtcatgtgttctagattgtctcttatttcaacagtctttgttttttttactacaaattagttatttataattgtattctagttgagctcttatttttatttttctaatttctgaatttattttatttttatttcgaattttaatcaatctcatattatgttctatatagactattaatttaatatttctttttttatttccaatttcaattgtttcaaaattgtattcctacttgaactctctttctaatattttataatatatgattttattttaatttttattttgaattttaattaatatcgtgctagtttcttatatggacttttctttcaatattgcttatttttaatttcgaattttagtcattttcaaattttattcctacgtgaattcttcctttatttttttttctgatttcggatttattttatttttattttaaattttaattaatcttgagttggattcttatatgaactcttctttcaatattgcttatttttaattccaaattttaattatctttaaattgtattcctacatggtctcttctctttttttttttaatttcagattttattttatttttattctaaattttgattaatctcgtattgggttcttatatggactcttttttaatattgtttttttaattctaaatttcagctatttttaaatgatatttctacttggactcttcttttctttttcttcaattaatgtgagaatttctagccccccaacgaacgtggtgtctcctttcaaagctgttttaataatataatagatagatagattgatagatatgcatcattgggggaggccaggcctccctccgcccctccctaactttggcccttatgatagtcatggaaaaactagacctattagaattgaaattgtggtatccacaaatactatgcatacacatatattactaagttggggtagagagtgggggtgtctatgtgcagtggtgacaggtgagtgtgcaaaaatccaacccacaataccatgcccaaccgatatgtgcatgatttagggtgcgtttggttgacggtcaaggttggatgggatatggtggccagattttgatcgatatggcgatctattttttgtttcgttgagtggatatgcgaatcagttttttgtttggttctagggatgaaggtggatttggtgatctatttttttgtttggttagagagctaggaaggatgaatggttacaatcaccccttcattagaggcggtgagtataccccttcatattcataaaagccacaaaattattataaatctaatacaaataaacaaatctaaagagaaataaaaaaatcacgaagaaataaaaagaggaaaaggagaaaaacaagaaaaaggaaaaaaaagtcatcctccatcttctcgccggccgctggcttgctcttctcgccagccaccggcgcatctccttgctcgccggccgccgcctaattcgctccatcgtttcgctcgcttgcgtggtgaggggtgacgcgatccacctcggttggtcgtccagctcgcctgggcactctggcggctgcgtccaggcaaatcggccggatccctccatccggcatctgggaggaatattcccctccgggtcgtcctatcccacctccacccaccaaccaaacacccaaaaaaagggaccgtcatgtcttatccacccaaaacccaccatccaaacacaccattagagtttatacctgtggtatgtccgacttgaatcccaagtacaaccgagagttttgtgttgtatagtaatcagtatcatgtccatgttaaatgcttgggttgcatttttgatgatattattccgcaaaggtctttatatgtacaaagtttttttttcctaagtttattcatacaccg

SEQ ID NO: 74194 - DNA, 1075 bp, Oryza sativa
atggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttctcagttgaagatgtctcgaagaggttggtttcgtcgctgccgtcaagaatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggccggtcctggacaggggtttaatgcacattcagcttagaaattctggttcgtgaatttctgggcgtgacaagttggtatcagagccgaccttgaccgtaggacaagccaactggaaacctaagagccctctgaacccctcttcatctgcatatgctttttgcacttggatttgtttcgggaaaaattttggggttttgttcttctgagtttgtgggaaaaatcttggtcgcttatttaattggatttctcgactagggacagtctagggtttggtaaaagtttatttggagtttatttgacagtcagttgggaatttatcgggtgatatgcattaggtcgtgtctatgttcgatggggcaattttatgcgcatcattttccatgcaacaagtttatgcattaagctatggtttagtcagtcgcattagtgtctttatccgggttcatgaaaaatgttctatgcataaaaatcatcatgctcggcgagttacttagtcatttgttgctttatttaatttggttttgagcatgtgttggttcctatccctctgtactctttagatgtcagacctgttcttcgatcgcaagcgccgctccaagcttcagagtcgccgcccttagcttaatcgtcttcttagttttgtttgcttgctagtttccgtgcttaggtttgttgcttgtgggttagtcgg

SEQ ID NO: 74195 - DNA, 2617 bp, Oryza sativa
tcggctctctctccatctccaccgcgcagacgagcgcaacctagcggtagcgcaggtaggggctcgtcgtctcctctctttcttctcttcttctcccctcggctctctctcaccctcccctcgcctttctcgcgcgtcagtggcggcccagcggtggaggcggtggcggcggcgggaggaaaggcgacgtcccagcggtggcgccctccgcagaaggggaggcgggggcggcggcggcgcctcccctccgccagatctagccgggagcggcgacccggcaggaggggaggcgggcggtggcggagggaaggcgacggcccggcggcggcgaacgggagcggaagcaaaaatcttgtgttcatgtgtgttcctgtgttcatcttttgtgttcatgttgtgttcttgaagtgaaagtaaaattgctcgatgcatcggctcgatgcgtaatggatttgtgcgaattttattccttttctttttctgggattatcggttggtgtagttcttatatttgaaagtgatgattgcttgattgggcttttaatctatctttgattttgtgatttgcccgccgtacgcgattaggattttgaatcgatctctgattcttctgtgcattggccagcgtatgcgatgaactaatacggatacgaatacaaccagggatgacgtacggaaatttgtgacaaaaacatcttaaacttttattataggtaaagataaagataaagattgatcgtctcagagaaagatttgtagtacataataagtaaaaatagatttatctctagaattattttatctctgtgattttaattcatgcgatatattactccacaaatataaaagtttgacgtttgaccatgtccaacgtttgaccgtgtcggatactttatgcatgacttatctttttaattttttcataattttttttaaataagacggacagtcaaacgttggcacggaaatctgcggtttgtctttttttttgggacagagggagtattgaatagtatgccatagttccatatacgaatgactcttgtgtcagctagctggcatggcatgtgaggatttatgttggcccttcttattgtattactattcaacaataaaaaagattgttcggtcagaaacaatgacttacacgtccaattgacaagaaagacggagagaagacgtacgtgactacgtgcatgtggattaggttgcgacattcaacactcgacccagtgttgagagttggccgtgaaccacgcaccgagttggaagaactcatgaacggccatggattgaagtctgaactctgaagactgtcgggcactcgggctacctctgaaactggaagctgaactctcaagtccatactaggattacgtccacgatatgggtcttgggcccaaggcgaaggcccatattgagaagcctagtatccttggatgaacttggcagggatgcccttaaaagtgtgacaccccaaacggcccaatgtccaaaacaacgattgcatcaagcccacatttatgcttctggttagatatgagcatgtggcatcaaagccgatcttagttcttacatacctcactgtttgagtggcggctaatgggcgatccatcgcccagcgatcgcatccccccgcctccccaatacgcgaccccagtcctcccacttcttcccttcctcctctccttcttctcttcctagtgcagtaaaccaaaaaaatttttaaaaaaaacaaatagttagaaaaatttatgtatagaaacactatatataaaaaatttgaattcaaatttgaatttgaattcaatttgaattttcaaattcaaatttaaatttgaattcaaattcaaatttgaatcgggtatgtaaacttttaacttataaactttggatctataaaatatttgaattcaaattcaaatttgaatcgggtatataaactttagttctataaactttggatctataaactttagatgtatatagaaaatataattcaaattcaaatttgaatcggatataatttaaattcaaatttgaatcggatataatttaaattcaaatttaaatcagatataattcaaattcaaatctaaatcgggtatataaacttttgacttacaaactttagttctataaactttaggtgtataaaatttagatgtataaaatttagatgtatagaaatattatatataaaaaatatttgaaatcaaatttaaatttaaatcagatatataaacttttggtctctaaacttttgatgtgtaaacttgaggtatataaactttaggtgcataaatctataactaatataaatatttgtatttttccagtcgtcacatctttcaccccgcacctttttttttcgtccgtaaccccttttttccatccgtaacccttttcacaccgtgttttccgttttcccaccgctccagtttgcgcgtattacacacgaaaaaaaaatcccataccgattcctactcaaatttaccagattaagcccacaagcccaaattaaaaaagaacgcatctactaaaaagagcccctgcaccgattcctactccaattttatcccgattttatgttgagtcatgctattaatattacatg

SEQ ID NO: 74196 - DNA, 10044 bp, Oryza sativa
atgaatatccatagataagatgcctggtttgtttgtcttgtgaagtggatgactggagatctgggtatatctctcaattgcatcaattgatgccaaagttggaggaacctgtgagaaaatgtagagaactgttatctcatttcaaaagtaaggtgtaaagatggcaacaaacactgagaaataatgtcctggcgagatgagctagcattcttgagataatcttaactattggataaaaacattaatgcatgttttagaccttgtttgtagcataactatgaatacagatatgtacctgtcgtttcttacgatgcgcagagagcatggtattacactctgttagttcatcaatcatcacagggttgataccaggacgaatcttcttcccgtctggtccaacttcatcttcaaatgctgaatccaacaatgcagaactatgagaaggctgaaattatatgtagaaatttacttcaacaacttcaaacagtcagaaagtaggtacctcttttcccgttggagacaacagctgtaggtgcagctcctgccatcgatgcaggaatctgtctctcagcttgagccaaaagtgctctggcttcatctcgttctttctttaatctagctataacacggcaggcagcatcatgctggaaaagggacataaaacaactaaacagatcagattacaggataatgaatgttcttaaaagcaaaagtgttaactaaaagagcatttcattaaaacggtattcagcatttaacccataatagagctgtttaatcaagcgctgaaaaaaaaatgtagctgtaaagacaagcaatgccttaacaaagcttggtacttcagaccttttcctcaataacttacaagtagttttttaacatatcaacttgcagtaataatacttcattggccctgtttggatccaagggatattttttagccctccctccaatagcccaaatagcccaaaaagatccaaaagggtgagctatttgagggctatttggaaataacccacccaaaaaaaactatcccacccaaggggtgctaattggggctatttcgggtgggggcccactgaaaaagtgtcttctctctatctctctccatgggaagctacattaaaggccaaatagctctcaaaataaccctttgatccaaacaacttagggctattttattggagggctatttccttgtgctaaaaaatagctctcaaaataacttttggctagttctccaaacagggctattgttttcaagctcaaaccagactgcctagagcaaaaaaacaacctaaatatcaccagttatatggtatgcacaagaacccagaacagcatcacacatttctagactggtcagtgaatgattgattttataagcattttttcttcagcttatgaaaatataaattgcagtacaactcgaacaggagcaggaacaaggatagatatttaacagtcaacttaacaatgcccgtacaaaactagtggtcatttgcagattagcgaactttagttagatgggtaaacagatcagggctaacattgttgcccacttcaccacaggattagtgccaggaaataagccaacaactataccttgtacatatgcacaacaagaagcatagaaggaaaaataatctgtaaatcatcattagccatcttcggtactataagtgaaaaggcacaagcaccagcaggataaaaaaaagacaaatgtcaaatacaaaaaaagaagaagaagaaagacgatactccctccgtcccaaaatataaggttttctagagcttttgagggagattaagaaagtaggtggaatttaatgaggtatggctgtaattagtggatatgaggaagtatgtggagatattaaatgagagatggttgtgtgattggttgagatgaaggaataggtgaagttgctatattttggatggagggggtagtttatcaagagtcaaaagagtgactcaagattgggaatcaacagtgctgattacagggataaattcatctagaatcaagagtcaagtagcatttctaaataaaaattcgaatttttattatgtaaggacgttcaacatcctactgcatctgctctaaccatacacaaatacaaaatggccaccagagttcctaaaagagagcactgttccatagcaatctaacatgccccaacaatagacctatggaaaagctcaaaatcctctgagcagatccttcatcagctaaagctgctagcatatgtagaactataataacattcatagtttgtcaaaagaaaagggaagattttgtacttaacatgatacaatatgtaatagaaattctgcataggtaaaagacatacctgatatagcgcatgactaagttcttgtcttgctgtatgaagctgctgctccaaagcaaaactagaaagcatgatagcatcccactcctgtaaaagccatggtattgttctagtgagagctagggtgaatcatgatgggttctcacaagacatttttagttccatgattatttgtggcaaaatcaaggcactgtactatattactcttcctaatagttacatgagatcatttaaactgagggcgatgcaaattttaggaaacaaagaccagaaatttaactctaccacagaatctctgaatctgctttaaacataaccaatgagcaggcagtttgccaagctccaattatgaagattagtttactccctctagtaacctgactatgcttggaaacagcgcattaagttctgtcaaactggctggtgtgcaatggagaaagacgcttaacactgaatcattcccaattattatgcaacgtgtttatctttaattcaaacatcagataaaaagtactttcaggtacagttttaaattaacaaactatacatttaataaacaaaacaatgtgagaactattatcaaagaaaaagaatcagatcttcactgtctataacacagataactatgaagttagtggaaccacttacattttggaacatccccaggagtccgggaatgcttgcagcctgcaattgtctgggcttcacaacctgcaaatagtataacatgattgaggccttgaggattatgcaagtttttcagctaaaaggtatagcaccatcagttacttgtacaaaacataggtaaatccacgccacacgctgctgaagcctgccactccacaataattttctcagcattccagcgaagccttaccttgttggtcttcaccgccacgatgtcgtccatggtgagctcctccttggtgactgggcacttcccatggtcctgcgccatggccacgaccatgaccaccacaagaaacatcagctcaaagcacgacacacaaatgcgacgcgagatctaaacccacggaagctataataaccctaaccgacctcgatgtagcgctcgacgagccgccgctcgaagagaagcccggacttcttcgacaccaccggctcatccggcacctcgccggagacttcacaacaggcggaggccacaaatcagcgcacgcacggagagaacagctagggtttcggagagacagtgagagaagcttacttgcgcagatcatggctgcggcggcggcggcgacggagagtggaggaggggattagcgcgcgcgcgcgcaccgaggctgctcctcccaggcagctctctctctctccggcagtggtggtggcggcggcgccggcggcggcgggggggagcggagcaggtttagccggctagggttttaatccgaagcgggggcgaaaatctcgtcgcttgtgcggctcctccttccgccgtggtccactcgcggtgcctgaaatcggtcgcgcaagttgaaccgtttccattgggtgattgggctttaactgcgtgggccggctaagtttggtgggccgcattttgggtcctggaaaatacttcgtgggctatagatgttgtaggcttgtgaaatatctggccgaacacggctacgtaggcggtacctacgataccgtttctcagcttctcccctcctctaccccacgcacggttctcaatttgctaaagacagttgattttcagcgctttgatgtgaaaattaatttttaatatatatattttcactacaatcaagctaggggtaaaaaaaataaatgaaataccaaggcttatcagtttttatcatgaaacaaacaaataaaactcacactttaattgataagtttatgttaaatatcataagaatgattgataggtttgtaaaaatattgtggaaatgatgtgaggggtgatgattggatttatactatacataatgatttgtagaattaaatagattgtagatgatgttgcatgcttgaatgagattgagtatgtaattattgctagtgggtgataatgtggcatggttgcatattaagcattagagttagtgggttgtaactttatagagagtatagattgtgttttttcaaaaaaaaatctatggaaaaattattaaaatactaatacttagttaattatgtactaatgagtcacatcgttttatatatgagagggattagttttcatcccaaactaccgaacacagccaaaaatcttcaaggagtatcatcgtacaggcttgaagggaatcctatcttactataaagttatcccccactaactccataaccttaacatgcaaagatgccacatcatcatctactaattaacaagatgccacatcatcatccactaacaatcatcacatttaaacatcatgcaaatatgctatatctttatagtttttataatttaagagcttttcaaatacaaaaatgttaaattatcatccaacataattcacataatgtttcaatgtatatatttattatgttttatgatataggtatatagttcatcctcacttagtgcttaaatgattaatctatggtcaaattatcttctccttttttcctctaattaagtcatatcacatcaattgtttttagcctttagataattaatctactgtccaaactatctccatatttttcttcttccataaagtcataccaccttactttttacgtttgaatcaccattctacatactatttaaatttaaattatcataaaccacattaattcacttaatctgatgttatatagctattttacacgttattttttttattgttatcatactaaattctcgcagaaatgcacggagtttcacctagtgatggtaataaacgggacaccatgcatctcgcctccctgcatctcgccctgtcgatgtgcatcgacacctcacagcatgacccacccctaaaggcacaaagtcgcaactgatcctgtgcatccatgttgacatgtacacggcccctctctcacagctgaaacctgaaccgcatcgccatcctgatatctaggcttcacgagatgtagtgccttttggagctaaagtccaaccaaacagtttcagctctatataaagcggagctagatggaacattctcaataaaacaaaacgagatgtgaaactggatttaagctgctctatgaatttactctgtacccaaccatttaagctaaattttagagttgaaactttatcaaatagacccgtagtgctccgtatgggcctgtttagcaggggtggagctggagctcagccaaacagtttcagcttccctaggtggagctctctcacaaaatgaactagagttgttgagctgggtttaggcagctccacaactccactccagacccaactcctagagctaaatttaagagttgaagctgtaccaaacaggtccacatattttccgctcgattttgctatatctcacacgaaagattttttcttatctctcactcgattttctcactcaaatttacagtgcattttcttgtaagttacagtgtaatttatgaaacttacactgtaacttttgtaagttacactgtaatttttgaatcttcgcatgtaaattttaaattttgtattggatttggtctttttcttgaggatatggtaatttagtgtccattatggtgtttcttaattgctttttgctttttattatatctatcagattttaatctaaagattaaaaatctgtgtgatacgattataaaaatatttcgaaagatgcataggtactcccttttccgctcccgcctacgcacgctcgcgcgggccggcgcacggccttgagccgacatgagtacacgatcgggccgtgccatatatatggccccggcccccatccggccgtgcgcgtgtgcgcgcgcgcgattccaccatgttttgcgcgagaaaaacacaccgcatcaacagctcgcgcgcacacacggctccggaaaaaattttggtggagaccggatgcaagccccttcttctgcagccctgctctggattattgacgcgtggatgatgtatcgatcggactatcggacggggcgctccgctcggctccaggctcacccgagcccgatctatgcgcgtgcggctgatggagctcgaggctcgatccgtcccatcccggcttgatctgggcccgcgcggcttgatcttgtcaccgccacgaccatcggaggatggcggctgctcggggttcttgatctggatgaggtaggacgccttcgaatccacgttcatggcctcccgcggctcgatggcggcgacagcggcgtcggcatcatcgtgacaacgggccggcgaggggagctcgagcttgtagatggatgtgcacgcggtggccgtaccaccgtactcgccgctagcctgtgctgtgtgcggtgtgtcgtcgtgttgttctgaaaatcaaaattcaaaacaacgatgtcagactacatcatagcatcggcatgcacatctgacactgacaccaatcaatttatgattttgagccacaatttggtttacatcaattatcttcgaatgtggtgacgagctcgacgtatccccactccccagtagggccggcagcagtcgcgcaggctcatcttcatcttccccaatccccatcaagaattcaagaacagccggagcagcggctgctcctcgatcgatgttcacctcctgcaatcaacgacagcagcagcttcgaaaatgtccaaaacatctgtaattctccatctttcccttggccagtaatacgagacaacctccttcccatgtccaccttcgcggccgtcatggcttcttgtgtccattgacccattcttgccatagtccggcgcatgcttctcctcgacgccgccgacggtgacaagctgcacatctaacgctacttggtagagcagcggtggtagcctggtaggcggtggcaacccggggtggaggcagaaagcgacaacgactccctcaatatggaggttgaacgaggattgacggcgaacgggcaggcggcgtcctcctgctcatgagccgctcacgctcagatcgagccgggacggatcaagcgccatcagccgcatgcgcatagatcgggctcgggtgagcctggagccgagcggagcgccccgtccgatcaatacatcatccacgcgtcaataatccagagctgggctgtagaagacggggcttgcatccggtctccacaaattatccttagctacccggcctctctacgtggaagaaatccgggaatcgcgcgcgaggatgatcgacgtagcggtgtgtgccggtgttgcggcaaagcggcgacagtcagatcccccggtttggcctatgcacattccatagctagtggtaaagctaacactactcctgcactttcgatctcagacaccatactttcgatcgccttctatacgtttcggcaggcgacagcaaacacaggttcgacgtatgccttactgcattaaacatgctactatacgcaatggtaaaaagctagtgtagtcggcagctggcccacggcgatttggcctattgacgaacggatacaagattcctatcagaggtatatatgtatctacctagctacttgcaaaagggtactagctagcgtgcatggcgttgtgaagaacgttgtgaagaatcacgattgatggatgtgtgttgtgcacgggccgtgcaatgcatggctagctatggcaaagctaagctaagctaagctggaagataagccctcatgggggtgacaagagggggaggaagctgcttttgggggactgatgggcattagttctgtctggtaggctaaggtatagctttatctgttcgatctcatggactaatgtaatatcctttgggtgctaattgttgttgtgttgctgacaggattgatttttaatcttggacattacacgccgccatcgcatccatctcgcgcgtacgtggttcctttgatccttaatcctttcctcacttgcaggtgtgtacagtacacctgcaattaatggtttaatttgttcctagtgtgaagaaatggattagcttaatttgagatcgtacagttgattcacgcttccttcgatccgggttatgatctctaacacacatatgcttgtaatataactcattattgcttgaaaatataactcattagtgtgttgaactcatgtatattatgcagtgcaggtctcctacaccatatagcatggtactctcctactcatggctaaatttagctggagatgcttggctaggtagacaaaagggccgaggcttttctacccaggatcccaacaaatatatctccccgagatcgccagtaatctcacggcggtgaccgcacgaaacgcccgcccggccggatgccgcaacgatgcattcgcatctcagctactcgatcgtctactctgcccggccgcggctacctagcttagctagcttaattagctaccgatccgagagacgacgtacgagtagggagcgcgtgcggcggcttatgcctagtactacactactggtatcgcgtaggagtattcgcgtaggtgatcgacgtgacgagacgcgggcggccgaccggattcccccactggagcagcggcatgtcgatcgatcgtcgtgggcgctggatcatatcgctcgcgctcatcgatcggcacgcacggttagactctgctatatgtacgtgagccggtgatggtgaaaacggtggtgaatcggggggctccgctcggtacataccatttggtgattagattatgcatcgatctctctctctctctctcgatcgatcgaattctcgatggattgacacctgcctaatcagcacgttgatctagttctttggcagattttgcaccgccttaggtgtcgaacactaatgcatagtactctgatatttatgatactagtactctataataaaactggctatatgtaatggtattaggtagtatacaactttccacaattttttgaaaaaatactttcaaatatctatactctttactacttaaaatgttataatagtgggtgtcctttcccacatcatcactaccattgatatgtgggtcccctaatctgtactattacaccatctttatgagtcatctcctattttactattggatctcctcaaatttcaaaatcacctacttgttaataagaaaaatcatcatattacttggtaaataaatgctaattaattgatctaatgaggtagaaactgattttgttttccattgtaacgcacaagcctctaagctagcaactataggtggtgtttggatttagggactaaaactttagtccctgtcacatcggatatttggacactaatttagagtattaaacatatactacttacaaaactaattacataaatgagaactaattcgcgtgacaattttttaagcctaaataatccataattagcacatgtttactatagcatcacataggctaatcatggattaattatgctcaatagattcgtctcgtgaattagttcagggttatgaaataggttttgcatagtctacgtttaatactcctaattagtgtctaaacatccgatgtgacatggactaaaatttttagtcccatccaaacagccccatagtatgagcaattggatagagtgactttctcaaattacag

SEQ ID NO: 74197 - DNA, 56201 bp, Oryza sativa
gcattcatatcatcatatgtgaccacagagtttcaaaaaatattcaatactacaaatcaaaaatgaaatcatatctgcaatccttatgttcccaaccccaggttatcattgaactcaaccctaaatgcagtttcaatttcattagatttatgagattcaaatatgttatgccatactcattgaatcagtatatataacatgaactactacttaatcaagatcaatttctgttgcattcatatgtgaccacagagtttcagaaaatattcagtactacaaatcggggatgaggggagggctgcaatccttctgttccccaaccctatgtctcacatatggagtatgtaccatgttaattgctgttaaaatcagatccatgaaggcaccaaaaacggtaggaaaaacatatttttcgttttcttcctcagcaatgcataccaatcgcatgaacttaaaataaaaccaatcatcataaaagcaggggccttggtagatttgtaagagcacgcctcatggaccaacaacaataatttccaagataagataaaacaaggagacaactcagatggaactttcagctcacctgttgatcattgcaggcacattctcagaagaaatgatcacaactggtatgtccttcaatgaagatgacacttgtacccccaaaatgaggagcaaaaggagcaaattttactccacttacagcaacaaaggacccaagatttatgaatgctcacaggataagaataaattcaatgcaaacaaaacttaccttcaccctcttcagtagatcatactgtcatgccaggcatgtagtagtcagtgattatcacgttgacatcaatctccagtacaacagttcaaaaaaccacaggattgatttcctggatagcaagcacagcataagagaattctaaaggaacacgaaacaaataaagaacaagatttcattcactgacctgatggtcaggtgaggaggaagaaggggaagaagaggagacgttgctctcatccctcgatccatgcagctccaaggccttgctcccagaatcaaaacatgcaagagcaacaaaggttcacaacaagcacaatttggtgctgaaaagtacagaatggtctacatatttgcactgtcacatggaatgcaaaaggtgagcaaatgcctaaaagatcactgtaatgcattaggagtgattagatgaattggtgtttacagtgagaattcagcaataatacacctaatactaccttaaactagacttaagtactaggttactacacctaatgatttaaaagcatgtactgaatttagtcatcaaacttttcaccaaacaagtgggttgatggtctgattaatgataggaaatgttaaataatatagctagggacctggccctgtttttcctaggccgacataatttgtgtgcacacttttaaacaccttgatcggatatgatccatttgaatggttgtactctagctttacaattaaatctgaccaaccattagagaaccctcttaagcatagcatataatcctataaataggatatttatatatgctgatcactatgtctatgcatgtccaacagctcccaacaagagactacagttcatttttacttttacaggtcgattgatgacgatcacgtcgatttaaaagaaaatccaaaagcacatatggttctccatgatgactactggtgaagcatgctatatatttggcttagattttgtcatttataggtgcgtagatgaagcttatgcacaattagcatcatcatgatctacataccatcacaatatgtaattagtactacttgccacaaagctctaaaagccaaaaagttactaaaagtacatatatagcccagtctggccaacaatatcacacagagaacaattgacagttctcatactgacatgcatccatattcttccaagaaaatgaggaagaaaaaaaataactcctgtgaataatatagcgtactccagtaagcgtatatcaacttccggacatgtttaataattgaaactatacatacacacatactactagctaaagcagtaatcaagcatattgtgtaccagcagttgcgggaggggaagaggtcgccggatctaaccctctcgtcgtcgctggcgacggatccgcgcgagaggcgggcggagagaagacgggacacgtgcgggaggggaagaggtcgccggatctgcccctaccgtcgccgccgacggtggatccacgtgagagggggccgaagagtggacggtatccgtgcgggaggggaagagtcgccggatccgcccctcccgttgccgtcgacggcggatcacgcgagcagaaacgatggcttgaaggctcggcccatcccgtcatcgccggcagcggatccgcgcgagcaggggcagagagacgacgagaggtggagagagaacggcatccggttgaggagggagagagaaagagagactgggagagaggagagagtgggggagagtaaacgagagagagagcctggaagacataggagatactactaggagataacgaggggagagaaaacgaaagagagataaggctggtctctgaacaggcaaaccgatattttctctcctgggtaatctaggtattcggattattttttaaaaaaaatacgactacaacccagttattaattgctgtcaagtttttttacattgtgctaatcctccgaactaatttacacgcacatacgagtgatattattttttaattcttgacatcataaataaaaatattgtcttacgacattaagaaatagatttttacttatgttgtaccactaagaggaagttgttttttctccatctttcgttcttcatacgcgttcaaggaaaatggaatcctcttatatgggaacatgtttgacccactcatccagtcgtgttcaccatcagagcttgtcgttgtcgttttttctctaccgggaacacattgttgtaggctccgttcttgttgtatggttttttcatcgctaacctccaccatatatggatcaatcacatctctaaccttataaaataactataatcattatcataacattagtttttttttctttgcaacacacaggctcttttttagcaataaaaactccccaaaatcaaccggaacttcactgcattttcacatacatacatagtagaacacatgtactccctccgtcctaaaaaatagttaactcattatgttaggcttatttacttaaaagtatatcaatattttcattcgtcaaacaaaattctatatgtggtttcaccatttgttcatcctatgctgcaaccatcgggcccacacgtcaaaagcatcatccacaccccgtaaatataaagcaaatgaattgtcaagaataacacgacttttggtcaccgtacacatcgccgatgcttatgatcatgctttgataaatcattaagaccaaatttcagtcaccccaccatcagccggtgcaacgcacgggcattgtgctagtttactaaaataagaaagtaatgttgtcggtgatatgggcccgggggtatcatgtttagagggaggaggctgcccccaatgccacgtggccctcccccgaggggagtgaggcctgaggtggggtgagggccactctttcccaaagactagacagaggaggctgcccccaatgccacgtggccctccccggaggggggtcgggcccgaggtggggcggcggccactccctcccaaagactagtcggaggagactgcccccaatgccacgtggccctcccctgaggggagtgaggcccgaggtggggtgtcggccactccttcctaaagactagtcggaggaggctgccccccaatgccatgtggccctcccccgaggggggtcgggcccgaggtggggcggcggccactccctcccagagattggacggaggaggatgccccccaatgccacgtggccctcccccgaggggggaacgggcccgaagtcaggcggcgaccgccccctcctgtgactaggggtcgggctcccccgatcccctctctaggtcaccacgtacggtgggttaagtgtccgcctacaggtgcccacctacccgcatttatggcgacccaagcggtcgcgccacgcccgtgcggtgtactcaaccggtctgtgaccggttgaatgaccgatgggactgggtagtgcgcctgtgcgctgctcgtgtgtcaggcggcgtgcagcctgacatgtcccatcaaataatgatggtgagaggttctcatcctcttatcccagccggagtcggtcctcccactctggtcaaagctaggctcccgtttcccagtgtaataggagcccagaagttttcacccattaaatggtgaatgacatgggcgccccccgtgtcaggtggcatggtgtggtaggccccacgaccgaggcgacgtgtatgcggcttccaagttaaggaacaagacatgcatctaatgcaaatattgtaatacttctcgacgaagttagggtgttgggcctatgtggtaaccccttgagatataaaaggaggtccaagcctagtaagaggggggaacttccgagcgaacgggcgcttgagtcttgcaaccccaaacacttgtgttctccactcaatcaatcaaacacaggagtagggtattacgcttctcagcgttccgaacctgtataaatcccttttgtcccatcgtctttgggggattgaaccccctcaagatcacacagctttgctcaccaagccctcgaatctcacccgctgcccccggccgaactctcaaaggggggcctcatggttccctggtggaggagttcattctccgacaaatgcgatgccaaaaaaggaaacaggtagaaggagggaggggaaggtgggagcgaatatgattgctaccccctccctagggcgagcgatcgccaaacagcatttccagttggcagcttggcaccaaaatttgaccagcggcatgtgcagactgaagatacactttgggcgataaaagacgttgaatgcctgatcttttttaattcctccacaaagcactaactagcagcatagaagctgacagccggcaaaccgaaactgacggactacaagtcgtagatgctgccactctagcaaatcagatccacgtgaacactaacctgatcatcgatcaagtaccccccatcaacaataaaaaaccccatctcttaataatcgcaaaaggggaaaaaaaaagcattcatgcacaaacaacatagagccgacacggcaaattaaggacgcacccacttcctgtcttcctctaaacgagaaaaaactaaacaccgacgggggcttaatcccccccgcgccgccacgtaacgccggccgagggaacaggccgaacagaggaatccttccgttgcaacggccatgcgatacggggcatgctgcacgtgatcgcatacatgagccggttgcgttctgccccggttgtttgctactcgcgtccacgcgatcgatcaaacgatcgtcagatcgaatcagggacagtacagtacagggagtcgctagcgtgcccgcacgccgacccggcgcgtcgcgcggcgcccaatctgcccgcggcgaccgaggcatgcatgcatagcccgataggcgatagcccatgggcttcggtttcgctaacgcagtacagcgtcgtcacctataaatgcaaggcaacagcagtacagcacccgtcccggttaagctccgtcccaggtaagagctagcagctcgagagagcgcaaaaaaagaaaaaagaaaaccccaaaactccagagattaatcggcagagctagctgtgaccgaggagaagacagagcagccgaatcgaagatggcgttctataatggcgcgagtgttgtcgcgctgctgttgctggtctccacggctgctcgagctgccggcgatggtgagagcgtcagataatgctgcattatgcacttttacagttttactcctgaaccatattagcttgcttcagtgcttcctatggaatttccgcaagattcctaggagtaatttgccatccactatctaggtggcaattctttgccatgaactagatagtactctgaagagtaatccctgttgttattgtcatgatgttcttacttctcggtcattcagttaagcagctagcctgttagtaaaactatcgaactgtacctgcaaaacttccttgcagataaaaccaaaatgtatgatattttaactgtcttttcgattgactaaggcagcctgaagaagaagaagagttagtaatttctagttgaattggtcccctagctatagcaatggatgataaggtcacttccgtttcattagttctagttcttaatttcaatcaggttttctcccttatctatctaaaaaaatagaacagatgagattttcctttcatttaggaaggcaatgtagggtagttcttatctgaaacattctcattttgctatgataactagaactaagtaatcatttagggaggatgaaccccagcttagaaactagacaatgtatagaaataaggacagcagcttcttattcattgaaatgatatccgtgtgcactcttcttaattagagtatcactaatcccaaaaatgccagcgctgacttgttagttaaggtgacacagaaatcaaatcaaatctctgcattgtcacgtgcgtaggtcttctgttcagacacaaagaactgcaaaatattagaatgagttagagtaatttactgatgtaaagaatctcatcacgtgagacctagatgctacttaatattccataatcctaacatgaaacaagaacgactttcaagtttcaactgccgtctcgtggatcatggtgaaaacatgggaccatgcggccgttacaacttacaagcatgggtaaagcctgaagtagtgataagccagtcatctacacttgcttgctgatgcatgttaatgttttgttaccataacatgttataacttattcgaaatcgtcatgatccactggtttatcatagtatatcagcgcgacttaactggttcagtataaccgtgccaagtactctctgaagagcaacctggcacgatccaaaaactagaatttgcttacacgagtcatgtcactcatgcacaatgcaggcctgctgctcaacggcaacttcgagtaccagccgagcaagtcacagatgaacggcacaagggtgatggcggagtacgcgatcccgtactggaagatcaccgggttcgtggagtacatctcgtccgggcagaagcagggcgacatgctgctgacggtgccagagggcgcgcacgccgtgcggctgggcaacgaggcctccatcgagcagcagatcagcgtgacccggggcatgtactactccatcacattcagcgccgcgcgcacctgcgcccagtccgagaagctgaacgtgtcagtggctcccggcccggagtccggcgagctccccatccagaccgtgtacaccagcagcggctgggactcgtacgcctgggcgttcaaggccaagcgcggcctcgtgtcgctcatcatccacaaccacggcgaggacgacgaccccgcgtgcggcccgctcatcgactccgtcgccatcaagaccctgtaccctcctcaggccacccagagtaagatgcatcgtcgaacatgcggctagctatgatgttcgatccttttgcgattactgacgacggacgaaacttgactggtcgagcagacaacatgctgagaaacggggacttcgaggaggggccgtacatgttcccgaacgcggcgtggggagtgatggtgccgccgatctcagaggacgaccactcgccgctgccggggtggatggtgatgtcggacacgaaggccgtcaagtgcgtcgactccgcgcacttcaccgtgccgcacggcgcgcgcgccgtggagctggtgtccgggctcgagacggcgctgatgcaggaggtgcgcaccgtgccggggaggtcgtacaggctggagttctcggtcggggacgccagcgacggttgcgtgggttccatgcaggtgaaagggtacgcgggtcaggggtgcacgaccgtgacgtacagctcccagggcacgggcgggcacacccgcgcgtcgctggagttcgccgccgtcgcgaacaccacgcgggtggtgttcgtcagctcgacgtacatcaccaagtgggacgggacgctgtgcgggcccgtcgtcgacgacgcctcgctcgtgtgcgtgtcccagcagcagccgcccgctcgccgcctgcttcgtctctgaaatgttgcgctacacggagcagttcgcggccggtcacatgtactcgcatggcgcgttggaatgtgactgtgctgggagtagcagtcgacctttcttcgaatttgtttcattttgtttgagagtgatgttcgaaatatctgttgaaaatttggtcataattcggcatattttaatctaaaataacaagataataaatatgatatttacaatcaacatgagcatagtggtgaatgtaatcaacatgagcatgcttaatgtagaataagcatcaacgtaataacacaatgttgacattgcgatgaacattaacagtaaaacttctaattaaaataatgtaagaaggttataccccaagaatggtcctccgctggagtttgaggctatattgcctccgttggtgttgacgggagcctccttctccttgtatccagtgttgctgttgtctccagtgttcgacatattagtgaaggtgaagtagatgttgacgaacagtgagtagtcacgccttgcgctccccaaaaaactgatcacccgcccgtccgtgcaaacgtcgcagcagcgcgtggtttcggaggcctactctcccaacgcgtgtgcacatacgtcgggatgggattaccgtagcagcaacagcgttggaaaatggatgaaagtgtgtctcacttctctcgcgggagatcaaatccattctcattttataagaggaatggaagatgaagagtaagagtcatggaataggaagaggaatagagtaactaattctcatcaattaagccatcaaccatcctccactacacaaccatcgaccaacaatcaattaggagtaattgatgtaagttaccaatggaataggaagaggaatagagcaactaattgtcatcaactagccatgaaccatcctccactacacaaccatcaaccatccatcaattagaactaattgatataagttaccaattccctaatcaaatggattaattctcaaaactcttcatcccattgatatcccataaaagaatgaatacacatgaattcctagcataatgagacttggaatttatttgatttaattgatttaaatggatcaattacccaattaaatctaacaatccccaccaaattccaaggctcatgagaatgctctttattccatagcagcttttatataccagtgtttcagtgaagactgttaagttgaactttcacctagaaaaggagctacacctgaccacaactgaacaatggactatgccttgaattgtcagtcttgtgcagttaggtttcactcaattccataactgatactaggcaaccgttagtattccctcgggttggagcttataagtcatacttcaggcctttcatgagtatctagagatcacccaaatctcatagactgtgactagcagtcgaactcatatagttgtgttccttctaagatattctgcaggtcaacatctctgcttaatgaaagccactcggaacacattgaggcatacgccatcctaccatacagaatagaagagaagtacatcatgaaaatgagcccatttaagggtctcttctctcggttacacaatagtttgtttcgccatccaaattcacgggatctccgatcacaatggataggtttccactattgtgcaactctaagtgggtctcaagcccatttccctcgatgcactatctatcacattacgtggtagccccttggtaaactgatctgctagatttttagctgtctggacatagtccagtgctatcactctggagtttttctgctttctaatagatttcagtcttctctttacatgcctaaatgacttcatattgtccttcgaactgttcaccttaataatcactgtttgattatcacagttcattaggatagttgtgtcacgcccagaaatttagcccaactttctagactattttgtgtattaaatccctgtccaggaccagccagggtacacaaaacgacaagtaatatacagttccaaacgtaaataaagcgtaaaatacttacagaagagatacttagtcctcacaccgaaacaaaagcagcagcagcggaaaaaggcgatcctagcgaggcttcagctccactccacaggcaaaactcaactggggtctaagccttggtcttctaacttcgtcttcagctcagaagcactacacttctgaaaaggaggaataatagcaaggctgagtacaaccaccgtactcagcaagccacaccaatgatgcagacgtgcaaggggatacaaggatggcttgcggctatttgcataaaggcgattgtaaaacattttattgagcaaaacggtaaaactgttgagtaattaaagtaatattaaatctccactgattaaagctacaccacgttgaacaggcccaaccaacccacctgaactacagtgcattgggtcgatttattaagtgtgagactaatcacggtgattctggtcgatcgcccataaccgcgggcatgactattcgaatagttttactctgcccagaggtgcacaactgtacccacaagacacaatccaccggcatgtcaccgtgcccggccggacacgtcaccatgccgagtgattgtgacaagacacttcatataacccgctctgaccaagcacaccacacctcaggtttcacccccgcccccagcaggtagcgggcaatcccctctcgtgcctaggtaaatccggaagtgacagaggccgtcgcagggcccgccccgctccatcacgccacccttgcctggatgcgtcagccagagaaaagctatacttcaagtcaggcagttacccattcccgcttgtggcaagcgctgtatgtcttccagtgcatcccgcgaaccggtccttacttgccatgggtgcgaccagcaaaatcatgcaaccacagcccaccattcagtcgtattttagttggataattacgaccatgaaacatggccggatgtctcgagcacgcagctcatcatgatactaacatgtctaatactgcaattatcccatctactgagctagtggtaattaagcatggctaagcatatagttctagctaggtcatcaaagtaacacaagctagtcgatttatcacccaagattgacaaaggacagatatcaaataacatggcacaagcgagcagataggtaaaccctattcccatgtaattagcaaaacgaagcatatttatttgcaaacaataaaacatttataaatttggatcaacatgctcaaggggaatgtgtgacttgccttgcttcttcaaacaatcttccgaactcttatcattgcgaccgcgatcttccgaaacgacggattctacacgctggcacacaaaacgaggaaaaactctaataaaaaccaaggaaacagtacatgaaaagtaaacaaatatgtagagctcaattttagatgaattttgcaagttgaatggctcaatttggagctcgaatgaattagatatggattttagaagttttgagagctcgaatgaattagatatggattttagaagttttgagccattttaatgaatttctagaattattatcgatttattgcgcaattaaatcctttatggcatcagccgagaggaagggatggcgccgacaagcgggccctacccgtcggtgactcaagggaggcgggtgcaccgtggaccaagtccacgcacgcgctggtccgcgggcgcaccacgtggcagacacgtggcggccacgacggacgggtgggcggaggtggcgccgacgtggcaccacgagggcacccacgcagggcggcacagggaggccacgtggacggcccagatcggctagggcggccgatcgagaggtcacgggcaggcgcggcgcggcaaaggggccgggcggccgtgggcgagcagggcggcggcgaccgaccggaaagcggcggtgctcgacccgatggtcgccggcagcgggcggcagcggcgctggaggcggcggcacacacgggaggcggcggggaagggagaggggctcaccgagacggcggagacggcgaggcgaaggcgggaaggcggccgacgacgaggattggcggcggcgcttctcgggttggggtcggggacggcgctctgacgactcccgaccgctgcggaggtacggccgagggccagcaggacctggggaaggggatggcgggattaggaaggcacgaggagactcccggcggcgtgaatcaccggccggaagaaagaaaaacagagggtgctcaccggtgtgcgatggaggtggagttccggcaggattcgggcgacagggagcggtggccgaggacctcctcgtccttgcggagccgagggaggcgacggcgtgggttggcgacgaccaaagcagcgggacgacgcagctgcagtcggcacacggaggtggtggctcgggtcgacggtggaggggtggttacggtggcgatttagggaaacgaagcggatgccggtatgtagccaggcacagcgaacctttcggcggtggcggcgcagcgcggtagcgatgggggtggcggtggcgagcgactcgaggcgacgagaggcggctgtgactcgggtgcacggtgaaaccggcgcccgggtggtttattgcggaagcggagcggtggacagggtgcggcaacgcgcggcgaggccggcggcgcaaacggcgcggcgcaggaacggcggcagcggcggcagcagccggctggagggtcgctggtgagcggcgacacttgggctcgcgtggggagagcgggagagagcgcggggagctcaggaaaaatgggaaagtggaagaggggaggccggggatgctttttatagcctcgagagtcgacggggaggccggttggtggcagatttgaaggggaaaaggggcgctggcgacgtgggtgagtgggctcggggtggcggcggttttcacggggagtgggggaagaacggcgcggacgtgggcggagaccgcgcccacgcacgcgcgggaaaaggagccgcgcgggagaggcggcgacgtgggcggcgcgggcggtaatggcggttgccggcggagtgcctggaggaaggagatgacaggtggggccgcgggtcccacctgtcagccagaggaagagaggagaccggttgggggggaatgcagactttgagagagagggccgagcgggccgaggaggaaaaggaggccggcctggccggatggggggggatggaggaaggggtggattgggccgaaaacggcccaaaaggagaggatgaaattttaatttgttttttctttatttaaattgattgaatgaactttgtattattataattatttcttgagctccgaaaattcacgggaaaatttcagagaatatttagggcacaaagaatattgcaaaatattctcggccaatgatttttaagggaaaattttaattatcccattatttcacttgattaaattgctttaatttttatttaatttctagaaaatgcattattaaatgatttttaatcccgaacaaaaatcggggcgttacagctggcacaggtttttcaatcaccggcaaatccatcaggagttcacgaaagccactcggcctcaactgtggcagtatctagtgctgtgagttctgcttccattgttgacctcgttaagatggtctgcttgcaagacttccaggaaacagcaccacctccaagtgtgaacacatatccacttgtggcttttatctcatcagcatcagatatccagtttgagtcactatacccttacagtacttttgggtaactagtatagtgaattccatagctcgttgtatcctttagatagcgcatgaccatttccagagcttgccaatgatcatctcccagattttaaacaaaccggctcagcttgctcacagcaaatgagatgtcaggcctcgttgcactagccaagtacatcaatgaaccaatgatttgggagtatctcaattgatccctttctattcttcggtttttccttaatagcacactggagttataaggagttggagctggcttgcagtcactataaccaaagcgactcaaaaccttgtccacatagtaagattgcacgagtgtaatcccaccctcatctcctctcagtagcttaatgttaagaataacatcagccactcccaaatccttcatttcaaagcttttggacaaaaagtccttaacctcctcaatcacattgaggctggttccaaaaatcaatatgtcatcgacatataaatacaagatcactccctctcccccaccatagtgatagtacaaacatttgtcagcttcgttcacaacaaagccagcagatgtaagtgttgtgtcaaacttctcatgccattgcttaggtgcttgcttaaggctatacaaggatttcaacagtttacacaccattccctcctgaccttctagtacatatccgtctggttgatccatatagatctcctcttctagctctccgtttaggaaagctgtcttaacatccatttgatggacgagaagaccatgagaggcttcaaaagcaagtagtactcgaatcgtggtcaagcgggcaactggtgagtaggtgtcgaaaaaaatcctcgccttctttttgggtataacccttggccacaagccttgccttatacttttcaattgtaccatcaggcctaagctttttcttgaaaacccatttgcatcctacaggcttgcacccatatggacgctcaacgacttcccaagtaccattagacataattgagtccatctcactgcgtaccgcttccttccaatagtcagcgtcaggagatgaatatgcttcttctatggttcttggagtgtcatccacgaggtatacaatgtagtcatctccaaaagactttgcagtcctttgtctcttactctttcgagttgctacaatgttatcctcctcaggattttcctcagccgtttgatcattgtgttctatcggtgcaaaatgctcatggggtaaaacaggttcttgactagacgtgctaagtgtatttttcatgggaaattcattctcaaaaaatgtggcatctctggactcagtaattgtaccaacacgcatgtcgggtactccagagtttactattaagaacctatagcccacgctgtggatagcataaccaaggaacacagtctacggtctttggtccaagtttacgctttttggctataggtatatttaccttggccaagcagccccatgtgcgtaggtatgagagatttaatttcttcctttcccattcttcgaatggtgttactttcttatgcttcactggaattttattcaggacatgacaaacagtcaaaattgcctcaccccaccattccttggaaagtcccgcagtgtctaacatggcattcaccatctcagttagagtgcggttctttctttcggctaccccatttgattggggtgaatagggatgcgtcctctcatgaataattccaaactttttgcaaaaggacgtaaactcattggaaaaatactctccacccctatcagacctcaaccgtttgattttcctttcaagttggttttctacctcagctttatagatcttaaagtaatgcaatgtctcatcctttgttttcaataggtacacatagcaatatctagtgcaatcatctatcagtgtcatgaaatatttctttccccctttagtcaacacaccgttcatttcgcacagatcggaatgaactagttctagtggtgccaaatttctcgcctcagatgccttgtgaggcttgcaaggttgtttcaattgaacacaagtatggcacttggaacctttgaccaaagtgaattttagaattaaactcatgttagccaaagtcacgaatgccacacattggactcatcattctcgctaatatggttcacaacattattattattattacacatgtcatccaaagaaaaacggaacagacctccgttgtcataaccttttccaataaaagttcaatatttagatatgacacatttattgaattcaaacacaagtctaaaaccatctctacacagtagagagccgctaactagattcttctttattgaagggacatgctgcacgttcttcagctatacggtctttcccgaagtaaacttcagatcgaccgtaccaacaccatgaacagccgcaagcgacccgtttcccatcaacaaggaggaacctctcccgacctgataagaagaaaacagggaaatatcagcacacacatgaatattagcaccagtatcaacccaccaatcaggtgaatgaaaaacagagagaactgtaggtaaaaaattgtcgtaccccgatgttcctccgccctcgctaataaccatgttggcagacttcttgtccttgcgatcaggacaattcttggcccaatgcctaggcttaccgcacacaaagcagtcgcccttggcctttcccttgcctttcttcttaaaattggttgtagcctttggtttgacatcagacttgactttcttgttgttgttgttgtgggatgcgtgagggttcttcttttgcaccaaattggcgctagaacctccctcgatatttttgccccggttttcctttgctctcgccttctcctcaacacccaaagagccaatgagatcaataacactgaactcttgcctcttgtgttttagagaagtagcaaagtccgaccaagaaggtggcaatttagcaataatgccacccaccacaaacttgtccggcaactcacagttgttgttctcaagttcatttgccagcatctaaatctcatgatcctgttccactacagaacggttatcgaccatcttgtagtcatagaactgctccatgacatacagctcgttgccggcgtcggaaactctgaacttggcctcaagtgcatcccacatgtccttccctgaaggcatgtgcatgtacacgtccactatattgtcagcgagtacactgatcaatgctccacggaacaagcaatccgaaacctcgaacttagcctcctcctcaggagagagaggcggttcacatcgtttgccccgtgaaacatagaagcatcgctgtcaaccacagtagtgcacgtgctttccatctcttataattagaaccatcaaaagcatgtggtttcagtgttgcagcaaagccaactaccgaaaatgacctatcaggtttttggattgttggaaatttggtcataattcggcatattttaatccaaaataacaagataataaacatgatatttacaatgggatttgatccagtgatagtggtgaatgtaatcaacatgagcatgcttaatgtagaataagccttcaccatcacctaataacaacattgttgacatggcgatgaacattaacagtaaaacttctaattgaaataatgtaagagcgttataccctaagaatggtcctccgctggagtttgaggcatattgcctctgttggtattgacgggaggctccttctccttgtatccagtgttgctgttatctccagtattcgacatattggtgaaggtgaagtagatgttgatgaatagtgagtagtcgcgccttgcgctcctcaaaaaactgatcacccacccgtccgtgcaaacgtcgcagcagcgcgtggtttcggaggcctactctcccaacgcgtgtgcacacactcgtcgggatgggattaccgtagcagcaacagcgttggaaaatggatgaaagtgtgtctcacttctctcgcgggagatcaaatccattctcattttataagaggaatggaagatgaagagtaagagtcatggaataggaagagaaatagagtaactaattctcatcaattagccatcaaccatcttccactacacaaccatcaaccaacaatcaattaggagtaattgatgtaagttaccaatggaataggaaaaggaatagagcaactaattgtcatcaactagccatgaaccatcttccactacacaaccatcaaccatccatcaattaggactaattgatataagttaccaattccctaatcaaatggattaattctcaaaacttttcatcccattgatatcccataaaagaatgaatacacatgaattcctagcataatgagacttagaatttatttgatttaattgatttaaatggatcaattacccaattaaatctaacaatatccatctgaagcagtgaaggtaattattaccatcagttgttatcgttgaaagattttggtgtatatttgtgtaactcattttgttacgttgagttcagacttcagggttcagaggggcaacttattgcagtatggattacattattcccaaactttgctaatgtttgtatcaaagaattttcgagctttagttagtaccaccctacacttcatgccattaattatcatccccaaatcatcagcgccgagaaagcaggggttcggaattttaaactccgaccccttgaacctccgtttttcattgctctttcctactccgcgtgccaattaacttcttgaacctgcacacaacacgtattcgatcccttcatctgtttgtttggtttttttccccatgctattactgttgttttccccattcgatttgatccatcattcctatacactgtatcgttgaactggctagctcggtcatttgtatgtagcctcttcttcagtccaattgtccaaagtgtttggctcttttgaaaggtatgatatgattttaggaaaaaacactagcgcataatattttacagaatatcttttttaagtctttacatgcattgaggatatagaaataaacacttattttttttaaacatagtataaacgcttgtgctcacaacatatgcgcactcacccatataaacgtgcacacgcacaccttatctttatgcataccactaaaaaactaaaccaatacatcttgttgtccacatgaacgtcgcctaccactgaaagaaaaataagtcgcaaatacgagcacccatttcgagtcttgttgacgggggatacccgtagaccggatatagagggtattggggttcgctgatacgaggatctacgtagtacggcatcaagcaaacaaaaaacagggattatactggttcaggccccttgataggtgatagccctaatccagttaatatgggattatatgatgaaaaccacagattacaaagggaatagcagaactcgatgataccgacgagaccgtagtcgagttggttcgattagatcacccggcgacttggctcctgtaggctccgacttcgtaggctgtgttggttgtgttggcggtgagattcgatgctttaggtcctcccggggggtcccttttataccgcaggcaagttaatctccaagtagaactcagagacatcggaccctacacgatacagtgacgacacagttctatccgagtaggactccttccatctgtggactccgtgatgaattttcttaacgtgtacagagaacgtccgtatacgcgcagatataccatatcgatacatgacgtatatccaagggtggagggtataccttatccgtaaccctgacaagtctaatacttgagtatggatgggttggttccaccacaaacaatctaaccagttaagatatactcacttcgcaaaataacagttatttgaatctgtacacatcattagacctaacatatagaaacaatagctattaatctttataatatttcagttaccgtggtaatttcaggaaaacaccattagtgtggtgcagagtcgtggatagcttcacatacaaagtttaatcctggttgcgtaagtgtgttttctataggaatttagtgggactaagatatgatgttggtcttcatctctctgagcttgtgttaggaagcacaatcattggagcgtgtgagtgtggtgcgtggacgtgttgtattttccatgtaatcgaaaaatgacatggtaattttgatgcgtgaacgagagttgtactaaaccaatttggtccaagaaatttatgggccttagccattacccctatgtaatttcggccctgtttttgtgtgctaagatgctacatcgctcctgcgcatatactatccttcgacagccttacgggcgggttagtcgcaccgacggtggcgcgccgcgtcggtcgccgttacgcagcttcccccttctcacaggtgctggtgcgggggacggcggagttttcaaatggcgagcagccatgcgcccatgccgcccatgcaaaagaaacagaatggcaagccaaaccaccatgtgaccccaggcaaacgcagacaacgccttccccggtcgccgcctcgccaagggaccccatttccacggcacctcagaaccgaggagagatgccctgccaacctcctcgatcgtggcggtccgcggatccggcgctcgtttcgctcggtttcctgcagaaaacacgctgtccatctggagttctggacatctggtctgaactctgaacaccgatccgttctctataattaagtgacagcatatcacaatctcctgtacagttctaaacctgtttgctgtccaatcccattgccaccttgcttacaaccaagtaataacaggagcagtacttgctcagagaggtgatgagaagaaaaacagagatgattcagactaccccctgcgtcgcgctgctcttgctcgtcggcgttgcttttgctgctcgatcggcgtcggctatcaccgatggtaagagccttccatagtacatttgccagcttaagatcgtacatgcgatttagacggttaatcagttgcacgataaatttgtgacgctcatttctgcttagatagtactgaaaatgacgaaagatcgctgatatgtcattctgcttgctgcgtgtatttttcaggcctgctgccgaatggcaacttcgaggaggcgccggacaagtcgcagatgaacggcacgagggtgacgggtcgctacgcgatacctcagtgggagatctccgggttcgtggagtacatcgggtcgggccagaagcagggagacatgctcctgccggtgccggagggcgcgtacgccgtgcggctgggcaacgaggcctccatccagcagcggcttaccctgacgcggggaatgcactactccatcacattcagcgcggcgcgcacctgcgcccagtccgagctcctcaacatcacgatcacccccgagtccggcgagatccccatccagacggtgtacaccagcagcggctgggactcctactcctgggccttcaaggccaagcacagcgtcgtgttgttcatcgtccacaaccccggtgtctctgatgacgaagcttgcggccccctcatcgactcgttcgccattaagaccctgaaccctcctcaaagaacgaaaggtaattaattaattgagccgggtgctaacctctccacaaagctgctatcagtgtgcatctctacaaaattgaatacaaggatgtgctcacagtcatgaaacaatcgaacaaaatgaaccaggtaacatgctgaagaatgggggcttcgaggagggcccgtacatcttccccaacacgtcctggggcgtgcttgtgccgcccatggacgaggacgactactcgccgctgtccccgtggacgatcctgtcgaccaccaagtccgtcaagtacatcgacgcggcgcactacgctgtgccgggcggcgcccgcgcggttgagctggtgtccggcatggagacggcgatgctgcaggaggtgagcaccgtgcccgggcggtcgtacaggctggagttctccgtcggggacgccggcgacgggtgctccgggtccctgaccgtgcaggcgtacgcgtcgcgcgggagcgtgaaggtgacgtaccagtcgcagggcacgggcggctacaagcgcgggctgctcgagttcacggccacggagaaacggacgcgggtagtgttcgtcagcatggcctacaccacgaagtccgacggcacgctgtgtggtcccgtcatcgacgacgcgtcgctcgtcagtgtccacagccaccgccggttccttctgtaatattattactatcgtcaaagtcactagaatttaaaatgacttaaagttgtcccatatgaaggaatatctcaattccttttatatgattcttatgccaaaagggtgagatgattttttttaccgaggaaaaaaatgtgagatattatggatgcaattgatagaaaaccgggggtaattacataaccgtacatgcttattcgaatattgaatatgaccaggcccatgtttggatgcaaagaaatgaagtcagtagaaaagatgattgaatttgacttgtctcaactatcaagtcacaagtgtaatgtactcatttatgttagattattggaatcatgttttaaggttgagatcaagctcttcattagtagtcccagaggtaagcttcacgtctactacatctattctaaaataaacaaacatactatatacaatactctctccgtctcataatataaaaaagtaaaataaacaaacatactatatacaatactctctccatctcataatataaaaaagttttagagttatatacggttattaaaaaaatatgtacaaatgaatggtggatggttatgattggatgagtagtaaaggtaggtgtgaaaagtgaatggtggagggttttgattggttgggaagagaatattggttgagaagttatattttgggataaatcatgagaactaaaaattgttatatttttgggacggagagggtattatgaatttagacaaactcttgtctatttgtaaactagaatacatcacatcttgtgctatatttgtatatttgtctattttagaacgaagggagtagtcaagatcattttaaattagactatggaataaacaattattccttctatttaaaaaaacatttctagccctcaaactttattaaacaaaatttcatttctaccttcctacctacttattggttcacaaaatcaagaagtttattctttgcctacaacttatctattatagtactaataactacatttttaattaacaatggacactttggttgtttacactaaccattagtttataaaccgatgattagaaatagagtttttctgggtcggaaataatagacatgttgcaaggtcctttaaaaagtcaaatatatttgtggctagtaaactttttgtcatgtgatatcttggtgcataaaaatctttaaaaatgtaaatccacaccgtttatgtttgcttaacgtaccatcactattccagaaatacaacgtatcatgttagagtataaaataggaaagtgttgttgaacatcctatatttttgcaaatactggacggtgttgcactatattatcacagaatgtttcacatattgcacaccacgatgaaaaatgtttcaacgaaaatgtttcatatgtttcattaattgaggaaaattattacatctttttaactgaaattcttgctttccgtcttgttgcttacaggtcctgcagtatcgtcatgtgtgattagtaatagcaacacaggccattagcatcaaatgaacgcattatagtgtggatctaaccagatttgggccacgacatttgtgtactacccagtgtgatagtgtgtcttaatcggtacggcagaaagtaaaatttttgggctagtgatttcggcctcatgggccagatcggcagaccagaccacgtgtacacccaacacgaggcccgttttctcagccctagtcatccccacttgcccggatcaacgacgggagtcgccgcatcgggcggcgtgcaccagtaactgcagtttgtcacctcctcgcaggtcgccgccacagatgcagggaagggcggagttttgtaatggcaggtggccatgcgaacgagaaagaagggaaaggaatggccatgtgacattgtgaccccaagccaaacaccgcaacacgcagtcgcgccttccccagtcaccaacacgccgaggaactccatttccaccgcatctcaggacggagtgatgccctgccaaccgcctcgatcgtggcggcccgtgcatccggagtgagttttgctcggcttgccgtaggaagcaaggtgcccaacttgccagcactagctccatccaggttcttccgtcaaaaaaagctccatccaggttacatcctctctgagcacgcatctcctctataactacaagtgccaacacagcactgtgatgcagcactacttgtttccattaccaaaattctgcggcaacttgtttacagctgagtatcagatattcagagtatagggagtacttcttgtcccgaaggcagctgatgagaaggaaaacagagatggtgcggagcacctgctgcgtggtgctgctcttgctcctcagcgttgctgctcgatcggcttcggccatcatggacggtgagaacctgcaacaccatgctagcttaaacaattgtttaacacagttgtggtttttcacgataaatttctcatgctcatttctggtcaataatttggcgagtgacacttgatagaaactagctggtgcacgagcgagttcgctgacatgtgtgctctacgctgcgtgttcaggcctgctgccgaatggcaatttcgaggaggcgccggacaagtcgcagctgaacggcacgagggtgatcgggcgctacgcgataccgcagtgggagatctccgggttcgtggagtacatcgggtcgggccagatgcagggtgacatgctcctgccggtgccggagggcgcgtacgccgtgcggctgggcaacgaggcctccatccagcagcggctcaccctgacgcggggaatgcactactccgtcaccttcagcgcggcgcgcacctgcgcccagtccgagctcctcaacatcacggtcaccccggagatcggcgaggtccccatccagaccgtgtacaccagcagcggctgggactcctactcctgggcgttcaaggcgagacgcagcgacgtgtcgctcatcgttcacaaccctggcgtcaccgatgacgcggcctgcggccccctcatcgactcgttcgccatcaagactctgcaatctcctccaagcaccaaaggtaactaaagatcgatgtcactattgaagtttgctctaatgctgtaattgcatccttacgtagtttaatacgttctccgtgaaacaaatcccgtcagataacttgctgaagaatgggggcttcgaggaaggcccgtacatcttccccaacacgtcgtggggcgtgcttgtgccgccgatggacgaggacgactactcgccactgtcgccatggacgatcatgggatacaccaagtccgtcaagtacgtggacgcggcgcactacgccgttccaggcggcgcacgcgcggtggagctggtggccggcatggaggcggcgctggtgcaggaggtgtgcaccgtgcccgggcggtcgtaccggctggagttctccgtcggggacgccggcgacgggtgcgtggggtccatgtccgtgcaggcgtacgtgtcgcacggcagcgtgaaggtgccgtacgagtcgcagggcaggggtgggtacaagcgcggggtgctcgagttcacggcgacggacaagcggacgcgggtggtgttcgtcagcatggcctacaccatgaagcccgacggcacgctctgtgggcccgtcgtcgacgacgcgtcggtcgtcggcgtccacagccatcgccggcttcttctgtaacataggctaacgtcaacgtggcattcattttgtactgcgcctctccggttcgtcggaaattatgtatagttcgatgatacacatatcattgaattgagtttcctgcaccggattttctcagtaggaagacgaacggatttgagattcagatgtagtccttcgcctgtcgagggttaactcagacatctgagcaccagaaaatgttttcgcctgtgctagatttcattacaaattagaagctggatgaatgcattagttttagtagagtgctactgaaaatacactatgttacaccaagatgcattgttttaacattgtactgctatactccatttcagtagtagaaaaaatattgtacttctaacttgttggaaagaaccctttttcacatatattgtaacagagaacagctagtggttgagagattgagccccgaggaccgccacatgaccacaccggccatgggccatggccctgtggaaactggagccgaatcttccattcgtggcggaatgccacgtgagtagctgcggtcactgttccttgcttacagctgcagctttgcaggtcccaagttggcaggacgtggccattcggatcgcctcgaaacagagagccgaggcccgaattcctccggtcctcctcgtgacccacgcaccggcgcgcgcgcgcgtcggtgtcacttgccatgccagtatgccatgcccggcatttaagtggacagtggtagaacggcacggcggctttggcggtctctggctcaccaagcttgtgcatcccatctagctccagagagtcggacgtcgggagcagccgagagctcgcgactcgcgagaagggagccacggtatgactgggagcgcgcgtagcgtcgtggcgctgctcttcttgctcgtcggctcggctgctcgggccgattcagccgtcaccgatggtgagatctcgcagactgctacagcgctcctctgttaaatattttttgagccttttgcatgatttgcacggtgatgatttacgcagttcccatgttctgattgacttcatttcaccatgatctatgctttatcataggcctgttgccaaatggcaacttcgaggacgggccggacaagtcccagctgaacggcacggtggtgacgggtcgatacgccatactgaactgggagatctcggggttcgtggagtacatcgagtccgggcacagggagcaggacatgatcctggcggtgccggagggcgcgcgcgccgtgcgattgggcaacgacgccaccatccggcagaggcttagcgtgacgcggcgcgcttactactccatcactttcagcgcggcgcgcacctgcgcccagaaggagaagctgaacatgtccgtcacaccggagttcggcgtgctcccgatccagacggtttacaccagcagcggctgggactcctactcctgggccttcagggccaaacacagcgtcgtgtggctctccatccacaaccccggcgaggaggaggacccggcgtgcggcccgctcattgactccattgccatcaagaacctctaccctcctccccgcaccaaaggtaacagtcacagatctgttcctactgcttcgccgaacaaaaagtaagttttttgttgagacaatgaactcactcattggcctggcatgtaggaaacatgttgagaaacggagacctggaggaggggccgtacatcttcccggacgcgacgtggggcgtgctggtgccaccgatcttcgaggacgagcactcgccgctgccggggtggatgatcatgtcggacacgaaggtcatcaagtacgtggactcgccgcaccacagggtgccgcagggcgcgcgcgccgtggagcttgtggccggcagggagaccgcgctggtgcaggaggtggcgaccgtgcccgggcggtcgtacaggctgtcgttctccgtcggggacgcgggcaacgggtgcaaggattcgctggccgtggaggcgtacgcggcgcgggccacggccaaggtgccgtacgagtcgcagggcacgggcgggcacaagcgcgcccagctcgagttcgcggcggtcgcgaacctgacgcgcgtggtgttccagagcttcaactaccacacgaagccggacgggacgctgtgcgggcctctcgtcgatgacatctccctcgtcagcgtacgcaagcgcgctgctcgcctgtaacgttaacgttgttgcactacgccgtctgctacccgcgcctccgcggtggctggtgatcgcttgaaaatcgggtgctaatttgtatgaagtgttgacactttgacttagagtcgtcgtcaaattgaagtactagtatggctacagggtctgggtgacctagcgctataatagaagaacgaccgatcccatcaacatattgcacaagcattgaagcaagataaatacgcggacggtatagagtaagagaatgagaatgcgaaatgtgagtatgcgacaaattttcaaagcataaaaccatggcattttttcattaaaaatactgtagctgattcggtaatgtgaaaaggagacaccgcataaagttacatcatataaaactacatacttattgcattattgcagttacatgcaggttacgatgtaattacattacatatttagaattatcttatgtttacgtatgttaattttttagaaaaaaaatatcgacaaatgtatagcaaaactgattgtgagaaaaaaaatatcgacaaatgtatagcaaaactgattgcgaggagaataaaatgtgataccataattatagctagacctttttttttccttttctagtcttctcgttttctcattaagccgctcatcaatcaacggagcccatgggttattgggttgaggcaaagtgcagcccgttacaaaactcatataaaattagacccgattaaaagcatatatcgtgatgcaaatccaacggtaaaaaaattcaactgacatattgaaatttttcaggcgcacgcagaccagcaaagctgataattaaacagtaacttatcccttttgggtttgtttggttcagctgggttgtagctgcacagccactgcgctgcagctcccctagcataatcttgcttgttgagtcttgtagctgtagcgctgctgctgccacagctggctcttccaaactcaccctttattacaaaattgtttaaaaatgctcttttcatcctctcatagtttgaaacataagtttggtttactgctcggttgaaagactgaccagcgattcagaattacagatgcactttgctcctacaatatttgtcctcgttggcgagggatttgaccttgaagatgctatagcgccaactttgaaataagagtaaatttcatagaagcctacattttcaggtatcggtgacacaaaacccaaaatttaaggtattacgatttattttaagtactttatatttgaagctaaaatgtttatttatataaaatacttctattctattattatgtaataaatttttaaaagaaaattcatatttgcatactcaaaatatgcatccatctcgtctactttccctaaaaatgaaatcaatttatttctacgaatatagtacaggctattattaaatatgatacatgcatgcttgtaactgggtttcacaagacattttccattaaatatgggtttctttaaacaaattgtaataccggtgttcgaaaatttgagattacatgcgaaatgagcagatctcaactagttaggtcacttgtgatggaacctatccgtttaggtttaagtcatagacttgcatggatactcgcatttatagcaatttatccttttggtggtagacgatgtactggttgataacgaggtgctcgtaatgactttgttaatattaaaatatgccgcctagtcttttcataactgcccataggaatatggcatgtatgttgtacgtgttcatagggatagtttacgtacgttgtgagcgtccatgtttgtaatttgtttaaaaaaagggagggggtttgtaaaattatttggagttgcaactcgcatttcctctcagaacaaaacaaagttgacaaattgcctccgttagggagacgcagggactgcacagggcaggccgtgagttttaaaaaggaagatgaaaaaagaacggccggcacccggcacccacgacacaggcctgcggagactttgcgcaacacgagacggtgggaatcgcggcgccgagcggccgtagtccgtactcttcgtcgcagcttcgccgaggcgccgaggcgtgcggagaagagatccacgccatctcggctgggacgcatcgttttgtcagagcaaggtgaatagtatagccaactactgctccaaaatatctatagccaatctaatagttcattcatacaatagttaactataaaaatatactacactattaatatacggtcacacctctcacacacacataacatgttggagttcgtgttgcagccagctataaatttatagcccgctttcttctctctcttcttttttcttctcgatatatagttacagctggcttatagcctactattgtacctgctctcatggcacagccccagtgccccaggccccaagctcgaacccccaacccgctgtgcgcggcgacgccgtggccccgagctgggcggcgtgcaaactggagaggaatcttctgtagcagatggtccccaagttgccgtgatgccttccgtacgatccagccggcgcgtctcgcggcgtcccggactcatcctccctgcacagatcacacaagttgtaataagcaacagctcttatatatgtgagctcgcgcactggcccctcgcgaatcggtaaaacgacctactccgattcgatttgtctgtttgcaccaagctccagcgaagttcgagtgctggaccgtgtgacgagagctcatgatcatggtcttggcgaagtgcacgcgctgcctggctcttgtggtggtggtgctcgttggcgtggctgcaccggtggtcttctctgtcaccgatggtgagcactcgtgaacaaatactatcagcttgttaatcagttgccgaaccttctattgttttgtaccacgcgaaacctgccgttgacttatatccatagatcgatcctcacaactgcatatacatgcagcagttagttgtataatcattttttttttgaacgaaagttagttgtataatagatctgtttggtgtgtgaatgtctcttttgatccttcctgcatctacagtattatcacctgagttaaatatcagatagcaatttatgaatgaacttgataaggttgacaatgcatatatagatcaggtgcacaccagagaggattgaggattcaaagctcaaatcttctgctgatcatgacagtgaatttctagaaactaacagccaaagccaatctgcagcgatctgaaccactttcatttttagtcatagtaagtagttacacctggctcgttaattctctccgaactctgaactctgtacagcgtaatactgttcttcattagttcactacttcactgcttaagaaaccactgctttgccctttaatcgctgtaatgtcgaagctcagttctgtttcgagctacataatacagcaaagttgctttgcgttcggactttttctagttcaattttcagttccctataacagagaacccctttcctctgttttcaatatcatttctcactttgtgacagctcgatcatatattgtgcgtacaggccttctaccaaacggcaacttcgagcacgggccggacaagtcccagctgaaccgaactgggagatctctgggttcgtggagtacatcgggtccgggcacaaggagcaggacatgatcctggcggtgccggagggcgcgtacgccgtgcgcctgggcaacgacgcaaccatccggcagcggatcagcgtcacccgtcacatgtactactctgtcacattcagcgccgcgcgcacctgcgcccaggccgagaagctgaacgtgtccgtcacgcttgagttcggcgtgctcccgatccagaccgtgtacaccagcaccggctgggactcctactcctgggccttcaaggccgaacacagcgccgtgtggctctccatccacaaccccggcgtcgaggaggacccggcctgcggcccactcatcgacctcgtcgccatcaagactcttcctcctccccatcacaccaggggtacgtaagctaatccgttgctcaagagaattttcgacatgtcgcaagcaaaacacgttatgacgagttcagaatctattcaactgaactggcaggtggtacaatgctgaggaacggggacttcgaggagggcccgtacatcttcgccgacacgccgtggggtgtcctggtgccgccgatggacgaggacgtgcactcgccgctgcccgggtggatggtcatgtcgaccacgaaggtcgtcaagtacgtggactcggcgcgccacgcggtgccgagcggcgcgcacgccgtggagatggtggccgggagggagtgcgcgctggtgcaggaggtggcgaccgtgcccgggcggcggtacacgctgtcgttctccgtcggggacgccggcaacgggtgcatcgggtcccttgccgtggacgcgtacgcggcgcgggcgacgctgaaggtgtcgtacgagtcgcggggcactggcgggcacgagcgcgccgagctcgtgttcgcggcggtcgccaaccggacgcgcgtggtgttccacagctccaaccaccatatgaagtcggacggcacgctgtgcggtcctgtggtcgatgacgtctccctcgtcagtgtggacaagcacacggttcgccggttgttgatgtagcatccctcgtcgtgtgccgggcggtacttgacctgtagttgcctagttgcacacactgtgttgcaccagaacgtactacctcggctcccaaaataagtgcaaccgtggatatccgtgcccaacgtttgaccgtccgtcttatttaaaaattttatgaaaaatttaaaaatatttagtcacacataaagtactattcatgttttatcatgtaatagcaataaaaatactaatcataaattttttttaaataagacgaacaatcaaatctgaacataaataatacaaaactacacttattttaggacggagggagtgatacggtttgttagtacggtagtagctgcctatgctggagacccggagtagtcgtatggacaatgccagtacaactacccttgtgctcttcaactggaaaagccggcattcgagcccaagctagggctaagttagttacaaactttttcttcaaactttcaactattttatcacatcaaaactttcctacacacataaacttctaactttttcatcacatcattctaatttcaaccaaacttttaattttagcgtgaactaaacacaccctagattgcaatcttgcaacacctcagcccaaattggattgtcctgtgagccacgagctcacaagacgttgattttcttccaaaagtgggaagtattgtatcatggacacttccttgtagtactattttttcgtttcgtaatgtaagactttctaatattgcatatatatatattaataaatctatacacatatttgtctagatttattaacatgtacataaatatggacaatgctagaaaatcttacattgtgaaacggagggaataccgatcaatgtgaaagaagaaacgcgagatgtaggcctggtttagttcccaattttttcttcaaactttcaacttttccatcacatcaaaactttcctacagataaacttttaactttttcgtcatatcgttctaattttaatcaaacttttaattttggtgtgaacaaaacacacccgtaggcatataatattgctgctgtgaaggttttgacttttctagatgcatgaatgatatatttgactccggggcagaaggatagtagtactcctacgttagtacatttgaatggataaaaaatctgaaaaatgccttcaacggtctgccgtgccggccagtgcgatcgacgaaaagttgaaaataaccaatagcaaagcactgcaggtctgcagccgtgccgtactacacgaggtgataaaaaaattaaaaatttacgtatgtagaaaagttttaatgtgatggaaaagttaaaagtttaaagaaaaacttcgatctaactcgggctgagtcggaatctctcctgctactggtagtgccaatgcgttgaacagagcgtgtgccacccaagctccacgtggctgcaggcggtcgctctgcgtctgcagcgtgccacgggcatcgacgaagatgcgtgctgtccctctagtacgtggcgtccggcccgcgagtgtcggcgtggtctcgcggccaaagctggggagctctcgtcggcgtgggagtccatcggcgatcatgacgaagggcgccacgcttttcatggcgctgttcgtgctttgtcgtcggcgcgtctgctcgaccggttgttgatgttgttgacgacgagaactaggtagtccgaacatgtggtacgtgatttgccaaatacgttttcatcttggtcttgcgcgcaatagctcatgtccgactcacaattcgtttgtgttcacgattgcggcacctgattgctttatacaactgggccgggcctactttacatgtataggcctactaccaaacggaaacttctactatgggccagaaaggtcccagtggagcacaaggggccgccatggcactaggagatttcggggttcgtggagtacattggatccggcctccgggcacaagcaaaagtaagtgatagaaacttcacaaattaaggatcactccatcctaacgaagttaatgtggatgattatgcaagaaattatggcatatcttctcgagaggtaaagaaaaccttcaatgtacccatgtgtactatttcaaaacttcagtcaaaaccaacaatattagggtacacatgatttttcaagcatatcttacagcctttaactttcaagatactaatttctgaaaacaaccataaatcatactataggtttttttaggaaacacaatacaagtgcatacatttgtatacacgcacacacactcacctctacgatctttaactgttaaaactgttaacatttcagccttcaaccagatttcgggtggtttggagtgatatggtaatgtagcccagcccaaggaataaaccttttttttagtttttaaaattactacttgaactatagaaaaaggaccacttgacattacgtaccatgtgtctattatgcaaaatgtgtgcaacctgagtaaaaaaattgtgttccatgtaaataagatggttgagttatctcatgaatagatacaatagtatttcatatattcaagagcgtgaccgatatttacttttttttcatcaatttgagaagaaggatgcaaacaactctagcaatggaatttctcttaaaaataagaggtattgcatcctcctcgtaaaaaaaaaatacagaatgatttctctgacggtaaacctacattaattattggctcttcgtttcccatatattgacatccatgcgtacatagattgtccgctagctgttaccgtataggaaactcatttaagccgaaatgttccaggtacattaatgttatatttctcccgttgttattccaacacacatatgtaatggacgagtatcataaaccagtgtacatatatatagcaaatacaggaattgaaggagcatacgtgtataacaacacatcatgcatgcatgcgctcgtgtgtaagcggcggaattatttttaagtaagctataagcgaagacaactactcatgcatatttgtcccagcacagtgtacgtagcactgtacccaacaatcagccatagctagcttagagtacgtaaggatacatcaatgcggcgcgacgtcgacactgccacgctggtgcacacacctacgtacgtacatgcacgcacgcatgagttgttggccgtgtctgtagatctggtctagtggccagggcctctcgggctcggccccgccgtgagctgtgccacccacgccatgagcagagacctcgccctctcgtgcagcgacgtcgccatcgcgtgggccgcgctgtgctgctcgcccggcagccgccgcgccgcctcgacggctgtctgcaggatagtggatgatagggccacgagtagcaagaaaacggcgaggattttgtctctctgggacgacatgatcatcgatcgatcgatcgccgagaggtgagctgcttgtgtactaccactcgatcgatcgatcgagctgtatgttatttggtacgtgatcagggtagctaacctttctcgcgtatatataggctccatttctcaccgttaagctgcacgtacgagagagaattagtttgtctgttgtgtgtcatgtgtgtggttagaagagaaggtcccctggctagctagtcagtagctagcgtgcttaattgcttgtatgcaacgaatctttgatcagtgagtttgccttaattgcggtaggaaaacgaggccgatcggtcgccttctcatgggtgggacagtggacagtttgcactatagaccaacgatcggtcgcctcatgcatagggatggcaatcgggtccgacgggcacgggtagtgcctatccatacccgtgcctataagattatttgtgcccgtggatatacccattactacatgacgggtaaggatggttgtccatgcccatcgcccgcgggcgccttgtgcccgcgggcatgcccgtttacccgccacaacaaaagtagtggaacaaaaagtctacaagcttctaagttcgaattgaacttaaaacatcaaatattctccgcctcggtgtggtgtctcttctctggcggcgatagagtaagggggagagaaataataagggaaataaaaagaaaaccgtagaaaacaaagaacgtggcctatgtattctagtggattttgatcttaacctacatgtaagttagattttacgggtaaacgggcaaagcgggcatggttaatgattacccatacccatgtccatttacccatcaggcatagtttttgacccaataagatacccatggttataaaatggagaacaaacccaactctaatagggtttttatccacggataaacggacaaacgggcacaattgccatccctactcatgcatgatgttcaacgaagttcacatgacagatccaagagcatgcatagtttcaaactgttgatgataaattcttagtataattaagcagacccgtatgtaataatgatctttttttctcataagtattgtacaaaccaccatgcgtggcgcatcctatcaacacgtacgatcaagaaatggaacctcgaaacagatcccaaaatcgtgcaaaaatcctgcttaaacacattaatgtggttacaatgtttaatttaaggatagttttgtcatctttgagaagttactgaaaaatagtatatttttatataaaatttaatatctttattaagtatcttgagctaggttagtgtaacatttagatatcttaaggtattttcttatggatcttaatttgaaccttcctgatagtcttgcataaataaattcattgttacagcaaagctattaatttttagtttattattcttctcatgcaggagtttgtccgccatgagctttatttgattattgttataaccttactctatgtatgcttttgtgtgtatccatgatgcagagaaaccagagatgtaaccatgtaatgctaatttagtttggtatcacattgtgtcctaattaattggtaattttcaatagcatttcttgatgtttcgattggtatcattttttgccaacaccatctcttacgtagcaataaatttagtaatgccaaaagttccataaaattttgcactaccgagatttaggcagggcaccaaattaaccaaactggcccatagttatcttcttttatcttaaagagttgttgaaccgttgatcagctgtaaaatacttgaaaaaggaaactatacataggctacaatacccatgaataactagatatacatttgaactttagacagagctcctggaaccacactcataggcaagatacattcgactagctagtatcactaaaaatgattcacttaattagaatcatcatctgttcacctaattactagtttacccatctaaccagtataaaacaaatgcataacctactcctgaacttcgcgacagtggtacaacgtctaaacaagctaggccacaattaatcgagttgcgtacctgcgttaatcagagctctcggaaatttaggcggtgatggaagtttcgcccggacgcttgatcgatggagcggatttgtttaccctccccaacgcccaccgtcgtgggtgcttgtggttttgacgggcagcggcaagcacaagagcccgcaatctcgcacgtcttgccgcaacgccatatgcgagtgggagctcagagctagcctgagtaccagaattaactggcctactacacggcagtacactgtacacgcctataggtgtgtagtgtatcgaacgctttagatcgcgaaaagcattgaccatacgcatttctatatcagctacatgccggtcggtgatcggtcgaaaggaacatggtgaagctaaagaaaaagatgaaggtactgtaaacagttagcgttgttctacctgcctgccaccggtaggaaacaagagtacgggtcgactagctccccgagaagagctggcaccgttcaattcaaatggaatatagttttacatgatgagtgtaatactcccaccgtcccattttaaagtccagccataattttcagcgtctaactttaatgtccgtcttattttaaaagcttttaaaaaaattaaaaaacataagtcatgagttaagtattattcatgttttattaaaagttagatataaaaatttatgattgtatttaaaatggaacggagggagtacattactaatatttaaggctgagaaaatgctacattatcgatcaatcatttatgtggtaaatgtcatgcaaaaacggccttctgtctctgtgccctttcaaagtaaaaacggtcctctgtagcgagtgtgaagcagccagctctccggccgggccaatgcataactagaggagcccaaaccaaaccatgacaatgggtttgcacttcgcaaacatgccaatatgggccgtttgctaagccgagccctacgaatacaggacgccatcagtcaaaagagttcactttaggtttctcaatttgtcgctgagtctaaaagtcatccctaaacataaataacacagtacttcgtataacctatcctccaactcacaacacccacgtgagccccacatattagcgaacaactcttatccctcctctccctctccctcttctgggaaggggttgttgtgcacgatctccaaccccggcgtgcgcttttctccccataagtgggtgtgtgagtgcggttgtgaggacatcatgtccgacgcctcctccttcacctcccttgttcttctagttgtatagccggcacagtacccaatcatccaactgcatgatcaattcatgcaaaatcatatcagaatgtgattcaattgtagatcgcctttatcgaataatctttgatcgaagcaagaataatttaacttttaaaatagtgaattgaggcttaccctgagagacctcttcttggtgcccgcgatggcgcggccaatgttggcgagctggtactcacataatccaatcggtcttgacccatcacaggcgtagaacacaagcacaagcgccttcttgatgccaagcgtgtgcctttgcggtgcgacgggctttgtcggttggggcatgatttgttggtgtgcttgcggtccggggtggggagggattgaataagtaccactccctagtgccactctgataggtcccacgagttgaaattttacagatccacctccacaatgatcgacaccaggcgcatgggacgggccccacctataaccatgaaacaggcatcgagaggtggtcctacaccgcaagctcgaagggcaacaacttggtgcaaccgaggaacacgacagtgtcgtttcccgatgccgtgggagggtcggtggtggtagggtgggaggaggtggtgatgagcggggagtagggagcaaaaccggaggagagggcagcgtgaatggagggaagaaggagaggaagagtatgaagaaaagttaggcctcgtttagttagcaaaaatttttgttttgggtgtcacatcagatatatggacacacatttgaagtattaaacgttgtctaataacaaaaaaaaatatatattccgctagaaaactacgagatgaaattattaagcctaattaatctgttattagcaaatatttactgtagtaccacattgtcaaatcatggtgcagttaggcttaaaagatttgtctcgcaatttacacacaaactgtgtaattggttttttttccacatttaatactctatacatgtgtccaaacattcgatgtaatgggtgaaaagtttttgttttgggaactaaacaaccccttagccactggcatgtggagctcacgtgagttccacttaccacatctgtcaaaaccggtcactatactgccgagtaaccaaacttgatatagtattgtgagttagagaatatgctacatatagtatttcggttcagaaatgagtttttagaatcgacgataaattaaggtaactaaaacaaagtgttcctcagtgaaatcatatcatatgtgggtaaaagaggaagaaaaatcacaccagcactgaaacccaatctacccccatccaaaacagcgactcgatcagccgtcgccgctcacccactccgacatgggcctcaacccctccaagcgcgtggacgccgcgctccggggcgcgccggcgttcgccgccgcttgcgacgacgccttcggccgctgcctcgccgacgcccagtacgccttcgccggcgtccgcccctaccagctcgccgacgcgtccgcgcacctccactcgtcgctccggggctccctcccgctcgtccgccgctgggtgccctcgccgccgccgcgcgcccgcgtcgactccgcgctgcgcgccgcggggctcgaggacgcggcggtgctctcgaggggccagttcagggagttcgccgccgagctgttcagggaggccgtgctcgccggcgcggcccaggcggctctcgtccgcgccccggcaggcgccgccgggctcgtcggtgttggcctcgcgacccgcgccggggccggggtggtagggaggttggtcgccatctacaccgccggcgttgcggctgctgtttacctcagcttgggctaggtttatcccacagcctgtaaaactaccatttgtaccatgtgattttacctggaatgtcagttccttcgtagtagcaaatatccctatcagaaaattttaatacggttgaattggttgttcttgatcctgatgctttcatcgatggaaaacctcatcaaaacggactgtaatcggtgacggatgaaattgaatcagcaatatgccactgcagaattgatgctgtcacgtaacatcctgcataggcatttccccagtgaattcagcaattagattcggtattcggcaagacagcatcttaaatcttaatgcatttctcgtttctataccaagcagcaaatctgaactctgaattctgcagaccagtgtaatgtggatccctatatgggccgtctgaagcagagacattcttagtccgatgggcctagcggcctatcctctcttcggctctttgcaagtgctaatatgcacgggtcatttttccttttttgggataatgaaatgcccgagtcttagaaaaccaatctgatttgtttggcaacttcgttttcaccaaatcaccatgtgcaacacactgcagagatcacctgaaacattaacccacacagttacagttagcgggcaggcaaaggcaacacgcaccgagccttctccctgttacgccattcgtccggtccattaccctgttgtaacacactaacacctggacgagacgagagctttgtctgggctttcctgtacctgtccgcatgtacattatctatccctatcatggtacgcgccgcgcccgcgcctgcccaaaccaaatgaggtaaggaaggcatatcgcatcgtaatattataccgccacagatgggatgatctggagttgcctgccttgccctcacgcacgtacgcgcgccgagacaaggcaggccgagttggagaatatccctacctccagcgattccgctgtagcgtagcgcggttggtgcgcgcgcgggcggggggccgcgccgtcacatggccgtcgtaacgcaacgtctcccaactcatcgcgcacacagaggcagccaggcagcgtacgttggcgttggggtctccctcctccggtcgtctgacgccaccgcggcggcacatggttaaggccatcaggcagagcctcctctccatcctccggtgatttaattagtcgtcctcggcagatatgctagcgcttgcgaacgcaatttcctcacgcttttatctgttagtggcagatgcttccgactactatcattgaatgtttcacgggtttggacagaagaataatcggctagccatctttcgatgttgtgctgtgctgttgctaattgctgccgattctgccatgctctgtcgccgcctcacgaattcgatactccatgtattccacaggtgtacatttgttcccttcatcaagcttcagctgcagaatatccaaaatttcagggcctctctaagctctcttcctgatacgggcagtaactgcggtgggcgtggcatagtgggcgcgtgtggcctccacgagcagtgcacggttgaaatggtaagaactaagaatcttcaggtagcccccgaggtaagcgaggcaggcaacgtgaaaaactgaaaaggcaacgaaatgctcttcgcttggccttttccgtcgcagttctggcggtgatcttcttttgctcaccctggtggatgtgttctgtgctctgttggctatcatcttccaggcttttctttagcttttatcttcagttcaagaattccagtccatctggacggatggatgagaacgggtgtggacgcaaacactgtcccgtaatgtagctttcccactttattaccaaacgtttcctgtgatatatgattgctgcatccttggttagagaagagaattattgaggtgtcaacttcgggagtgtgccagctaattcagaattcatatcgtttgactaacggcattgattttctctgccaagtaacacgagactatcattcatggcactgcattttaattaggattgttctaccatctttctcatgtgctgtgcgagtgccacactggcaccgtggctgtacgatcagtaatatctgcgagaatgtccatcaactgatcacaacgagaaaaatggagaaccctcttcttttttgcgtatgctgtgctcttcttacgtagtacaatcaactagtgatgaccagatttttttagatacgtaatggaataactagtgacgaccagatgacgtggccagtgaaagtagcatgctgcatctcctccatgaactacactggctcctatattttaggggaagtgacgttaaactcgttcacggaaagatcacaaggaatcaaagatgcaggttcagagaaggagagacaaaccgctcgatgaaacgggaaatggaatggtggagtcgagctgcaacagtatgctccaaagcctttcactttacgatttcatctttgtgctttccgtggcagtatgatggcctgctcgttgaatgtggcgaccaatcgggctcgcgcatgcatgatggtggcctacgcaaggaggacactcgtccatgaaaaccttttgtgaagaaaaaaaaatgtcggatcggtgtaatttgtcaccattaatttggcgtaagcatttccctcttcggagcgatcaaagtgatacgaccgtgctagttggtggagagacaatgacgcgattgagtgacagtaattttcagtacgcaatagccaacacgagtgcatgcatgattaatcgcgcacatgatcgcccatcgggccaattagacgggtggaagcggcttaagttaggtgcagccgtgcaggtctacctaatccatcttggtgctatgaaacggcaccatcacacactcacacacgtacatatcgggaacaaatggaaaccagtgcgacactcgaaattcatgcccatcaaggtaggtgggtgactccgtcagtattagctttttgaaaattttgcgtttgatatgtccaattcgaggtttaattcatacccgattactcgacaaagtactactggtagttcgaggtttaaagtatgactgaaaaagtgagaaggttaaagtatacaactatacccccaacgattagtttagagtaaagtttttaccataattttttccctttctttctggcacctgctctttcggggcagcaagtagagcagtccaacatcgagggtaaaaaagccccgaccgaatcaatgacgcgaagatcctgccaaagtgagctaaagattcaggccagcttccatgttgtctcacagcgtggtagtacgtagtcctacactactactgcaaaccccgcaacgtactgtaccagcacgcaagattacggccgcgcggtctgacggactcgctcgttcgagaccaaaggcaaaaaccaaatcaaaccgagccaagccaaaccaatcgaccgacctacggcaagcggcatgtgcaacctggcatctccctttaaatcccatgagctgtttctccgggccgcaataatcatccaccggggccaagccaacccagacagccatcgcttttccgccttcctccctccccgccggtggacggtggtgctcgcgcgcgcggccggcttttttttcccccacctcctcgatgtggcagctcaggcggcgttggatgtcgtagacgtacgtacgtattctcgccttgttggctttttgtctcgctcatgcgtggcggtgtacgtagaggacaagggacatgttggggggacgttgcccgttgatgggttggggtgtgcaggagaggggggtttcataatggtgtgcactcacaagcaacggccaacgggtcccccccaatctgcttgattggggtttgggtttgggtttggattggaacgtgtaagtattggctgtgcactggtttaccactgtacatacggacacatgtaacaggttgacagagtgcggacctaaagactactagagttttgggcatgcgaatgcacaagtccagtgttaatctttgaaaaccagaagttggaaaaattgtcccgcttcatgaaacggatcacataaatttcgttccttcccattcgtattgttttaagagttaaaactccctaaaactagtaatcaaatgactgatgatagaggtctccaagaaaatatggcaagaaggtgagtgtttggtggccttgcaactcctaatagcaggtacaatagcagctataagccagctgcaaatatattttaaatagataaatgaggagagagaaaggcagcgggctacagatttgtagccagttgcagcacggactccaagacgcagtgtgtgtatgacaggtgggaccagatactaatagtgtagtatgtaactattatataaatgagctattagattggttatagatgaattgaagttagtagttggctatactattaaatttgctctaattggctatctgtacatctgtttgttattctaatcaacaagtggaacgccactgcaaattgcgcctacacggattgctgccatgcatgtgcggcatccctaggtaaaccaccaccagcaccaccatggctctaactacgcacaccaaggacgctgtccacttgacgagatatatacacgctgggacagtactcgatcgggagtgattcgatcagagggaggggagagaggcaagcaacactagcatcctctgacctgccaaactgtcccccgcggctcacatttcttggccatttcttaccttccaagcaccaccaatcttgtccgaggcgagcaagcttagccggtgcttctcagagctaagccaaatcgcgtgccaaatccaagaaaggcacgggaggaagaggaagaagaaggaggggaagaagagcagtcagggcagggggatcagtggcaggctgacacgccaatgggggcagcttcttgttcttcttcttcggcgaagcatctgttcctgctctgcctcctcctcggcttctgcttcgcgttcgcggcgagccagcaggagcagcagcagtcggactcgtgcagtagcgccggcgtcgcggtcgctcatctcgtccccttcaactcctccgccttccgctgcctgaccgtctggaagcaggaggacttcgtcctgcgggtatgtatgctgctgaattttgcagtcctatcaattcttggagttttactgcatactgtaccaattttcatctcggtgatttgtttagtttagatgccattgccaatgcacgcgtgcagtgtgcaaactagccagatatggctggaaaatggaagcttggtagttaaattgattagagtggagtaaatactgcaattagttaaacgagtgttgcttggatgatctggtttggtcctataatgatgaactagcactgtggcagtgtactaattaagcactgatgcttcatgcttggagtatgttcttgcgatagtttgggaggaacaaaatttggtagcatcaatgcaagtagtgtgcatcatagataaaccatcacattttgcatcaaggagtaattaaccgtaagctgaagtgatctgattcaaactgctcgtgtcaccgcagtacaagaacaccggagagagccaatggagcttcatcctctcggcgccggacaagggctcgtacgtggcggtggggttctccggcaaggggctgatggtcggtagcagcgccgtcgtcgcgtggtcgtcgggcgggaagggcacggtgaagcagtactacctcaccggcaagagccccgacgagtgctacccggacaagggccgcctcacgctggtcaagaacaaggccgtcgccgtgtcgcgctccggccggctctacctcgccttccagctcagcaccgacctcccgcagccgcacctgatctacgccgtcggccccgagggcaacctgccgccctccgacgccaccctcccgatgcaccggagcatgcactcccacgccttcaactacacctccggtacaaaatgcttgcacgcatttcgacaaacagatggagcagagggattttgtttttgacctgtttcgtttttttttcagggatggcgtcgagctccggtggctcgggcggcggggggttcccgccggagaggaagcacgggctgctggcgatgatggcgtggggcgtgctgatgccgctcggcatgatggcggcgcgctacttccggcgggtggacccgtactggttctacgcccacatggccatccaggccgtcgcgttcaccgtcggcatcgcgtcggtcgtcctcggcttccgcctcaacgaggacgggctcaagaacgtcgacgtgcaccgggcgctcggcatcgccatcctggccatggcctcgctgcaggtaaattaacttggtctctgaacatgggggagaactagaataattgcagctgagttgaaaaaaaaatgctcaatgatttgcacatgcgccgcaaggccatcatcgatttttctagccatgagtgagtaagttgactgtgaatgatagaattgctaaccaagctacgggaagctcagaatcactctagagaatctgagtactagtaaacgaagactgcaacgtcagctgcatgttctttgagccaactagttccatttctccatgtatccgtcatagccgaattgtttgataaccttatgggaaactattctaaacagttattcaaatactcaaatagctattgtaaacagtttatatgtcactcaaatagttatgaaaacaacgaggacatgttcccttgaaaacaacgaggccgagctcagcagcgcgagcttgtaacccgagcgggggcattaaggtggtgtggacgttgccgtatggctgcgcgcctgggttggcagtgccatagatggcccgcccgttccaagttgcgtagttgggccggcggggcttgggcgaaagctctgggcctcacggttcctagagtggcaggcattgcgtgaggctggcttcataaaatccactctctacccttattcgtggtttgattgatgaattacatgggcaacgcaggtgatggcgttcctggcgcggccggacaagacgtccaaggtgaggcggttctggaactggtaccaccactacatcgggcgggcggcgatcctggtggccatcggcaacatcttcctcggcctgcacatcgcgcaggaggtcagcgcctacatcgtctcctacggcgtcttcgtcgccgtctgggtcatcgccgtcgccgcgttcgagatgaaccgctgctactccgacgacgactgacccgtccctccgtccgtccgtccatctccgatccattctcgatcgatcacggcgatgatgcgtcgtcctcagtctacagaggaacagggactaatgggcacaccgcgttcacgacaagtgatgacacggcatacagcaaaacacagcgattattattcttttttcctagctctcacacggttgttgggttggacagcgcattttgagaggagtgtgtttaattggttgattattattgaattcttttgtcttttggggtataggaggatacgaggccggggctggactgctgtttctttgcctagctggacgctccggtctggttcgtgtttgtacattggtgcatggtgtcgttggcgtggttgttgtaccgttgtggttggtagttcgttcacgtttcccttcccctgtgtattgatcaattaatggcatcatttgctgattcagctacaaagcttctcccgcctagcttcatgtgtgttggacgattttcttcgcggtttggaagttgaaacaacagcagcatgtatcagtgaaggcgacttctatatcattctattcctgcagcagaagcagcagcaatgcagtagtgagccacaggttcccaaaactggcgttaactggcctaaaagcccatgaattcaaagctaaaattaaaattctgaacctttccccgggttaccggatatcaccaggactaaataattccaggtaaaaccggtaccaaaaacaattgtagctagggaagcaggaagagggacttgtcgacatacctgatgtccacaagagaacaaggtcagatattgagacaggcgcgattgcatatgacgtgaacatactccatggcaccggtgaattactcagttttgcctcatcagttctacaacttacaactgaatgggatctacattctacaggctgcaggcatctaagtgcttcatagatagtctgaaattttacctagatactgcgctagcctatgcatgagtcactcagatacaacatgttattattactgacaaccgccatgagcctatgccaactcacggctcactcctcagagcgtggctttcagatgcgccggcgttctgtgcatgggatgccgccacaattcctttcatcttcagatcccctggcaagggcaacccctcctgcagaagctgctgttggaccgtgctaagatgatgatgctgctgcagatgcatctgttgctgctggtgctgggagtggatctgtagctgctgcagctgctgggctgccagaagagattgtatgtgactgcgctggtaaccttgtggattggcgcctccaaatgaggagaggccaaagtttcccactttgccgcagttggcattaacctgacctgttgcaacctttagctgctgaatctcatctcttagcctgtcatttagtgctacatgcaaacaaggaacagttacaatcctaaagatgattggaaaaacactgtaggagagtttttgtgacacctacaaaatagtaataaatgatctgaagcctatcaaagatgatatcctaagtcataatttgcattaactaatgcttactttcttcatacaacttatatcttgttttatgattttttgttacgtctctaccatagacaaaaggttaataactcagcaaaaggggtagagaaaacaataatatcacttcgatcactaggtgatgaaaaagaaaatatcaggagaaaattgaagataatatcacactatattattccaacgaagacgcaagagaataaagagaaaagaaaacaatacttaataggctcaagtaatttccagttatatatactataaattagtgtgtcatgaagacacttcatttttttttctcaaaatatatggcaattcgattagaattactgcgatgatatgaaaaccttaccatcctgcagcctgacttgttgctccattgtttgcacccgtattttcaaatcactattttcacttgttaaaccagtggtatctctctgtattattcaggtagagataatcaaggatagactcgtggaaaactgaaaagtaagttccttcaaaaactacataatctgcaatatgttaacagtatcaacctgtaggatacaaaaggtgtatttgcagctggaaaaaataaatcagatgttaacatcctaactaccataaatggttactgctcagatagaggaaacagggtcggggtggcctgtgggtcctttcacaacccatctcaacccttaaatatttttagcacaaaaaaattctaaatttcagcccaaacctttttggacccaaccctcacattttgtaggtcaaaatgatgggcccattaccacccctaggtatgggttgtcggaatttccagaacaagcagcagtgcagcactttgtcaaatagcttcacttgatatacaaccagcatgaaatttagaataacctacaagtttagtaaccttatactaacacagataataggaagcctgccaggtaaaaaatgccaagttaaaagcataggcatgtacctaaataaacattttcatggggctgaggcatttgtctagtagagtagaaccaactgctaaacattggtgtagagtgtctaaatcatggatgcacaaagtatgagataaggtaaagccaaaataaagtacctgtaacatggacaactgtgctgatagtgtagttgcttctgtctggagagtctgtacttttctctcaagctctgcaatgtagcgcatctttctttcttttgacctagcagctgactggcggtttgccaagatcctaaaatgtttcaaaggagtaaaagaattaactgaagtcaaaacccaaaaggcacacaaaaccaatttgtaagtgagacaaaataatcggtaaaaccaaataacctcagtcaaacacagtctagatagctgtggaaaattggacttatgaattatttgaaaacacaaactgacatacagttaaaaaaaagttgagctaaattactgctgataaaaggggctaaattacagttaaatccatataatatatagggcccctctaagtaggggaacgcagactaaaacaaatatataattgtcaacatcacatattccaactgaagatattctccaatgtgctagtgaattaagaaccatctataaggggcaagggctattcggttatatgatgagcacaccaacatcaccataagcacttatttgcatatcacaccttagatgtgagattaacaacacaaatgacggtccttttcagctttgttaaatattaactactactgtacactataccaaacctgctcagaaccaaatttcccttcatcaatgatagatagagacaggcttagtagttagtgctatactctgttttatcaatagttcaaatgtagcagtatagcatgatttccaatgtatgattcccccacgttaaaaatcataaaatcacggattccacaactttcttactgttcacacacttaatcttgtgacttcgtaggtttgctttcgtcagaatcacgaacacgctaagtcagttaatctgtccctatcaaacgccgcaatgataccctattccccaattcttaccgtccaaaaataccacaaaggtgacaagcattcaagcaagcgaaactaaggggttctcacttctcaggccagtctctctcacctcttggcgcgcttggggtcaacgagggcgagctccgcgagcttggcgtcagagatggccttcttagcgtccgcgcccatcctccccgccacacccgcggcggacgacgccagggacgtggacccgtccatcgacatgctgtgctggtgacgcggccgagcgggcggcggcggcagcggcgccgcgggctccggggtctcgagcttgcccccggcctcgaggaacatctcgaacatccggctgccgcccgccccctccatctcctcctcctcgtcatcctcctcctcctcctcgtagtcgtccccgccgccgccgccgacctccccgaccacgccgaggtcggcgtcgaaggcgatgtcgtccgggagcgccgccccgaggaggatctccgactgcgcgcgccggtgcctcgccgcccgccgcggcggcgagtccggcatcgcggcgacgtcgcgcgacgacagcgacgacgactccgcggcggaggcggccgggtccattggggggacgggagatctgccaccggggagggtaatgcgggagcggaggcgggcgggggcggaggcggaggcggcggaggaggcgaggcgagggtaggcggggctagcggcggatggggcggggagacacggagaacggagaggaggaagacatgctctcgttgagctttgaccgagccattgactctccggagaaaaggagaagaggatgcgacgtggggcatgagtggccgcgccgttgggtggtgggcctctgatagtagggcccagtaacctggacttggtgggcttgagacctccgaatattctggactctgccatggagctctccctagcttatcatggggaaccgggaactgggccagggatgaacatttcacagaatttgcgattaattgttgtgcatactatatggaagaataagttcactttgactcccttcaaagttacccgaatctaatccgtgaccctcaaccgtaaaaccggataggacgactccccgaaatattaaaactggtgtaatttgactctctcggtggttttgaagggcagtttcgctgacgtgacgcatacgtggcggtattgacctagtcttctttccgcgtggcgttgacatggcagttatgtagcactcgaattaaaaaatatgtcactcattttttcattaaaaaataatatgacacccacgtgtcatcctccctcttccatcattcctcctccctttctccgttctctctctctctcctcacgccggcgtcatggagcccgactccccgtcgtcggcacctccacctcgccaccgtcggctgccgccaccaccggtcgcggcgtccacctccctgccccccatgtgggggcacctttgcccctcgccgctgcagtagctcggaggcagcgccgcttgggagaagaaggtgcgggcctctgcgggcgtcaggcgctataccccgcgcgtagaagtcgcggcggtgatgaagtccgcttttgctgctcgggatctgctgctatttgcttattgcttgatgaagccttgataagggcgaacgagcttctggttgctagctcaacccgacaacaagctgctgctgcttgtttgcttgagcatgaactgaacaaaaagaaggtttgctgtgctgttgcttctaccacttggcgtaggaataaccgaagaagagtagaaggtccacctcgccaccgccggcgccctcccggcgtcgtccttcccaacctctccttcacggatccacgccggggacctcctccgcccccagtcctctcggcgcggtggccgaacgggcggcgccgcacttggccatcttctgctcgagctagagcagctcggcggccagattctccgccgagggctcgccgaacccctcgtccaacgcagcggtggcggtggcggtcggcctccaccaccgcatccgttcgcaccgcgcgcacggccaactccatgcctggggcctggccacacccctcgacgccggtcatgagacgcgcgcacggtcgttcggggaggacgacgctgggagagcgctgacggtggcgaggtggaggcgccgacgacggggagtcgaggagacggggatccatgacataggcatgaggagagagagagaagggagagagggacgaggaaggagggaagagagaggatgacacgtgggccccatataccggtgggtcccacatttttttaatgaaaaaatgggtgacatattttttttaattcgagtgacacgtaaccgccatgtcagcgccacttggaaggaagaccaggtccataccgccacgtatgcgtcacgtcagcgaaaccatactccaaaaccgctgagggagtcaaattgtaccggttttaatagttcagggagtcgtcctatccggttttacggttgagggtcacggattagattcaggtcacttttaagggagtcaaagtggacttattccttatatggaggctttgggcacccacattactattttttcccctcgatgtcttgtttggattgtagccactctcaaccttatcaaaatattggcaggcaaaaaattggtataagttggttgttttgtttgatgtaaaaattttggtaaagttagttcaaaggttttctatccttaacaaaatactggcatcccatatttttcggtaacaaaccaaatagcctatgggtactttgctattactaacattttttttgtatgattgagatttgagaatagcgttgaaccaaaacataccccgtaatgtcaacaatgaatttggtatggataagatttaagaatagcattgaacgaaacacacccgtactgtaggctactttcgtacgacaagggtgtagcgatagccatttaattcaaaaagatacgcatccaataaaattacctgatctcaatagaggccgagtttaggtccaaactttttcttcaaactttcaacttttccatcacatcaaaattttcctacacacataaactttcgacttttccgtcacatcgttccaatttcaaccaaacttccaattttgacgtgaactaaacacacccagaactatggtaggaaagcaccaaacacaaacaaaaacaaagggggcaaaacaatgcatacactgtgcctcatttaagagaaccgcagagggtaaatcttggcttcccattccaatattccatcatattaggctaaacagctatagattacaaaacatgccagagtttgaaggtgacactgctgtagaaggaaaccatgtcccatggcagtatggtacatgttccaaccggctgatttggagaacggttggaaggtcaacaatctagagtactagacggaacatgctgaaaggaacagattagatcaaggaccagaggagctacacaatgaacgaacagaacaaggctggcatttttattttagctgtctattctaaagagctcttgagactactgaggatatatgttcattcactatcactagttcactactgcataggtacagttggcctggggagcattgagttgactagctcctcgtttatcttcactggtagcggtggcatctgcttcatgatatctggagcatcatttatcctgcaagatcaacgttgcatgagaagcagaactaaattttttagagctgtcaaacgttgcataatatccggagcatcatttatctgtgtatgcttcccataagtaagatcttaatagatttgactgtcctgtaacatggattaccagaaaaatctacagaaaatatccaagatccatctactgataaattttcagtcagaaaatgaatgaaagaatgcctgatgggaactgcaaagaggatcatcgttccaaattttgatg

SEQ ID NO: 74198 - DNA, 1515 bp, Oryza sativa
tataatcgacatatgccaaacgacatggctgataagtgcaagatgggtgatggcacatgcctaacaaattagggcaatgtttatttcaatccatgccaatgtgttacaatatattttaggaccttcttatttcaatttttcgaagtttctatctcctgtctccacttgttcagctaaaacttagcttattttccttggctctgataagggtttgatgataatcattgtcatataaaagagttgtattttactatgataatgtggatgcacgctgtggacgttgaagatacgattttctttccgctgtataatcatgcaattcttcttcctgggcttagcaccaccaccgttatcgactggtgagcttccttggtatagctccggtcgttgttagccatgggcatctactactcattcaatatcaatgcatagctagagagaggagcgttagattgatcgcttgctctcctactctagatagagagccactggcatgcgaattgagcaaagagcattgcggtggagtcccctcccaacgaatggcgaaattcctagcgtcaattgaaaagatgggtctagcccttatctattatgctattttggtcaataattcaatagacattgcttaaagtgaaatttacttttgtatattgacatattcttaacagaagacctcattttttttagcatcgacactgttccatgggaacttgagaaaaggggtttagaattgatgaattttcctagttgaccaatttttttattggagtgatacctcatcacctgttggaacttggaagaggtaacccgtgcatgatcagtagatgcaaccaccgagacgatcgaaatcggcttcatccaacatgcaaccaaccaaattgaatctcgtttaatcctagcccaattgatctaaccaactaagcaacctctcttgcatggttgcgttcatctaatcaggtcaagcctagcatggataagacatacgcgctagaataggagtgcatacacctaaacacgccttttattgttcttactacaaaaaagagatgtgtttacagtgtacatgtgcctctactctacaaaataggaatgaccatgacatttttatgttacttacaaggtactagacatatctcccactaaaagggttcattagtgctttttctttagattagagactaccccacatgtcactcacaacctattgaagtgttgtgtttgactccatgtccattttagtttgggtagagcggaatgcaacaatttctcacatcaagctcaagacgacactagtgatctatcactaagtaaggaagaatcacatttgtgtcaagttgttggtttaaaagccatagaaaaacgaacgaaggaaaaaaagttacgcgtaaaacttatatctatgttattagtggtttaaaattaaagctaaaaatagaatagatgaaaaataacctaaaattacctctaaaattaagttctaaaatataaattttagttgcggctgataagccaaca

SEQ ID NO: 74199 - DNA, 1140 bp, Oryza sativa
tatttttaattccttattttaattatttttaaattatattcctacttcgactcttcttttattttctaatttcggattttattttatttttattttgaattttagttaatctcgtattgggttcttatatggacacttctttcaatattacttatttttaatttcaaatttcagctaattttagattgtatttctacttggactcttcttttgattaatgtggaaatttctagcccccacaacgaacgtggtgccttctttcaagactgttttaataatataatagatagtatataagacttttttcatatataagttggcattgtgtggttcttatgggtgaggatcctctaccataatctcactatcattatagtcactagtgtgggtctcacccttctattgccacacctgacagtgtttataataataatgttataatggtaggggatgtgaacccgtttcttgtgttggacggggattataggggagattacttacaactaactccatgaaacgtcgatcttccgtacgtataggcattgatatgcaccttctagcagaggtccttaagtaaattaaatcctgcagaagccaacaaagagatcaccgaacgcgaagcagttgaaattaacctagaaaaaacacggagggaattaaaggatagaaaaccaaccaatccccaccggggatggctgatcggcgatcagtcgcgcgcggcgcgcgacgcgtggtcagtacatacatacatacatacatacatacatacatacatacatacatacatacatacatacatacatacatacatacatacatacatacatacatacatacatacatacatacatacatacatacatacatacatacatacatatatatatatatatatatatatatatatatatatatatatatatatatatatatatatatatatatatatatatatatatatatatatatatatatatatatattgtatatttatattttttgtgtatatgtataaaaagtatatacacaaatataaaatttgtatacgatgtatacaaatacaaagtttgtattcgttgtatataaagtttatatatgtatgtatataaaatataccaactttatatatatgtatataca

SEQ ID NO: 74200 - DNA, 4983 bp, Oryza sativa
tatcccttcaatacctttacctacctaccactcttattacttttttttaatgattaaggatattttagtcattatcgctctccactattttcattttggaatgctaggaatggttttttttttacggagggagtatatatttaaacggttgcagtactctacaacagtgcatctcgtgtgagatttcagacttggaactaaacaagtgatcctagtcaggcttcacctcagaccaaaagctctaaataatttcattcattattaattcgtcaacaagaacagaactgtcattgcagtaagatctccagaagaaatatccatcaagtttaattaaatcagtggtggtgatgctaaattaaagcacatgcatgcatgcccaaattaaagaggataaacacatatctacttagtgacatgatgtcatttatctagtaatcttatgatcttatctgcagtactcacttctaggtataaagtaacacagtaagcatcgcaggaaaacgatggaaagcaaaaaaggaaaaccactaagtgctaaagctaaatctacctacgagatcaaaggggattagctgatgagctgatgactcacccacctgatcggctgattcacagatctcacaaaaggacggccatggtgtggcatcttttaattatgattgggaaattcaaacagaaaacaacggttgtcaaattatccgagagtcaccggcgtccatggcgaaccagcttcgagcaagagatcttaatttcatcagagattcagagagacacacataccaccttaattaacacagctgcagctaagctctgttcagatttcagatatccctacatgaacccaacaacaaaattcgcctaattaagaaaacatgtgctatcaggtctcaagaaaaaaaattaatcactgaatacaataatttcttcagtagtttcatgcttttggcaaccagatatatatgtacgctcaattgttcatgtcactccaaattgacatatacatgtataatacacaaacatcttcagcttcaggcttattatggcaaccgaatatattcatgtgtcacgtacgtatatatacatcccataccatactgtccatacagtatatgtacacaatacatgaacaagagcgtgttaggatcgtagtttctccattaattttgccatcccagatgagcactatgaaaaaaaaacagtagtacaatctaacactaataccacttgcagagttgcaggtagaccagaacaataatctccggtctccagcaatggcagggcgcgcgatctcgggatcgaaccgaatgagctacctagctagagagcctagaagcggtggccggagacgacgaggccgacgccgtcgtcgaagttgcgggagtagctctgcaggtcgtacccgaacctcgccgccgccgcgccgccggcgtgcctcttcgacgacgaccgcaacctcgacctcagcttccagtacagctgcctcaccggccgcggcgccgccaccgccgacgacgaccgccgcctccctgctacgccggcgcccttcgctgtcgccatcctcctccggctgccgtacagtccgtccagaaacgccatctcttctcactgacaaaattaagatcactctctcgatcgacttgctgtactcgagatcaaacacaagcctaggagtttttgcaaatcttgtttcgccgcgctgctgtgagctaagctagcgtccctcacctgcggcttatataaagctcgcaggatggctgggcatcatcgccggtggcggggcccgccggccactcaccggccggccggaatggtccgggctaaagtggatttcaggtatctttttttctctctctctctcccattgccgctgtggtcaaggacagaaacaatggatggagatagccaagaaagaggaggagagcatcgtagatataggctaagccttttgctttagaggtattcctccgtttttaatgttacaagacattttaactttgattaaaattaaactgctttaagtttgactaaatttatagaaaataataataatattttcaactcaacataaatttattatgagaatatattcaattgttgatttaatgaaactaatttgttattataaatattactatatttgtgtatagacttagttaaatttaaaggagtttaacattgatcaaagttaaaacattttataatttaaaacagagggagtagctaattaacctaggtagcgtgagcagtgaggtgggaaatggcgatcgaacgcggccgtctccatcgcagcataaattaaaggagagcaaaagctatgttgatcgatcggaataatcgatcgtttggagatagatcagtcggcgtgtcgaggcgcgatcgatcgatgctcgctgccgtcctgaaatgttgtagtggacggcgaaagcggaagcagccagatgcatgcgtggatacgtggccgagatcgcgatcgaactgctgccgaattgaaatgttgtgcgtgaaacttagggtttgaaagtccggccggaatgaaatttcggaccccatacattattatttcggccgatttttttaatttttttaatttgataatattttgttcaaatttgaccaacatttgttcaaaatttcagaaatttcggatcaaaattttagaaatttggtatatccgtgacctccgatagaatcggtcaaaccgaaaaattaaaccccgtgaaagatatctatgcagatcgatgtagtcattatattcccggccgtacgtaggcatctgagcgccactagctagcgtctgaggcatattacacatctacacgttttacaattgacacagcaaaacgtgggggaaatataatgtcacatgaacaatgagagagcttgcagctacagtgagggttgtacaatggtcgagtttaggcgagatatctggatgttgccatgctacgacagggcttaatttatgcccgtttggctgacatgacggtgtggccgtgtctcttgttcaaacgacgacaatctgtgtgttcagttcagatatcgcgtggtcggtcgttgctgcgaacgaatgcactccaaacagggccgtgcacatgggcatgcggcccatgcgaccgtatagacctccaaatttttagggcctcagaaaatcagcccaactgaataaggcccatgcatttgtgtgaggccagagcgccataaccctgttcgagtccgcgcgtgtctccgcgcggcgacttcgcgtgcgtggcgcttcgtattctcaactccgagccccgagaccccacggcgttttgtattctctttcgtttttcgtatctgtgacttattcagttcgtctcgagtctcgacgtcttgtctcctccgagcagcaagccaccagccggctcatccaatttcaaattttcattcaaccagcgaatagcaacttagcaagcaaccaacaagtaaggcactaggcagcaagccagcaacaacaacgaacattctccattttcaatttgacagtttctgattatgcaaaacaagtgataaaaaatatactattcttgatatatcgcatttgctctgcagtatatatattattttagttatagtttgtatcctcacttagtgttttgtacagggcctacaaatttaacggcccggccctgacttcaaacagctagctaggaccatggctgtccacgttgccgatcgagaaaggttttggtgatgaaactgaattagtacagtaaagcataactgcataagcactctgcactcgttggagcaatatgcatgacagacgatgatatataggcagagagctaggaaagacaatcgcgatgaggaggaaagtgtaggaaggtgactagggttcaccataccaccggtaaccgcgtggttaccgcagttaccgggtttaccgcgtttaccgtggaggtatggtaatgtaaataccgcggtaaccttcttaaatttaaaaaataatttaaatttttgatgaattttacacggttttttacggttaccgcgataaccgtgcttaccgctggggcgcggtaaccctggccccggcggtttgggaaaccctaaaggtgactgcatcaaggcgctttacgcgcgtgattgaatattgatggatggttactgcttcctctggccggtgtatttgacgtttagggagaatctatctatctattatattattaaacagctttgaaaggaggcaccacgttcgctgtggaggctagaaattcccacattaatcggagaaaaagaaaaaaaagaaaaggagagtccaagtagaaatacaatttaaaaaaagctgaaattcggaattaaaagtaagcaatattgaaagaagtttctatataggaacccaatacgagattaatcaaaattcgaaataaaaataaaataaaatccgaaattagcgaaaaaaaagagtctaagtaggaatacaatttaaaaatagctgaaattcggaattaaaataaggaatattaaaagaagagtccatacaataacccaatatgagattaattaaaattcgaaataaaaaaaataaaaaaatcgaaattagaaaaaggaaaagaaaagaagagttcaagtaagaatataatttaaaaattaactaaaattcagaattaaatataagcaatattgaaataagagtacatataagaacccaatagtagattaactaaaattcagaataaaaaataaaatataatctgaaattaggcaaattaaaaagagagttaaagtagaaatacaattttaaaacaactgatattcaaaataaaaataaaaaaatctaaagaacacaatacgaaaaataaaataaattctgaaattagaaaaagaaaaataagatatcagctagaaatacaatttataaataactaaaattggtgataaaaaaataaagattactaaaagaaaagaccatctgaaacacatgacgagattaattaagtaacatgcctatataggaga

SEQ ID NO: 74201 - DNA, 5245 bp, Oryza sativa
attaataatactgtgtagctctaggattcgtctttataaaatggctttgggcaactaagtgacttttaaatgccgttacgtgaaaacttacccctatcttattatccccttgtactcctttgcattaattgtgcatctccggtgtggcctgctgagtactgtggttgactcattcttgctcaatcttttccccccttcagtaagagaagctttgaagaagaagtcttaggtggagtcctggcttataccccagttgagcgcctgtgaagatggagccgtaggcccgctagtccgctgctgtttatttttgtttgtcaggcctaaagtacctttgtaataatgtaaatattatcgatataataaagatgtgtcttttataccatgtttgtgtggtgtacccggcttttcctgggacggggattaatacactggtgttcgggaaaaggcaattttcccggtcgcgacaagatggtatcagagccatctcgactgtaggataagccaagtggataaaacctaaggacatattttataaataaaactatttgcgaaagttccttttttttctccttcccctaatgctatttgcaaaaggtttactcccttcttccttcttcggatttccactagtactagatggttagtttgcgaagaagaagatgtcgccaattgttcgccgaagctccggaagactgcaggatccgctagcgaagtggaggaagcagtgaagccagctgtgaagcagtgaagatcttggagaacccgtcgcagaacctaagccaccctgtagggtagtgttgttagtcgtgtgttccttgcttgtgtgtgtagcgcgtggtttgcatcggggggttgtgatgtaaccatgctaggttgtttgcttaatcaacttgcagaataagtgaaacaaacaacacatcaacaaagagagttagttcctttaaggtcctgtccctagttctggtctattctttcctagcttgtttcctctctcacctcaatccctgtaacagatgtttaacagagaaaaaggaaagaatgtcagagggtatgcctccagtaactcaagttttcaactcaatccaccactggcctcaagagagttaaccagggcacacccttggtccattccaagcatgccgcttagttcacagctaccattggttggaagtcaagaccaaaatcagtatgtgtttgatcgagcatttgccacccaggtcaatgagcttccaatgccagaagaggatgtccccttttgtcacgattgtagagaacaaggacactatgccctgaattgtccatgggtatatgccaaagaagccccttcctttggtttaacagggcagacatcgctaaaccagcctcctcgcaccaagtcaagcttgcagcctagtgtgcaaagtagagagcccaatggagagaatccattgaatcccgggaattgctttcctcctagcccttcgtaccacgtggggtcacgtactaagcaagccaaaggcaagaagagtaagaatcagaagagaaaagcgccgatgcgaactgaagaagaagtacgtaagatggctattagcagcaccgaatggcctcccgcagggataactattcctagacgtcaaagaggaaataccttccgaggtgcacgacagttgacccagcaccttctaagccatggtggcagagtatctgatagtgaagggtcagatcaagtctcctcggatgatgaagatgagtctccccgacatctcggtgaggaagagatggaatcaaaagcatgtatccgttgtggagaaattggacacattgctagcatgtgtctcacactctgcgcttattgtgaagaagaccatccaccaggggagtgtcccacccgcaaggtcacatgctttctgtgcgaaggtacaaatcatgtgcccaaggattgccaactcagtgtgttgttgaccaagaccgcagaaatccaacgaacgaccctacgattgtctcgtcagctagtcagctccaacagcaacatcgacgatatcatccacaacaccaatgctcctcctgctccacctaactctgcaataaatcatagcaataatatctttagcaccaaccattctctgcaccgacagcctcagcaaagagttgtcgtcgatggaagaagttgtgtctctccccgacctactccaggccaagcaaagggcaatcaacctcaggagggcgataccaagcagaaaaccgtcatccgcttcaaccagcaatcagaaggaagcttctcctgcgaatgatagcattatgcagtcctatcacatcatcacagaaccaatcaaggatgatgcagtcactagaacaatgccagctatatctctccggaatcaaaatgagcagccatgtttgtggttttcagtttgctacttatcattgtgtaatcgaaagtatgcagcaatcatgtaataaacaaatatattcatgattttaaacaatgagcttgctatgtttagggatgattcatgttgaggatacaatgtaccaatgataagcaccttccctttttgtttaaggcagtgccttgtattcgtgtaataagggagaaatgggtaatacagacaagttctaagaggattcttgtggaagatgcggatatgtgatcatatgtataattgtttactgacaaggagacctagggtctcgtgtcagaagaactatattataaactcgagttaataaccaacctgttgatggaaaagaaaaccaattaaactgtgttgggttaaaaagccaatgagacagtagttggggataggagtttggatacgccttttacagatcaagataaggattgctggatgaaacccataagggtacccgccatgcctctacattgataagttcggatatacctgcaaacagttaagaagatccaggagacatcaatatttgagaacatagtagtcgatggttggtaattagtctatcaggtatcagaaaagggtcaaaggtgatatggcagaagaacaatttgggatgctccccatctcgaggaagcactaaagatgatcatcggcaattaaaccctagtggcatagatacagatagcaagcaacgtatttccttgaaggtagtcagtgcagctttttgacgaaccacatcaaggtttcacggaaaggcagcaagccaaaggacctcatcgtccccagaagcgtccgcaatccacattaaagaataccacctgttagagataagccgaaagatgattgataaaagagattggcaaagacgttctccagcatgaaagaagtaggccgaaaggtgattgataaacagaaacatgctctgcatcgctcaaggaagacccctgatagtaattgccccgcaacagtcaccttgtcattaagtaagcaagatgacctaggtaaaagtgtttctatgaaggcaaagagtgaaatcttcaactcggtatcagatgctgcacggagtgaaaagtgcaagcaccggttaccaggcaacaccatgtcttgggagattgtcacgcccagaaattcacgaaccagaatttctaagctgaatgtgcattaaacccctgtccaggaccggccagggtacacaaacgacaattgttgacatacagatccacgtcttacaaaaatataaaagattacaaatgcagcggaaaaagagaaaagcgagctaagcctgaagacttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgacctaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaacggatcgcaccacacttaagggttcgcccccgtccccagcagcaaacggcaagcccccttttcgtgccgcggtgaatccggcagccgatcaaccggacaccccggccgacccaattccatcacgcccaccctcgcctgggtacgtcggctagagaaaagctacactacaagcccagccgttgcccacgctggcttgtggtaagtacgataaattcttccagggcatcccgcgaaccggtctttaatcgccatgggcacgtctagcaaaaccatgcacccacagcccaccatgtagtgtattttaattagccaacaccattgcggtggcactaatccaaagctattgccaataatcaagtctatgctttaatgtggtccccttttgtgcactagttgaactaagcatggctaagcatctcctaaaccaacatctagtcattttaatacccaagttatcattggcataagggaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatggaaccacagcaacgtcttcgagaaactgcggatcgacgaaacgggcgaaatctacgcgacaaacaaagcacacaagcaaaacatgctataagactactgaaacaggaaacaaaaccatttttaatggattctacacatttttcttgatttactgagacttgaatggacttaaacggagctcggatgaattagttatgaattttagaagattcactgtgtttttactaataaagaaaaagtccttaattaattattgcgcaatatattccagggctgacgtcagcacggggtggcgcggcgccgacaagcggggcccaccggtcagcggcccggggagagagaggggaagggcgctggtacacgggcccactcggcagcggctcaagggggggg

SEQ ID NO: 74202 - DNA, 26736 bp, Oryza sativa
tgtatacgtgtatacaaactttgtatacgtacatatacaaactttctctccgtatcttttttttatacgtgtatacaaactttgcctacatgtatacaaactttttacacatacatatgaaaaaaccgaaaaaactggaaaaaaaatatggatagaaaaaaacggtgcaaaaaaaaacgcggaaaaaacagaacaaacaaaaaaaaaaaaggaacgtgcgggaaaaaaggaaaccgaaaaagaaaagaaaccgttcgaaaaaaaacacggaaaaaaacagaacaaacaaaaaaaaaaggaatgtgcggaaaaaaaggaaaccgaaaaaaaaaaaaaaaccgtgccaccgcctgtgccactctccacgcgcgacacgtgtccagtcgcgcgagagaggacgcgcgcgactgatcgcgtattagcgttctcgatcccgacccgttcagtctgggtgaaacactgaaacctccaaacgccagtcaccggcggcactccgaaaaggcaagtcccaacccgttccagcccaacccagcctccgcagaagagcccaatagattcaccctcatgggtcgccccgccggcccactttgcacgcgagtattgcctgcgcagcccaacactcggaccgtacagcccacagaaaccttattgtcggccaaggcccaaaggcatctcaaaacactcgaattccggtccgcggttgcacaccacaagacagtcggcagaagagttttttgactcctcaatccattgaaccttcctgtccccttccttgatgcaggttggtaattacaccgaacagcgacgtctcatccaagtacgcttaaatatctcgttcatttcaacattaactgctcctgttcgtcgaatgcaaaatcggcagacagagaccggacgaccattctcgaggctaaaaacgtctaacgttgaacaaagcaaagcaagtaattgccatgtacagatgtactcgttggtgatgacagtgacggaatccccatgttgacctgctcgtctactaacccaaggttagcttatccggtgttgattaaaccggcggcgaggtagtagtagtagtagggctttgctctggtcttgcaagttaggttagtgattagtagcagcagaaagagtggaagatttagaggataagggatagtttggtcatgtcggatacagccttgtcgggcgcgccgccggcggcgaggtcggaggattcgtggagtcagcagcagagctacaacttcagcgggcgcgtgctgctcacggccgtcgtgatcctgttcgtgatcgccgtcgtcttcgccgtcacccgcgtcttgctgtactacctcgtggtgcggtccggcggtggcggcggaggccgtcgtcgtggcggcctggcaggggggatcttgcggtcgttgaactcgctcggcgtgagcggcgccgcgggctggacgcgtccgcgctcgccgcgctgccggtcaccgcgtaccggaagaacggcggcgggggcggtggtggggagggctccaaccgcggcgggcctggcgccaccgccgccgactgcgccgtgtgtctgtcggagctcgccgacggcgagaaggtgcgggagctgcccaactgccggcacgtcttccacgtggagtgcgtcgacgcgtggctgcgctccaggaccacgtgcccgctctgccgggccgaggcggaagtacccaaggcgagggcttcggcggcggcgacggcgacggcgcagtcgtcgtcgtcgctcggtgacggaggaattaccgtggtcgtgaccatacacggcggctctgacgaagccggtggcaggtcaacggcgttgactggtcaaccgggatcctcgaactctcctagctgcgaggctgcaaggaattgaggatcgacgatgacgacgaacttcagagttgtgatgtgattctttattttgctataggagctctatcaagtgtagattgtgaaacgcatttgtgatgtgattctttatttctttcccatatatagctaagaaccaactgcataatacattccccgcaaaagaaaaaaaagcaaaagtaaagtgcttctgtggtaattgttacgagttttggtccattgaatatagtcaagacgattgcatagctttgacatttgtgcaatacccaattatctaacacctcatctcctccctcctcactcctaccctgccgccatgactcaattgagagtccacttgatgccgccgcttcctctgtcgtcgtctagccttattggccggtcagaatgcgccaatggtgccagcaaggccccacaaccggcctcatcccctttcctagctttccttgtagttggccaaatgggccgcccggcccggtccgagcacgacaaggcacggcccgatcgatacgtcgggcagtgttgtgcccgcccatgggctgcaccaacagctcaggcacggttcagtaagaagggtcatgctgggctgggccgaaggcacaacaggccggcccatcgttctccttggaataagtctatttttcctccctcatctcttgggttgtgtcttatatgggtataaataagtctattttgaatccctcatatctttgggccatgccttatatggctagaataagtctatttttccttcctaatctatttggcctccctaatcatttgacctggtcgtgctaaggaagaggcccaggcatggcccagctttcgggccatgccgtgggctgggccgtcgggccccgacccttttggccatcaatagctctcatcctcctcaagctgatggcggcgaggtggccttacccagccatcgttcacgtctctagcagctcccatggctagattagccaacaccaaccacatcctcctcttaggcacaagcttcagtttgcccttgccgccaacaccgacccactaccttcctccatccccacggcttcatcatcggcaccggctcctcgcctcctgcccatgtcgatcgcccaacgcttggctgcctttttccatggtcatcactcttaagccaaacgatgttctccctctttcccctccccatttcctctctcaccccaactcaataccctaaagcgcaactcgcagggacatcgccggatagaagagaagtgttggggtcgctggaacatgaattgtgaagaaaatcctaaggttagaaattttcaaagttttggtctcaattttctaccaacaaccatttagcaattctgactatagaagggctttagggattgatttccatataagttatatctcttcacttttgttggtcaaatttgtcttctcatcattatttgttagatactttcatgtttggctttttatcaaaaacaatgtgattagtagttgtagcttctgttgaaacaaaggttggattttatatagagtaaatttcactttaggccatcattttattaccgatgtttcactttggaccactcttttatctattatcttaaaaatacatttgtcagatgtaaacaatgcatttgtaaagtaaaaacaatataagttgcatgtgactacaacataatttctatgtgactttcacataattttgaactattagatttgctttgagatacatgaaagaagggaaggaaaaaatcaccgtgtgcaaatgggtgaggagatttgatgatgcaacctccacttcacaagagtagcttgttactatggtatttttgaaagtttcgtataagttatactgtagttacatgcaagttacatactacaatataaatgcattacggttgcactacacttatatctgacaatttttttagagaaaatttatcgatagatattataaatagtctcagatgctcccacctctccttcaccagttaccacctttcaccgcctacattgatgattagccaccacgcaaacctacaccaccatagctaccggcttgagctaaacttttgcttccatgctgtttctctctttctccctctcttttcttattacatcctcagattgtcagataccaaacgaatgaaactatcctgagaaaaagtaagattaatcaaccatatcagttcatatctaagaacaaacatatttgagaatggacaatagtaaaattagggatgtacttcagaagctgtcggaaggaaggtaggaccttcctcttccaccaatacaactgagacctccacgcggttctaccgtcgccaccacaaatgagtgcacatgtatgagtgcacaaattggggcgaattggactggttttgtctggtgtcttgttctactcaagctcaacttgacccattggcattcttacacctttaactaaaacccaatgaaccggcttgacccacttacagtggtttggtttggattgggttgacaggttaattggtttaattttcaaaaaccatgaacaaccatacatacatgggcaaagtctttctgcataggctaacggaataccatgaagaaagaggaccagggtggcatttctttgataaagtaggtgaaatcccgcgtgttgttgcgtttctttgaaaaactaggtgaaaccccgcgtgttgctgtgggagtttagtatgataacagtaagtaaaaataatgtgtaaaatagctagacaacataacattacgtaagttaatgtggtctatgataatttaaatttaaatagtatatagaatgatgatttaaatgtaaaagtaaggtgatatgactttatgaaagaagaaaagtattgagatagtttggaccgtagattaatcatctaaaggataaaaacagttgaggtgatatggcttaattaatgagagaagaaaaggtgagagataatttagaccatagattaatcatttaagcactaaaaacaattgatgtgatatgacttaatgagagaagagagaaataacattgacgaagtgaggatgaactatataggtacatagcatattataaaaaaaataaagatataaattgaaatattatgtgaattatgtgggatgatgatttagcatgctttcattttaaaagctctaaaatttaataattataaaataatagataatatagcttgttcgcattatgttcaaatttgatgattgttagtggatgatgatgtggcatttttgcatattaagatttaggagttagtgggttataactttatagtaagagatgattcgattgtatgatagtatttatttttgtagaacttgtacttgttgatgatagaacatagattctaaaacttatcgatggcaaaacctagatttcctctgaatttttattttattctgattttcatttagtcgtatatagtatttggctcgaatttttcagtttttttctatttttaatacggaattagatatttttaaatcgatttttcaacagggatttactacatatgtttcaaaaggcgtattttattttgttaagacaataatttaatcaacagttgctctattagaatattatttgtgtaataaagaaaatattagaatatcataagcaattagtttttttatattaataaattaattttgtgtgataaaattatatcgtagagtaatcattggttaaagtcttgacctaacgaaacaaaacacacctatattttaagatgaaagtaataatattcttcgtctaatctaaaccatcatatataattgtctcccatgctaatataagtgatatatattttttatttggtttatttgctaaatctaagctttttagggcgaacgtgaacacataattttatatttccttaagtaagataacaacttgacaaattctcatagagagagtgtacaaggttttcatccttgttaacctcaagggtaaacggctcaaggacattatctgatgaacttcaaccacttgcatggataagactaattatggagtctcttgaaacttttcattattgcagtttcctctgtaaaatctttcattttttcttaaaaataaagtatgataattaatgcatgcggtttgtcagttacttgtgccaaagcattccaaaaatagcaaagatccaacactccacaattaaaggtatcatataaaaggtatttaagtattgctatagatacttaggtaggaagggtaaaaggataattttcttaagagatgaaaaatgacataattgtcgtaatattagttggaggtacattgataccgcatcggtagttcatgaccatcggatgctctaattctccattgcattatttgcgtactttttttgtgatttacatattgtttctaagaacacggtcgattaaaatatcaacaaattattgtgtggtttcacgaactttgtggttggttaaaatatccaatctgagatattcacgaactttgtgtcgtattttgaataagacgaatagtcaaatgttagtcaaaaagtcaacgacgttatacattaaaatacggaggaagtagtttactgtgagcagttttcaatgaagagcatcatcatgtggaccccacctttctaacccctcccactaaaaggaattctagaggcgagacaagtttagttcacacgtgccctatacagggtatatctacgtgcatgtaacatgcatgcgtagtggtacgtgcgtgcgtgctcattcttattgtaaaaaaaaaaagagagaaaaaagttagttatcaggcacacattttacgagcctaaaattcatcaaaatcaataaaaccacatatattattcgcattgcctcaacaaacaaatattattttgccacgagtctaaaatttatagttggccataaggcccgaggcccgaaggcccggcccacggcacgcctttttggcccggcccaagcacggcacggcccgacttgggtcgggcccgtgctggcccggcccgaccgtcgggccgtgcctgggcctccccaccggcacgctgggctggcccggcacggtcgggccggcccggcacgatgggccggcaggccaggcccggtacataaagtatggggactaaaaatagacatataaatgtaactgtctaaagaatagggaccttaaatagacttattttagctatttatataccccagcccaaagaagagggaggtaaaatagactttttgtagctgtacatatgtcacagccaataggagggaggaaatttagacttattctgaggaaaagcacgacggcccatcgtgccttcgggccggcccggcacggcccgaggcgtgttgggccgtgcctgggccgtgagtgcggcacgtgggctggcacggcacggcccggtgcgtcggtcgggccgtgccggcccgacaagcctcggcccaggcacggccgggcctgggccgtgccgtgccgggcggcccacatggccaactatactaaaattcatcaacatcaataaaacacatatattattctcattgcctcgacaaacaaatattattttgcctccaagaggcctaactaaataagctcaattatcgagacacatcagcattttccaaaatgctatctaagaagagacagacagacagacagacagacagacagtcggttcctagttcctcagaaccatgcaccagcatcaccagtaatgttgtttccccaaccggacgaagacgcatgctcgacttccggcaaagcagcttcaggaacaccaccaaaatcaccagcaggaggaacgcccatgttatcaaccccggagccgaagtagatctgtccatcatagagaggagaggcaaccaactgttggtagccgaacgggttgtcgtcgttgcctatagctgcaaagcctgcgtcgccggcgccagcggccaccggctgtgcctgtgagagccccacgttctcaaacatgtagtcatagttttcatactcttggggttgctgctgcacggccagatcttggttatactcttgtgctgcaggtggcaggtgagcttccaaaggcatctgcaatggaggtggaggaagagcatgcacagatttctgatcagccattataagtgattcttggaacaatggagcctcgagtgggaagtgatcagctcccactggcatcagcaatggcgttggtggaggagcatggaccggtgcttgatcaggcatgagaaatggttcttggatccatggagcctccagtggcatgtgagcttccactggcatctgcaatggcgtcggcggaggagcaagcactggtgcctgatcagaaaacagaaatggttcttgcatgaacggagcctgcacttgcagtggcaggtgagtttcagccacaggcatctgcaatggcgatggcagaggagcaagcgtcggtgcatgatcagagaatagaaatggctcctgcagcaatggagcctgcagtggcaagtgagtttctgccacaggcatctgcaatggcgccggcagaggagcaagtactggtgcttgatcagcaaacagaaatggctcctgcagcaatggagcttcctcccgtatcagaggtagtggtgctagctgtgtgctgacctgtgccggaggcggagcttgctgtgattcaagaaaggatggctccatcccggcaaaccgtggtggtcgcagcggaagcagaccagcccatggcgacccctccaccggaggtggaggcagctcagggatccagagagaccctcctgctgctggcggtggaggtggaggtggctgatcagcgacaaatggcggcggcgccacaggaagcaactggttatgaggaccggacagattcggccattgcggcagctgcagctgttgctccggctgcggcggtggtggcggcggcggcggtggaggtggcacgctagagccctggattggccgcttgccaccgcgacgacgtagcgggggtagccgcacgttgagttccttcttgatctcaagcatctcagctaacagttcattcatctcgtctgagctgagcttgtcggccttggagaagaagagcttcttcttcttcgtgtcaccctcctcttcgttctcctccttcttctgggccatcttgaaccgagctttggatgctttcgtcgtctcatccttctcggcagcttcacccttcagccaagccagctccctctccagcggcgcgatcctctccatcagctgctcgtcggcgaccggccgcgcctcagccgccgcctcctccacgtcgcttgagagggcggcgtcgacgacggcctgcaccgtcggcgtcccgaccgcgtggaacttgctgcggttctggtcctcgatgaccacggcgacgctagcgccggtgaggatggagaggtcgctggcgcacttgaacagcccgttccgccgcttgaagaaggtgatgtcgcgctccctctcgtcgtcgacgtacgccgcgccggtcctcctcgccctcctcggcatgatcggcgatgaggggatcgatggaggtttataccaaaaagagattttgtgagagaggcgaaccctaaaatggaaatttaataaaagattagtttatagtgatagacatataagctagatctaaaaaatataaacatagctagatctggaaaaaaaattatagctagatctacactcttgtttctggatttaattgcttttaatgttaagtggttccaaatagctagtatatacataattatatagatgcatctaccatttttgttaaaaaataaactatggacatatggctaagcatacatatgattcatgttaaagaagagcatcattatcaaaattaaggaagatgtggctacttgggtaagctggagctgcgaagctccgtgagtttccttcgttaggagataactcctgattttttttaatcattttacgggcatgatacttgatggcggatggcctgtgtatatatatatattttaccgcaatcgttcactgctctattaatacaaacacggtaaaacttttgtcgcctctttaaaaaaatgttagtgaacatctaaaattaactacgtccatatagctccactactctatcaatacaaacacggtaaatcttttgtcgcctttttaaaaaatgggttaatgaagacctgcatctaaaattaaatacgttcatatagctatgcatagatatgaatcatgtcgaagaaaacatgcatctcctctaatggagaacaggatgtttaccttagctagggagattacagagatctctggtggagaaggaaaccattaagcgagagctacaaacatcttgccaccttgttggagaccagtcatggtgagacaggcatccgaaaggagatggaagaaactactaaatgatttcttaagaggtatatgtggctatagcaagaatgagctcgatgaagaacaaagagggggaggccgccttcttatatagggaaatgaggggtgtcataataagaagattttatccaatgtgtttttgataaacatgcaaactatagaaatcctaccaattgtcactgacaggatggtcatccttttacatgggtatggtgggtccatttgtcagtgaaaattggttctaacgaatagtagcattatgtataagttcaataagaaaacattacaatgtttcaccctatgagcacactaaaccactcaaaattcatcacagtatggatcaaccaagtgtgctaagaaaactctattttctatgaagaaatcaacgtaaaattgtagctccccgcttaaaccctaagttcacctagcagcattaggtcgggccgggtttcccgggcaaagacataatactatttgaatgatgtgggtgcaactaattattaagaatagtccgttatgtctaaagccaacggtttcgtataatgattagttgaactataactatggtcccacgttaatataatgtggcgcttcaacatcgtaaagacatggtacatagtaaagttattccatttaagttgccacaatactaaaagttattctttttttttctaataatagttctcttccaagcaacctaaggctattttcggcaccccttttctgaacgactcttcctcgttttccgcttgcacgcttttcaaactgcttaatgttgcttttttgcaaaaaatttctatacgaaaattgcttaaaaaatcaaattaattcatttttttaaaaaaaattagctaatacttaattaatcacgcgctaatggaccgcttcgttttctgcacgaactgttccggttaggaacgtggactagcgaacacagcctaaatcctaccagtgtccccattcaatacacaaaattttcatagaagattattttccacaagcaatacttccagcgtgttgtacaaaataggaggccacatttcgttctgcctgtgtgattccaacgtgtcatatgcatttcagacgaattttagccggcacaaactagctcatttttatcttccagtaagccgtttcaatcttgcaacgccaagtcaacatttttgtagcagttactagataattgcgtacaatagaagcgtctgcattgtaccgtaattcccctccgtctttaaccccctcttttttgaggataaccgcgtacgttttcttctgcctttttatagggtatataataatataatcttgtacgtatacagttttagatacagagcttggatgaggacgaaaacgcccgttaccaatcacagccagacgcggtaaaaaaaaagacgcgtaaaatcaatagcaagcaaataaattcacctcattccatatctgtatttactaactatagcaaacatttattcgctttcacaccagtaataaaggtaccgaaaaactgtcaacggaacggaaaatactgtaacggagctgaccgctatcatcatcataggaaaaggtaaaactgggaaatgggctaactgaaacctgtgggacgggcccatgcgaacgcaggccggaccgtactgctaggcgggccgccaacttgggccaaacaaacaagggcctagctggtccaaaccaagcgacaacgtggcaatccaagcgccagctcagcacacacgtcgtcttctcgtttaaacagaaaagaaacgaaggtcaacattatatacggttcgttactaagttcacggtctcacaagtcacaaaagtcccttccttccaccaccaccaccatgtcgtcgtcaaatggcacgacgacatacttgccgggaggagaggcggccggcggcggcggcggcggcaactccggatgctgcagcaccacgacgttgttcggcgcgttggccgcgtcgttcgccctgagcttcttcctcatcaccatcttcatctgccttcgagcactccgcgttgctcgtcgccggcgtgatcgtcccctggtcatggagcaggagcagcggcggccgacgccgcctaggttcggcctagacgccgccgccatcgcgcgcctcccgtcgttcccgtacgtgcgagcccgtgacgacggcgaggtctcggactcggcgtcgtcgtcgtcggtggagtgcgcggtgtgcctcagcgccgtcgacgagggggagacggtgaggcagctcccggcgtgcgggcacgtgttccaccgggagtgcatcgacatgtggctctcgtcccgcgcctcgtgcccggtgtgccgcgggaaggccgcgccggccgacgagctcgccgacgccatagtcgcgcgcatagcggtgacgcccgacctcgtcgggccacgcgtgtctatgtccgtcgtcgtgccggttgagatgctgaagggtgaaatggtgggcgcgtcgtcaacgtcgcgtgccgcgtcggcgccgccagagcagctcgatgcgcgagcgcctggcccggaaacggacttggagagtaaatagcagtcgttttccggtgagccttgtaaactctgctttgtttttggatttacaaaatttgaggagcgtgaaatgttgtatatatgttttgaaatttacattagtcgcttcttgttcatatttacttattattcttctctagtttttagcatcgttgcggaagtgcatgcagctgatcgattgaattatatcatccaccagatattcagattgagattcgatccagtaggactctagctaggaggtgatcgacacggcagcacgtatgtacatttacacacaaaaaaaagaaagaaagaaaaagcatcctaacgtgcggttaaaatgttgctttagtcccttttagggacattgttttttgtaaagatgttttcagacatagttgaccatgcaaacatgaaattaaccagttaacttgaaaccacgacatgtacacgctgttttatccccctttgaaattttctccaataattccagtaaataaatggtgtctgtaatctgttgtattgttagaccaagtcatgcaactttctttatggcaccactcgcaaaattttattgatccacagctatcatattcatgtcgcacctccctgatcaggcattagaagctgcaaaatgtgaattggcaaaatgaatttgttaactcatctgtgggtatgatcatccaaagtatttgaatccattttacatagtacaacatataactttcaaaagaaaaaaaagatatcgttgttttggtggagacagatttcgctcaatatataataggaaaatacaggaaatgctaaagaaaatctgacagtaagcaaaacaatatgttttttaaaaaggaatttagaattcagctgtcgttgtcataattctcaacccttcaatcatttcaaaattaatcaaagcaagatcttgaagtagtattaaatctattcacttacccttttgatacatatggtagcgaaatggtagagcccatcgatcaggctgtgtagtttttttttttttttgaaaattcaccggatcaggctatgtagtcttcctaccctctccacttcccttgcttcatcgtatttaaggtcatcgagtattttttttaagataatagaataaaacatcatgatatttactcaatcagctacaaccaattattataacctaacactcaaaatgagtgtagtttaaataaatataaagacaccaataatgaagaggaaacaaatcaaaaactaccaacccaatataagtagtacacaattatttaattctatttgtgaatcttcatctgaaattggcaaacagtactcaagataaggtcattgagtatgcgtattgcattcataaaacccatggcaccctccacatcaacaaagttactctttcaattgctaaagaggtatccctccactcctcaaataccacacaaatagtcgtgaattttttttaaaaaaatatccataaaaatcattacaatgtgcacctgtggattcgaacctgatccagacacactagaggatcagccgcttgtggatatggttcacaagatatcggcagccgtcatggaaggggaagctcatggcctaggctggcaggccggctagttttcgtgcaatccgttctttcttctatcccggtgcacccatccatgacgattggattgtcttgtctcctgaggtgatcgacaagagacggcgtgaattcctttggaatggttcagatcataccgagtccatggcagccattgccttgtcgcctggcccaaagttttccaccccaaggacttcgggggtttgggcgggcgtcacggacctccaagtttatatgggctgggtgctgtggattcgatggctgtggttgcaacggacgaacgatcctgcctagaggccgatttgaaggcagtccatctccacaaagcagcagaaataatatagcagtggcacaatgaaagcgaagtgaaagcacgattcacacgttcctatttactcgtagccatcagagtagtatcactcacaaacaagctaattctgtcaagggtcaacatgtaccacaacactgttcccctcccccctcattcccgccgcaggttgctccctcccatcaccacaaacatgcataaaaccccagaaaaagacacccaacctattaatttatcccttatcccacactcgatcgatctccccccgcccaaacgtctgcatgcatgcgcgccatgggcgccaatgacggccacctcgacgccaccagcaacaacaggggcggcctgcacgagcagaccaccaccggctgcctccccgtcgaccagtcctgcttcgcgctctcccggctgtcgtaccgccgcagcagcagcagcaacccgcgcgcgtgctgctccaccacctcctacctcgaggtcctcgccatctccttggcctcgctgctcgtcatcgtgctcgtgctctgcgccatacggtgctaccgcatgcggcgcgcggtgaaccgggtcacggtggcagccgcgtcggcggcggcggcggcggcggcggccgggaacgtcaccaacaagaagcggccggcgccgggcctcggcgaggacgccatcgccgcgctgcccaagttcgagtaccgcggcacgggcgacgagtgcgaccggtgggagtgctcgatatgcctctgcgcggtggccgacggcgaggtggccaggcagctgcccaggtgcatgcacctcttccaccggggctgcgtcgacatgtggctcgtcgcgcacaccacctgccccgtgtgccgggcggaggtggtggtcaacaaaccgccggacgaggacgacggcaggtgcgcggagacgccggaggatgaggccgcgccgccggcgtcggcgctggagccggcgagattggagaatggcgagagggacttggaggcgcaatagcagcgtgacagagtacatgaccgcgcgtttgcgttttcattctcaatcttttccttttcctttgggtagacatgtgtagtttttgcgccccattacggaggtgatcatttttttaacaccgtttgattttacgcaagcggtcattagaaaataagaaaatgatagattgattctcattagaatttgcatgtaaaaaagaagaagaaacatagtgtataatttgaagtcttgaacgaatcaatgatgaaatgtaattgctccgttcggcatcagctgctgtggatgcatttagctacgcagcacaaccggtttgaaaaaatgtgtgttggctttcctgtaccaattggcagccatcgcttctgatttctgaacattcccattgtttgtatgtcagggacttgatgaaagtaggctgtaggccccgttattttctgatgttcgggctaatagcactcctttgaattattgtgggtacatttttcaaaccactaaatgttttagataatgtaaaacattttcattatttaaaaatatacaagttttttaaaaatatataataaatgtatttttcaaataaatataattatattaaaaacttgattaattttgctcttaataatccaccttgtttcgtgtgcggttagtaagctcagcttatcatctaaaatgaaatggggccttaagcttacgtgcttacggcccaaagccgagaaaagcctggccctcagatcgattgtagcccaaaatgaagtggtttagcccctactttttcgaagactaatttggcaccgatcgattcgaatgttgtacatgtatagatcttcaaaattcaaatggtacaggaaatttcaagcatacaagtaatacctatactaatattaaactttcctcttatttttgttaataaagatattccagctacggttatatgccaaaaatgacttttcttttgcggaattaattgcggggaataagatgtattactaactaacttcactgtatatgaaccccagtttgttgctccaagcttaccagttcccagtagtccgaaatcaaaataaaccaaaccagctggaaaaagattcctgtcatgtgtccaattaaggctttgttcatcgtgatgattgaggagacaccctctttatcttatcagcttgtgatatgtaatagtactaaccttggcttatggggcccagttctctaatggagtaggcgagtagcagtaatggaccatttagccgaatgccaacgccgaactacaacacgtatcgttgtgctttgggctaatcagggttcctgaacctgatttttcttttttcatttccccctcaccctggcaaaggcccacgcagcgctaaccaatgtactagtacgctggcacgacccatactgaagtagtactaccactaggattgtacacactgtcatgtcctgtgcactcttcatgcgaccattactcgcccgttgtccgatagcgcggcgccaccgtactcccccctcaatccaaccgtcgtcgcgccgcacaccggccacccaccctcctcgcgccgtcgcacgctggcgcgcgcgcgcccactatgtagcattgcgcgtgacggcagcaatggcttgacttcccaacctcgcgaacggcccaacacttgcacgtcaacgttgccatgccttgccgttgcttaacgccagaactcaagtagtagtagtattttattggacctattttagtcggcgtggccgcgtggttgcctcgaagatagagtccgaaaccgctgcggcggcgccgcccgatctgcgagccaagtatcaaaaaaaacagcagcgcgcgcccgcccaattcgtgtgcggcgaccgttgatatttctcgtctctcatctcaccaccggtaggcgcgctccaagaatctcccagtagctcactgcctctctcggtttctcggttctctctcccccccagctgcagacaccacggtggcgtgccggggcgagacgtgtttgtcgtaatggcgacggtgggcgccgtggacggcgttgaagttgtgagcgcactgatcggccagtactacgacgggctggcgctggagctcgtggtgttctccctcgccatcgtcgtcctgcggtacgccgcggtgctctacgcgaaccacctggtcgacagcctgagcgagctccaggcggcggtcggcgccgggatcggcggctcgtcgtcgggaggcggcctcgactccgccgccattgcgcggctgccctgcttcgtgctccctccccgccgcggaggtagtgcggcggcggcggcggcggagtgcgcggtgtgcctgggcgccgtggaggaaggggagacggtgcgcgcgctcccctgctgcccgcacgccttccacgcccgctgcgtcgacgcctggctgcgcctgcggccgacgtgccccctgtgccgcgccgacgtgccggtgccggcgaggccgacagctccacgacgcaggcacgtgcctcgtggcacagtggagtgacgtttgctcgcaaattgatcccacgcgaattcacgcgagagcgggtgagaaatctcacctcgacgatctctattgttcattctaattctagttcgatttttctttctctttctcattcgtagtacgtacagaaagcgttttctcgctggtgtaattttatcggtcaacagaaagagagtcgcaactcattcagccattgtttgttaatttcatttcatttatcttggactgttgggcctgttccgttaaaaaaatagaactagttgtgttttacactcaaggcccaaaaggctctaacaaacaagcccatatgtgactactagtctatttcttgagggaataagttcatctaaggtcccttaattttacaccgaatccaattttcgtccgtaaaccccaaaaccagatacaaacggtcctgaactgttaaaaccggggtaaacgagatccctcggtggtttggaaggtggttttgactgacgtgacgcctacgtggatgaattgactaggtctctgtttcatgtggcattgacatggcgctgacgcgacgtagacgtggcaattatatctcataaaaataataaaatccgtgggcccacatgtcatcctcacaccccctttcttccctctcccttttcttcatcttcttcctgtaggcgagcgaggctgcgaggcggcgacctcggcaacctcaccgccgccgccgcctcagctaccaggctcctccctcgccggaccaccgcctccatcctcctccccctgcgctgcctctgcgccgacgcagcagccagcacgaggcggcagagctcgttgcgacggcgctccgcacggaattccggccgccgctcgtggctcgtggcgaagaggcggagcacggcgtcgggaggggagagcacggcgtaggcggcgagaaggcgggtcgccgcgaaggcgtcgtcggcgaggcggccggagacgagcatggcggcgtggacgacggcgagctcacgcggggtcgtgcaacggtcggccaggagggacaggttcggccggcgccggacgccgctgcgggggaggcgggcgttgacgactccgctcgcccgccgccgcgcccctctgctccatgtcccggagctgccgctgtccccgcgcctcactccccccggggcacgcgcgtataggaaaggggaagaggaacgaaggagctaaagccgtggcgagccacgagctcgtgttgtctagtcgcttcaccaaagccggcgtcgtcgcttccccatcaccgacggcctcccagagccgagagcggagggcgacgccgaggtggaggacaacgccggaggggacaccagaacccgattgttctgcaccacgaccaaaatcatgcagcaaccaagcaagagaaacaaattaatcagcatatggtgaacatttgaaaaaaataaaataaaattcatgtcgcgggtgcactgcaccagagcgtacaccatcgtgcgcggtagcgttcagcagcaccgcgacgtgctcccggaacctgccggcgacgaaggcgtccaccacattggtgttgttcagcggctactccggcttgttgccgtacccggagacgaagtccacgtcggagaacaggagctggaagcggcctgttcgtcctgttcatggcggcgtcgaacacgtccctgatgtagccggcgcagaggaagaaaagagaggggagaggaagaagggagaagtgaggatgacatgtggggggcctacgtgggccccaccattttgtagttattttttttgtgtgtagctgacatgtgggcccaccgttttttattttttccaagatataattgccacgtcagcgccacgtgggatgaagacctagtcaaaccagccacgtaggcgtcacgtcagccaaaaccgccttccaaaccaccgagagacattgtttgcaccggttttgacagtttaggacaagttgtatctggttttgaggttaaaggatgaaaatcggattcggtgtaaaattaagggacgttagatgaacttattcccttcctgagcaataggctcactgtacccactactacccagggccatttcaacttgtgccgtcaacattcagcggcagcatgtcatgccatgccacgccatgccactttgatagggcataaaccgggccagcttgtgcgcaaatcctccaacgaatcccggcggtaccttcgtcacattcacaacggcggaaccagaaactgagggcggaaaggtagggtgggacgtgagtgcacgatccattgcttctctttgagaaaaagaagcgattttgaccgacaaaaggtaaacattttggggacatgttcagaagaggggagggtcttaaccctcacctttcgtgtcgaatcattgcagcttgaagaagatagtgagatcttttcctactactgtagtagtacatgggcttaccggcctctgtttggctaattttgctggaagagaatttagtacagatcttatcttcctgtgggcagagatgctagtgcagcatctgaatctacgagaaccaagcatagcgcatattgcaatagtgtccggagtcgctaaattctccttgtgaggaccttcaggtcatcaggtcatttccattcttttttccgtgtttgtggttaaactgcgtgctagtttattctcttctttttctagtaacagaggcatcttgctgaattgattagaaccacaggaatcctgaactcaacaaatacagtacatgtacacccgacatcagcatgcttaccatactaacgtctgaaaaggacactagtaaacgcgtgatactgatgcgttcatcactgtaccattcttaatcacttaaaagcagaagcaggaaatgcatcatggacctgtcatgaacccaaagaaagaataaccatccgaacgctagccgtcagttttgctcgtctgcattccataacctgtcaattgtcaagtctgcgtgagctccttggcctcttgcccgtgtcgatgaaaactcaaagactacctgggtgcacttttccgaacccttttgacacacggatgattaagtgtcgtcagtggtgccattccagggcaatcaggtgctgcacctaacagccagcctctgaatcaatcactgtccattttgcagtcaccagctgacacatgaccatcaagaatttgacgcttcggcagtactggaaacagggtgaaaaatgctacactgcaatactgctctactatttcgatgttgagattagtgctcctttttgttaacacgattgagaattttagtacttcaaatcgacttgtgattcctaaatcgatctcgcgatggccgctcgctaattctgtgtgctaaaaaggctaaaaagcccaaaaggcgtacgtgagaccacactggaatattgatttgcagccgagcagcctccactactgggttagtgatgcaatcaatgaacctttcttatcatgaaacaaataatgcagcttgttaaattatgaccactaaagtgctaattttctacttcctccgttttacaatatcagactttatagtattatccatattcatatatatgctaatatgattaatgttagaaagtctcaaaccgaggaagcaacgaggaacgccaaacttatcgacagcttcttgacggcatcacgagttcacaacggcttgttgacacggagatcatattattcatgctggcgtgcataaacgtgcaaacctcgctgatcagcgctagttaacaaaaaggacaaagctatggaaaagtattagtggtgtaatggtaaagtcatgggtgtattagtaaggttagggattaaattatcgttattctctgtttatttaaacgttatttaaagagtgtatttacatacagttgtgtgagtgtactatgcgtgcgtacgtgtcttatgcgcaatagagaaaatgaccaagcaaagcatcatgagtcatgacaagccgctaacccaagcaaaggatattcagtgataaaaaaaaaacaaagtaattcaaggttagccaagtgcgcatcaagaagccaaaggggttgaacaccaaacgccacgtcaactcaactactggcataaagtttccttccgttcaattttagcacctcacatttatcttaaaacaaatttattttcaaatatagttattgcattgagagtttatgaaagtagaaaataattatattggtaataaataaagtgagaaatagttgtatttggatttgataaagtaggagtatttagttttctttatatatatagagtatattggtatgtgtgggataaatgagaaatgaatttattttgagacgaaggaaatacatatataaatttgctgagtttttagattaaaattatacaataatgtttacgtgcatggactacttcgagagtatacgaaggctctctttaaagaacttaattttgagaaacaattggttggtaattagtttttagaagtttaagaatctgagatattgagaaatccaactcctaacttttagttcattttctagattctataactataatttttcaaaatatgaattgaaagctataccttttaggaaaacttttgattctaagggcctgtttggttcgcgaaaagaaaattcgggtttcacattgaatgtttgaccaggtgtcggaagagattttcggacacaaatgaaaaaactaatttcataactcgccgaaaatcgcgagacaaatctttttagcctaattaatccgtcattagtacaagtgggttactgtagcatttatagctaatcatgaactaattaggctcaaaagattcatctcgcgtttttccctctaactgtgcaattagttttttttaattaatatttaatgctccatacatgtgtccaaagatttgatgtgatatttttgataaaattttttagggactaaaccagacctaagagaagttatcaaaagctgtcaaacatgctcatattaaccgtcaacaagttaaacccttctgtcacgccccgaactagtaccgaccggaactagctcgtgacgctccaaattaacctgttgatcgataccagtcccaggaaacagtgctggtatcacagggagacagaatatcacagcaacagcggtctcttcattatagagtagggatacagtcatgttgggctacggacagatcccgagctcacaactgcattacaaaagggaaacggaagcaggacttggaccaaacaacacaggcgcgacttgggaactaggccgaaaccctaaaactcatcgtagccggcttgctcctgaaagaactcctcatcagcaggatccgcttcatcttcttcagcaactggggggggggaattatttatatagagcaagggtaagtacgggagtactcagcaagccaagggaaaatagatgtttaatgcaggcttcaaggaaaggctgttgtttttgcagttgattttatttgaactctttttctaaaaacaactaagtgagtgcttctcaaacgacacggttgagacggtgcgtctcgtccggtcggagtatgtgcaatgtatcagtctttaaaatttaaaacaaggttggcacccggccaacagcttttcaaacggccacccgggccaacaactttcaaacggccacccgggcctagctgatcccatcagctgcagatttttcaaacagcgaacccctttccacaacagcaatttcacaaccagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaagtgcaagagcgggaaaaccgtacacccggtacgttccccggtccgcggttttagaaaatccatttagttcgcaagcaccgacccaggtgtcgggttttccaagtcttttgtaaaactcaagttttacccaagaagttgctcagattttaaatttgaaggcgcccttcggtactcgcacagattgcacgatttcagaggcgcaactgggaggttacaagggaacatggtataacaattaacaaaggaaggatcaaatgcaacaaactaggtagatccgccaatctgccttacagacgggacaacagattaagtgcgatcctatcaatgcataatattttgcaagcaacataattaaatttcaaatataggctcaagatgttcaaaggtggcttgccttgctcgaggtctggagcttgatcctcgaaatcctcgcgttgcgggtctttgggctccgaaactacatgcgaaacgggacaactcaacaaacggcgaaaatgaagccctaataatgacctctaagcgtgccattagatagatctcgagatttgaggaattttggaagttgaacggagtcaaacggatctacggttgggaagatattgaatttctaagattattggatttttggtctaaaggaaaaggatttaattaaatcctttttggaaaagaaaaagaaaataaaaggaaaagagggagggattatagacttctcctcgggcggctagggcgcggcccaagggaaaaaggagcggaccggccgagctaaatgggccggccgacccaaggcggcccaagtgcgcgcgcgcgggaggggaggagagagagggccggtggaccgggctcaccgtgcgcggtcccgggtgggacccgcttgtcagcggctcggctcaccgtgcggagggagcacgcggcgcacgcgcgcgggcgggggagggacgcggtgcacgcgcgcggtctgcggaggaacggatgcggcaggcccacgcgcagcctcacggctcgcggtggaacgcgcgcatgggaggggctgaccggggtcggcccgtcccgacctcggctgagctggcgccgacgtggcgcctacgtggctgccacgcgggccggcgggaggtagacgacgacgccggccggaacggacggcgggcaacagcggcgagcggcggagcgaaccacggcgataccggcgaaagcgagcacaccgggtggttgcacgagacgaggggagacgagccaatggctcggattcgccggaggaagcttgacggcggcgaatcacggcggcggcaaccggcggggagggaagagggaaacggcgacgaggtcacgaggggccgattcccggcggtgagagcatctacgcggccacgggaatccgatgctagcgtcggattgggtggagctacgccgagcgaggctggcgacgagcgggtgctacggagctcgagcggcgacggcggcgagcacacggcgggcgacggcaacggtcggggcggcgccggctagctacggggaggctactcgtgctaccaccgaaaactaaggggggagatggagcgaggagaaagaacggagggaggcatcaccgaggtgaggaggggcgctgtgacgagaggccgacggctcgggagtaatctctccggcctcaggccggggaagaggaagaagagggcgcgcccggagtccccttccgcgtcctagtgcgcaccggctcctccggcacacacgcgacgacgaacggtgacggcgaacaggggcgacagtggcggcgagagacgaaaacgagggagattggagggggagggcttgggtttaaatgggcggcaatgtcggtttgggagaggggaaccgacattggacagtcaaggcgcgagctggcgctcggcgcttgcggccaaaacggcgacagggcggagggaggatgacgccggcgggaaggggaaaagaaaaagagggagagaaaagggggcttgcccccatgcttctttggggaaaagaatgaggggagcgggagcgacgcggcagagggagaggggctctgcctccgccccttggaggctagcgcgcggagtggcggggccgaggcgatgacgacggcgatgacggcgggcggtgtggagcggagcggcgacacgagcgacaggcgcggcaggcgctgacgacggcggcgaccaggcggtcggccaccacggcacgcgcgcgcgagaagcaacgggcggcgaccgcgcgggcgcgcgcacgcgaacacggcgcgcgggaagcggcagcgagggagcggagagggaggactcggctcggcgcgggcggctcacgcgcgcgggcagagcggagggggagggagcgctcggcgcggctctcgcgcacgcgcgcgcggcgcgcgggcggagcggagggggagggggggaaagagagagagagagagagcggacgccgggagggagggggagatgg

SEQ ID NO: 74203 - DNA, 12122 bp, Oryza sativa
gcaatattgaaagaagagtccatataggaacgcaatacaagattaatcaaaattcagaataaaaataaaataaaatccgaaattagcaaaagaaaaaagagagtctaagtaggaatataatctaaaaatagctgaaattcggaattaaaaataaggaatattgaaagaagagtccatataggaacccaatacgagattaatcaaaattcggaataaaaataaaataaaatcggaaattagccaaaaaaaaagagtccaagtaggattacaatttaaaaatagcagaaattcggaattaaaaataagaaatattgaaagaagagtcatataagaatccaatacgagattaattaaatttcggaataaaaaataaaaaaaatcaaaattagaaaaaggaaaagaaaagaagagttcaagtaggaatataatttaaaattaactaaaattcagaattaaatataagcaatattaaaatataagcagagtagtggcagttgatgggacatctaaaaactattaataaaacaccaaatacaatcctaatgatgactaaaaagaagtacaacgggcaggtcgtgaagcaatcggtcaaggtaggtggcaggacttctagaaagtaaaaaaataaacccaatgataatcatattagatttttaaaatctcaataataataaaatgagaggcagcggccgggtcgtataggagtacaatggcaaagtcgccgatggttggtgggtcttctataaagtaaaaaaaatgaattccaatgatagttatgtttgacttttacaatcctaataaagagtatgcggcggacgggtcatagaggagtatagtggtaacgtttgatgggatttctaaaaattataaaataaaaatgaaacccaacaagataataaactccaatttttaaaggttcgggcttctaaaaagtaaaaaaaataaaccccaatgataatcctgtttgattttaaaatctcaatgacaataaagaagggcggcagcgggtgagccgtagagtagtatagtgacaaagtcgctgacgttttggagaaacttctagaaagtaaaaaaataaacctaaaggataattatgttcgatttttaaaatagcaatgacaataaagagaagatgcaatggacgaacatagatgagtataatgatagtgtttgacgggacttctagaaattataaaaaagatgcccaataggacaataaactctaaaacatataaagattctaaggagaatgaatagaaaacggtggtagatcgagcaagcaaataaagaataatatgacagaagtaaggggtagcagttgttgtgactttagaaactaaggaaattagaaacacgaggataataaggtttagtctttaaaaatcttaagacaacgagataactatttaataaatttgaagtaaaatcatattaaaaatatataattttatatgggtgctagccgcgcaattgcgcgagccacccagctagtttatttttaaacaaagaaattcagaaattattggtggccaaagttttaaaattaagtttgattaaatcctattttaaacgttaaatatttataacttttagagggagtacgtcctagcgtcctactaagctcaagctgctagctatgacgtaaaaacacttctgtttaattatagtgctatagagtgataacataaccacacatcaacggtcggatttcagacttctggcaaaggaattatacgcagctagtacaactaaacagttccaatttcaggccaattgctgctggaactgtttgaggcctagtgcctagcttttatgttttgttattcgaaacctatattgcgagcttaaatactcagactatgtatctttggggctgcgtatatcctgctgcaggatgtataggtcgggttttaatccattattaaaaaaaattagttatattcattcgtcagcaagaacaacacattcagccgttgcagagtgtacatatctgcttagtgacatgatgacatttatctagcctttccttacgatcttatctactcataattaacaaatttctaggtcgtagtagtgagcatctcaggaaagcgaaaaaaggaaaaccactaagccctaaagctaaatctagctacgagatcaaagtgacattagatgatgagctgatgactcaccgacctgatcggctgattcacagatctcacaaaaggacgacggatggccggcagctttaggattaggaaagtatagttaaaaagcacaagtcaaattatccgagtcacttggcgatcagcttcgagcatggcgatcagattcgagcatgacatctttcttaagctcatcagattcacagaagctgccaccttaacagcaacatttatatctgatcagatagcaccacatgactacaacaacaaacaatagcaatggtgctagttaatcctatgggatttgtatgggtttttttttaccaatttacttatgcattatgcaggatctgtatgcattctatgttctaaacagatcattaaagtttgctaaagcatttatctggcatgtcatatatgatttcactttttttgaatctctcattttcctctgagcctgttggacggaccgagattggtgcagtccttactataagccctatcattttgcttattcgacgatatatttacaaacaaaaaatagtttgtgaataattttttattgtatatgttcttaacaatttaaaagcaaaggctaaaaaataaactatgataaaaaatcataaaaataaactttaaatttaaggttaaaattttaaattttggttgataagcataagcataagtgaaaagatgaacccatataactacaactttagcagttgcaccgcaactgatggatcaaaaaccaacggcttagatcataaaaaaaatattgttcatgaattactgtagcaaatctacaacggtgttgctataattatgtcaacacattttgtgagtaatcacagtcgatttcttgttcaattgatctcccttgagattcgtgctacaattgcaataccatgtgcattgaacgtctttacatatttcgtgttgcatcgtgaagccaatcaatttaaatttctcatctcgtcagcatgtgttttcatgaaaaaactactacatatataatttcaggacttagatatgtaattttagaacttacattataaatatactaaaattacatatgtaatttagagacttacatatataattttagaatttacattgtaaatacactaaaattacatatgtaatttagggacttacaatgtaaatacatgctgactattttttggtgaaaaatatggcgacataaatataaatatagttactcccaatctacaatgtaccgattactgtagcatcgatggtgcggcatgatggcagagcaaatccgagccgttggttccatcgatccaacagttattatgtgctccttgcagtcattactactacagcaccgatctcagttcctctcgacactgatggatcattcacatagccaaagccactttagggctaagtactgttcctagtaatctaggcccaattaaaactctaacattagcagtaaatgggccgcatattgagccgaaagcccaaagcccaaaggcccacatgcctctcgccttataagtagccgaggcagtgaagccctagccgggtcctcgtctcctcgcgccgccgccgccgccgcggacgccgccatgtcgaagcgaggtacgtgcgagccacctctctccccacctccgctccgtctccttcctccgccgctgcttctgcgtcgctgatctggtcttcgcgcgtgtcggaaatggtggcgcagggaggggtgggtcggcggggaacaagttccggatgtcgctgggtctgccggtggcggcgacggtgaactgcgccgacaacaccggcgccaagaacctctacatcatctccgtgaagggcatcaaggggaggctcaaccggctgccgtcggcctgcgtcggcgacatggtcatggccaccgtcaagaaggggaagcccgacctccggaagaaggtcatgcccgccgtcatcgtccgccagcgcaagccgtggcgccgcaaggacggcgtctacatgtacttcgaaggtacgcggaagctgcacccaatttcgcccatgccgatctgtgaaatcgtgatgctctctagtgtcttgatgattagtgttgcattatgacgtgttatgagctgcgttaagtttggtttctaagtattttagtgtgatcttttagtccacctgcataaattagtgtcaatttcattatgggttacacgatttaccatattgagaatgctgatcagttgtggctgctacgattggagcaatgctctatttttttatgcttacgtcattacgtgattaagttacacattcttatgagctacagtgagcttgttttgggggctaggctttaggttgattttacttgaactatcatcaaatctaccagaaaacaccaaatatgttagcaggttttttttagtttggtgaattatttttaagcaaaaatttatgtgtttgcttattgtgagtttgtaacatggcataaaagagggtacaaatattcttctatattttactgtcttcactaggaagatgttttagatggggccttttggttgggaacatgatctttattgcctgacatggtgctggtcctacttttaataactatggtgttctcaaaatatttttcaactggaagatggctggcattacttatctgattgcgctgtataggccaattgctgaattttgttcgttggagcttgttctgttattttatttgcactgccgtaggaaatacacagtgacgggaggactgcaaggttcttcagctttttctggagcaaacttatatacatgtttgcatattcctaagtaaacgtcacaaacaaagcattgttggatgtagaggttttcttataaagattttatcttcataagagttcctccatctggaagcggtcacatattccattgccctaggtagtggcatcgccgctatgaaactttgggactggccatgtgacatatatttttgtcttctgatgccataaatataatacattagcttttattcattctacatgttttgtgtgcttttattctttggtctcttttacattttgagcagcatttcatttgtacactattcccttggctattttgtcattggttttatcatttggagctgccatgtggtctatcgaattaataccggttatgaaatttgatgtgcagacaatgctggggtgattgtgaatcccaagggtgagatgaaaggtatggcgagaacactactatactcccatatgttatgtgttattgtattttctctcgaagcctaccaggcaataatttactcactgtgtattcttttccaggttctgctatcactggacccattggtaaggagtgcgccgacctctggccaaggattgctagcgcagcaaatgccattgtctagagcttgtttggagtagtagttttcagttctgtgccggatgtgataatgtgctccagttcttttttgtttccaaccaagtttaacctgaacttgaagcaaaccttcagttaaattttcagtgcggattgtgtccttgatgaatggaaaatggcatgtttgcttgtttaccttgctccttttaatcagttcacagtcagcaaccagatcgtattctggagaaactagctgaatgaacatcaatctcacctttctgccacctgaagctgcctgaagatttaggctttgttctatgcttccctacctaatctctactcgctcattttcaatgtgccgctgcacaacctctgcgatcagcgacggcccatttgactcctttctatgtacgttctgacgttatgtgatgttctaggatgatttcctctggggttaattggattcatgccactacaaatatgctaaattagaaaaatagcactactatttgtgatatcggttgggtgccactagaatttggagaaattagaaccgtgttactccgttggttttccatccactcctcgttaatttcccaacttcagtgcttggcctcgatgcggcagcgaaggaacttcggtgcttggcctcgatgcggtagcgaaggagctcggtggcagggaaagcgatgacagccttcaagcatgacagtgacaatgacgtttcccaactctggcggcgagcggagcttcggcgacgagcgactagagcggcggtaacttgggtacgcggggaaggcggcgctcggccttgatgtggcgaaggagctcggcggcaggaaaagcagcgacggccttctccgctctcaaggggcacgatggcgaagcacgccgagagggcgaagcggcggcgacgggccatggctgtgcgcggcaagagggcgaggtgatggcgaagggtctctaggggcacaatggcaaagcacgccaagagggcgaggcagcggcaacgggccatggctgtacgcgggcggcgagaggtcaaggtgacggcggcgggtctcaagggggatgatggcgaagcatgccgagagggcgaagcggcggcgacgggccatggttgtgcgcgggcggcgagagggtgaggtgatggcggcgggttgtgactctgtgtcggaggggagaaggagaggcggcggcggactgtggctgtgagtgggtggcgagagggcgaggtgatggcagcgggccgaggctatgtgtaggcggggagagcgtaaggctgcgccggttagtggggcgagggcaaggcggctcggttgtgcagggaaggcggtgctcggcctcgatgcgcgatggtgatggtggggagtttcgacgatggtggaggagatggcagcactcggcacaaacgaaagatggtggcgccaatggggagtagataacgcgacggagtggcatggatccaatttccccaaattttagcggtactagtcgatatcacgaatagtagcgatatttttctaatttggcatatttgtaatggtgaatagtagcgatatttttctaatttggcatatttgtaatggtatggatacaattaacccttttcctgtagcatagtaagagcatcactaacagtccttatattgttcccaaaactgatttttatgtttttaaaactgatttttatgtttttaggtgaaaaatcggatccaacataaccccacacacgttttagagttccttcaccatactgattgtaagggttttaaagtgaaaaatcggatccaacacacgtttcagagttcccttcaccgtactgattgtaagggttttaaagtgaaaaatcggatccaacagatcatctacacacggatataacagaaccctgtttcttccaaaactgattttaatggttttaggtgaaaaatcggatccaacatatccccacacacgttttagagttcctttaacttactgattttaatggtttttaagtgaaaaaatggattcagcagatcccctacacacggatctaacatatctcagtttcttcgtgatctattcttataaaatttaggttttctatgagagagatcagtttttttttctattttcagtttagaaaaccaaaaacaaaattttctattttcaatttagaaaaaaaaattgggagaagattattcgtaatgtcttgatgatgctctaagttcctcttgcgtaattttccaatattctcaatggatgtgcattgttacgacgataaatggtaataactgttaaaatttctgccaacaggattttcaaaagattcagcctttggtaaggaatttcttttttttatctgattctttttttagatagtcgtgtttttagatgccacagatttcattggtccctcacttgtatttcctaatgaagtaatgatatatctggagaacttttgggtcatttttttattttttatttgtgatctttttgggaccttaattagttgattgtttgaatcaggcattctgtgtaaacaaggtttgcataacagttttattcggtgtgcttctacttagcttaattttattcagccgcttatattttgactgaatagattaggtttcttgttcccaattacacgacatgtagaaattactttgacacgcaaaaggtttgcgcgttcgcgaaaaaagacatatagaaattacttcatccgtattcaaatatatgatgttgttaactttatttagtttgttttcagaaaagaaaaagaactttattcagtcaaacttttgaaagcttgatcattaatagctctcataatatttagtttgaaaaataccgtatgtgtagatttttctttactggagcatttacaataatacagttttgttagatagttttgttgtattctaatttaaaaaaaagtactgctcagacttgaacactagagaaggaataaagtcaatagtataatatattcatatagaggtattataccgtcaaacatttgcaaatatatccttttcctttacaccctcagattgctaaaggcctaaatctatattgattttccctgctccaattttctcaaccgtttccaggaccacctcaaaacatactaggcatttcaaaatgccttctaacatcgttaagtacacacgacatttgtatctatacaaattatgcaaattaactctatctatttcattcacctgcaagaatgacaaacaagtgaaaagcagattgatatgacaacagaccgaccctacagcaactccagctgatcaacatacatcaaatttctacaaaattattcagaggtttgaagtaaaggaccggttaaatctgcacaaaatagggtggaaaaaaaaagaaaaagcaattcgagagagtttctcagtgctgtgtcgtatgagtttatatccaggattccactgtgtgattgtacatgtatgagctcatcccgctgatatgcgctagagcgtcagaatcaagcatgtcttctcccttcacgccgccctgcaaattcaagacaaaaaaaaaaggacaaaaagtcctcaaatcattgccaaatttcacttcgtaaatataatcccaagtttcaaaccgataatatcactttgttttaaagatttttttgagggcgttcttggcatttgaatgcttacaatttgttcatactcttcgtgattctgcgagccgatcgacctggatgcctcgcagtagtcgtcgttcttggcgaacctaccacggacgcgaggccggctatccgcgagggtttttctgcaagcgtactgcagattttttttttaaaaaaaaaatctgagatgtcagtaacgtggtcggcggtgaggtgaaattcgtttgaaatatgggttgggggggggggtgatattttgaatttgaatttgaataatttggaagttcttgcctcaccttgatcttcttgctgaaattcctctcgttcctcttcttgatgtacctgtggatcttttccttcctctcctcgttggagaggcggacggtcttgaagctcgtgtcctccaagctcgtcgtctccgtcgtccccgtcgccggcagccgcgctgggctactcccgcctccgcccatctgtggcaccacgaccaccatggtgaaacggtcatggcgtcatgctgcgcgtgcgcgagaggttcttgcatggcggcaatgtcctacctgcaactctgcggcggcggcgttgccgaaggccatgtcggcgccgtcggcggcgtgggtggcgccgagaagcgcgccgccgcattccatcatccgctggtactcgccgatctcgtccattcccatcatcgacatcaccatgcttccgccgccgccgccggccgcggcgaagaaggcggcctgcgccgcgtgcgcgtccttgctgaagaacgcctcgccggcggcggcggcggcggcggggagcatcgcgccggaatgctgctgctgcgggcagagcgggtcgtccaggcccatgtaccctcccgccccagctccggctccagcggccaacgccgccgcgaagacctcgtcggtgaacccggcgtactgcatcagctcggtggcggtgctgctcagctgcgcctgcagcgccgggtgctccgccgccgcgccgcccatcaccgggagaggcatctgggtgaattgctgctgctgctgatgctccggtggtggtggtggctgcgtctcgtcgacggcggagaacgcgtagtcgtcgatggggaggaggagctcgccgtcggcgccgggcggctcgtcttgctcgaggagagccgagagcgtggagtccagcgacggcagcggcggcgacagggtgtcgccgccgccggcgatgggcgcggtggccgtcgacgacgacgaggcggacgcgtcctccgaggaggccgtgaacatgtccgaccctgccgccgccgccgcgttcaccgccgcgaagaggtcgccgccgttgccgtcgtcgcagaagtcatagatgtgctgcgctatcgggctcgagatgccatcctgcaaaaacaaaaacaaaattcagacaaaaaccatcaaaccaccaactcgtaaccatttctttcttcagaaaaaaaaactgtattcttctacaggcctgtgcaatgcaaacattcatcgccaaaatcctgaattgacaaaacggtgatttacagatttgtattaggctatttaaacccatttctatgattcttttataatctctttttttgcaaggaatcaaatgccatactgttgtatttgcaaattatactgttctatctgaaatctgaaatctctgaagatgtcaagaacagtagaggtataggtccgtatgccgtatgctggggggaatgttactgttaggatcaggcaactaatcaaaaattccaatgcgcaatgtcataaagctcgtggagattaggaagcagaaactatcaagtcgaggcatcgattcccatctgtactgcaagaggtccaaaaagcagaaagattttcgcaggatctggtgcccctttccgctttagtatgatagccacctaacaattattgctctagcaaaatctgatcagagcattagcatttgccaattgccattgctatggaatcctaatatgcatgggcaagcagaatgcaaaataaattatcagaccatatgcatgcagaataacaacagcagaaactgctgaaaacaaccatgctgaaactgactgaagcttgcaaataactgcagaattgagcctaatttgctttcaggagatttacggcgaaaggctcgtcgtcgacgtcgtcgagcatgatggatcttgcaccaaggaatgctctaaattgatactgagaaggtagaggctcatcaacggaatgggaatttgaagaggagaaaagctcacgacccatgctaatggcagtgtgttctatttataagcccatgaacaagaagaccaagcaataatccaggctaattatagagccataagagccggagacctaacaagaactagatgcgaagtaaccgtagcacttaattaggacaaaggacaaatatatttacatgtcacatggtgaaaatgtaagtacatatgcccaaagctaaagaagaaaaaaaaaggggaaaacacctatttttgtgcatgttctatgccgtaattcggctcctaacgaacaattaaaccgccctttgtctctccaagattagtttccccttactcctagatcagtttttgaccgagacgtcgtaattttcttttgcgagaaaaaagggatattgctatctagttgattcaacacatgaacacatgatcattaagagataacagtatgtgatatatataggttttcatttttttaaaaaaaaagaatgaaagagttcatggtcgcacaagatataggattccagttcctattgtctttctttgtaattctgttcgtttgcgatgtactcaaacacctcattacgtcttaatgatgcgtattcgccaaaaaaaagaatgtaagagttttgcctgatatattgtttttttatctctgcaatactgactcgatctcagaaattgtactccctccgtcccataatataagggattttgagtttttacttgtaatgtttgaccacttgtcttattcaatttt

SEQ ID NO: 74204 - DNA, 688 bp, Oryza sativa
ctaatgttctttaagcatgacatagatatttttgtatttgcacaaaaattttgaataaaacgaatggttaaacgttgataaaaaagttaacggcgtcacacattaaaatactgagggagtgctagaatgtgacatatggttttttagacggtgggagtatttcactataaattatgagtttacagaattaccctccaccaatagtataaaaagacaattttatcccctttaattttatactatattatattgaagcaggaggaaaaaataatatttttttcgattatttgtactgtcagtataatactgtaaaagttttcttaaatttatggataagatggagatgtgaaaatgtcaagagaggaacgtcacccaggctagcggcttctccgttctcaggtagtcaacgtcagaccaggattcctcgtccagcacatgcccgtcgccttgcagcggccttctggagatcgctgcgtccgacgatgttatgatcacgcgctttcaccgtccccgccttcgcgcacgatctcatcgcgttgagcgttccattgacggcggcttcaaccaaatctttctgccaccatcaacgtcggaaaaaaaaacgaaatggagagcagtagagcacatcaaagttggatgaacatggattggaaacggacgaaaactagctatctcgtagtcagtaggg

SEQ ID NO: 74205 - DNA, 1253 bp, Oryza sativa
gtgccaatatttctaggaaattgtccctttctaaggacaatttcgtttttccccccactttcatcttcaatattgattttgcccctatcaaaagctttactgctaatccatgtatattcgtgacaaatgtcgactatatattttgtacctgtactttgtcatgttcatgtattgtatctctgcggtcttctcttctaaattgtctgcgcacacacagataatacctcagtttctgatctaggaagcagactgatcatcatcataattttcatgatgaatgcaaacttcagttccattcgcacatccatgaatgctttttgcgaaatatcagttccagttccatgaattgcaaagtaatgtgggttcaagcacggtaatgaataaatgctcattgaaaaggaatcagacgaggtcatttcataaaatgggatagttgatggatcatggatgagaaaggaaaggtccatcagcagggagagttcctcagtgtcagtgaaacgttctgtggttatgcggatttgtgctggcacgacagtccgtcaccgtgtgctccagctctggtatcaacagtccattgctccgccagctcgatccctcaccggcgatagcatctgctacaatcattaccgaagccaagagcgacgccgccaccaccggcatcactgattagccgttggacacaatggccgcgtaagccatgcgagctatcagaatgccttatccgacatatagccatcatttaaaattatgaccagtactatacatgaaagcaaagtagcaactcacgagtgttcagttattgctcagttgaataaaatggcagttattgcttccttgctttatcagctaaccaccatatgatttcctaatagcacaaaggtgacaatatactagtaacagtctagattcatactttttagattataatcatgccaacagttcagaacatgcgaagacacctgaatgactttcatgatcatactaatatggtcaagaggaagtacgattcgtagatagcatcgcgatacatcagatcatttgagtgatacagtaaatagcgaggtaggcaagactgattcgcttcgagggatccatggaacatggtggcccgaggtttctccttcagtactttggtgctggcttttgggttgacagcaacccgaatctcttcttcaacaggtatctctggcgtgagtacttgtcatctgaaaaaaagcgagctgcaacacaagcacaacctcagagatcttttt

SEQ ID NO: 74206 - DNA, 578 bp, Oryza sativa
ctcaaaatcccttatattggtacggagggagtagttgattcttgtaggtacaatgagaattgctttgaatatgttattgatgtgcttatctctaatttgatatgctgattcaatggttcaaacggtgtctatcccgggtgaaattttgacccccttttttaaaattttcttgtcaaatatgatacatattaacttatcattgcttcatgaatccggaactaaaaggcggaaagcgaaaagacacactattactttagagacctctgcatacatgcaaggttggtcacatatctaactaagctttggatgtgcgtttatagatatttcaggagaactggatgccaaacgtcatggaaaaaagcagccaagtacatgcatgcctgccagagatgtatatgctcttatgtggcaaattggggctgtaaaatgatgattgatcaataactgtttgcatgcatgaagttgttctctatctaaaagaacaacctggtcattccgtacaaaaagaacacttcatgtaactgaaaaaaaaaatggataagaatagcaagaaactcaggtctcagggctgcaggaat

SEQ ID NO: 74207 - DNA, 504 bp, Oryza sativa
cgtgttgtttctctcccgtttttgcaatgccacggcggccatggtgggcacatttggtacggtgctcccgcgtgcatggtaaatgggcctcatgtgatttgggctgggcgcctgggcagtatatgggcttgatgggctgggtgtaatatttcttcagcgcacaccttctaatttcaattgccttattcaaaattttccacttatcgggaacacctttgcatattttctacttactccattattaaatcgctgtaacatatgcattattccccaccatccataggcacatcgtcgtttttaaacttctctgtacccatgacggggcatacgatctgtctgctttacgattctagcttctctttaagctaaattactttatatttacaactttcttttagagaatttttctatttactttcatgttccctagctggaatcctattttgtgctgtttttcactgcattccgtcctactatttgtaaagcggaatatgtctgtctaga

SEQ ID NO: 74208 - DNA, 8586 bp, Oryza sativa
agatgggccgagagggattcggcccatcgaccccgggggaggcaaaatagacttttgcggagggatttgatttggaaggatttggattcggaattggactcgacgatagatcggggattgagatccgggatggcacggacactagacaacaagcaaggaaacaaatttcgcaattagggttttttaagagataattttcccgctatgcgccacgacggaacgggcgctacaccttcgaggctagcctgtttgaaaagatattttttatggtgcttgttaagaatactacacacgtgacgtagtaaaccaatggaaaataataggggcaattataaaattttcactggtttattcaattttataaggatgtcactcgaatgataattctactgacattttataattttgtttccagtgacagtcttgtaataatgatttaaaccagtggtaaatttatgattgtcccaaagtaatgttatctttaagatttttatttttgtactctttgttaaaaatataaaacgagttgaagtgatcgaaacgatggaaaaagctatgtatctactttgctcggaattcatctttccactataaactacaaaattggttatttttcacaatatttgttagataaatgttttttgatagcacaagctaaataatgtaggtaactttcatgggtgtggacctaaataagtagcatttgaatcaaacaaaatttactcaataaggtataaatagaaaatcgacctcatttcaaactaaaccactacaaaaaaaattaactgcagaattataagtcacggccccaaacaagcagggctccgactgcaagatcgactgcggagcacacatgctacaggcacagcccccattctctcgatttgccttagagcacaatagcagattattagccagctataaatatattttagaaagataaagatgatagagaagagcatcgggctatatatctgtagctagctgcagtacggattccaaacgcaatgtgtatatgacaggtgagaccagatattaatattatagtaagcaactattgtattaattggttattaaatattggttatagatgatttatagcagctagttgactctactattggacttgctctgatagaaaattgcaatcttcccacaggccagggcagcgcgcaagcagccagccacaccgagacggcgtcgcataaatatctcgcgcgcgctcacttgctcacggccccgccgacctcacgtcaccttttgttgcgagttgcgcaccgtgcagctgaagctgccaccaccagctagcactgacccgcctcctcctttatatattgccccggcgcccccctttgccccagcaaacgcgaaccaaaacacaaagcaaacgtccatctccgcagcttgctccggccgccaattacaagcgccccacacccagctgcttcgccttcacgtccacttcaccggagttgccatttccaatcccaaaccaaaggacttcattggattgcgaggggagtggagttgctgtgctgctgctgccgctgccgtcttcgacggtgagaagccaagaaagaggcggaccatgaacacgcccaactcgtggctgttcgcagacaactccaagtacagcacgcgggcgcggctgctgttcatggggctctccttctccatcggcatcctctccttcctcgtctacctcgccatctggtacacctgcacccgccgccgccggagccgtcagctccgcggcggcggctcggcgtccgcggatcaggaggcgcccgaggcgaacagccacggcatgagcgccgccgcgatcgccgcgctcccgacgttcgggtacgaggcctcggcggcggcggcggcggcgctggattgcgccgtgtgcctcgggcaggtggacgccggcgagaaggtgcggcagctgcccaagtgcgggcacctgttccacgccgagtgcgtcgacgcctggctgcgcgcgcactccacgtgccccatgtgccgcgccgccgtcgaaggccccgccacggccgccatcgccaagaaggccagctccggcggcggcgccaccgacacgccccccgtcgtggcaccagccccaccggcggcggcagaggcactgccactgccacctgtctagcttgctgcctaccagtcgccgccgtacgtgcctccggatggaccgccgcgcccgcctcgggaagcgtcagcgcatgattgaggaagtagctaaagctacatgctacagtgacgagactagagtgaaacctagctaggatcgacgtcgtagatcgagaggcagcctaatcaaccaagattttattcgttcgtgctcaagtagctttgtacgtagtacgtgtacataccgttttccttattatagtgatgggtactactatatgaccgaaaatttccgtctcttcccacacaaccaccttgctgatgagtagtgctgatgaaaacgtcgcaggcaccagcaatcgtgtgctcgcgcgcaacggcgcgagcgtcctgacacctttttgtcccgtggcggctacttccgcggtcgcgaacgaacgtttccgttgcacggttccgcctcccccagcgaccagctagcgtcagccgtcagctatacctctcggtctccgggcgccaattcgcttcgcggagccgatcaactcggcattgattccgatggtgcgtgccagtgcaagcgatcgaaaaccgcgtccgccgcagcctcccccgatcctttccttcaccgccccgagaggcaaagcgaaaacggattcgatcggctagaaacgttggtggagtagtcgtcttccgtgggaaaaaaaaaagaaaaaggaaaaattctgtacgtacaaatattttttacaaaatacttacaaactctgatgtgacaagccgtgagtaaatctaaatttcttataatttttattagttaaatcaaaacggttgagaaatatgtgttagtaaaagttttgtaataaaattatagtacgtctatcagtgttaaaaaaagaagatgtgtccaccgctccgagagatcaatttttactgcctgcgagtgcggttcgggtgctggtaggcgagttttatgagcggttgggaacctggaagaaacatagggggtcgtctctcttctctctctcgctgaccccatttgcggctttcgcaaaagtggcggagcctttccttgtcctttctatctctgatctctccacctccatcggtttcgttttgtttcctcgcccgtggctttagcatctccagctagcttgcctctgcatgttgcgtattgctctctctgtgcgctgtgtagttatgatctctgccggtttatctccagctgtggtcactcgcctcctcctcatctcatcatcaattggttcactagttgggtgcgtaaaacacgtactactagtacttcacgctcgatggatgggaagactagtgggtacggtgtacgtagtttgtgccaattaacgagtaggttggagttagcacacgattcaatgagccacacacaccgtaccgactcgttcgatcgcctcttttctcatgctttatatggtgcgaacataccacgatgctgcacgcacctttgcactcgtcgttgcacatgcgagacgcatctgaatctgaccgaaccaaccagagccgcctgtactgtctcctgcaattcgttaatttggtccgccaggaaggatgagcgcgagaacgcaataactgcaagcggtgacgacatgggggctaaagctttagcttacggttgcggcgggcggccggaaaggcggaaacctgtgtgtggctcccgaccgtcgaatggtttgggcggcaacggctgcgtgcccgcgtgagctaagctaagcagccggccgcggccacgagctgagcgcgcggacaactggaaccgagctggtgtgtggcctgtggcctggttgatgatgcgagacgagacgatgagctaaaggtcgtagctagagctgcgtgcgtgtgtgcgtgcttgctttgcttctgttggacaaaaaggaggggggaattcaatgcctcgatatactactcctctccttggcttgttcggtttctctaggttaattggagggagtgcattgatcgtctgatcaatctcggcagctggccagcctacgcaacattgcaggcaatgcgtgttgggtgttagcgcggggacctggcctagctactgctaccgtggcctttctgtttgggccttgaggtgcaaaggggtggagatggcaaagcagtctcgctttgcaacttgggccagaggcggtatggccacggattcgtatcatctgtagtctgtgcagctagttccgagttccgacagtccatgccgtcaatgcgccaggacaaaatttggcatggagaaagaaaaaacggggaaagaagaaaatcgaaaaagaatggaaatcacaaccaattgatttggttcaccaagtagcatgcaataggtcctcttttccggaagttggttctggttcataaccaaatagcgcacgtgcaggtgtgcacgaagcgcattactgtccttcatggtctaaacttaaaactagtgagatgcgcggttatgcgttgagtgagtactcgcgttgctgcagagatttttatgaaataaaataagaaattttattgtccttaaaaaagtatatgaagataccaaatttgatttacactagaaaaatatgataactcccggtattttttaagaatggtaaaattacccataaaataaacaattaagaaaatgctagtagacgagaatgaaagaaaatagtaaatcaaatcttcttgatgcctatatagcgcaattcaacggaaggatgagctcagctgcatcaaaactaatctggaagcaatgggcaccctccaaatgcaaacactgtgcctggctattgctacaaaatagaatttggacagcggattggctacagatcaggcaatggccaaacaactatttctgtcaactgtgctacaggaatctagaaacaactcaacatctcttcaaggattgcccttttatgcgatatatttgggagagggtcctaggtaggctgaactgcaataaaattgactagacacatgatgaaaatgtgccactgctggactggtggatcagaaggacatctcgaggtggaaaagacagagccaaagaaaaaacaatcagtcgacatactggtagcatggaaaatatggtgtgagcggaacagacgagtatttcaaaatcaggataaatccgcagctgctagacaagatacaggataaaatcaagctatgaaagatatgtggagcaacaaatatcgcgagattatccgcctaggatgttttcattgtttagtagcttcttctttcctctctctttctctctttcacccgttttgcgatcttgtaaatacttttttttctcccctacttaatatatataacaccagctttgctggcttcgttttttttttaaaaaaaatcttcttgatgatgtggcctgacacatttttcttataggagtaattgcagatgctgaattgtagtaattaactgtatagaatctacatagaggatgcacgtacttccatttttttttgcaggacagatgaaattttgttaagagcttggagagagttacaagaaatttttacagcaaacatattgcatacggacttgtgtttatattattcgacatagttttcaagcgtgtgaaaaagcatgtactctcatgtactcatatatcatatatgtaggtaccaacattagtagtgtactatgcataacgcgtattgagtgtgactgtgactaattgtagttcatcgaaaaaaacaaataaacatctgtaaatcgttctgtatttttcactattcgttagcttcctttacatcggcctaaacattaaaaaaatattgtagcgtggaatgccccaagagtactattatatattctttagtagttaggaccataatattaaggtaacatgtgatttatgtcgcttttcgtgaaagtattcgcttggaatatttgttgatgtcacaagaccctttgaactaaaacccctctattattgcacctcacagactttccatcgaatatgacttcgagtgttaatttgagttctcgaattatgctgaaatgctcagagtcctcttaagtgtctttgaatatcttaaccctcaaagcctccttgattctctagcattctacaacatctttggaccacggttctctgaagcgtcttcgaaccttgcttgtatgatgaagatggctccatatcctgcatgttagaaataggaacatggccttggatccttgggaggatggccggggtcttgctcttacgtacaaaaccctctcttttatttttacatatataaatagtgagaaaaaaaacatatattcgtgggagcggtcacaattattcacttagaatattcgtttatgtcacaagaccctagcttgaaactaaaccccctattattgcacatcacagactccccttcaaatatgtcctagagtgttcgatcgagttctctaatcatcctcaaatttactcattgtttatacatgcctaaagctctgtttttttctaatttactcaaccccagattactggatctggaaccacattcactctgattaattaacctccgaaatgcagtgtctaaagtctagctaaacccatctacatttgtcgtgtcaccacatttgtcgtgtcgtactagctgttgggatgatcccatatttagcttgtatcgtacaatgccatcatgattatgcatggagatgattttctaggatcttggaaacaacacaatactttatgttggaattaatgaatgggccttagcccactcgaagattaattctttggaaaatcacaaaagcccaccttatgggatggcatgcatgtggagtttagtaccaccttgcttattctaggagagggggacctccttaaaagggaggatgccctcctagccacttgaagcatgtgtgatggagagaagaggggaaacacacgcgcgcgctggctcgcctcgcctggccgggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcggacgccctgatcaagcgacccttctctatataaaccgacttgccgtcttcacgcaacacttgcgaaatcaatctagggtttgtctcctactctgtactgcgccgtcgctcgtagactactccatcccgctcgccggcgtgcaccggcgatcgggagagcaggtctccggaacctctgccttcgacgttctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcaactggtctttccgtcacctcggtacgtgttcaatatgttgcgcatatttgatctgttcatgttgtactgtgtagtttacatgtatagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctataaaatgcttctgggtgagtactggcaaacctgaaggagttcttactgctgaacagcagaagcaattctaggaagccactactctctttgtgggatgcattcttagcgttcttggcgatcgtctggtcgaggtgtatatgcatatgaccgacgctaaggagttgtgggatgcactaaatactaaattcggtgctactgatggtagcaatgatctgtatatcatggagcagtttcatgactacaaaatggctgacaaccgttctgtagtcgaacaggctcatgagatacaaaccatggctaaggaactcgaactccttaagtgtgtcttacccgataaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgctaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgt

SEQ ID NO: 74209 - DNA, 933 bp, Oryza sativa
actgtacgcaccacgtgcaacacgtaccaagtaccatgttctcaacctaataaaaatcagctaattacctgtgatgatcggtctttccacgcgataataccattgtcacgaacccatcatgcgcaactaacgaaccccgcgccgcgcgaggatgacggatcgctctcatgaaccctacctatccatgaatccatccatccatccagcgaaattcgcttccggcttcatgccatccacgatcccagcggcacaacgcgccacacaccacgggccgctcgtacaagtccgttgtgctgcgtgcagagtgcagcgtgctcctcgacaaggaatctctatctctctcgtcaattctcctctgctctcttttttttgttttttttgtcccatgttaatccctactagtcctaagctaaagcgcgctctgatgggggtgatattatcacatcccgatcccgcgatatcatcagcgcccactcactcacgccgcgcacagccgcgcgcactcgcgagcacgcgcgctttacgctttttcttacggcttaaaccgtgtgaccgagcgcgcgggggtgaccgaccggtggattccacagtgtcgcgcgcgcttgaccccgagtcagcgtgcggtcccgactccgactccgcgggcgcggttgcgcgctgttggttggagtacgccgcggcgaacgacggggagagtggtggactggactggtagcgtgacggtggtggggttaggccccggggctcccgtgttgacgacgcggcgacccggccgaccgtataaagggagacgtactccctccgtactcgtaaagaaaatcatttagaacaatatttaagttaaatcttagaaatataaatcatgaataatcacaagttgttgagtttaaaaatacaaaaattatataaatagatttatcttaaatcattaat

SEQ ID NO: 74210 - DNA, 6097 bp, Oryza sativa
aaaaagataaactaccaagtgatgagtaaaactggaaagatatggtagatgtaatgataaaatgaaagaaaaatagcatgatcctgaaatatattgatgaggcagtatcaccaggggtcatcttgaaataaacacacaatacctgcatagtgctgaggttggttgaatttgactcaaaacttgggcattagtttcaaggatttctcctgttggacctccaattgctgcaaaaagggggaaaaaaagaagtaatgaattcagcaacctgtcgacagtcccggacataaaatttggtgcacttgacttcagcagtcaaatcatggtccatacaagtcccaaatgatacacgagaaagaactttgcataacacgcgcatttcttcattgcacatgtaactggaccaatgaaaaggttcaataaaacatatgaaactaactgcgaattagttcagtcaatatcaattgtgatttacctttggaagaaatttcatcatcgtcaatgggcagagctggaagggggtacggaggaacattaggccttccagctatatgaacaggtggtttcaacgaagaatctgaaaccttctcctgcagcaataaatgtctgtcagtgtaaaacttgtgaatatagcatgcattagctacacacacatcaaggaactttttctcttggtgaatcgtcacaacgcatgagtaaaataagttgaaaacaagtgctttcacataaatataataaaaaaacatgttcatttcctgccagctgcagaaaaataaaaagtaacagaaaacggttccactttaaagtgcataaatgtaaaatctcaaaaataaagtgcgacacaattataagtatcaagtgcaggcattaatatgaaattttaaattctctcatgcatacaaaataaatgccacatttattggattttttttggggggggggggggggtatagatcaatatagcaaggtccaagctggagctacagaatagcgatatacacttgaaatacgatggctcttgcaaatgccatcttgaagcttaaatacatggcataacttacagctcgaacgatgaaaccatattgcgaattttacattagtacatatgaatgccctacctcttactctacacagttgccaaagcaaagtaataaagttgcaccggaagaaaccattcattaaaaaaaaaaaatcgaccagtgggggaaagaccgctcccacggcattgcactaagaagaagctcttccttgcccggtcgagaaaagaccccaaaggccggttgcctggatgcgccacagggtgctcagggcatattggcctcatacatttcactgaaggcaaccacaatggttacgggtggaacacggaaaagctgacgagggctcttttttttttgtgcaaatcctgggttcgagcccaggaccagcggcttctcaagtggaagcactaccgccaagctaacagcttgtttgcaaaagaacccatttatattacggacaatatggttgaaacagattaaattcacagatgcttttgtggtgcatagtaagtgctgacaatcaataagtattaaaaaaactaattgatctaatatgcttgtttttttttttttggaagagatggttctgacatcttccattaagaaatatcattacaaaatgccagataatctggaggattttcattcagtgacttttcggactatgtctaaccaggttctgttataaatgaacttattgtagcaagtcaggatcaattttcccataatgcattccaacagtcatgagaatggaggggatgggagatattagtaaaaacctttttatctttgcttttcttcgaggagctgtggtcctctttctttctctttccactttcctttttctgcacatcaaatgcataatctcaaatcattgcttggaaaaagggtaacaagaccaggcaccatgataacagagttgaaggcgcatatgctacatttattactcacattcatccatctacaacgcaaggccacgtctcgaactgttttgtctggcaacttcatggctatctttgcataacgaattacaggagcatcagatgcatacctgagagcaagcaccagagtaacatcagagcaaaaacaaaggccctcaaagctaaacaatccatgacgccccctcacaatgttgttttcggtgctactgtcattttgatggcaacaagacgtgtcggtgccatgtggattctacccattatgcaacgaccgagcattcacataatataccgtacaacaaaatagagcaagtcacataatatgctgggaatagaggacgaaaaaaaatagtctctcaacattgctacattatccacttgtctaaacaaatgctactggtagcttttacagggcagaaaaaaatgacatgcaaaattaagaaatattacataattgaaaccctaaatggagccgtcgtacagttacaatcttaattacccgacataatccaagcaattgtatccaaaactcggaaaatcagtacccatacgcaccccctaatccgaattgccaaacccccaaatctgcatgacgcagcgaagcacgcgacttacttgacgagcaactcgtcgagggtggactgctcttccggcgaccactcccgcgccaggccggggtcgtgccggagcgccgccaccgtgccgccggggctagggtttgctccccctcctccaccatctcctcctccgccgccgccactggaatgggacccgttctgcgcggcggcgctcgccggcggcgggtggccgttcgcgcccatgccgaccaaactgggcgcgaattttcttgctcccttcgggaagcggctcgctgcttctgcgctccgagcgccgggagagcccctctcttctctttcccgctacgagtggatggggaataaaaaagaagttttttttctttttctttttggggatcttttcgatcgatttggggatttttgttacacttgttcgcaagccgaggcgggtttctctctctctctctttaggggatttttattagtttgctctgaattgacctttttttttctccctgtggatgcttaatttgtgttttatttttaaccttcttttcatattatctaaacaacaaaccataatatctatcttgaaaataaacttcgaatgtcacttcctatgacggttgatactagtgtgaccgtgtagagctttttttttttaaggcaaggcaccacagacctacgatctagatagattctataattcagttacaccttcgaagttgcacagaggttcctacaaagaaatagtattacacattaacccctgaaagtagcaaaaaggatctcgtaaaaatatagaggaaagattgattatcatatcaaggactatagtgtatctagatttctatatatttttctcaagctatatggttagagttctattaagattgagggaaacattttattactatcaacaaatgttggaaagaaaatattcaaattacaatgatttatatggcttcccgctcttcattgcattatcctggtcctgaggacctcggctacgacaatatataggtgaaccagtgtcaaaattgaacaaatccaccatgatcgagtttttttttgccattcattcgtgatgacattgatcagctcctccaccatttgagcgttggattggagatattggcattgcgtttctgccaaattaaccacgagactatgcatgattactcatgcatagaaacgacgttggtctcgcttcgccactatacgtggcatacttgtaaccacacagtccttgaaatcctcgctagtgggagcgagttgccatggcaagtatgggtcctcgccgccggtcaaaccttcgttgagaaggagcatgatatgggcatatgttcacaaaattttatttcaacggagcaagtagccacaccggattgtgttaccaaccccttgtttacatgttattgccgttagacgggttcatcttattgctaaaaatatcaaaaactgacatcggcctgactgtgttaacccctattttatcgtatgttttttttaccgtgtattaatatgttcaaatctttcagatttaaaaacatagacaagaaggcttatttgaaaagggaaaaaaatgggttgaaaataaaatttatgaacagcgaacgatgttaagggaaaagggtctacaaagtggtgtctaggctagagtaaagaaatatggtaaatatggagtaaagatatatggtaaagaggatccaaacttcggttagaagtgagcctaaaccgatattcacctaattaatagttttattatcacttttacctagaattgtctaggctagttctttcctttttattggagcggctgaagcgttacacatggaaaatattaggaaattcaggctaaaccgatacacagcagcaaggtgaagaaaacataacgaacatgatagattagtaagcgtacgtgagatgacatccaagattaactcccaaaagctcaaatgctaatttagactatgcattggtttaaccgcacgttatactataagcactagtaatatgtccttacagcgttgtaacatttttaataagatattaaaatttgatggcagtgaaaataattttcctaaaatccgtccatttaagctttcattccattcatgtcatatataaaaaataatatgatatggccttaaaaatatttattcaagacaatcaacaattacatctaatcaattcaatatacactatacaaggacaatttatatccatgcaacaaagaatggttgagttattcctcgagaagtcaatatagacaaatatgaaacttttttggtaggtatgcaccattaacgattcaactggttactgcaaaaaccattttaaaactattgacttctggtaaattatggttgaattttgttaaaaatttaaagtcagtttgaaatttacaaatttgacacaaaaaacaaaaccatttgaatacaggacagtttgaaatttacaaatttaaagtcaatttgaaattttacaaatttaaagccatttgagtacaagacggaatggatcgatggtcccttccctgttttttctagaagcggataataatcatattttacatttgatcgatgacgtaaacactatttctggctagtaagttgatgctgcggattcgatcacacccaacaattcggttcgatctttcaaaatttttcatcatctaaatctacacatcaagtagctaggcgacacattgccctgtgagagcggtatgtacgcttcaagcccctgcatatatgacaacatataagtagacctacgtggccatgtcagaacagacgcatgaagcgatgaagatgcataccgtcggcgcccgatacgcccgggtcaaaccgcagctagctaagctagctggagtagctcgctcggagaggaggctgggtcggcaagaaactccaagcactggtggagaagtgctttttagtcccggttcgtaaccccctatagtcccggtttttaaaccgggactaccaatccgggactaaagatcgctatctttagtcccgggtgaaaaaaccgggactaaagatcgatctttagtcccggttgaaaaaaccgggactaaagatttagtcccggttggtgtcatcaaccgggactaaagagagggtagcggcagtccatcagctagtcattttttcttttttattttctcccgaatcgagtggtatgcatatcatcaaatcaaaccccaaatccacatcacaactccacagcacgattcacagattcaccacaaattcattcacaatatccattcacatattcattcacaacatcacaaatatattcacaatattgattcaaaggttcattgacaacatcgagtcacatactcattcacaacatcacagattcattcacaatatcgatttatagattcattcacagatcaaaacatccaaaccacaaattaaaaaaaatcaaaaaaaaatcgactcactggccggcctcccatcccgccgtcggccggccacccatctcgccgcttcccctccggccggatctgggggaggggagggcgagg

SEQ ID NO: 74211 - DNA, 10543 bp, Oryza sativa
taaattttttgtaaaaaaagtaatccgagcatgtgtttaattgatttggcacaaactattgacttttgaaatgaacatcattattatgtgcttcctccgtcatataatataagggattttgactttttcttacactatttgaccactcgtcttattctaaaaatttgtgcaaatataaaaaagaaaaattgtgcttaaagtattttggataataaagtaagtcacaaataaaataaataataattctaaatgtttttaaataagacgaatggtcaaacaatataagcaaaaagtcaaaatcccttatattatggaacggaggaaataccaacactacatgtttgtcttattgaccaaagtctaagctgtgaattataaaccactctaataattcttttgtatatgctaaaaaatgaaaataaaactaaaaccattgaagtaaaagaatgacacgttcacttaaaagtaataaaggaataaagtaaatactttacgtattggttacttctctatagctctataacccatttgagaaaaatatattttacagatctaaaaattaagataagatacacaaatgaaagtctaaaaatttatatattatagatctaattgcgtttgatttgctcaggtcatctcgactaaaatttttactctctacgattaaatctaagagtaaaaagatttactcaagataatatggataaatcttaaacacccatttacatatctagaagtagttttcggatttacaatatatgtatatatgtatagtttgcatcatatattttcctcatttaggatgagcctcatcggccaacatattatacgttttgtgttgagttaaaaagagaccggatgcttataaaagctactaaggatgaaaaaaataactaaaaacataaaaaagcagtagagtggctgccgctacaagcctacaaccaatgatatgctactatggttgccgaatatgatcctttttactatggttggtgcccaaactatgagctcacggaattttcatcactactccttccattctaaaatatgaacacttctggcatttaaaatttacactaaaatataaatacttcaagcgctatttagagtattttctccaccgattatatccctctcaaatatgttcttatggtttcttaaaaaaatatatgttcttatgttgaatcctaatcattatgtcatttcataaatctatcaaaatattttctacttaagcataaattctactcccttcgtttttaaaatataacaacttaataacaaattcaacaatcttactactacggatgagattacaaaaaaaaatagattttagaacagatgaagtattgtattaatataaatttcttaccctcaaaaacttgtcgatccttctctattagtacaaccagcagcctacatttctagatgagtaaagtccatcaccggtccctaaacttgtaccgctgtgtcatcccggtccctaaactcgtaaaatcgaccattcagatcctcagacttgttcgactgtatcatcccagtccctaaacttacagatcactcgtttaggtcctccaacttgttcagttgtgttaccccggtccctaaacaggacggtctaaaaattttatatcaaaaaataattcataactttttcatgtgaactctaatgaagacaatctttatatcaaaattgtagctctagacgtgacctacaactttatagttgaaaagtttttgaattaaaactgtttagggtcccaaaatattgttgcatgtttatatattttgaaattttaattttaaaattacattttgggacaaaaaatgacttaaaataaaaaaaatcaactacaaagttgtagatcgcgtcgaggactgtaagtttgatataaagtttatcttcattagaattcacatgaaaaagttataaattatttttaaatataaagtttttagacagttctatttgacccagatgatattcaaatacaagtttagggactggggtgacacaactgaataagttagagtatttaaacgagtgatctgcaaatttagggaccaggataatactgtcgaacaagtttgagaacctgaacagtcgatttgctagtttagggaccgagatgatacaacggtggaccggtgatggactttactctttctatattctaactgctcctaattgattatgcaactacaccatcttttatattggattctcggatgatattcatcctaatatccaatatccactcattagcagtttagcaccgagactttgagattaggccaagtcaaagcggatccatctgctcatcccggaaatgaatccaaccctctaaacccggaaaccctaaaccctctaagagcacgaatgcacgatgccatttccactcggtaaaaaaaaaagaaaaaaagaaaaaaaaaagagcaaagcaaagcaacggcttttcgcccatcggaaaaccaagcacgacgacgtataaaatccacgtttttgagcgcgagaaattaatttctctcggtattttcttctttcttctctctatactccagtactccaccctccaggagcagttagcttctccccctgctttctgctcctgacgcgagagcaagaagaagaaaaggccatggcggagaagagggcttcttcttgaggtgaggttggttgctcgcttctcttctcttctcttcctcctgctgccgattcggttggcgattttgctcgagacttttttttttcttcttctttgttgcgagtcttcgcgccgctttaatccggagagcatttggagtctgacttggcttccactcgcgcgcggtttaatccccttttttttttctatttttttcttcacttctgatgatgatttcgtgctcttctccctcatcacgatttcttggcttgcaggcagctgcttcgctttcctcaccccccaaatcgcgccagaattcgatcttttccggcggcggctggtggagcgcaagatcgcgctgcgcgtttgatgggcaaggcgtgttcttggtggagtttcttgggagccgcctctcgtcctggatccgtggcggccggcgacatcctgggccggggagggtttctcggatccggttcttgctaatccgatcggaatccgagcggatggggtcagcgatggatgtggtggacatcagctccgacgaggagggcttcgccgcggcggcggtggcggtggcgacgacgaccaagaaggcgtccgtcgactccctcgggtggattgcggaccttcttagagaggaggatgagagggctttgtcggatgagttcgatgatctggaggtgatgagtgagctgtcggcgccgccggtgatggcgcagcagaaggggggcaagcccgattgcggcggcgaggaagacgacgatgattgcgtggtgctggatggggatcctgatgatgttgtcgctgtcgcgggggagaaagggagtgagggagatggcagctcggatgaattgcagatcgtcgcagagaaaggcccggtattttggcttaattgcttattactaaaattttgatctgtatttattgcattctgtgcatgaaataggagcagctcaattgttatgtttgtaggctatgtatatagagatgaaatgttctcgtaattgggggaaactgttcgtaataagtcattttgttatgatctgaactttgaattactatattgttctgatttcatttgaaggcttatttactcattgcatagtttagtttgatctcctttgttcagtgatgtggaattcagattcaaatacattggatagcgtggaagtggtttgatttaagtgcatgtgtttctttccccatctgtacttgcctatttgtctatgaatacatgtacctctagttcatgtcacttgtaataacgaaatgataaatttcatgctagctttttaacagaaaccacagtgtggagtggacatgtagtagcattcatttcttttgttattttccttaactagtagttgtctatttatccacaggtagcatgcagggacttccctcattcccgccatttatgttctaacttgcccttcagcaccacttctcatgtgaagtattgtagcatggtaagtaagaaataattttccctccagtgaatctactagaggagcagcttatagattttgttttgacacgatttccatgttcgcttttcaaatgcagtgccactgttttgtatgtgacactccagccccatgcaattattggggtaagggcaccgagatttatgatcattgtcatgctacagataaggaaaaaaagtggaaagcaatgagacatacattcaagagcaaaggtctgccaacatctcatccagaaaagcgccagaatgtcgtatacccaacaacaacgtcatttgtacagcaagatacacagtgcgaaatttcactcatacaatcgcatatgactacttactttcccaaccaaagtcatcttgcgaatgttgtgaaccaggggttaactcaaacaagacatacatcagtaagagtctcaccgagtgtagggagaactgtcagtgcaacaagaacaactcctgcaacaagggctggaagaggtatgagcaatgctcccagcattcagattcctcaatcacgcacaagattcaaacgagtaggggctacttctccaggcatagtaactctaaatgataaccagtttggttctgctgctccgaacaatacccagttgcaccagccatcctcgccacatgcatcccagccagctcaagttgcaccaagaacattgtttggtactgttcagaaaaatccccctcagagatcgctaagtgccccaatagcgcttcaagggcaacaagatcagtcggcgtcgtcctatcaggctgcctcaaacggaacacacggtacaggaccacaattttctcggtgcatttctcttacggctcagagaacacaattactgcctgaaccagcattggatgtttacagcaaaagctggcaagacataattgatagtctggcatctgatctggaggtaccagattacaatatgggcgctgcagagtctcagcagccagacaggactatttctcaacctcttgattccattacattccagggggtaggtcttcacagtgagcctgttgtggcattggcgaacttgatgccttgtaatgggcagaatgtggccaatggcatgataggcagcaattgtcttgcacaaacaacacaaattttgcctcacctcaatcaccagcctagccttgttcccaatgaatcccatcttaataattcagtaagttccactgcggacggattactaatggaagctgctcatcagagagacacgcaaggatcggattctctagatcttctatttgactttgagtttgaggattgggattcagcagagccctgacaaacaacctccgcatttctgaaccccaaggacaataaaatctggcgtcaccgacaagctggttcgttagcttccttcctaggaagaggaagagatgttccttgtacattctgtaggttcagtggtagaaatgttttttttttccttccatgggtgcttgtttacagtagcggctatacaggccttctaggccttagattagcagttatcgctctgaagttttagggatgaagttcaattcccaaactgttgttgatcatatatctatgggccataactccataatcctatatctatggtccataactccataatccaattgccagaatgcatgtttcaggtagcatagcactgaagcaaaatcttctgagcactggtgtggattggctctagtaactgctgatccagcgaagcaatgtatagtttttgcttgataatggcaaagagtgatctgctcttgaaaagccttaagctttccttgcaatgtgaaatttgtgttacaaatagctgagttggctatgcagaataccaaggcaaggaggaagaaaccaatgcttgcgttgttctacctccattgaggtaaaaatctttccttttcctcttatcgtagagatttgtcatttatatgacatgagttactccggctataaatatttgataaaattaagtcaaaaatttgaaattgtgaccgtcaataatttttctccaatacttattagttactttgaaaagtactgccataatatcataaacttatttaaatgtaaaaccgatggccaaagttttaaaagtgtaatcgaatctcattctaaactcaaatactccatttatgaccagttaaccacagggagagtacacaattccttttgttaagagtcagtaataaaatcagcatgtagaggggataataatttctttggtggccccacttgtcaggaagggtcgaaggcgtagtgcatgtccacggcggcggcgatgtgccaggtgcaccgtgtgcccttggggaagacgacgatgtcgccggcgccgaactcgacgcgccgcccattctccggcgagccctccgccgccgacgccgccgccgtcgccgtcgccgtcaccttccctctcacgatgtagcacgtctgccgcgcgccgtagctcagcgccatcctccccggaccaccgccccacctacaacacaagtacatatatacggtacaatacgtgtattttgtacaccgtataaaatacgcgtatgatgtatcggagggagatttatacttgggccaggacctggcgccgagctctgacaggcgagactccggcgggctcctctcgacggcgatgccgccgccggcggccaccgtgcacggcggcggcggcgacgagctcgaagccatggacaatggacgatgcagtggtttggattcgccaggtcctcttcttcggagaagttgcaatctcttgccggaaacaagacatagtagcatactttccgacgacttgctgctgtcgtggaccgcacctcgacatgtcggcagcggccgccggcggcggcggtggcagaggacatgtcggccgcagcctgcaggtggcgcttggtcagccacgttgaccggctgccagctggctgatgacgtggcgacgcagcactgggcataaataaatgtgtatgatgctgatgccgttgatttttcgcatagcatttggccatttgttttatttgaaaatttagtataaatatataaaagtataagttaagattatattttatttgatgataaaatatgtgctaacaaaataaataacattcatataatttttagtaagacaaatggttaaacattacgtcaaaagtcaacaatgtcatacattaaaaaaaacgagaaaattgacattttaccatcatcaaaaaggggtttcgcccaaataccactatgcaattgggattcaccaaaataccattctcaattgaggggcttcacccatatgccattttcttccaattctctctttcctctcatcattattgaccaaaatggccctagttgaatcaatttaagtatatcaaaatacgtagattataaagtaaatacgctaaaatatttttacatgctatttttttcttacacagtatgcatcgtattatatccataacataaaaaaaaagacactatcaacggaaactctcataaaaaatacgtaattatttttttatttatgctgtggagatagtgtcttatactctgtaatttggtgtaaagaaaaaaatatattgcatgtcaagatatttggacgatatgtactttgtctgtaatctacatatttgctttacttgaattaattcaactaggggcattttggtcagcaaagatgaaaggaaagagagaattggaagaaaatggtgtttcggcgaagcccctcaattgagaatgatattttggcgaatcccaactgcatagtggtatttgggcgaaacctgttttgacgatggtattatgccaattttctcgatttttgtagttgttaacccttgctatgaaaaatctgaactttgacaacggttattcaacccattcattcaactgaaagtccttaaattcagcagggagctgaagacttttgtttctgattggttttgttaaaccaaacataatgctctagaacttcaaatgatagctccaagggaagaaatcacaagtccaatccttgacctggtagtctatgactctatgttacaaagagatcaccatgtcccaacctgtcgacttttgaacaatagctgaagcatggatcttttttttttttgaaagtagaaacatggatcatttattcaatgacaatcttttttttgtccctcgcaatttcgacaaggtctaacacaggtacttagtcaggcgtggatcggattgccatggtaggccagatcgtgcgccgattgctctacatttgatgcctgcctgaagcatgaacaggaaatatcccaatcaaggtaagaagtgaagaacaaaaaaactagtagtatttttgtttcatttctgtaaatgaaggaagttgttataccacttggcaagcaaaaggcagcatcttttctggaggcatctctgtggatagtcctaagtatattcaatagaggaaacattgaggtcacaataaataattaatgataggcgatagctaactggattttaatatttagttaaaacaaaaatacttgaatagcatcatatatataagaatcatattcttgagcaaagaagtagtaatcttaataactgtttatgtcgaattcccgtctcctcagggagacataatgaagaaagtaaatagttattctggaagaagttaatggctcaccatgaagtactgctcctatgaatgcatcaccacaaccagttgtatcaacaagctctgaagctggaatactttctgctgttcctatgagcagccttgcaaatatattcccagaccctcttgcagtaagtctcatgaactagaaagtaaaatggaaaaaggttaggtaaagcagtaaaagagatccaaagcagtcatcaaattactcacatttctgatgacataacaatgtaaacgattttgattgccagaaatatctcataccttagatgatacacaagttggcaggatatcatctttatctactttcagccttaaggactcagcgacattctctatatctactggctcagtttcataattttcacctatttaagagtggaactgcagataaataggttgaagtcacaaaggcaaaacttatacacaaactttatccagcatgtaattaaaattgtctggacaagatcaaaactaaccatctttgcccctctcaagcatcatgcatccattttctccaagggttacaactgcgaagcatgcacgaggatattgcagaaggatttctagtagtgcagagggaatagatgggactgatgtccatttctgtaggtaaagagtcactgtaaatagtgagtgggaaaaaaaactaatgcagctttactaaagcatgccttttaaaaccattcatgcctgtcaaaatgtatcacaaacctctggaaatttcccattacagactatgtaacttgctaggctgagcaaacctcccaattcttcccttgttctttctggttcggcatcaaccaaaataggaatcttcatctgatcagcctgtacatttctggttttaatcaagcaacaaatcaaaatatgatctaattctctacaggtttatgatactgttactgtaaaacaaaggtcatttacattattgaaatttacctagacagtactaactactaagatgtatgaagattggacaacctagactacatggtgaaagcattacatgatacatgaatggattaatgttgcacactccaaacgaacttacctgcttagcaactgccaaggccatctcatctgaatatccatctaagtatagtaagcttacgtcttgcagtgcagctgacaaacttgacattctcaagtcactaggtatcattggagggtaccctgatgtgattatacacgtacgagtttttctgcaaatgtaaatggcccttctatgaatatgcacagaaacttgctatgatgccagaaagtgttattgtaaaaaagcaataattgagtaagtgtggctaaataaccatattgcttagacaagcttaacagcttcaaccatataaaggatgttcagtaaccagcaaaacaaaaaagtagtgaccaaacatcaaaatggtcaagtataaagggtcagttggagggtaaaatttttatccttatttacatgtatctactaaatgcatatatgccctatttccatgcatttttttcctttatctgatctagatgcccagtcctttagaataactgagcgaacggtgtacgcgccgaaagggaagtttataatgaagtgagaaccatgatttataaaagcaccttgtttttatatataaaaaggtaagtcaggttactctaatataaataggtgtaacaaaactaaaaattggttgaacttcattcgaaatgtacctgattgagtgtgcaaggtgaccagaaaattcatttggaatatttcagaaatgcttatcattacaacctaggagcatgcctttaattgt

SEQ ID NO: 74212 - DNA, 827 bp, Oryza sativa
cattgacacaatcgaaaagaagcctttggtatgaactttgctcccgaagctccaagactttgttgaacagaatcggatcaagaggacagtcaggtaaatgccagccagtgaaaagcatactcgactgcgcatcgtctaatccagcagacgacattatattttgcacaagaacatggcattccgattcatcgtcatctacatcagggagaaaagaagactgccctcgggtgccaggtaatgctgattctgaagtggtgtcgtcccatgataaggaacaagcaacagcctcaattgctgaagatcttgagacagcttctgaagaaagttaagcagaaatgtcagtatataaactaaccaatctgagacttgaagaactctaggctggaaactagacttactagcattttttgatgtagtgcttgcagatgattcaggttcattacaactgctatcttcagagggtgcatcaagaactgacgtagggctgggttggtcgcgtgtactatttaggacctcattcagtcctagtttattcaggtttccacttcgacaatccaatgatgcaggtacatcagttaaagcagttgttccctgtaataaaatttctcatcaaattctctgtggccgaacaaatgcattgaacaaatatttcttacaaatggaagaaaggatgtcatagctcaagaataaatgtgcccatatcaattacccagctatatgaaaagaacataagatttggcttgcaagatagatgagatgaagtgcctacctctgaagtgctggttgattgcacagcacaaatatcaagtatgtcctcacaaatggtg

SEQ ID NO: 74213 - DNA, 31013 bp, Oryza sativa
ttatcaggtcgcacggggttccaccgtcctaatggggaatgggtcacatgcttctgttcatggtgttggcacggtagatctgaagtttacttcgggaaagatcgtgcaactgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgtggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgagattacactcttgcagtcccattatgtggagaagatcttgaatcgctttggctacattgatagtaagccttctccaacaccttatgatcctagcttgttgcttcgcaagaacaagagaattgctaggaatcatctggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcttgcggtactggagggttatagtgattctaactggatctctgatgtggatgagatcaaagccactagtggatatgttttcacactgggtggtggtgctgtttcatggaggttttgcaaacagacaattttgacgaggtcaaccatggaagcagagctaacggcactggatactgctactgttgaggcagaaaggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgttaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcaaatatattgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccacattgcttattctagagagggggacctccttaaaagggaggatgccctcctagccacttgaagcatgtgtggtggagagaagaggggaaacacacgcgcgcgctcgctcgcctcgcctcgccgggccgggccggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacttgccgtcttcacgcaacacttgcgaaatcaatctagggtttgtctcctactctgtactgcgccgtcgctagtagactactccatcccgctcgccgggtgcaccggcgatcgggagagcaggtctccggaacctctgccttcgacgttctgcaccgggagaaggcggcaataaagtttttggaagcgcttcgcgcgactgctccctgttcgttcgcgacggctcgccttcctcttcgctcgcgtgtttcgtgccttcgtagacacctgcgaaaagtttcgaccaagcaactggtctttccgtcacctcggtacgtgttcaatatgttgcgcatatttgatctgttcatgttgtactgtgtagtttacatgtatagatctaatgatgcgttcatgctagtttttatctgtaatgtcatgatttatttatggaatagattaaatcattatatgtctataatctcaacactttaacggacagtaggattgagatcctatatatatattcaatcattcataaatcctacgcaagcgagaggttatttagtttttgctgtctcttgtagtaggatcataggacggcagtacagtggtaataataaacactcttctagcgcccatacgcatcctacgtatgcatacacacatggcacatagaagtccatatcagttatttttctgaggctgggcacagcaaaaggttcagaaaagaaaaccaacaataaggcagcttttttttaattgttttgcttttattctacggccttgcatgtcaaacacattccttcagcgtggcctgtaccatgccaccgtgagcagttgagcactttatagctggcgggggcactggcacatcactctcatgcgtgcacaaccatgcttccatccatattttacggtgtttggaactgagctgtttaaaattaaaaattaatatttttcaagcacagtaataaaagaaagagacttggagggagagacgtccctccaaatatatttttaagaagaaataataagcatgttgggattgaacacagacctcagggttgaaatcatatactccttgccactacactaaagtgcatctctttcaagcgcagtagaatatctcgtctctccgacctaccttttttttcataaatatttaatgtatttatgaaacaatttgattatcactacttagaaaaaacaattttgcagctctagtcttttcttttcacagactgctcagaaggaaaatcgtatgtaacagatagccgaggtcatgttactatgttagggtcatgactgccttagaaaaacacctatgaaaacaagtctatttctgcgagtcccttttctaaggagctgtttgtgaaaattctgatttttagaggtggtttttaaagaaaattatttccaataaaatgtgaagtgtgatggttcttggcagttcccttaatgaaaaggcaagtaaaagtcgatttttatagatggttctcttgaaaaaaaactgcccatgaaaataagagcaatactatttcatgaaaaattacaactcttttatggtgaaaaatcttatatagaaattgtttgttgactatatctatataaaaaacaaatttatgggtattttaaaaacctctaatggagacattctctatatcaaaattctagagttcagaaaatctaaaattttatcgttgaaactttttacatttgagatcatttcagtgcctaaatattcgctacaggttttagagagaagtaaaaaattagcatccatcacacagtcatgaagtgtgagatggtaaagaggctatacgtgtagggagaagaattggattaggatcctacataccacacgtgtaatcgtgtatagatgtgtgtgtgtgtgtgtgtgtatatatatatatatatgcgtcccaaagtataagaatttttaggctagacgtgagtattaagtaagtaggtggaattaatgtgcttgggttgatattttgagatgaggaaataagtggagaatttgaacggtgaaatgttattattggttgagaacaaaaatgtaggtgaaaaaattattgtactttaggggagtacaaattacttttttgggttttgggacgcggtggaggaagggggaaggggggggggggtttgcacttaaaaaaatcaaaaaaagtattttcacgaatggtttcttaagagagtcgtgtgcaccatgatcgtgcatatttcatgatgtttagaattgagatatttataatatcttcccgttaccgtaagacatatctctgtccatgatccctctttgtatatattttgttttctttcttttatcttatgtatagaaccatgctgccattattaaccacttgttatatgccgtcaagtcgcagtctctgcttctcccgatttgtgatctttctcttagtatatatatttttgttctttttctagttgagacataagaagagagtggcccatatgcatctaaaatggtctataactagtggtctggtgcatacaaatcctcacatagccatgctagggccaacatagcacactctgtcacctgttgtaaaggaaaaagaaatagataagatagggataagatagaagaggatgacatgagagatcataaaaataacatatatgtaacttttttcctcaataaaatactctccactttttaatttatgacattgttaacttttgaacatacgtttgatcattcattttattaaaaagattatacaatattttgttgggatttgttttatcatatgtattttaagcgtgacttatatttttttcatatctatataaaattttgaataagatgataactcaagcatatgtagaaaagtcaacagtacctatactcatttaaaagaagggagtaatggtgacactaatctgccaccccactatccattgtaaattttgcatattacccctaaactttttaatattacaaataataaaaaaataaatgaataacacagataaaatcaaattaagccctgcagcaaaaaggtgagtaacgcattttttgaaaaatatatttttatttattttaaatgctattataatatgtttttttcacttttattcaaagcaaaaacacgggcattgagttcgttatacatgaaaaatcttaatcggagggactagcacgtagggcccgatcaactaacgagtacattactcctttggattttgcaaagatccaatcactagagctcacgcccgacaattaaatttacaggtgagctcgttcctaagtacttctttatttgctcttgaggatagattgctacctaatgatttaattatgattaggaattatggagaggaccatggagcacttggagagaggctaggagatggaaaaggtcattatggatgttcaagttaagatggagatccaacttatatcaagttcgagtccacttcgggctccaagagcagtctacactaaattcgttgctcaggtttcatccggactccgatttcgacgttccacacatgcatggaaagctaacgaaatcacctttccaatggatttggtcccacatcaaaaatccttccaagtcaacaggaatcttcgaaacaagaaggcattcaaaatctatccgggtgctgagtcaccgtctttgggcccgttgggccatgtatcgagtcaaagtctaatagggtcgcgtccatgggtctaaggtcgacactaaaacctatatattcagtagccgtcattgtgttagggttgggttttgcttagattatttctgccttcacagtttcgccgctagatcggtttgtgaaacctcaacttcgagtccttgataatcattcatctgcaattgagttgttgtttttcttgtttttgattgtgttcttcgattcatacgtagggattagccttctcggcgaggtcaatcgggtttcggcatggttgataaccagaggagacgtacgtggtgctgcgattgaaaggtttggatcgtgttgatcggaagccgaatcgtgtgtgtcaagtttccaccaaattgatagatatcttcacctgacagaagatcgggcatcccgttgccatcatcaactttgtactactaattacaaacggcatatagaagttcctcggtgaagttcatttacttgaggtcatacaatgcaagacaggaaaagtgcaaaagttggatcaaccaatcgatctaccggtgcaaatggcaaaaaaaaaaaacaataataaggaaaagggacaatacgaaatataaactctcatcaaccaaaaggcatatataagttcgaatactgcgcttttttcccgaaagttttaactagctactagtcgagcataaaaatggataggtatgacttgaagtacgcagatcgaatattcgatccttccaacaacagggacacgaagaaatggaggatacgcttttgtagtaaaattgagagattgtttcctttgaggtggtggtcgcagcttgtgctcacaaactccaaagtgttcttcttcgcttttgcgttgcttgctacagtggaaaagtccacctgccagttccatgttcgttggtgtgttgcaggtctctccccttttagttttcaacatggataagtaactggttcttttccattacttcttcctcgaagagatgagagttcttttgggtcatctatatctgggtgcattttcttttattagaggggcactgttccatatttacattcatctcatattctcgtaatctgcaaacacaagcacacaacctggtgcctccatttgtcttcactgcaggatttcttaaaccaccgggaccagggttaccgtgttccgaaggtaagcacggttaccacgcggtaaccgtgaaaaaccgtacgaaaccatgcaaaatttattaaaattcaaattatttttaaaatttatttgaatttaaggaggttaccgtggtttttctattaccgtaccctcgcggtaaggccggtaaccacggtaaccgcgtggttaccgacggtaatgtaaaccctgcttcagagtacacatcgcataatgcttatattttctgtgatgagactcatcaattacccatattctctaacaattatatattttgttcgtatcgaataaaaagccaacgttaaaaagaaattatgttaaaaataatttagagtcatctccaaaatcaaatttaaaaatttaaattttagtttttttcattggctcgtgccaatcgatggatctcgaaatatgattactatggttgttatgcagaattagaaaagctagctaggaccgacatgctattaacgaaaaccgtagcgaaataaaccgtgcgtcacactgagagagagagagagagagagagagagagagagagagagagagagagagagagagagagagagagagagagagagagagagagagagagagagagagagagcgcattttatgaaaaataaattaaagtccctggcagggaggataaggaggaggcgtctatagcctgtaggtccagcaagatattttctttagcctatccagtttagtgaggatcgcaatatcgaattatagcataaaatcgctataaccaacagtaaattgagtttgcttaagtggtgcaaacaattcagtgactgattttaatgtgcactgaagaaaagcaccaatataacaaattactgtagtgatctgatcgaagtcggttcgatctggatctatctaacagtgcaatggggtagcaaatgcacacaacctgttcgcctccgttgtagcaagttgatctcagtcgagtcgttgatcgatgtcttgtccgttgtcacgaaccaaactgatcggtttgcaaaggcaaagaaaagaattccattgccattaaaatggtcgacacaccggcgatgtttatcctagcacgttgtatcgatcgatcgggacctcgcattttccaagacggccagggcaaacgtatctactcctactccagtactagtaggagacatctcgtgcacggttgcgtaatcggacagtgctttgacgtgcaaaacgtcctgtgctggtgtacgatgtgtcgagcactcgatcgagccagtggccaccaccgcggcgatcctgaactttaccggccaccacccgcactgtcttggcattggctcgcagagtcgcagctcgcttcaccgcggcggcggcagcagcagcttgggccgctgctttcgcagtccctcggctgggccgcacggcgcggcggctgctcattgcgcggcccgcgtgggtgcaccgtctcggcgaggtgcgttgccgtggtagatcagtctctagccctcagagcagtaaggagaggcctcaaattaaatgggcttcctcctcttctgagagagagagagagagagagagagagagagagagtagttcttgggcttttttttttctcatccgttgagctacttccgatcaaggctggcagtcgggccaaacgagatttaaaggccagtggtctaatcgaaacacagaattacaacatccaaggctccttttcaagttgttggattattagtacggtgcatccaaggtttatttttcccttatcgggaaagcatcggcgatgtcgcagtggagatttttgttgcataatttcactttttgacaagcacaaattaactttaagtttttaatacgtttttagtcctcgtgaccagagtttttctcactactagaaaaacagacgattaaaattgctatgtgcacacaagcgttcctccaggcaaaaacctacgaaagttaattttaggggtacatttgttgttgtgtttagtggtacgtgcacgtgtatacctttttcaatagtagaaaaaaagagaaattgttttcttatcttcgcattgttgagatgaattatattacttcaattacaacatgtatacatatgtgtcctagagagggattgtttgcatatcattcaaatattttaaaaaattgaaaaattatcaagatatattaatatgtgatagtgactccatataaacatgaaaaaaaaaatcaaatttagcttttacatgttacaacgtaaaaaacaaatttgattgttaatatacgttaactaattatattttaattggtttttttaacttgtagaagttgaattttaacttgtatatttgtggaatgatatataacataataatccatcttcttagtttttttagaactatttagataacatgcaaacaacgatagaatgtccccttaagagtttaaatccactcccctaaacagcttctaggtgtacttaaagttataatagcactcccttcttccatataaggtctgtaatttcacacggcttctaactttaaccattagtttattgcataacatattatcaacaactatgaaattggtattacatgaaagtattttttttaatacgagtctaatgatatactccctccgtcccacaatataagggattttgaatttttgtttgcaacgtttgaccactcgtcttattcaaaattttttgaaattattatttattttatttgtgacttactttattatctacaatactttaagcacaacttttcgttttttatatttgcaaaaaaaaattggataagatgagtagttaaacgttgcaagcaaaaactcaaaatcccttatactgtgggacagagggagtaattaaactcagttgtatattgttagtttaattattgttcaaaattttcaaatattaatttctcttaaattaaggtcgccttataatttatgacggatggagtacgtacatacatatacatatagtattgttgtcaaacttcataacctagaccccatctataaataatgaggggccagtagatgtaaaagcatggtgaagaccatggaatgcaagagccaagagcacaagaggagaataacatttgggtcatggactctcgtggagcaccgttcttaaaaagaccatatttctaggggagtagggacggagggagtagttaagagatctgaaatcctttttatcctcgaaagatactagacagatacaaatagttttaacatgtaaaagtattgcacgtcaacatattagaagaagaaaacatagtttagttacacaggggaacaaacggttagaagaccgttgctaggggataaagaaaaaagaaccgaaaacaagaacaaacaaaaggtagctactaagaggaaaaaactcctatcgtgagggaggggcgggtgggggaaaaccactaaactcccaaaaggcccctacagcagcagagccaacaatggaccacaaacgaccttcttagaagatggactccagcactaccgaaaccgaagagagagagagagagagagagagagagtagtcgaaaaccctggagttctgctccttccacagttgctaggataccagaagaacaagggagtcgaaacccttgcgaagatgctctggcaggcaagcccgagcagtcagccaccagacctgaagtgagcagccatgggaagtggcgaggtccggccagctaggaggagaaagaacattgcacgagacctggcaagtgaatacacagtcaagaaagatgtggttcaccgtcttaagctcttgggtgtagaaaggatagtccgagtgtctgtcaatgccacgcttttgtaggaggtcagccttccagcaacgctgttggagcgcaagctaaaggaaaagcttgcacttagcaggacctttgaccgaccaaagcaaatcagcgcaagcgaaggagtgatggccgagaagaaagcctggtagaccaagcgggccgagtaacgctgatctctcgtccagcgcgagacaagttcgtcttcagtgctcggagagagttggacaggaagcaccatgtcccgaaagcaccaggaactgggggatggacgagacaggtagtgggccatggatgtcccacagccaagagttgccggtgagggcaaaagcgcaaccgtacacgaagccctgagatgtggtggccaccgagcgaccgtcgatccattgattagtctagaaaagagctgacgtaccatcccctagcacgaagaaggtggatgccgcaaatatgtaggagacgcttagctcgacggaggccttcagacccatccagtaggagtggccagagcgctgaagccagagtcagtgaagacgtagagcgaaacccgttgtactcaagtccgcaatgcccagaccgctgacagcttagttttagtagagatatttacactttatgatttacgctaaaaatttctcggtagatgacatagaaaaatctcctagagatccatagttcggcaatttagaacgtggtgacgaaataccgacagctgacaactggaccatgcaccaccggaggtctctatcagcttcctagatggcacaaacagcgatagtatggttgcaagctacgcagcgttctgaactaaaagaagctgagatcttcacaaggcaggcgaggaccacacgaaaggaagctctgggcagctgggctagctagcaagccagccagccagcaactcaactcctgcctgcctcctctgccagaaactacccggaattactacacaagcgtgcgttgcctgctacagtacagtgggattaataactggcacagtcgacacagctgctgcccacgtcttacaacaatgctcctttctcaactactacacggccatggtatcgatcggccgatgaactgcatggttcaagagttcaactcatccgtgcatgcactgccggccgcgatgccgttgcgtaatcagtgagtaggcggtgtggtgcgtatagcaaaattaacgtaccacgtaatgtgggcaccgtatctgtgtggcaacgacgcgagatccacggaggatcgatctgtgtggggggtgcgagtctgttggagcttgaaagcggaaggattcggtggggcgcccgccggacggggggaagggtgtgacgcgcgacaccccgcgaaaggcgtccccgtgcacgcgcgcgcggcatacgtgcgtcggtccacggccacacccacgcatgtgtgcggtgcctgtgggagcgcgtgatgcgtgcgaggcgatcgctcgcgagggcgcgcgcaggaaccaggaggcaggaaggcaggttgccgtgaattgtttccgagtaatattcctcatctatatcgacaagatcaaaggagtaactaggcaagtatacaatataatagttataattaagcatgatagacactacacaacttatagtaattgagactaaaagctctctctctctacacacacacaaaaatgcccgtgcgttgcaacggatgaaaaattataatgataatatacgttttttcatgcataaccatgttaatgcaaatgtttgtatggatcatttgttgataagacaatcagaaaattagaacatcttcaatgtaatgacccaacctcaacgatggcaaccttaccgatgcttatttacctaaataattagattattcatatgacaacatcaaatcaaatcaaatcctacactgcatcgcatggtcaaatctacacaaaacagagtcactgtgcactcttctctaaatactaacaattaaaaatatgtttattttttaataatattttcatatcatatgttatcaagaatagtagctatacttaacaaaaatagtctgataattgcatatagagacgtgcaaggtctacaatacaggagaatacatgatgaaacaaaagtcgtgtaggagatggaaaaaaatcgatggatcctatccaacccaagcgtccatcaattttatctcgcgttaagttggacggttttccagagcggttcttattataaacggtattttttttctcatattgagtcggattggttctctctagcctttttttagaaaaggtggtttttctcttgcgttgagtcggacggttttctcgaaccatttgtagaaacaacaattttttctcgcattgaatccgattgttttttagatttggctttgttataaacggtgtttttttctaatagttttttcagagtggcttgattttttatgaacggtgttttttttgcgcaattttctcaaaccattttcacaaatgttgcatttctttctgaaatttctttcctagcacgttttttttctttttttacagacgatgaaaaccgtatttttctcgcttttttttgctttcttttctcgcgcgttcttttgcctgttttttctgacatttttttcttgcgcatttttcttgcttgttttttctcgagtgttttttttttgcttttttccaatataggagcataaatgacgaaacaaagtcgtgtaggagatggaaaaaaaattgaaggctcctatctgatccaagcgtccatcaatttagtattttttttctgacagtttttttcagagcagcttggtttttttataaacattgttttttttcctgcacagttttttcttacagttttttcctcgcatgcattttttaattttttacggatgatgaaaatatttttcctcacgtgttttgttatttttttaggacgacggaaacctttctttgcgcttttttctgacttattttctcgcgcgttttttgcttttttttctcacactttttaaaaccgtttttattttatcgcatatttttttatttttagttgtacgatgaaaacttttatatagttagattagatttgattagagatagagaaaatatatatacagtcttgcgagtttttttattttttacgaaccgttttttcgcctcccttttaatgttttacccgatttttttttattttttcggactttttttttgttttttttttgcctttcataggaatcatttttttttgttcttcccgtttgtttttaaggggaatcggatctatgattatttttcgccttttataggggaatcggatctacgattttcttcgcctttttttgtctgattttttggttttttcaccttttatcgggggaatcggattttttttagatttttctcctttttttgttttccccgtttttaaggtgaatcggatccttgtttttgttttcgctacttctcctgcgaatcggacttctactttctttttttttatttttttgccacttcttctcggaatcggattttttaaaggtgtatttttttaattttttgccacatcttctgggaatcggacttagtttaggttgtttttttcgctatttattttattttgacttacgaaggaaacatttcgtattttgaatcggatctacggatttattttggttttttcaccttttatagggggaatcggattttttttagatttttcgctatttttctctgattttttttgttttccttttttaaggggaattacgtttttttttcgctactcctgggaatcggacttctacggttttattttattttttgccacatcttctgggaatcagacttttaagtttagattttttttcgctatttattttattttgacggacgaaggaaacgtttcgtattttttaagtagtatatatatatatatatatatatatatatatatatatatatatatatatatataagagacaattctaaaagttcctctctccaccattatatagcaaaatttccttttatcttgaactaaaactagatgcaatgtttcatagatgctttactttccttatcttctctcttctcctcacactactacagaaagggtttttctgtatgaggctcccggaaagttccaggcaggccataagtgccacgcctagaaaaaacgctcccctcggggcctgatgatggacaacacgcgaagatgcattatcgcgtgtggtcctcttaacaaaccgcacgtgataatgcgtccacatcgcgtgcggtccacttaagcgaccgcacgggatgatgcatcttcccgttcggtcgcgttaagtcgactgcacgggataatgtatcttcacgtgcggttgggccgaccacatgcgaaaatatgattatcacaaactttcttgggtgtgtgggccggccttttgcataggaagatgccttttggcccgcacgcaaaaaccctttctgtagtagtgtcatgaagtgattggtctaggtcacattttatttttttttattatacataaaacacatacacatatactactacataatacgttaaatatgatttcctatcaataatagttaaaaaagagtagcattgatggggtttctcgtccaccctacccaaccttgtgtgcgctctgtactagcaaaaactagcattgtatcagaattataatagattataaaatgtgaaaaactattagttccgtaatttaaatgaatcgatgtaaataatctaagccgagccaaaccgagagcctgcaaaagaactttttagccccatcgtctcccccctcactctctctgtctctcattctctcacttctcttcgatccccctctacccggcgagcgctccctactctcgttggcatggtggctccctccccctctttctaaatcatgtcgtctagggctcaggagctactggatttattcgccacaagctcaaaaaccgccagatgcgaggttgtccgagtttagagtgctagctcaacggtggcagatgtaggttgctgcagatatattaggatgggcggacttctccaccacagtgagcagtagcgataagggttatctcggcctccgacaccctttctctgtgtaatttagtttccgttcttccaatatgattaatgttttgacttgttaaagattgattatgtggctaattttttgttggtttttttattcgtttttgttggttggaatcatccacgtcgacgctgatgttcattaagacgacacttatgagatgtcttgggatagtggaacgacactaaacacacaccacactcatgtacccgcaagtgtgacctctaacattctcaaagagatgaagaccgacgacaaatctttagccccaatggatctaatataattgaaagcacatatgcataatatatatgggcaccaagattgaaactttaatgaatggattcatgcaaccacacgactgctagtgtacgttttcctgatgagagttcagtttagttgaagcattttttttctttttatcttgggccagctattagttgatataattgatgttgtacacgtccaagactagtcgtctaggtgctaattaactagctagaagggaagagatattctatacgtgcacgagaaagatctggttgttagatatacggtgacatggggagatcgagatgccatgtccacaatatggaggtagctagctactctttcccttgatgaatgttgcttgcagttgcatcgtactaaagctgatcgatcgaggtagggattgggttgcgtagatagctttggtcccccataagttttttgccaccttattggttatgatagagcctggccatgctttttttcctcttctactttgaagctccttgacaaaatcccagacaaaattagtgcaggatgtgtgctaatctcagcgatctgtagactgtagtagcgagatgaagcgtcttcgtaaagacttcgaacgtactagtatctactgtgatgctgaaagatttgcataaaatctgacaagatctttactgaatggtacctgtgaaaagaaaacacttaaagctcgtccttcttggtcctagttttgaacttacggtaactacacatgttaatattttactctataaagctcatgttttgaactataaactgatgtggtttcacctgagtgattccagaatttggccggtggagcatacatatatatatgtacacacgtttagctttccaatagaaattggatggtccattaaagcgaaatctacgtacaaaactgaacatgtctatctaatccacttgatccaaacaacccacaattgatttacatatgcatcatgcaattctgtgggacaggttgctgctgtggatttggaccagcagcagcaggcatgtacaaccctacccaaaacaaatcctgatgctagttgcacggaacaatatgtatattccaacacgccagtacatctgtacatatatgcatccatgttcggaacatgtacgtacgatcactgcaccacgctagacaattagctttgcaccactaaattcagagaactggtcatgaaattaactagctagccagccagaaaaactaacatggcaaaccacacattactaactcgcttgctcatgtgtcataggctcctttttaaaaccaaacattgccacgcttaattaatggataagtatttgttagccacattttgatcacacctttgacaaagttaggttgtggcaaaaaggcccatgatgtacagggaaataaacgaaagaagctagctagcatatatatgccatgcacacgcacacacatcgatccacatacatgtctcttgttctcagagcatcacacacaccaccaccccagccgatccagcatgcgtgatcgatcaatctaggctaattaggtcgcccacatgcacctcgtgcagtgaacgacacgatctcggtaggactccgactcgatcctccgaaccgatctctgcaatttgcaggtggctctgcagaaacgggaaacgtaggggaggcccggaggccggagcccggaggcgagactcgagagagggataagaaaggaggcgagcgcgttgccgagccgagcgggatgcccgaaacgagacggtgaaagcgtcgggagatcacgatgagatcgcctccaaatcgcaggagatttgcagggagggagaggcagcgaaaggctgaaagctctcctttcttgtggtgtggtggtgggggccggctcagctagctatagctgggcagagctggctgcccctcttgtcttggctccattgaaatgcttctgcgtggcccccgtctcactggccaggacccaggattagggaggttaggccatttggggtctatcattgtggtctctctatggaaaccttgtcaggctcaggtccactagatagggttcctccctttgatggaagtacatgatgtgcactacagcttatggttccatttgttttttaaaaaaggacacgttatataaacgtaggtgttcacacgcacatcctatcacaataaatatgttcgaaatactggaccgacatatcttgagtggtttgtttttaatccctcaatgatttgggttgttaattggattttgggcgaaaatacttctaggcgatctaaatgttaagacagtttatatggttaatggaacaaaggaaatatgctactcccttcgtcccaaaataagtgcagttttagcactgtttatgtctaacgtttgaccgttcgtcttatttgaaaaaaaattataattagtatttttattgttattacatgataaaacattgatagtactttatgtatgactaatttttttttaattttttcataattttttcaaataagacgaacggtcaaaatgctaaacacggatatctatggttgcacttattttgggacggaggtagtaagagataagaccgtgcttcatgctgaagactctgattttttagctccagttcatacagaagaatgaattatttagtgctctttcaactaaaattaacaattaacataactaattaacaatttgttcgaaattacttctgaaagttctcaaaccatacctgaataggttcaataagaacttcacttgctcaaaatagaggaaatcggcaatagtactacatatttacatgtgagttttgaagtttcatgggaccacgactactcactggaatccttttacaaaaaacagtacactggcaagttgtacgtgccatcaatagaaagctctaaaagtaagtggccaagatcccagcggaatctgaattcaattgttcttttatatttttaatttgctttaaagtaaagctttgttacttatttttaaaaacaaatgttttagtcataccacccaaggttgggtatgctatagcaagttgcagtagcacaaaatattcatgccatggcaacaaaaaccaagatactttatgccacggtcatatgttggtgacaccagctttgtacgtagggttattctttagaagtctggtttattgggattaatggggaataaccctatacctaaggtgtactattgagaaataaccccatacctaagttgtttataaactaatgtaataaacaactattatgcccccatagcaatgccaatcccataagaaagccccaagggcaacacaataatttttcgttacatatgaataaataggaccctcaaggggcaagtgggaggagggtctcccattgaactgccatcatcactctcttcctctcgtcttccctcctacgagtctaaacttgagctcccttcgagagaggggcgtccttgttatgcatgttagattttgtttcaatattgatgcaatggttgcagtgtattatagttggagatggtggtgaaagtgtttttttttacgcaaggtcctcggtatcgatatattcttagaattgatggccattaattctcatgtaatccactatgttttatctttgggtgcgtgtgagttggttgtatgcattcttatctatacccagtggttattgtcagtaaatcatttaccccttaaacttcttaatattaaaaaaataaaatctaaataaatagtcatgtacaaaattatattaagataaatattttctatattaaaaagatgggtaacacattaatgcatcttattttatatgtagcaaatcacgggcaagtaattatgcaaaggttggtagtgttcttaagacaaccgtatcatctatatgtaatttactatgttcaataaagtttttcaattatacgtgcaaatgtaggcaaccccaaaacaaaatcaatattgaaacgatatttagtcaattttttttaaaaaataaaataaaatatacaaaactgcaaatattttaatcaaactatttcaaaattacagatttaaaataatatataataaagatatggatttattatcaaaattattattaaactacgggttcaaggcaggctatcataagactagagatttagtaataaagttatcacaaaactatatagagttattgctagcactattaccctgtgatattataagtgttgtagtttggtgataatactgccactaaacctacagttttgcaatattattacccttatttgatcatagacttaatgtttaatttaattttgtatacactattttaatcttataaatttctagtagtacaatagtttggttaagaaattaaattttttacaaatttacttacaaaatacattgggatataaatttttttcttaaattatatgttttacatttataagtaattgattatatgaaatgcaattgatagatatgagttcaactaaatcatcacacttttgtttttcttcccttttattatcgtagttagaactttgccaaccccttataaaaattatattttaccctacatatatggctttccttttatcatcgtagttagaactttgctatccccgtataaaaattttataagtaatttttcccctacataaatgaagaagtattcactatgttatattacacttttaagggtaacatgatatgttgcttggttttaacggaagtccattgacgacaatgacaaaaaaaaaatgcttgtgggatgctatttcatagaagtaatatttattgatggcaatttgtaaaaccaatcacttgtcaaaatgtaaaatttctcaatatattatattggaaataagttatcttaaaacattttctttaataaaaagttctaaatacttaaccagaaaagtcaaatctaaaattacagatactttacctaaattattacaaaactaaatattatttaaaagttaagtaaattttataaaactaaatatactttgatcaaattatcacaaaactacatatttaagatgatataactacatatttaacaataaatttatcacaaacatagggtttaaggctaagtatcgcaaaactacaaatttaatgataaaactatcacaaaactaaagattttggggtttaaatccttaacgctaatgctgtgtttgagctatagatatcaaagttttgtgatttaatttattttaacactatagttttgtgacatttcaccttaaacacatagttttgtgataaatttagtgttgaatatgtagttttgtgatacattgttttaaacctatagttttgtgataatttagccaaagcatatgtagttttgtgaaatttattcttaaaagtttgtgtaggagaactatacactgatttcggttaagtaagttataagatgttttgcgttccatcctcacatgtataattagtgaacgagttaatacttctacagatttgcaataacctgataataaaataggcaattgtaagtaagttaatgttttgagctccatcctcacatgcacaattagtgaacgagttggtactcctacatacctgcaataacctgataataatatagacaattgcatgtaagttaatgttaatatttgagctccatcctcacatgcacaattactgaacgagttgtacatgagttggtacttctacatacctacaataacctgataataatataggcaattgcatgcaagttaatgttttgagctccatcctcacatgcacaattactgaacgagttgtactcctacatacttgcaataacctcataataatatagacaattgcaagtaagttacaagttgttttgtggttcatcctcacatgtacaattactaaacgagttgttgcaagtaagttacaagatgttttgagctctatcctcacatgcacaattactaaacgagttggtactcttacagaattgtaataacctgataataaaatagacaattgcttaaaaaagatgccacaagtttttcttctataaacttttaaatgtaactacttgtagtctaactataatgtaatttgtactatagtgtaattaaactgtataactatattattatctctatataacttagtataaagtttcatactttttaattttctttggagaaacacagtacaaacagtacaaacgcagacgctcataacgcgcgcacgctcacccctatgaacatacatcctacccttacgagtgcctccgaaaaattgagacggcatatcatgagattaaattttaatacttatagttaattgtagtataattacggtaaaattatattacaatttaaaatttttccataaaaaaacttacggtatttttttaagatagtcccataaaatatttacaaaactttgtgaaatttacctttttaaaaaatccccaaaccgcaaactgacagtttcccaaaaaaaaaaactgagtccaattatcacgggggcttaggtggcttcactctgaactctctcacagcctcggtgtgagatcggatgagagggagccttgcccctgacatttcggccccattttctcctacaaccttggacaagagaggagagggagagaagggaggcgcgtgattcgatcgagagaatagggagcaaagtggagcgagggtttgggcggcaaatcagccgggcggaaggaacaagattccttcgacgacgacgatctctctatctatctggatctcctcctgctccccgagtctcccgctcctgccaccactcaccgctcgctcccacactcttcgccctatatatataccccctcctccatcgattcggtagcctgccacatccgtgcttgcatgcggctcaactcctcttgtgttcctccgagaaccacgcctccatcgatcgatcgtctgcgatccttgtcacggcttgaactgtgatcaagaaacgcctttctgatcgatgcgcggttgattgatcttggtgcggacggagggagagagagagatggtgcaggagcacggcgggagtaaccacctgcagcagcagcatcagcaccagctggcgaagtacggcggcggtgtggctggcaccggcgtggcgcgggcgtcgaggaagaacaagcccaagaaggtgccccagcgcggcctcggcgtggcgcagctggagaagctccggatcgaggagcagaagaagatggagggtggcgccgcgttgtcctcccacggcgcgctcggcggcggtgatggcgtcctcggccacctccctcctccgccgccgccgtcgctcgcgttgagcgccctgcagtcgaggtccgccgcggacggtggcttcccggcggcgctctggagcccagtggatcccatcaaacacccgtacaagaggagcctgtgcccacagcctccatccccgatggtacgtgtctttctcaaacctctccgtgtcgcggcgcggcgcgcacccgccggcgtggtctggtctcaaacccgctcaaatctctttggctgatcaggtgagcacgggcctgtcgctgacggcgtcggcgcgccacccaacggagcccccttcaaaccaaatgtacagcagcagcggcagcaggagcagcgccgcggcggcggaggaggagagggtacgtctcaagcctcgccgcgtgccgagtgattgcgtctttgatggtcgctaaatgtgagcttggttagaggttttgcaggagacgggcggcgtggacaggtcatggcctttcatgttcaagggcatggccgccttcaggacgacgacgagcagagctcctcctctggtggcgcctttctcggcgaggacgacgaccaccggcgagctggcagggttggccgatgttggtcctgacctgagcagatacgagttcagagcaacaaattatttcaggtagatttgcaatgctaattaacttgttgattgattctgtgctttgtatcttcgaaacaaagattctgtttttctttcagaagtacaatcattcattaaaaaaagtgaatctttactcggttttctcttgctctgctggagctgaactagttatttcatttgcatcactgcaaagtatttcaccgtttttgttaaatcttactaggttttctctgcctttttttttctgaacatgagttttctgtgtcccaacaacatagtagcaaaaggcaaagaccaaacgaatgaacttgaataccttgttttccttgaaaaaaagagtagcacattcgggtgcattcttttctcttttcgaattggattctcacggataatttgattttacttttgatctgtgatatgcagtgccaatgcaaattattcagactggacatctgactttgctcactgcaaaagcagcaaggagaacggccgtgccagagaccctgccttcctcaccttgagctcacagcctccacacctcctcaagcagcctcatgtggtgccatcatacaacgacttcagtgccatggcatctcaggcaagtgaatgatatgctctaccatattctgaaaccagtaatgtgtgacttggctgtgaaattgtggtggactaactgatgatgaatgtgaacttcagggaagcaacatttcatcatcgtcgtcgcagccattctacagcttccttccagtcggtccggttcgttgcgaaaggaccttgagcgagtgcaagaccgatgtgtctgaaggcgtcgacttagaactgaagctaggaaattgctgaactgaacttgtcctgttgctttctgaaaaaaaaaaactgcaatgaggtttacccaattaccctgttgtgtgaaaaaaagtagaaacttgtttagtcagtaagaccagatgtataatcagttgcttctagaagatgctttccctcccaataatcatctgctgatggtttactctgtccccagttcatttctagcaaagcaaaagagtgtgcataatggaaacatgaagcatttatattacacacatgggtccagataagatcgcgccaaatgtagtagaaactcaacagaaaagggtgtcagatgaatacatcatgtggtgttgatgcagcaacagtttcaacaaggaaatgagagagcatgtgctggatgggcaatacagctaatctgtggggtctgttttttcacagatctagcacaaggcacagtagaaaactgaacattttcagacatagatgatgtgtgtgccaattagaaattcaaaagggtttgtgtagatgtaagatgtaatctacggttgcattgcaagttgatttttgttcacataaagggtaaagtcttagcagaattctaaaactgtcaaggacgccaattccagaaataagcttgcttggttactttcaggcaactctcaatttatatattatgctcatctctgttcaagatcaggataaactagaacaaatgggaaccttaggataggcacaagttacaatgcacagcgtgaagtgcagacagataaattacagggagataaatttacaagatcaaaccgaagaaaaagtaaccgtcaaaagcaggagttcagatgcattagcttatgaagcagaagttcagaagcatttgcttatgaccagccaaagacgaagtcgaggatgtagacgacaacgagcgaaagcgggtaaagcatgtacgccaccagacaggtccagagcgggaatgtggttctgaagcttgtgaagagtcccatgatgacacagacgagcagtatgatgagcacctccgatgagaagtcccatgtcaggttcctgatgtagatgagcgccaagaacacgcccaagcacagcgtgttgttcatggtcacaccaccatatacctgcaaacaaagaatcaaacgcttagaatcagtaacatttttgtgtagatttagaaactagaaacggtttaggaagaataactgcttctataatgtacctcagagaaagtaagggaactggtccgtagcttcttcctgctagcgaagatgatggcagacacagcctcgctggagttggtcgccagcgggagggcgatgaacgaaatgaagaaggatgggatgtgcgaggcgttggagaagttgtggacagcatcaacaagcgggtctgcgaatgcagcagcaatggcactgccgagaagcaggagtcccacggctttggtgatgcaccagccagggttctcaacgctctcaactgtctcgtcagatctgtccaccagaaggtcgtgttcctgccttgttctctgcagaattcagacattttttcagcacttaaatctctagacgtctgagtcacattcctatatctgaatcttttcgtgtatcgcctgtctaagttatgctacttgatatagattttcagaaactaaagcactagaggaaggaaaatatataccgcatggtaatcagtgatgaacttattggaataggcaccactggtagggacgctgcgcttggcctcattaagccatctcttcatccccgagacaaactctgcctcctcgacgatatcattgcctgacgtgtcaaagtcatccatgatcttgtcaacagcgtcattcttgtcaaagtcaacctcctcaaagttgataccaatgataagtgcatgaagctcagcacgggacagggtttggctctcatccatgtcaatcttgtggaacaacctgcgtgtgaggatatacaaggttcatgtcaagttcacgagctttctgttggcatatcaagagaatcaaaatgtctaagcacccacttttttatgacatcttcattgggtgtgccatcctcattaagcagccgcccgagcgcttccatttgggcatgcctgaggattccggagatcacatgcttgtgttttgcgtatgcaagcttcctcttctgaatccatggctggaaaacctgatgcaaaacgcagaacctaacagtcaaaatctagagacaagagtttccaatctatgccatcgtttcaggaggctcaagtgtccttaaacataattgtgcttacctgataaaggcaataggcaagcacaagcgagaatgatacgataagtgccagcaagacagctaggcgctgtccgtggtgggtcttcaacattttggggaattgagcaatgataaagggaataacagaaatccccatgatccgagctgcatagctggtttggacatcagttgaaataccagtgcctgcaaaagaaaatttgtgcatcttacattcaatatatacagaaccagtaggtcaaagcagtgtaaaggtaaggttaacatagtggcttgtggtttttaacatgttaaccagaacctccaaattgaatgcatccttacaaagaagcagacaaagatcagtgtttgtaatttaaactccattctactttaggatttagatgtaacaggatcaacaattatcagaaagactacattaataacaatgttaaatacaagaaggcaatttaccagtcaagctgaagcccttgttgttctgtaaatcaactgcaacgccatttggaccaatgtcacacttgccaacaacaacacaggttccccacagaagggtgagaagaaagacggtcgaaccagcaagcaaccccattccaatcaggacctgactttgtgcggtctctctactcccggacagaccagacactgttaatgtgacagaacaaagagatcagaactctaattggatatagttggatattcagagcagtaaaaggtgagtagcttcatgattgtagcatatgtaccaggagaaatctgttttgagcaatatggatatgcaaaatgtcaaaatctgcatcataccataatacaagatcggtggtcaaaatcagagaactggtttttataggagtaaatattctttttattaatggcacagaagaacattgatgtttagacttaagagtggcagagccagaaacgctaaaaaaaatggttgaagagggccaacagtgctagttttttcaaagtatgccaaagctacagtaaatttagtgtgaaattagaatccatgggggaggacacacgcctgtctccgccctaggtaagactggtaaggtggaaaacaaatactaatagagcaaaatttctagaataatgagttgatcaaatgtagcattatcatataaaaaaggtgtaccagcatccacatttaagtctataggcaagtcctacatcggtagaatacatatttcatttcagatctcattgcgatcaatgaaccatgtgcagccatgctatcatagtaaagtgtagccaaatcagtattgtgttctttttaatgaatgagtacctgaaaatgagcagatagctacaaatttcactaatattagagcaatattgcctattatctatggagaattagaatctttatggcacacgaaaggatttaacgaagagggtttcctcttataaaagtttatgaatcttagagagtagttaaaaaaaacgttaatcactatttcctatgtcgcaaaataagtttatttttcactcatcccacatgtaccaacacaaaataaaaaagactaggatactcccactatatcaaatcccaacataattattacttgtactattttatttttttgctcgctctggtctgcattgcacggtttttcttttctcaaatcaaattccggcagagctcctgccgtcagtttcctcaaaaaaaaaacataattattacctactttatctacttacatttatttcctatttttacaaactccgatgcaatgatttcttaaagataaatttatattgggatagacgggaggagccaaaaatgaacttattgtacaacggaaggagtacttcagtactactacgtcacaaatgtttaccgtgatagttcaagcatgtgattagtatgatctgctattttcacgtgacaagatcggcaacggtcttgaaagaaagacggaaccgaaaaagcataatttctggaaagctaaactccaacggtccaaccactctatccagttgcacaacatgttgcctttcaatgtgttcagttaaactacaataatttggttgcatacaattttacaaatatataatttggaactttggatgtaaaattctatgagtaaaatatcaaatctatgccctattaatttcctctgaggacaaaccatcgtatttgctacgtacaagaatagtacaagataatgcaacacagtaaaagtgcatatcaaagcaagtcgatcacttgatcacatccactaatcagataggtgcaacgcacaaagaaatattccatacaaaaagggtcaattatgcaagaacgtaataatgaaaagtaaacagaaaaggggaaaggtcaaaatgacaggacaagcactggtggaactttatcatgctagcttatctgacacatttcagagaaaaagcagagctcagtagaactaattcctcgaataagcaggaggttaatcaaaaggcatatatactttgctagagcttatactctgtttttcttttcttttgaaatagtagaacatactctggttcagtcacaagactaacagaaactttagatctgaagcaaaccaagaacagacaaatctctaaatttacggatatgagttacttttttacccttcataaacacgcaagattttaccagtgctaattccaagaaaaactttgcatcctcgaatgttaaaaattcaaaagtttcactataaaatccaaaagtcttactgctaga

SEQ ID NO: 74214 - DNA, 2795 bp, Oryza sativa
tgatgaaaaaaaaaagagaacatcagcacttcagcagggttgtacttgtaaataggcaatgctgtacaaatagatgactcaatttgacaattcagtaaatgctgcactgtaaatgctaatttcaaaatgactctaaattcaatttaccttggagatgagcctcgtgttgaggcccaggcgggcggctcctgtcagcgcgttcccggcgttgccacctccagacacctgcaacaatggcgaaaccccaagaaatcgccaggagcgaaacgtcaatcttttccccatgtttcttggtgaagaactaaagaagtggggggtttggtttggtgtggtgtgtcacctgcagctcgccgctgcggatcttgtcgtcgggccgcgggtacgcgtccaccgtggcgaggtagtccagcgtcaccagcccgcaacccagctgcaagaagaagaacacctcacgccaggagtcaggtcaggtcagaccaaccaaaggcagcgggagagcagagggcgcaaatcacagtagctcaccacgacgcggcctgcggcggcgggagcagcggccggcgccccggcggcgcagcggagaggagggagccgctgcggcggcgcgggagcagaggcggtgacgccgccggcgagcagcccaggaggagcggcatggtgagagcgagtgattaccgctcgctgctgccggtggagccgacgagagttgtttggtgggtagttggatggatcatggatggctcccgttgtcattgtcgcgtcgtcacctctgattgcgtcattccatttccatggattgctcgatcagttcagacattttcgagttgaagaaaaagtttagaaactttcacctcaaagaggggagaattccatctcaaagaaagaatttccgaaactttcagtgcctgtaatttttatttaccggcatccaaatcccaagaactgatgttcttatcagtgaagtttgcagacctatcttagacatgcatggttcttagaaaaactgaacacatatgtcgaaaattttttgggactcttgcctttttaatttcaagtaggattgagctaacaatgatgccagtacagcaacaaaaaaatgcaaatatatttctttcacacctcaagttcactttataacttaaaaacacacaaagaaaggaaagaagagccctcacatttgcaactttattctgcagaaaagcccctcatttggatcgcacagaaagaatggctgagagccagacgaagacgaacagctcatgggccttaattcgggatgtactatagactttgtttcatggaccataaaaggcccacattgcgagcccagcccaactccgccacggcaagacgcaaacctaagcttaaaccgcaactataaaatgcagcactatctccaaaccctcgcgaaccctagcgccgcacacacgctcaccccacctcttcacccgccgccgccgccgccgccgcgcgaagggaagcaggaggaggagccgccaggatgccggcgggccacgggctgcgtgcgcggacgcgcgacctgttcgcgcggccgttcaggaagaaggggtacatcccgctcaccacctacctccgcacctacaagatcggcgagcacgtcgacgtcaaggtgaacggcgccgtgcacaaggggatgccgcacaagttctaccacggccgcaccggccgcgtctggaacgtcaccaagcgcgccatcggcgtcgagatcaacaagcaggtataacccccgatccccaaacaccccggcggcggcgccgcctctttgtcatagatctgtggttgtgtcgcttaagtgacttggtgtcatgtttttgccccaagtgactttggaatcatgtagtttagttgtgccaatatgaaatttcatttttgcagttgcaggaatgggaagccattgcatactcttgcatggttgtgtaagatctgataaatagtgtagtctagatggtttactggttatatttactggtaacatttgtgcgattttactttgtgctttagtatttggattttgttttctctttaaatgtattgagaatgttgtgtactgaagtagagctattgtgattgtggctttggttcatttcatttctaggtttccattcgtccaagtaggatagtggcaaatcaatcctcaagtttacgtcgattgtattgttatcggttatgtggaaagtttaaccgtttggttttatgatgtagttatgagaagtgcatttaaagatatacttctgattgttcatttaatcctgtgtgcatgtgtagttatatgtttcaatcatataacatgctaccgtctaaacacattctgttggtgtagataaattggatagatatgtagttagctgtcggcatgtgtaatgttcagtcatgtggatatgtagtcttcgggattatttaatttttgaaatcatgtatctgttttactgattgtttgttaatctcttggtaggttgggaaccgcattatcagaagaggatccatgtccgtgtggagcatgtgcagccatccaggtgcactgaggagttccgcctgaggaagatcaagaacgaccagttcaaggcagatgccaaggctcgtggtgaggtcatcagcacgaagaggcagccgcagggtcttaagcccggcttcatggttgagggtgcaacactggagactgtcacccccatcccgtagatgtggtcaatgatttcaagggtggttactaggattttcaatctatctgcctgcgctaccaattttaaatccctgtcactctaatgagtagaagtttg

SEQ ID NO: 74215 - DNA, 1013 bp, Oryza sativa
aatttcaattgccttattcaaaattttccacttatcgggaacacctttgcatattttctacttactccattattaaatcgctgtaacatatgcattattccccaccatccataggcacatcgtcgtttttaaacttctctgtacccatgacggggcatacgatctgtctgctttacgattctagcttctctttaagctaaattactttatatttacaactttcttttagagaatttttctatttactttcatgttccctagctggaatcctattttgtgctgttttccactgcattccgtcctactatatgtaaagcggaatatgtctgtctagagctctagggttcttttttatgtcttgggccaccaatgaattgtttacgcatatatgtatgtgtagattcttgagtacatccagaagagtgtagagatgctcagaaatgtaatggattccttttggctttggctctaagattgtagtaaaagagaatccattatattacatgcgggatagagattaattaactcgatcatcaacataggataaagaggcgcaaatataccgttttatattaaagccaaaacataacctaccaaaattttggtgacttaagtagtaaaataaaggaaaaactaaggagttatttagtatggaaatcctacaaggaaaaaaaaactagaaattgctactccctccgtactaaaatataagtgtttttggatggatgagatacatcatagtactacgaatctagatagtctcttgtccaaattcgtagtaatatgatgtgtcacatctactcaaaagccctttgtgtctcgaaattcctatgtttttcatatagtgctatcaaaaaacattttcacaatcttgtggatttactttctatagtatttaatgaggtgtggcatcctattttacaaatttgtgtatttactttccatattattcactgaggtgtggcatcatgttcttgtattttctaaatcctgattttcaaatacctgaatgt

SEQ ID NO: 74216 - DNA, 1268 bp, Oryza sativa
aaaattatatcccaataggctctatgaatattatagtatttataagattttatttgacttgggcttttttatcaatttatattggaatttggataaaacttctcgaaatctcaaacagtttctactttcaagcctcgtcggaacgtcgaaatttcgcttaatccgattggatttcgtcggaatcgtaaaccctgatagcaaaccaaacatattctttggactttcatgctctttgcatggaattttggacttggttggtttgtgccaaaggccctgtttgggggagcttggcccaactatagcttttcccaaaaagctgcttctactagaagctaccccaaacagtccacagcttctaagaatctgtagttacagattctgaaaaataaactaagaagctgggtttcagagctcttccagattctcagaagctggctaccaaacagctgcttctcagaatctaaaagcttccccaaacagacccaaacttacccaagccaaaacaattggcaatgccaaaaaataatcattcacttggtttatgtaaaggtttatgccaaaaaaattgacaaagtgattaggaaatggcctttatttcctgatgcgtacggatgtaccttgcctgcttggcatgcttggtagattcattcaatcgagaacctaaacaagtaaccgcaccagtgtatgacacgaaaaaaacacaacacgtttccatcttactgccataacattgaactatatagaacttgtggtagctcaccatcaagctgcacatcaatgttctcctcccccatcgtcatcatggcagcggtggactagctagcttcggttccgcgcgtcccatcaccatcagcatcgatcgccggcatcttcaggtgtcacgggtgctagtttttttttttcccctggtgatcgtttgtccactatcctaacacgcgccactgttgtacacataaaccgccttctcttctcccccgctgcatcgcacgatttcgcaacgacgatcatacgattattccctctccctctacgtcgcctgctgcacaacggaacaaacagccgttttcatgttcgcgcccgcctactcgtcccagctcgtcctgagtcctgacactggcttgggctgacgcgtcatgtacatgttctcatacatgtacatgttctcatacaatttgttcggaataaaatcctgtggcgctgtgcatatggctggctggctctggctcggctggacctgaatacgtacgtacgtatttgacatgcactgg

SEQ ID NO: 74217 - DNA, 9393 bp, Oryza sativa
atctttagtcccggttgataatatcaaccgggactaaagatcctatctttagtcccggttggtgttatcaaccgggactaaagatatcggggggcctgacaaggcctgacagatttagaaccgggactaaagatcatttttagtcccggttggtaacaccaaccgagactaaagatcaaatatgcccgctgtagccaccaaccgggactaaagatcatctttagtcccggtttttagtggaaccgagactattgtggatttcgggcgaccgaccaaagatggtttctccaccagtgaagagtccattgcatatggctctcgactcgtgtcgagcacacatggctgatggctcccacgtacgcacccgcgactctcgtcgttccggcgtgccggcgatagctagcttccagtacctgctactgctacaccgatcgatatgatcctcaaccatgaaaacacttgacacgcttcactccgcaatgcgcgcgcagggatgtaaaaaaagctcgaggctcgcaaacagctcgagtttggcttgtcctaggctcgattcaagctcggctcgagctccaaacgagccaaactcgagcctgagcaaaagctcgcgagctttaccgagtctggacgagcttgactgtgtatagtttgtattgcatgttcatcttattaatatatatatatatatatattactatctatttacaaaataaattatcatgtgttagcacaatatatttattttaatcattttatactcttttattagtgtgattaactagaaaataattatacttatcaagagattattattatatatatattatactatttatagccgagctcggtaccgagctcgagctcgaacgagctcgagccgagcttgcctaaaaactcgaaggtgcaataggcttgacttgagctcggctcgagcttgtgtcgagctcgagcttgggcagtcgagctcgctcgagctcagctcgttgacagccctacgcgcgcgtcacatgtcctatcaatccacgcgcgcgcgaccgggcgatgagattgacactaggcactatctactccagccaagtacgcagcagatgtcacagccacgtgggcgacgcatggacacgggataacccatcgcgtgcgtcaagactcgagagtgcaaagcccagacgaccgtcactgagcggctgtggatgtggactggacgcgcgacggcacgacgaaagagctggatcgcaccatgcgacgccccccgtgcgggtgcggcatgaacgaatgccaagcgatccatagcctcgaaacgccggccagaaaccctgcgcaccgcggagcgtcttgtcgtttatttccacactagttcgggagacaaggtttctaactttacctcctgatacataaacaaaacaaaaaaaatactcgttctattccaaaatataagacactgtttttttaaatgtttcacaatataagacatgctgctctgctgaaaagtttggtgtgaaagaaatagacagatcttcaaaagcaaagaactttcaatactttagttagtggtaaaaatactggatgaagtgaaacttggtctgtacgtggagctaaggacattgcgagaataataccttagcaagctctgatgtagcaagatgtgttcatttttcatgttactttcctgtcacccttggtgattatgtcaagattctctcctacttaaataaaaccagctttgactggtttaggtttaaaaaaagacatacatgtaattaactagcccatctaatctactaaattattaatatttttaacttttttactctcaaaatctctaataagcatgtgtacacaacatgcggtgtgatgtcccatcccatcctgattttccgagaatgagataattccattctataaccgttattgttctttttttcttttaggaaaatggatggcacgcattcggtcacaaataattcagttcaatcttttacattaactagccaaacgcacgtgcattgtaacataatactccctccgtttcacaatgtaagactttctaacattgtccacatacatatagatgttaatgaatctaaacacatacatgtgctagaaagttttacattgtgaaacggaggaagtattaaacatagcaaaattaagtccttattgaaatatatattataattgactggttgattgaaacaaatactttttatattaaaaacaaacaaaatgtcatattgagaaaatcaaagagttacagtctagagtacatagtgactcacctaaattctaatatcatgttccacatgtcaatgatggtaatggtgaccattatctttttaattacagtgtaaaaaaaaaccaaaatcgtacccatctacctttgttctaaaatattgctatttatagcataataccgtgtcccaaaaataaagttatttctccacttattctatcatccaatcacgaccattccctttcatctatttatcttcttaactaatcacacatattctttagtcattaacatctactttgttaatgcacgtgccaactaaaaaatatctatattttagcacggagaaagtagcgtgtcattgagttgaatcacttcattaggcgacacactgctctgtgaatctggtttacgcttcgagcctgcaatggcagcagaaatagacacacgttagaaaagaccgatgagagaagacgaagggagatgcatactgtactggctatattcggcgcccgatattctactaccgtcgatcgttcggtttatagcaaaggcacaagcacaaccagctgacgctatagcacgctgcacgcccggcgggccaaaccgcagctagctggctagctagcgcgaaaaggagaggctggtcggcaagaaactccaagagtccatgcatggcttcgactcgtgtcgagcacactgcacacatggctcccatgcaggcgcggctctcgttccggcgcttcgaccaattgatcctcagccatgcaacactcgacacttcactacgcctgccttggcatgcgcgcgcatcctgtcaatgttagagcaagtttaatagttgtgctcactacttactataagtgaatgttggagctaacttatataatagattagctataaagttaactttattttttccattctctttctttctcaccctatgaatttaatgcatatttcttgtggcttgtgtgaagctgactcttgcatgagagacaacactatccacttttttttatctctctcttccacataagcatatagcttgcttatagtctattattatccttgctcttagagcatgtacaggctataagccagctgcaaacatattttaagaagataaatgaggagagaggagaggagcgggctacatatttgtagccagctatagtacggactccaagacgcagtgtatgcatgacaggtgggaccagttattaattgtgtagtatataactattgtataaatgagctattagttggctatagatgaattagagttagtagttggctatgctattaaacttgctcttacgccgcgagcggcgatgagatcgacactgtgggcgaacgcacaccaactaccgtattccgtcccgtccgtactttgcgtttgctatctccatcgcactagaactagcttctccagccaagtagtactgcctccgtcccaaaataagtaaaataagtgtagccgtacatatccgtgcccaatgtttgaccgttcgtcttattttaaaaaattatgaaaaatttaaaaatatttattcacacataaaatattattcatgttttatcatctaatagcaataaaatactaatcataaaaaaattcaaataagacgaacgttaacgttgaatgtgaatagtgtaaatctgcacttattttggttcggagggagtacgacgcagcggatgtgacgggcgcgcgtgcgcgaggcgactcagccgagcgagcgagcgagacggcgacggcggcgagagcgcgcgcggacacgggagcaatcttcgcggggccctgtagaatctagcgtacgtgtttcttcccttccccatctcgctcacgcgcgcggtcaagagtgcgaagcacgaatttttttgagaattaatattatttttatggaaaatcgcaaaagtagtggtcaaccggggaaaatcgcgaaaataggtccctgtcgaacgggtgcagttcgatagggcgcctatcgaacggccagagcgcgactggcgacgagatcggaaggctgccgttcgacaggacctgtcgaacggcccccgttcgacaggcagggctgtcgaacagcccccgttcgacaggctgggctgtcgaactgccgcagttcaacaggatgtccgtcgaactgccgcagttcgacagggtcgcgttctccatttatttgtaataagttattttttttaataatatgtaatttattttagtgtgtaagaaaggaaaatatttttgtaatgttatatgtatgtgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacataaatgactaaaagtttaatataaatagataagtcaaggacgatcagtgcccttcgcacgcttgctaggtcctcccttcttcctacgcctaatctgctcagtgggatatgtcaaattatcagggggtgcctatctctagctgcctgctgtggtgtcacgtctggcccctgaccggcctccgtctcctgcgtcggcattgtgacctgaggtgctgcgtgccagtaatccatccctacttccccctggggaggatcagtggaaaagaagtcctcaatgaatgctgtgcgaggggagtaagcaggcactccgtgatgcgtcgacgccgaaccgtactcatcgtctgtttgtacaagagggagaaaccaaaaaatatggcgtagttagtaacaatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagggaagtgtgccgacccagatgctccctgcgaggggtgaacataaggcggagtttggaatacctgcggacgtggtggtgtcgtgctcgacgtgggtacccctgatccggctgaccccctggtgtactccggtgctggggtgtgctgaaaggaaggacgaccgtgagatgtgtgggccgcttcgtacccgcgacgtgaagaggatggaccactccgatccacgctggaacgtcggggtagtggtggtgatggccgtcggcccgacgtctgcaccacatctgccgcgctccgacaggagacacgacgtagtagtgcggcagcacgtgcacggaagttgcgaaggacactcgccacgtcgtcagacctgacgactggaggtctcgcctctagtctttgcagcagggtgtcggactccacgtgaacgtgctcaacaaattccgcctgttccacaaataatcaaggcaattaaaattatttaaccagttgcacatttattaagagtatttaacaagatacacatttgttagaaataatgaaccagttgcacatcatttataaatactgaactagttccacatttatgtaagaaaaggaactaggtgaaccaattgcacatttattagacatactgaactacttgctaactttttaaaaatattgaactagttgctcaaattccacaaataaacacgtaccattgagttataagctgatctaggctgatgggcaaacgtgtcagtaatcgctgcctggtgggggacggtgctatctccttgtggaggaaaacacctccatcgtgtaacactgcggtaccaacgaaggtaagctccataataactcccatcgtctggaggtgtctgaagtgccaagttatcagctgcgtgctcccactcttgtaccgtcggctgaaccgtggtcacaataactagctcgtaggaaagcccgagcccctttctggagtacctgcacaacaacaaattcacacatcagaaaaaatgttgtgcagtgatttattttaaaaaatgtaggattaaacaactgtgatgtgaactaacctatgaagactatcagccaaaggacgaccatctctcggagggaagtcctgatacatgcccaactgtttgagaaccctgtggacattgtgtggctcgacgtgcacgtccaccacgaggtgacaagtcgtcctccagagttgcatatctcgcgtgcaaagatccgcgagaccgtgcggtgcacgatcattgacatcgtgctgagtgtagggagtccaccgaacacggtcaggcgtaagctgatcaaagtcagctacaaactgagtgtagacacgacgtgtcgtcccgctaacccactgcggctgtaacaagtagtagttttcattagtcatataaggaaagtttgtgaactagtattcataatgataacataaacgaatttaacaaaaattacctcacggtgtgtccacaaggatcccatagtgggacgatcgtcgatgtcatcaacaccagacctgtacatctctcgcaaaccgtagtttgcgtacgagtcaagctgaggcctcccaatgtcgaagcgctcgtgcgcccacaacataagtagcaacgggcatccagggagtgaactttgcttgctgttcctcacgcaagcatcacacagtccggcatatgtcgccgcaagtaccgccgacccccaactgtactgtggaatctccgcgataggtaactctgcaatctgctccgcaaagtggatgaattgcttgtccacggagtcagcgtgagttcccgtgaacatcacccatccaaacaaccacaacaggtaagcgactaagtgccgctgcacgatccactcctcctggtcatcagggaagacatcctgtcgaaactgattcaaccaacttttcgtaggcccgtgcccatctgtgagatcctccagtgcaacaggcagcacaccaccaaaactggccagaaggtcatccgcccatccagcattcaccattgttgggccaactgctggcccagttatcggcagccccaacaaataagacacatcctgcagagtgggcaccatctctccaactgtgaggtggaaagtgtgggtctcaggcctccatctatcgacaagagcactcataagcgccgcgtcaatgtggattcgttcggaccttgcacgtgaaggctcgaccaaccgtgcaaacgtcaacaacccagctgctctcagcctacaacatgacagagcgcaagttattaatacatgaaaatataaacaccttgtattagtaaaaacaatatattttcacacaccttggaacccaacgaggatcaatacgccaatattgatccggtcctcgcatctttagcacattgcagaaagttcctgtactaagacgtcgcgatcgatggttcctatcgatctccttgtctatcagctgcccatcattttgatcagccatacctgcagatcgaaaaccacattagtacaatgcacgtatggtaacagtacaataaatgtatgcaacataattcaattaacaaatttgcatgccatttcaatttaaaattacagtaccagcacacatagatacagataagaatagttcagtacatttcaatttaaaattacaagcccacgacacatatattacgatattacaagtgcagtgcagttcgaaatttaaattacaattccaatacaaatacatgacgatattaaaagtgcagtgcagttcaaaatgaaaattacaaggccattacaaatagattcgggtaataaaagtgcaagaaagttcaaattaaaattacagacgcactaaacataaattgaacaataacgatcttcaaagtagggagtccaccaaggataatagcgaactaaggattatttttcttcttcgacttcccctttggaacgcgacgaacatcagcgcctgtggcatcttgccctacattgtacatgctgcaatctttacgggaatggttctccccgcaaagaatgcaagctttcttacgacgagaacgatctttcacttcagcttcatccataaggttcttgatcctgcgtgactggcgacgacccttagtatcaactaataaatttgagtcaggaacccaattggcttgccctggaggaggacgagtgaaatcacacacggcacgccaaccacgcaattcaccacgccaagttgcctcccacgattcttttctaaagtagggagaaacaaaaatgtttccatcaacacccccttttgcggaagcagcaagaacatgggaacatggccgatgtaacaggtaaggcttgttgcaattgcatttgcaagcgtgatactctggccacaacgtgcattccaatgtgatgtcagtagtcccaatgccgacaccactcttgtcacgaagtcgtatctcaaataacaactctctattcccagcaggccacactctgtggattcctcccttcttacttttctcatccatgtactgtgtaatagcggggctatacttaacactgggtttgctgaggttcagactagccatggaataccttttacagagatacttctgtgtacccctcgtgatgccctccaggatagcaacaagtggtagaggtcgtgtattcttcataacccaattatacacttcagcaagatttgttgtcatcacaccatacctcgatccatctgtatcgtacaacaacgaccatttctcccttggctcaaattctacccactccgtgaagcacttcgtggcccttccacgcttcctgcgccgagtaatacttggtgcttcattaggaatgggttcaagtccctccggctcctcctatctggcaactatgggttttttcctaacctcttccatgtgtgtagtggtcaaacgatccagttgctcccatatggcatcaaactttctttgttgattctgcttgcataacttcttgaacaggtccatcaatctcttactcctgaattgtctataaaaattagccccaaaatgtcgcatgcaccatctgctatgtaaatctggccatggcacggactgtgtgacatcttcttgaagcttctgtatcgctgatagcaaaccggcgtgtcggtcatgcagaacacacacatttggtctgttttcaacaacacacattttaatgtgccgcaaaaaccata

SEQ ID NO: 74218 - DNA, 10313 bp, Oryza sativa
  unsure (1)..(10313): unsure at all n locations
ctgtacttgcgtgtcatgaaagtgccatcaacacagagcaaaggaatgcaatttttaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccctcgaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgcttactatcataacaccagtgggcatctaaaccatcgtttaccttcatacgactcattgatatggtcgtccaattatcgggtatgtaagtttcgttgtcccacaatgttgtatcttctccttccactacaagcgcaatgtattcctcgttttccacttccatctgatccactaccgcctcattgtcctccgctgcatcaacagcataggcgaatccggttttcatcgtccgagtcgttggcctcacgattagtaccacgaacaatgacctctccttgtgtattaccctctactacttcttcccctcgaccttgctcagtccgccaaacattttcagcttgtccaccttccaacggagtttcttccaccacggcatgacttgactcccccgatcgatcaacacattttgtcttctgcaccactattgccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactacattgccgtgtactaatttacaactattagtaacaaacaactagtttaataatccaaataaaatataacacctttgtacatattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctctccggcctgctatcccctcccctcgctccctccggcgctcacggcgacgatgtggcgactctcgacggcggctggcgatgtggtcctcaaataaatcgaacaagcatcgcgagctggggagacggggctttaaaccggcctgtcgaacgcccattgttcgacagggtcggtggagggacctgtcgaacgcccccggttcgacaggcctggcggcgcggggtggtgggccctgtcgaactccctccgttcgacaggccagcgtgtcgaacgccagccgttcgacagggctctgtcgactgcccgtcgttcgataggtgccctatcgaattgcacccgttcgacagggacctactttcgcgattttccccggttggccactacttttgcgattttccataaaaataatattaatcctaaaaaaattcgcgaagcacaggcggccgtcaccgagcggccgtcgatgtggactggacgcgcggcggcacgaaataactggatcgcacggcacaaacgaatgccaagcgaatcatgcacagccgcagaaccgcgcactggatcgcaggagctagcgaatttttttcttcttcgaaacacaatttgacaaacctctaatttattaatccagtatacataagttcagtgggaagaggatgcgcggcgactccgatttgtcaaacatgtggcattaggtgcgtagacaggtgatacaatcaaaagcttttatcgcaaaaaagaaatctgaaaaaaaagaaatcaacgcatcaacgcatccctctcgcaaccatccacgactgacctaccaagttgcatcaaatttaaacactcatcaagattcacgcactaaccccacaaattttaatcactcacgatacggtcgcgtcaacttattatttccgctcctctcttgcggtgagttcacgccatccccctccattttccccaaagcaaacgagattagagaaaaaaaagagaggattaatcggtgacaagaggttttcaaaccaaaaaaatcggtgacaagaaaaacgaagaatctgctgctgcgccgcctggaataaaaggcgcacagggctttgggagtttgggaatttctgagccaaggaatctcctcctcttctctctccttcgtgcttctccagtctccacctccctgggcgctgttgccccttccaaatctgcgccaactgcgccaccgtatcccggttttttttcccccgcttcttgtcgctgcgcccaatcaggaggcgaggctgctggcctcgtttcctccgcgcgagggttggggctttccgcgccgcgaccaagaaacggttcccggagcaggagcttggaggcttccgcgtggtctggtgattgagctcgggacgacgggaggtgtagttctgcgcgtcattgccgggctcaaggttggatacttggatttggtgcggatgttcctgtttgctactggttttggggacttttgaggtgggtggtggcgtcagatttgatcgcctttggtgcgtttctctggatcatttgttttgaaattcgctcttgatgctttaagccgctacctttcctgacctttcactccaaaggtttgaccttttgagttcctgtgctgattgttcaacaggtgatcgatccaccagtcctggggagtaggcctaatccctctatgaacaatacgatcggaaaagcagtctcctgttcagatgctgcccattaaactagtcccagtgttgtacaaagattctgtcttttggcagaatacagtgatcccctctgcttcttgtccagggcagaatacagttgctccaactcgatgttggtattgtaggagtggataagtcgtaaggatctttaaactgcacgagtggagcaaagccatggatatgcctacgccatccaaccgtgctggctgcaatggcaacaccggcggtactatgggcccttcagatgatccttatggtgcagcagccatgaaccttgattgttactcggagatttacagcccttcggtggccgaccaactattctcgctgctaaatgatccagctgcacaccggatgtttgctatgtggccatccatgggatcatcgccgtgtgctgctggtacgagtgaagatatgccgctcgatgcatattctggcctaggggaggcagtggaagaaccttctcaaataatgtcagtgaatccaactgaagcagagaaaacgggcaagagttcaggcgagcttggttcggacgatggtgcccatcaagggagtagcatggttccaaggtctgttgtgggcagttcacttgctgacaggatgctcatggctttgtccttgttcagggaatcattgggcagcggtgctcttgcccaagtctggatgcctgttgagcaggagggtcatgttgtgctgagtacatgtgagcaaccttttctactcgaccaggttcttgcagggtatcgagaagtatccaggcactttgtgttttcagcgaaggaggagcctggtctacagccagggcttccagggagggtcttcatctctggggtgccagaatggacctcaagtgtcctctactataataggccagagtatttgaggatggagcatgctctccatcacgagatacgtgggtcacttgcaatgccaatttatgaccccagcaaggattcttgctgtgcagtgtttgagcttgttacaagaaaggagaagcctgatttcagtgcagagatggacaacgtttgcaatgccttgcangcaagttctaacttgatgatgttataccatgaaattatcactttcaaaacttaaataggcgaattttgagtacaagtgatggatactattgctaatgctatcccatctatacttatggctggattctgtagtgcgtcatatgtccatcatttgttagcaacttctataaacactgtggtaaagtacatatactagatatgcatccgattctttgtttcatttgtggatgccatgaagaaaagagtacactgaaagttagatgcaagttttccaattcctatggaaccatacagagtgttcttttagcaaacatatccagtatgtagttctaagcagcgtattgcatactaacgaattccttgaaatcaattattggcattctcaaaacgttttgaggacctttttttatacatatattggtactaaatctttaggattttaactaccacaaaaattccccaaatccaaataagcaaatacccccttgtgtagtttccaccacagtagtttcagtaccctttatataacactgatttaaatatagtgtaattcaccatttggtaatatgaagtagtttcattatcctttattagattgatttattctagcaatcactatccatttgctaatatatcatccggtgttgtcagaaaaaaaatcctatccttcccttaattcctttgcgtactacataataattcactgagttgataataataatgtgaagttgtgggttcatttccgttcttatcaatggtaaactctggatattattttgttttatggtctaatatttcacttggtactttcatttgatactaaacacattacttttctgcaggcagtgaacttgaaggctacaaaaggttctagcaatcagaaggtaccatcttcaccttttgagttctgaacggttatattgtgataatttctcttgcaccccatggaaaaatgtaagttctcattttattgtgttatctattgacgtttgatgaatgtaccatttgtttgtttgcagttttatacagagaaccagaaatttgccttcactgagattttagatgttctcagagctatttgccatgcacatatgcttccactggcccttacatgggttcctacatcaaatggtattgatggtggttatgttgttggaaaggatggtgccagtttttcacaatcagggaaaacaataatacgcatccatgaatctgcatgttatgttaacgatggaaagatgcaaggttttcttcaagcatgtgccagacgtcatcttgagaaagggcaaggcattgcaggacgagcactcaaatctaatttgccatttttctcgcctgatataagagagtacagtattgaggattaccctcttgcacaccatgcacgtaagtttagtctgcatgctgctgttgccattcgtctaaggagcacatacactggcaatgatgactacatactagaattctttctcccggtcagctgcaaaggcagtggagaacaacagatgttgctgaataacctctccagtacaatgcaaagaatatgcaaaagtctgcgaacagtttatgaagcagaagttgataatgttaatgctggtactgcagctgtgttcaggaaaaacaatgagagttgcttgccaactggacacacagaaagttcttcacatggtgatcaatcaatcacaggagcttcattcgaggatacatctttagctaacaagccaggagtcatggaacctgagttggctgagcaggtgctctactaactttaactaaatatgtcatgctatgcacctgatttagtaagaagctgagtgacataactggaatataaactcctttttagtgtgttcgggtcaaaattttcagcagtaaacatgagcaatcaaaatgaacttgaccaaactgaacctttttaaaagtttcttctgtagagatatgtagttctgtaaatatctagaataattgtgtcttagtagtcatagccattgctgaaaattcaattggattatgtatctttgactcttgcctattgaataatgtcatcaaaatcacctttattaatgagatgtgagatttttatatatacctttcagttttattagaggaaaaggtgtccaatggtagtaagctagtagcaaagttcatttgaacatgctagtagcaacccaccatagtcatactgggatgggttaaatccacaaaatccatactcaacattaatacataaatgtaatcaagttgataataaaaagtctagagtaactttcacaaaatcccaggttttgaagtacccataacataaaaccccaggtattacgatttgtttcgaagaacccgaagttttggggcaaaatgtttcaagaaaccccatgttaaagcttatatcattgtttttgctaatatatttatgcataataattgaaaaattataatatgagatattcctgagtatatatacatgttagcctcattttaacaagcattggttattggtagtatgattatttaaatgtataggtatctgattaatgtgtcagtattaatgagataattttgtgtttttttaatcatgcaatgtaagagtaaggaagaagataaaatacatgcgagggatatgtattttgagcctactaatgtgaacatataccaaaaatatgatatataataatgaaattatgagtatttgccataaacatggggttttgctttacatgtgcctcaaaacctggggttttgtgaaatttactctagaatctagaatgtgtgtatccacttgttgactgatctccttctgcgctgcaggtacagcctattccataggacatgcagagaaaagcgcagtacagctgagaagaatattagcttggatgttcttcgtaagtacttctctgggagcctaaaggatgctgcaaagagccttggtggtgagcctctagtgtctttttgtaaaatgaacttaacaaacctttactgtgttatttgatctactttatgtaaatagggtataattaaatggttgactttctgctgatgccttcttttaatattgggtgcagtttgtccaacaactttgaaacggatatgccggcatcatggaatttcacgatggccatctcgcaagataaacaaggttaatcgttcattaaagaagattcaaactgtcataaactctgttcatggtgtggacagatccttgcaatatgatcctgctactggatctcttgttccagtagtttctctgccagaaaagttgacattcccttcttgcgatggtttgccaactccatcagtcggaaaaactgtggaagagaattctgacctaaaatctgaagaagggtgttctttgcctgatggatcgcaaagacaaagttgccagttgcagatctctgatgtgaagaaaagtaacgaggatgaatttcacattggcagtggtaacagtgatttttatggtgcaaatgccacagcaaaatctaattctgaggtcacacaaggtccattatgtcccactggtgcttttagtgctttgcatctcaagggaacagattgcaccaatccttctagctctctccgcccaagttccgaaagcaccagaaatcaaatagttggaagaaactcaccatctatacaacaagaagatcttgatatgcttgacaatcatgagccgaggacaaggaccacatgcacccttctacctctggtatgactgactcttctagcggcagcgcatcaagccaccctaccttcaaacagaacacaagaagtgctcttaaagatgcagccagtcctgcactgacagttaaggcaacctacaacggagacactgtgcggttcaagttcttgccatctatgggttggtatcacctattggaagaaatagcaaagagatttaagctgccaaccggagcataccagctcaagtacaaggacgacgaggatgaatgggtcatcttggcaaacgattcagatctccaggagtgcgtcgatgttctcgactccatagggtcgcgaatcgtgaaactccaggtacgagatctcccttgcatcgtcagcagctcgggaagcagcacctgcttgcagttggcggcacatagctcataacatggtagggaatcctgggctcctgtcacccaaccctcaactgtaccatattacagtaggctagtctttgttgtagcaacagccaatagggtttgtattatgtatgcagtagggtatattatgcagtttagctagcatcaacggtggagtcatcatcccacacagatcagatcatattctcgcaagaaacaatgccattaaggtcttaagtttgttgaacacgagtacatgacaataacctgttgtcatgatggtgtacagtgcttgtgaatcgtggtcctggctctctgttgtactccctccggtttcattttaattaatgttttagacaaagacacggtctacaaaatatatcttttaccttatttttctattataatatatataataaataaatgcatgtttagttttattatagtgctttaaaagacaaatctatatatgttgttctagttcttttaaaccaaatatttttaaagttagtgatggtcaaagttataaaagtttgaccttaaccttgttttttctaaaacgtcaatttatatggaaccggagggagtacatgctcacgaatgtttctgcacatattggtccaactgtaaatctgcttctttcagctctctgaattattgtatattacgacccgtgtgctgtgtacttactactgtatatatctttgtgggcatgaagcgactgagtctattatggcatcttttctgcacactcaatctactaaaaagtgacgctcgacaggaccgattgcttgtcattttaggcatttattggctgaaatgtagccggagcaggttataccgtgtagcagctggtgatttcttgatgatacgaaagctaacacctgtggtcggttagagctaaaaagtccagctgacatgaacaggtcgctgccctcttggttgaaactggacatcatcacttcgacaacaaacggaaccgcacgacagcgtcgcaattcgcgtgtacgacgccttcgccgcaaagcggcatggtggctagccgtagccggtcagtcagacccctctctctaagtccagaactactcgctctgttcacaaatataaacatttctagttcatttcacagagattgagatcgagaagaaaagactttgatgatctttatgaaatttgagatgagtgagggtgtgaaaaagatgtttgacggtaaaatacgaaaaaaaaaggagataattgatgagacaaatactagtactctaaaatacctaaacccttcatcttaaaaaaaacatatgacatgataggacgttttctagtacatgcccagattcattatactaagaaacgtcacatcttgttttaggatgttttttttaatatgatagagagagtatggccgtgtttagtttccctctattcccaactttcaatcacatcatatcacataaaaaactttcctacacacataaacttacaactttttttttcaaactcctaacattcttcaaacttccaactttttttcaggaactaaacacacccatatttgtaaacagatgttaaacgattgagatgcttatatttgtcaagaggagtagcaggggaaactgttttaaacactcgggtggacgtccacccgtttcttgcatgtcatctaaatggttatgaaaaaatttcaaaaaaattgacatgataggttaatatc

SEQ ID NO: 74219 - DNA, 13678 bp, Oryza sativa
  unsure (1)..(13678): unsure at all n locations
aggttttatgacctattgaaaaaaaaggatgaatttgagtattccactttagcaaacaatgaaagattaaatcatgcaaaacagtaaatgattgaacttcaagcaactattagttccaaagagaacagataacagtgcatttaaggattctgatatacccaaaattttctgtacctgcttttgacttttaaagtctgatacatcccacagacgaatagatccatcttctgatgacgtcagtatggtttcttttgacttgggattccattcaccaccggtaagcccagaaatgtgcccttttgtattcttcagatctcggatatacatgtcacccttaataaactcacctagtgtgagcccgtcccgatcatatatctgattacaagcataattccaaacatcaatacaattttcaagtcatagggagtgcacttttgggaacttacagaagactataaaggcagattaccttggcctgagctgaaccagtaacacataagaaccgatccgatgttgggctccaacttaagctgcgaacttggtgcccctcaaagggttctaactgcctgaatgattgcagctttgagttcataccttggaagtcatacatacatacagtgtagtcatagcttccagagagcactcgggatcctgtatggtcaacagcgagggctgagacaacctgcaaagaaaatcatttaattgttaaccagtaaatacaatatgtgtatctagtaatctcataacaaagacaaaaaaaatggttctggaattaacctatccctcacttgtgtacctcaactagattaagcaatcaacaaaaccaagtaaacaactaagcacgcaaagttgcagaaatcccttaatggcaccaccaggagaccaaacctttgagggccatctcaagaaagcaccatttgatttattccttttcaaaactaaaatttaccatgcccttcatctagctaagatcaccaacaattctctttctttggacttgccaagtcgctcaattaggccaaataagtcaccagtaatactcaatcataaatatatcttctctggaacctagcctacaacaatactacagacaacaaaatgtgtaggaattctggtttgtctaattcagctaaataactgctaatgaaaccaacttagctgagctaaattattcacaaaatgatacaaatgtaaatggcacaataaatatccagaaatttgagcacacaaactttagcaaggacaaacagataatatcggcgagttgcttatgggctaccttggtgtgcccccgcagaacaacttcgttgctgagaggaatccgattgtaacgctcgccgtcatcctccatctcgtcgtcgctgtcatccccatcgtcgtcgtcgtcatcctcgtcctcctcgtcatcatccttcaccggtggcggccgaggcggcccaatcatgccgccatccgcgtcctccccctcaccgcgagaggacgaccgcggcggcggccgaggtggcccaatcatcaccccgccgccctcctcgtcgtcctccccctcgccgccgccagcgggctggggcgggggccgagggggcccgaccatgggcccttcgtcgtcgtcgtcgtcgtcgtcgtcgtcgtcgtcgcccgcggcggcggcggcggcagcggaggaggtggagggcttggcgctagggttttggggcggcttgcggagggtggaggcgtgcgcggaggcggcggcgccggcgcgcgtgggcgccttgccgaaggacatcgggaagaaggcccgcatggcctcctcgtccatctccccgccgtccgccatcggccgctcgccgctcgccgccgccgcgccgacgtcctgtgcgctgtgcgcgagacgcgcgctctgtttttcttttctttttttttttccgagcgggtcggtgcgtgttccagcacgggcggggagaggcgtggtgcctttcggagaaactggtcgagtcggttcgtcgcgttaacttagggcccactagaaaaactgcgtggcagccacgtatggtaaagtgaacccagctcattcgactttagtggagtatctaattaggaccccttaacttgaaagaaaaatatagaaacttttattctgtatagaataatattttttttctatatgattatttgaaccaaaggattattgaaaactatcgaatcttatcaaatttctaaggaatgcccaaattcatataagttttggagtatttttaacatgaggtccaatatcatgcaaagtcttttatgagtttatctctatcatccaattcttgcatttttcgtacggtccaatcaaatggtgatttcatatattttttatgtgttttataattctttgttttgcgcttgattttttgttagaattgtatgtttttcctattcatccctcgatcttccttccaaagtagcccttacaagacatatataggttgcatttgactgagggagaaaagagaaaggggcaattttgtttgtacccctactttaatatccaataccgattttaccctatattttagggttgttgttttttgcccaatttttttaaaacggatgaggcatttacctttttttttacggaaatgagtgggatcggacttaatgcggtaaagaattagagaaagaaagagataacgatatttaaattattgattgacccttttacccctagaaaatatccaagtaacgcttgggctgtgtttgaaaccatgagttcccaacccctctccctcgttttccgcacgcacgcttttcaaactgctaaacggtacgttttttgcaaaaagtttctatacgaaagttgcttaaaaaaatcaaattaatccattttttaaaaaaatagctaatatttaattaatcatgcactaatagatcgctccgttttccgtgtgggagggtaacgttccaatccatggctagcgaacacagccttggtgtactttcaggcttgggcacttggcatcgactattcccttcccaaacccgaatctccgttgtgaaacagtggcggcagtgttcgtgggccggccaggcaacggggatgactcggccagatgcaggccacccaacccagttgcagcgtgcaggagggggctaggcattgcgcaagaggacgtgatagggaggaggacaatggcggctgctgtagttcagcgcagggagaaggcgtagctgctcgacgtgtcgaggagacgacagggaggaggacaacgggtcaacggcggtggcggtggctcgatgagaggaggaggcgacaacagtggcttagcgcggggaggtgatggtagcagctcgacgtgaggaggaggcgacggcggcggcggttcgtgagaggaggaggcaacaatgacagcttggcacatgtaggcaatagatttgcttgacttgtctatttgttttttttttcaagatgtcaaatttttaagcaatttttttgttgatatttctatcaaaattattatattggtaaaagtatatcaaaattgcaaggttcatgtgctaaatgtggtgcaaattctcaatcatgaataaaaacaggggaagttgcaacatgagtaagagtattgaatgccttctcactgaagatttaacatcgttaatctatccatcaaaagtaggggcaaaatttatcttaatttaaaaaaccatgggcaaaaataaaaccctaaaatattgggcaacatcaatattaaacatcaaagtagaagaaagaatgaaattgccccaaagagaaaaggtcctatgatttcggtagaggaaaacacatgaaagaaataatataaatcacatgaatacggatacaaaataaaaggatggatgtttgcaacttaggaattttagtgggtgatttgattacatcctgttaatcctcttttagtctctaaccaaagtatgtattattacttctttaatcctcaatatccggtggtaggaggaagcaatagctgcctgagctttgccagctgtacggcggcaacgcgactacgcgggaaatcacatagcctacagtgcccccatggacctaagagtaggtaaaatagcaggctataagccagctgcaaacatattttaagaagataaatgaggagagagaagggcagcgagctacagatttgtagccagctgcagcacggactccaagacgcggtgtgtgtatgacgggtgggaccagatattaatagtgtagtatgtaactattgtatgaatgagctattagattcgctatagatgaattgaagccagtagtgggctatactattaaacttgctctaattgctccatcgatagaaacttccggacgaccttcttgacaactgttgcacgcacgcacacgagcgtttcacgctgcacgcgcgcaagcaggaacgagccgttccgcgaaaccggtgttgccacgtggcacaattcttctttggatttttttgcatggaattcgtattataagattggttattcacatgattggaaaaacacataaataggaaaaacataggattttaagtggtaggatttttaaattctatggaaaagaaaacagagcaaaatgtaagaagatcctttaacagaggcatagggaaaacaaagaaatttacacatcacttcatttccaagaggtctgacctctttttagtttcctttgaaatccactcataaaaatgcaatcctatggaatttatacttgcctttcctataaatcaaagaggcttgaaggaaaaaatcctttggaatcccattcctccgaaaatcctttggcattcctttaaatcaaagaggcccattattactacttcatctcggttttggtttgttacaatgccaaaatattaacaatactaaacccaaattttaatagcgccaaatattttaggggttgttcagattgatgccattttcaaccatactattttttggtaaagttgccaaaaaatgtctatgtttaatttattgccaaatttggtagatacataagaaatcttgccaaaattttggtaatattaattttggcaatattgctaacttgctaaaatttggtaacgtttattttttatacaatctgaacaggcgcttagcaacttattatattatattgggcattggcacattttggtagtaaatcaaacactagccaaattattattcaaaatttcaacaatcaggtgtcgacgtttgatgtcgcgattccggtatttgcatactatggggatcgttggtactaggatatacgtgagattgagataaaagagatggagacatggatttttatacaggttcgggcccctgaattgtcaggtattaaccctacatcctgttggccaaagccgatattgctcttattcaccataatcacaccagtacaatatttggggtagcctatctaactgttgttgacatggcggtctgaagttctgactcgtagtcaacaacagggtagtcttcctcctcgagttcgtgcccggcgagatcagagacatcgctagatccctacggccggcctctgtaggtaccggatagggtcgatccaggcatatctctgatgtcgatatacggcgccttgtcttgcgtatgttggcttgtatgttgatctgttctcttgatctattatctgtgtccccctctcctcctagggtgtcttgtatttatactcataggtgtccccttgtccaaatanaactagtgaanacaatatggatccatctgagtagtacttgtcgtttccatgtataactctagttgtctttccttatccaaaactccctccatatccgaggtcagttttcatataagacatggtatatggtgggtcctgtcaagatttaatcaactactattaggtatatggtatctataaccctgacatctgttagggcatattttgacatcaaaccaaaatgtcctccgtcttcattctatctctcaatttatcccaatataaatttagtttatagtagttgttgcatcgtagtttgtaaaagtagataataattatattaaataagataatgaactcacctaactattacggctaaatagtaaatgtacaagattgtaagtataggttcctttatggctattggattttgctcaaagtatattcgagaagtactaattcgcgcgtacgcgcatgatatcttaccagcgcacggacacatgtcactcgtgaagcgtaggagcgcacggtgctataggataaaatcggaaacaaaaaatgattagtacggttgtcgacgtttgttgtcgtgattccgatatttgcatagtatgagaatcgttggtactaggatatatgcgagattgtagtaaaagagatggggacgaggatttttatataggttcgggcccctaaattgtcaggtaataaccctactcctgttggccgaagccggtcattgctcttattcaccataatcacaccagtataatatttggggtagcctatctaattgttgtcgacttggtgtatgttgtcttgtatgttgatcttgtgtcttgatctattattttgtgtcccctctcctcctagggtgtcttgtatttatacccataggtgtccccttgtccaagtagaactagggaaaatcaatatggatacaatctgagtagtccttgtcgtttccatgtataactccggttgtctttccttatccaaaactccctccatatccgaggtcagtttccgtataagacatgatatgtggtgggtcctgccgagatttaatcaactactattagatatgtggtatccataaccctgacaacggtgattagaacgattagtacggcgattaggggattattgtgattagttcagatctttttgtttcttttcgaataattataccgtattcagcgttgcttctttttaacttttcaaatataagttagatctttcaaataaaattttgaaaaactctacccaaaatttaagacatcatatcccaaatttaaaactttcaactcatatttgaaaacattcaattaaattttttttttcaacatatacttttcatctcaaatttgaaaaactttcaactcaaatttaaaacttttagttcagatttgaaaactttcaacccagattggaaaactttcaagtcaaatttgaaaactttcaactcaaatttaaaaacttttaactcaaaatttgaaaacttttaactcaaatttgaaactttctaacacaaaatttgaatcctttcaagtcaagatttgaaatcttttaagtcaaaattaaaaactttcaattgtatatttgtaaagagttgtgcgaaagattgaaaaaaattggaaagaagcggcacctgcccttttttatccaatgtggaatcgacgacctatgtataaaaaaaggagaaagtttttgaagaaaaacaccacgccaaaatcggacgaaaaaaatgaaacgcgtgaaaaaaagggcgccaggagggggcccaactgacgcgcgcgacagttaaattgctagcgcgtatgtgcgtgctggaactgtatcctctgatattacacactaatgtcacggtgtgatattcttgaatccagaccatccaaactaaatcaatggctatagattaattggcatacaagtaatcaaattaattagcagattatgtagttaaatattaccatacttaatgagtaggaaatttttttagcactaaagtagtcccttcatgttcattaacatgagcccaccaacttgtagattaagagaattgtctttttcttatggaagatgtggcaacacaaagaaaattgatgcacgagattcattccttaacaggttcatatgctaatcattgcgtctaataggtaagttaaacctaattatcgtcatgtgctagttacttgccgattcctgtagcatttagcgatatttgcctccttgataatatatttggtctactggaatttgtttaactacataatctactaattagtttgattaattgcatgctaaataatctatgaccgtatttagaatggatggtgtggatcaaaggaatgtcacaccgtgacattagagcatctccaacagcctctccaaatcgaactctccaaacacccacatagccaaccctccatctgatttggctagtcaaactagttgttcacttcaacagtctctccatctaccctctctattacaactctattacaaatgggacccttatgtttcttcctccctccagctggactactgcattctctccggcggagaacagcgagcggcggcggcgctgtgcggaggccggcggccgtagcgagcggaggcggcgagcggcggcgccacgcagaggccggcggccgcggtgagccgaggcggcgagcggcgccgcgcggggcggcgggcggcggtgccgcgcggaggccggggaccgcgaccagccgaggcggcaggcggtggtgccgcgcgcaggccggcggccgagtcagagcggaggcagcgggcggcgccgccgcgcggaggccggcaagcgaaggcggctagaggcaccgcgcggtggccggcgccggcgactggcttggtgcggcggcgagagaaggccggcggtcgccgtgctcgtcctcgtttccgtgctcctctcgcgcctatccctggttgcctcgtgtggggatggagccatggaggagtttggctgtgtgggacccaccattggccagccaaatagaatggccaaatttagctagtgaggagagggttttggccagccaatcggggttagccatccggttagagaggctgttgaagcacgttttttgggtgaatagctaaaatttggcttggagagtgggatggagaggctgttggagatgctcttagtgtgtaatgttagaggatacggttccacgcgggctagggttccccaagtatattttcaatcctaaatataaaattggttattttttcctaacttttaaaaccaaacaaatagcatctatttcttttattagttttgattggaaatggggttggttttcgtaatatattattatgcatgttttgttacatgtagatgccaattaaaacttacctaattgaaactgcaaacaaagtttcgtaattaagggagtataagtaatcaggattatttgtgcatccttaaagtgcagcggtggggatatttattccattattaaaaagcagcaaatttgcaatactacaatcgacgtcgcgagaaccccaacgcgtacacatcagcaaaacacatttcccggtgacataacacaaacacgcccggttattattatttggaaattaatgaaattgatccagagagctcgatcgagatgatcatgcgtcggcggcgcaggcgaggccgcagcgctcgccggcgacggcggcgtgcagcagcagcacgtagaggagctgcgtgaacgccagcgtcacggtgagcccctccagcgcgcgcatccgccacccgcgcgcggcgccggcgggccccgccgcggcggcgtcgtggatctccctgcacgccaccccgaacgccagcgcggtggccgcccacgcggcggtgccgagcgacgccgcggcggcgagcccctgcggccgccacgacgcgcccgagcggccgccgtggtacgccgcggacgccttcgccgcgacgcccagcgcccccgccagcgccgcgaacgttgcgaggtggaacctcgaggcgaaccacgcgctctggcggtagtacggcgaccacggctgctccccccagccgacgccgacgtcggcgccggcgttcttgatggagctgttgagcgcccacccggcgaaccccagcaagaagacgtacatgaggaggttcagcagcagcagcgaccccgccacgttcctcctcccgagatgctccaacgccatggctgctaattaacacagcttgatcgaactgttcgattgacgaagacgagcggtgtcgcgtgtacttgaagagggtttcgtgtgcgtgtgcgcgcttcgctcgcggtcgatcgctcgtcgccgcacgcgggctcttcccatggcggagacggcagcgcgcgcgtcacgacgggcgtcggcgtcatcaccggggcggctttagcttcgtctcggcgttcacggcgagcaaaagatgagaagaggccaaaaaaagcacaaaaggcaacggatcgaggagcaagcgatcgaagctctcgatcgccaagttgctgcttccgggtggcaaaacgcgactactactgacaaagaggctttggcctgatttgtgtgttgccgtgggagaagctttgccgtttgccgtgtgccctcgcaactgacaatgagcaatatcgtgttttctcgagttccttgtgaaggttgtgaaactgttctcgtagctggtaaccaacaataaccgagctttatttgctttctacccctccatccaaaaagaatccaattctagctatgagcctaaacatatgcgtgtccaggttcgtagctaggatttgcatttttctagaatggagtagtactttatagtatatctttatacacactgtaatgaaataccaatctcaatgcatattagaaaagttaattcagaacgttagatagacagcctaagcttcacatggtcagagccacaacacacgtgcaaattttcagacatcttgtgcattccattctaggagtaggtgaccatttgagaagatagtagttggctgcttctaactcaactttctgacgaacatagacccttactggtattctcattgtagtcaagagcatgttccaagtattcatggaacataatgcagcagtacaagcacaagaacagtagtgctctttctgcatcaacaacgctgcgaaagagaattcttcatgtctttcacttcacaacgttgaatcacttggaatctatcactgactggttcccgttagcagaattgtcctccttcaaggaatttcttaggtacggcgagtctttatacttggcgtataatggtaaattcagggccttatctgatatccttgcatcctcgtgaatcctctctatcaagctctcaagtgaaggaaagttggcctaggcattttcataacaacgtgacaagtcaggaacatgcatcaacatatagtgggatggcttctgcagtataaatagtctggtcctaaattacctcgggtcgtatgtaaccaacaataacaaggcgcagctcctctccgtaaaagtcttcaccaaaatcgtgaagcaaccatggttcctgtgaccaatgtcttttagaataaactaatatactgaagtactaaacatgaaaggggatgtattgagaaacactcacaatagtcttctccgtgttatcaaaataagggttccagccaatgctcatgaccatcttaaatatacctcgcgttgaaagtccagcccagccaaagtatacccctgatgtatgctctgatagtacgtcggagaagttttctgcaggtaagttggctgcaaggaaaatatatagctatcagtgctcacaatggaaattcggcatgctagcattgaaaaaatgaatcggctgagtactttgacatggtccagcaaataaagagagtaacacaccatatgagaaaaatcattcttgcaattcatagaatgtaaaaccacaaaagccgtagagctcataaattactctctagttatatgctccaccatacctgttggaattcctagtactttagaaccacggccaaatcctttaatcacaggtccaccaataaaccatggttctattggtaaggtatcatcgatccctgcataagaaatatgtcagtagataagttaaagatgcccagaattttctaacagaagtagtcccaagagttagagcatacaatcactaaatggtggcaatccccatttttcaggctttacgtcaaggagggaattgatcacctcatcagcagaactgaattcagcagtccttttggggactgaaggtacagctatgacatgcattcctgcagcttttccagctgcaacacctggtctagcacaatcaataacttacagtattaaaggtaaagttgtgaagagaaaagtagaatatgcacagttatgtttaagtgtagatcaagataaaatgtacacagctaatcatgcagtgcaaatttgcacacaggagaaccatacataacaggaaaaaaacttacaaggagtcctcgattactaagcaatttggaggatttgtattcattcgttttgcagcttccaaaaatcttgaatatcaacaccccagcagttttaaggaatgtcggaacaaaagcagatcaaagcaaaggaaatgatatgagatgagttcaaaagatccataaagtaccagtaacgaaaatgctacatagcacacagccttacatatctggggatggcttccccttctctacttcatcaccaccaacaattgcggagaacgactctttccatcctaaacatggtgagaatacagtaattaatatatgatatatctgtccacaaaatcaaagaaaatagcatgcaaattcaggaaaaaattttaccctaaagtatgagagggttaccttgatggcaggaaattttgcgtcaatgtttgatcttggtgagttggaagccaaagcagctggtactccattactcttcaaatgttttatcaaccgattagctccaggaagagcttttatgttgcaccatctgcaatatgaaattcattatgagaacacgatattttttccctttttctatacaatcttctttgcacattacaacatgaaaattttatcttttgaacaatacaatctttccaaaacttcagtttaaaataaaatctgcataaagggctttactatgttacacattgaacaattcttctccatttatataaagtacttctctgcaccatacggaagttcagtttcatgttcaacttgaatcgaaggagcttaacaaaccagatattataagaaatccggctatttagtgacagcatacgtagtttcttacacagtgacttacaaagtgaaacttgcatttcattatttcaaacaaatgctatacaaaaaaacagacatacttcctacttggcattgacattttgacatggttccataacaactagatgcttgttcatagagtaaggtagaaaaattggaatccatgctaataaactatagaggaatgtgtaaggccaacctactggtgacattttatattactattatttccatgaatcatttggcaccaaattcatcagagcatggcgtgtcgatgcatattatgtgcagatgcaaacataggtgatttaggtgcaccaaaggaagagatgatttaagatttctcgaggcaacattttgggggatactgttgagaagtggtctataaaggacacatgtcagtaatttaaaatatccaaagagaaatgtacaaagattctccattgaggtagcacggcagtatgcaatttacaaaatgcaagttatatgagtgttaagaagtttcagcaacagtactgctcattgaacattggagtaagcattgagagaaattcttctgttgagtaagggagtccataatcttctaaaacaacagctgctgcctcataaggtgtctttccaactaatttatgagctttcttgctgtcccactttttcccatttttgactagaaatggtttcagcacttgacttacaacacagtctgccaaatggtta

SEQ ID NO: 74220 - DNA, 831 bp, Oryza sativa
agtaactacctgacaaatttataagtcttcttggttgactatattccctaataagccacttattaggaaataaaaattaatttatagataaaaattttatatatttattcttagcgacttaaaaaccaatgctgaaaaagaaactaagttaagtatatcttaaatcaacttcaaaattaagtttaaaaattcaaattttggcttttgctctagcttattagcccaacagatgggcctattgtctatgcagtgaacagttccatactacggcacagtaagataaaagtttacaaaggttaccattgtgatttattaaggcttgctgccaagatattattatcaagattcctgtttataatttgcttatttgcacacgctactttatcctggcaaatccattttattctgactgtgatttagtgatgcctatattttgttggcgcctacaatacaatgtagatactactagcatatctgcttatgaactacagatctgcaaatgcaatggatctcaaataattatgcccacggttcccacattagatgcgcacgagtaattaaactctctgcaaaatggttccagaaatgccaacaggacaatgaacaaagcctagtcagtttagcttcaaattcaaacacaaccaatttgcaaggaatagttaatttcggagcaaatactatcgaacaacagaactgcgcagaacattcttcagaggtagtacatggctgatcacaaaggacaatgatgtgaccatgactactatagatacaaccgtcgttcacatcaagatcaagctgtccaagttctgcaatccagttcggtcacctgct

SEQ ID NO: 74221 - DNA, 5561 bp, Oryza sativa
cccgtacgactgctcgcacttctcctccggggcggcggccggcggcgaggaggcggaggcggagttggaggtggtgaggcgtatcacggctgacacggggttggagaggagggaggtggcggacgccgaggccggcgagccgtcggagatgaggcgtccgtacgcggcggcggccaggaggaagaggaggagcgggacgagcgggaaggagcggcggcgagtcgccattgcgggaggcggccggaggcgaggggcttctcgggtagggatgggtttggtgcgcgtagctttatatagtgcgatctgtgcgatatttgatttatgtatttctttccttaattaatttagtaggagtactactagtttataatatagtaatatttttttgtgtgtgtgtggatcaacggcaaggagaggctgtctggctgaagagccggatccaatgatcatatgtacgccttggttaaagtggttcgttatacattccttacctagcgatctgtacgctttaacctttccaactagagtaaattccctttgtactcctgaaaactcacttaattccttttatatctctgaaatttacccgatcccttctatacccctgaaattttaatttgattccttgtatgccctcaccgttacattttccatcatttcactgttacgtttggttgcaaatgtcatttttacccttgatgctttaggtttaaatataagcttcaaaaacaattgaaaattttatttgagtgcacagtatgtgtattttataaaactaatgggactaaataattagtgcagaaaattttgacataaattttgaaaataaaataaatgtaataaattaaattttttatttgaaattttaataggacaatggatttttttatcaggagcattcataaaaaaaatgttgtgaacatgggtagtcctatctttatatgaatgcccctcatttttatgacttcttttaaaaaaataaatacgtatttttctatttcattatctaaaaatattttttgggataaataatacatcgcacaacaaactcataactataatagtctcatgcgagaagcttttatatttttaataatgtaattcatgaatttctttcttcatccaagggtataatagtcatttttatagaaaatacacggtcaactgacgggaagggtatgcaagggatcaaaatcaaattttaggggtacacaaggaagtaagcaaaattcaagggtatagaagggattaggtaaaatttcaggggtatataagggattttctcttccaagtaaccacactcaaacaatcaaactatgacatgttatacatacgcgtataaaaactatggaaggtgcgaaaccatattttggcctattgtgtgcagaaattaccatgagcttaaacattgaaaaattgtgaacaaggcaaatctataatttgaggtttcacaaaagaaaaaaaactagaattttaaaataatgctttggtgcgagcacctgatactacgagagaggaatgtgtggatctttttctctttcgccctcaatctcatcaatccctttctgcatggacgactaggaattcgtgggtggctagtagcttggagttgtggtaggggagagcacctatgcccctattgtagagttatggcgaccaatcacgtataacggtgattagctcgacgttaattcttttcttaagctagtatctgagagtcaccagtttcgtggtggcgggttttttctttttttcctgattgtagcatttcagggttgtaattttatttttttaatgctacattaaaatgaaatctcacacctatcttgtgtggttcgtttcaaagagaaaaaaaaatacacgcatcatgtcagccatttctccgctatcttttctctctcttcacctctgatcccttctctcttctctctccagtcttcatccctattctggcaaggttgctcatgcggctacaacacataactataacgacggtggcaataactactagtgacgagcttgaggtggctattgcagctatgatgacgagcttctcacaaagtagtgcctatgacaatgatgagcaatggcggcagtcgcaagttggggcatgcggatgccccgatctggtacttgtgaagcttggggctaccggattcgatggtagtatcacttagggatgctcgatccgacatcagtgaaactcttgagacgctagactagtggtgatggagcttgggaggttcctcctttgtaatacgtgcctagcaataattccctgcaggctgaatggataaaaaaaaagccattcattatccaagcaatataaggcaatcaaacacacccttaatacttttatgatgagcacaggaacttagaatatatgttcaagaaatttgttcctcagctctccggaggatagatcctgaatttcgttttaagagtccatttggctcaataatgtgcataaacgatgcaaaaattatggctcggccgcatacgtggccataactggcaaagagattagctttctaaatcaaactgtgggacccgctgatttattttgatgtttgtttgagatctttggatggaccgtggaggatccagagttcacactgctgccacatataattttttagaatcagatcctaatttctcattcccaaataaaccgaaagttcagctctttgagctcagaaattgatatatcgtcttgctcttctcttttcttgcgaggatagctttggcatttggtcatttaagtcctactatccttagcttcgttgctatataaaagcacagtggtacatgatcgtgactcggtgatgccaacaggcaacaagttatacgacaataacatggcgattttcaatgctttttttttctttctgaagaccgtgtcaccgtgtgtaaagcctgaccccgctggatgtttgacaaaacaagtgcttatagatctgcttatgcactgcattagcaactggatgcagactgcttgtataagctacgaattgcttttataaaaaataaaaaactaggatggtcatgcaacccaccaacaattggtcgagatggacaaataaaaaacaaaggcaaatcgctcttgcaagtgcaaatttttaaacggaggcaactaaaatctactcctatatttcaattaagactctgttcttccctcttctttctcaactcatatctctctcttttctttttttttgttacgtacgcttttcaaactgataaacaatacgatttttttgcaaagttttctatagaaaagttgcttccgaaaatcatattaatctatttttcaagtttttaggctacacttaattaatcacgtgttaataagcaacaccgttttctatgggagtacttttcaggtcactcatgttccagctgattggcgctgcatgtgtccgcacagtaggcaccttgtttctataattaataatttggagtgatctgatcctgaggaatagatctaccactctcatccaacagatcagcaggttcatcagttattttattattattattattaaacttattttttagatcttaacttgtgccgttagtccaggacaatccagtgctccatccatccatccatgtgctatttcaaatctatttacaaataggcgagttatgtatgccatcttagcaaaacacaagtaaattcccaatcccgttggttattcttttcaaaaaatggattgttgttttttttcattatattttttttgaacaattaaaataaaactccctctaaaacatatgttgtttaaaacagttgaattgacctgcgcttagtagaatttgtgtgccaaaaacgacaattaatattcaccggaggaagtaactcgtctatgtaccaactaaagatattcacaaccatatttatgaaaatcaagctttaaatcccaataggtagacttaaggctttgttcgctactcttggttcccaactctcctatctcgttttccgtgcgcacgtttttcaaaccgttaaatggtgcgttttttaaaaaaattatatatgaaagttgtttaaaaaaatcatattgatctattttttaaaaaaaaatagctaatacttaattaatcacgcgctaatggaccactccatttttcgtgcgcattgtttgggttgggaaacagacctaacgaacgcagccacctacaaccccctaccacactttcggcatttccccggattaaaagagaagggcgaagcttagtaccaggatccaataaccctggtgtcctctatatgaaaccccttattacaagaaaagataaaatcatgagaattcacaagtagtgtatggtgagcacggttcaattcctcgtctacgcccccaaagagtttgttagtgcaaaagggttttctaaggctggcatttggttgctaaagttcgtcgtgcactctaaaatcttagtctaatgtaccatctgttctatacacacaattagctaaatcacagtttagcaaacattttctgggcacacaactgttgtatggcactctttgccaaaaagacaaaaaaaaagaggttaattggatccatgccactgcaaatatgccaattcgaaaaaatatcactactatttacaatatcggctacgtgccactggaatttgggaaaattggaatcatgccactcccatccagttttctgtcaacctccatcatctctctccctcttccttctttgcttcttcgccatggatgccggtaagccctccacctcggactcgctggtccttgccactgcagctagcaagcagtcccctccatctctcgttgctcctccgccggcagcagccatgacccgtccattcctcatcgtccccaccggcggacgcgacaccctcgccgttgtcgttaagggaatcaacggccggggcgcttctccgccatggaggccggcgagcccaggaggacaacggctaaggggaacgagcgaccggggagccgagggtgaagctcagcgggacgagcggcacgggggaaggaggtcggtggtggcagcgacaagggttgaggacggtgacgcggcggtggctgggtggcaaccggcacaggggcggtggccggggaccttgccgggggagcagacgatgacactgtaggcgcagcctggcctgccggctccgagacgaggggctcgacgacgacgacgcaagcgcagtctggcctgccggctctgagacgaggcactcgacgacgacgacgacggcgcagcccagctcgccggcttcgagacgaggggctcaacgatgatgacgacgcagtgcagctcgacccgccggctctgagacgaggcgctcgacgatgacgacgacacagcgcagccccactggctggctcagagacgaggcgctcaacgacgacgacgcaagcacaacccggcccgacctccatctctaagatgacaacggcgacgacacctgccgcgtcaatggtggtggcgagagaggaaggggaaatagaagagaggggagggaggtggggcccacgtgcaatagggggtaacggggatttttgacggaaaata

SEQ ID NO: 74222 - DNA, 1296 bp, Oryza sativa
ttatcaaatttagtttcattcccttgtaaccttattccagttgtttcaactttctattgttcccccttacaaaggtcattgcaattgtatcttgtggaagcagataagaagttgtctcggtgtaatcttgttttgtggagtcaaatgtttgcttgtgtgttgcttgggaatattttatccgagatgctcatatttaccttgaaagatagcattattgttatatcttcttttacatcaagttatttcctttcgttcgaaaaaaaaatgcataaagttatttgcacgaagagacaggattatgtgaggtcggtgttggaagtacttaaggctctgtagcttcagtcataaatttttttgcttctgatagaaagaatgggaagagcatgtatgtgttgaatacttgaatctacgaacgtctaagcatgtactgagactgaagcactgtaattgcatcttggttattcttgcaagctgatgctgccaaagtgcttcccgcatactgcaggctagtactagagcacagatttccggcagatgtccagaaaagcttccttggacatgaacatacagccaaaagaagtgcttgtaatgctggagacagatgctttactcagtacttttcttgggagcttttaagtgtccaggaaagatagcatccttgattgatcttgttcgacatatcaacgctgccatctttcacatatcaacgctgccatctttcttgttgttcgatttgcaatgaagaggcaggattgtgtgggtgggtattgcaaagtaagaatacgtgccattctgtttatcaatagctcggtcacaaatatgtgttgtttttctgatgaaaataataatagaacacatgtaattaatctacaaacatctaagcatatatgtattgaaaatcgctgtctctgaataccgaagcactgcaggtggtaccttgatccatcatacgtcctagtcattcttgcaagctgaaactgccaaagtacttactgtatactgctagagatagtactccttcgtttttttaatatatatcatcgttgactttttaaaatacatttgatcattcgtcttattaaaaaatatagtaattattatttattttattatgacttgatttatctttaaatgttctttaagcatgatttatttatatatatatatatatatatatatatatatatatatatatatatatatatatatatatatatatatatatatatatatatttgtgtgaaaaaattgaataagacaaatggtacgggtaccgagctcgaattcgccctatag

SEQ ID NO: 74223 - DNA, 918 bp, Oryza sativa
cccccccccccccccccccaaaaaaaaaaaaaagccaacatctggataaacacaatttggagcaccatattggcaaattgctattccaaccctgcaaggttgaaggcaccgggtcgccttcgacgatgtgtaccatatcatcttttccatataaactattccgtacactaattttcttttatcattgacaaaattttattggcacagcagacagatggtcctctgggacccacatgtcagtggctgacagcactacagctacggcgggggacgggatcctcggactgcagaaaaggcaagctttcgaacaagggtaactagtctgtcactcgcagctttatgaaagataagctatacgctggcaatccaaaagaaactactcggattattgatcgctacaataagtagcgttggatccgcggaatacacgcgtaacacgaataagaatcccgtgttattatcctgtcttgtgcaattgttactattattgaaagttgtttatgacagtcggcaccagctgctggccagtagccagttcgtccattgtgacttttgcaccattataaatatcaactgtaaaacatagtggtcagtcatcactacgatgatgagatttagtttggttggttttgctgaaacattctctatgcgatcaccgtaaaaagactactccgtattaatctatatccgcagtcatggtctcatggaccatgaagtccactttaatagcgagttggtttgcagcggacatcaattctactaatcagtttccctaaaaaaaaatctactaatgagtttgctttatctgatatgcttacgtttgtcctatttttgtactaaccaccccttaaaattccgaatacgacaacataacaagcaagatcagcccccacaggttattacaataaaatacttttt

SEQ ID NO: 74224 - DNA, 5470 bp, Oryza sativa
atgttcttataactaaattagtaagaaatcagaattaaaagcaaggttttcaagctttgatggaaaatgagtactgttcacaggcaatcagtatacatacatattaagcaatgtttagggtgatcatgaaacaattggaacaattaaatgcttcatatttccatatacgcgggcttgctattttgttgtaaaattggaactttgtttcaagctgagattgtgtttaaaattgctcctttggctgtcctcaactggtcacataagttcactcggtttatactaattaaggttacgaactaaatgatgaggccatgtcatcagcactagactgaattctacaagatggcaaaggcaaaatactggcatgacgcacaataaccctccagcccatgctaccaaggtgagctgaaccgtccgcaaccagcagcaacagattgctgcgagacagcctcagacttggcatgaagccaaattcgcccgcttggggcgcccggctcaaccccaccacactagggcatttcaccgaacagctaccgcgcagaggtgaggcgactctatacgtctgagcaacaagggcgatcccgcaatctaatccaatccccccacccgcctttgtcgttcccgtagctacccgagcacgcacccgccaacgcacgcgaaccaaccccgctgctcggggaaggcatcaacggcgatgtacgccccaccccccgggcgcgcctggcggaggggaggaccggacgagcgaagcgaccacggtggaggtgaggttcaggagggctgcggcttaccccgcatgtgtccggcgacggcgtccttccctgcagctgcctccggcgacgggtccggcggccttggcggagggaggccggggaggaggggggataagccgaggggacggtgggacttgggacggaatgattcgggtggaaacggtgagtgggtgggagacgtgggagtggggatggggagcgacccggagagagacgggctcgaatccgacccgcagaggcggcgatcggggattttttttaaactttttatttttttaatatttataaaaatattattccgataaaaatatttacataagtaaaccctgcagccactaacggccgctgagcgggcatacgaattttgcatgcgatgaaaattgcgtttcgacaagggacctcaatgcaaaatacgcacacggcgccgtgtgccgcactgccacgtcaccttgttgctcttcacttgggcgggtctatttctgtaaatattaaaaaaaattaaaaatgaaaaaaaatcgcgatcgagcagctcgagaagtgggcctcacgcgatgcgcggaggcgggcctggccgtgtgatactaagcggccgacgatgaggcccaacacctggcatgcagagtcaattaaatagttctaataaatttaaataattaataagatgggttagtattatatatcactccataatctaattttaaattcgaattcaacaaattataaaaaataaatttgactatgaattcaaatggttgtttttttggttaaagaatggaattgctagaaacttttgcaagttttttctcccaaaacttccagatttgtggccatcgaatcatctcaagatttatgcatgaaggaaaaaattgctacaaagaaatttttacacatataagcgtaagatcccggtgctagccaatcaaaccatagtcgaatataagttatatcgtagttatagtgcaactatagggcatgtttgggggagcttctagccgctgtagcttctcctagaatcagaagctcccctaacagtttagcttttggttcagattctgagaagctgtagttatagctagaaaataaactagaagccaaaagctgggaaactcaatttttccaaattctcagaaattggttaccaactagctgcttcttaaaattttaagctccccaaataggcccataatatagttacaatataattatactttagttattctatacttacatttgaaagttttttactcaaaattacattctatcattcttaagtgactagctaagggcctgttcactttgatgctaaaaaaaaccttaccacttgccaaaattttggtagtatttcttatatagttaccaaaatttggcagcaaactaaatgtagttattttttggcaactttaccaaaatttggtaaggttaaaaatggcatcaaagtgaacaggccctaaatacccatgcgttccaatgggatttacaataaagcccaaaaagaaaaaaaatcccaacctctaatcatcatatcatatattcatatttggtatgcttctaatcggtcgtccaatccaaacataaaaatcggacagctcttgactgccttgctctgacatttgtgaccgcacatcagcacatgcgatgcatgccacctttgccagtgacttgctactgcatacctattgctactctctctcttctctctccactccatgcttgcatgcatacatttcataatattcaaaacgatttttctcctaaattacttatccaatctacaattcgatcacaccattgtattcgttgtaatgaaatcttcacaacaaaatgtcacatgattatattataataaaaaataattatatgtttcaatctgttaacattctttgtttcatacgtaatagcgatatgtttcaatgtgtgtattcaacatgtttcgcaaaatttccaaaactaactgcactactctctctccacctcatccatacatgcatgcatgcattttaacaagtttcaaaatactttttctcctaaactaattatccaatctacgatccgatcccatcgttgtattcattttaacaagatatggcttgattatattttgataaaaaaatagcgtatgttttaatccgttaatacttgttgtttcatatgtgacagcgacatgttttaacgtgtatcttcaccatgtttcataaaatattcaaatgtttcagttgctagttttttgtttcaccatatataacttaatgtttcacttgttggttaactgcaacatttgaccgtccgatattttttggggcattggacgtccgatgggtagattcctcctacccatcggacgtttaatgtttcacttgttggttaactgcaacatttgaccgtccgatattttttggggcattggacgtccgatgggtagattcctcctgtacgttgagctactcaattgatcgtagagagtaacaattgatataaattatccatattgtattttagtgtatctatattattgtatttgatttatagagtgaacattgacatcatgggcccacatgaaagtggtggcggtggtggcagaaccatcactacgactatagaaatactaaaaaaatacatattaatatatattttcctcaaaaaatacatattaatttagggttaggatttatcttataattcttttaaaaaatgtatttttttataaattagcgtggacatacactcaaagtgattagaatctctctccgagctcatctcgctttgatttgcctagctagattatttctttatttacactataacttacttccattagattagatatatgattgtatattttttttcccttataatcgatatatttttctgatcatatgctatcacgttcttttattttagaacgtacagcaccttaatgatcatgtggtaggcaataaccacgcgtccatgccaatgttagaaggatatcatagccctaagaaaaacttcctaacaaaagtttgatcaccatttgacaaccatcctctgcaccaaccaaaccatgtcctgatgtcatgtgaccctcggtataagactgacccaacggtcggtaaactgaaaaaaacctcactgcaacgaacgagaaagatacatgaaacgaacgaaacaatggcttccatatggttctctcccacctagtactagctaagctagcttctgcttcacaagttattattagctactgcattcggcgttgccatggcgcgcgcgaacatcacgaacgccgcccggggaacgacatggccggcctcaccgagcggcgccgcagctgcgacggcggcggcggcggcgacagcgacagggacggcgccggtagcggcgccgagcggctcatcgccacgacgacctccggctggagcgtctgcgagcgctgcagcatgtcgaccatgaagggcgtctggtaggtatggatgacgctggtgagctccgtcgagtcgccgcgcgccgtggcgcgctgccacgagtgggagctcaggccggcgagcatgtaggcgcggccggactcctcgtaccgctccgcgtctccaccctgtcatgcatctccatcaggtccgccgccagcgccacggactgcgggtcgtcgtccgcccgcgactcgagcacgccgcggcgctcgtcgaggatggcggcggccagctcgaagtcgccccgctccgcggcggcgcgcgcggcggccatgtcctccgtggcctggacgcgatgcagctcccgctcgacctccggcgacatgccgtcgtagcccacgggggcgtccaccgtgcgagggacggtcaccgtgtcgcccccgacgcggacggtctccatggtggccgtgctccggtaggtgcagctcggcgtgatcagggcggacaccccgcgcgccgccgggacgcgcacggtgacgaggaagtccctctcctcgtcggcgtagaggtcgccgacgtgacgaagccgccgcggccgtcgccgtccacgtggctcgcgtagccgcccgacctgacggaggtcagcagcacgccgtcgtcgccgcactcgacgctcagccgcagctcctgcgccaccacgctgagtaggccgccgatgcactgggcgaacgcgtcctggatcgagcccgccgcgtcgatgaacgagaacgtgccgccggacatctcagcgatggagtgcatcgccggcgagtcgtggtcggcgccgaagccgaaggcgtggacctgcacgtggcgcgccgacccgcccccgggaaggagccagctcccgaccagcagcgcgcagtccggctggtcgccgcccccgccgccgccgcgcggcaccgggacggtgtaggtgtcccggccgtcggagaggaggacgatgctgcacacggggttcctctccctcctgtcctccatcaccctcgccgccttcctcagcgcgtcggcgatgttggtgccgccgtcggcgacgagcgagctcaccctctgcaacgcgcgctgccgcccggactccgtcatcttcctcagcgggaacagcctcctcgccgacgacgagaacgtgacgacggacagccggtcgccggggccgagcgcctggatcacgaagctcatggcgcgcttcagcagcgccagcttcgtcccggccatgctccagctcacgtcgagcacggtgacgaggtcgatgggcgcgcgggaggtcaccgtcgccgg

SEQ ID NO: 74225 - DNA, 1164 bp, Oryza sativa
agattatctatactatcctaaagaagctaatggtggtggtggttctatcaccccccccccccccatctatctgacaagtgggggccaccatctatcttgtgggctcatcattactgaccaacaatgtactagagtgagaagctatatttgcttcatatatagtgtacaacacattgtttatcctgtcattgttaatcacagagtgataatttagtttcaattagagctcgctgcaatgcaccggtattttgctagtttagataaaacatgctggctggtcattctaggtttgagggcttactaaatctagctgttctttaccttgtgctcaagacatctcacaatcactgagatgttctccacttgtcgaaaaaggtgaaagcaggttctaaaaacagcaaccccaagtcccaaactccgtttcttatagagatattatacacttcgaggcttcttttcatatgtccttgacttcatgcatagttcattctaaagtagtcaaaagatcagtcggttcattatcctatcgttgagagaacacacacctgctagcatctatttgcacggagctctgggagaagctggtagcaacaggagccaagtggcaagcaaacaacatgttgctctcagggaataagaatcaggggcggatgaacatatcctataccatctaccacaaacaagacaatgctaagcaaatggattgctcttattggcagctagatacttgacttgctttgaaataatgctagagaatctaggtccatgatcatttattttgaactgaagtaagagtacaatgcaaattagaatgatgctacttgattggcaagtagataaagctctaacaatagtaaatatttttggtcttttactctttagtccaataaattctatcgcatcagactatccccacaaaaatgatgaaaacaatatacccatgagttgcatataccatgacgcagggtaacagtgattgtcattaacagaaataattcctctctgacaatgccacgacaacattcatattgccacacagataattcaacgcagtacactgcagcaatataggaataggaaggatataaagctatggcagctactttccgctgacatagtagaactatcagtctacacggcacgtactcctttgcctcccaatgt

SEQ ID NO: 74226 - DNA, 787 bp, Oryza sativa
ctcctcaacactttaaaattttatcaaatccacccatcctcatccttatcctttctatcctctctctgactctctcacctctctatcctctctcactctctcacctctctcacactaccaggcgcagacggcacgggcgcggcaggcggcaccgcgcggctcggaggcgggctcaaggcatgcgcacggggtgggcgactgggagcagtaggctcgcagcggcggacgactaccccccgctcggatccagcggagacggctgccccccgcccggatctggcggcggcggccggtgggagggctcggacggtgaggaggagccggatccgactaccgtgacggcgacggcgaccgtaaggagggcggcggcagcagctttagggctatggttttctttttttggattttctttttttcagtttataaattttgcgtgcgggcaacataaccaccccgcatgcgtaaatcagatgtttcgcgtgcaagtgcgccatccacacgcaaaaatagcgatttttacagatacttcgtttcagacggttggaagatccgcacgcgaaaatcacttttgaccgcacggaaaaatcgtttctctactagtgtgttcccctcattgagtaaagtatggtggaatgttaagagtgtggttgcggataagatataatgaaatttaaaatggacgtaattgaaggaatatatagtatttaaaattcttaggaccaaataaatccctcatatttactgatgcagggagtatatagcaggtacgagtactactaatgtgttg

SEQ ID NO: 74227 - DNA, 27508 bp, Oryza sativa
tgaggggaagttcccaaccaggatcaacaactccctctggacaagcattttgatatgaaaaatgtgaaaagggtaattcggttattcttgaagcttctgttacttgactcatcaattgtatggttataatcaatagatattccttttgccttttttcttttgtgccagattgttcttgaggctgatggttaccaaccatacctgatatcacctgaaaaaggtttaagatctcttataaaaggtcttctagaattagcaaagggaaccatcgatactccttgtggatgaggtaacatagttgaggatctgtttccttattctgaactagatagctttcctgttgtagtatattgcagtattatttcttattactcttcaaactctcttctacatgaacctttgaaagacccttgacttacagtctattagtactcttgtctggcactctgatcttgaaacaaatttgagttgcatgcttcatatctatatattccactgatatccgagtgcacttgcataatgcatatttagttcacatcattacatcaaaacctgcaaccaacatttgtgttattctcaattcatatttgttctgtgccttcttctacaagcatgtttgcaaattaacacaccatatgctagttccaagattgtactctcgaaacaacccccccccccccaactctcaacttacaactgtcatcactactcatgtactttctgtttgaattataattgccaggttcaccgtgtattgctagatatagtatcagccacagcaaatgccaccccaggacttggcagatatcctctatttaagcgtgaggtatcttcttaggattcataaagagggaagctttcatgattcaccattagtaacattttttatctccatttccgcaaggtaattgcaattggatctgctgctttagatggctttaaagatgaggctaaaaagatggtaattgcactagtggatatggaacgagcattcgtgcctccccagcattttatccgcttgttgcagagaaggttagtcttattactacgtagtaaccttggttaaaatttcaatgtaacttaatgaaacactgatgatacttgacaaaacatttgtggaacactgatggtactaggtaatactcagtgtctcagagagattcctaatgcctcccaccatctctcttttttcatcatctataggctcaatgcctgcattatctttccctcttaagcttactaatctctatttagatgtgtttttcaatctttatgtgttcacagaataagtactcgaaacttggtcttatattgcaacaaactgcataacctatataatttgaaattctaaaattacaattacttaacaaatattttgtgtttccttatttatcctcagagtcgtacccagcatgaaaaatactcagatgattaacacataggagacaatgccttaattagagttgtaaacaatctgctgatcttgtcaacagcttggtctattgaaaaaaacgagaacaccaagaagggaacatgcgcaaccacaattatagatggccatatggcccgtggcctggcccaaggcaccccattttggcccggcccaagcacggcatggcctgattggggtcgttctcgtgccggcccggcccgacagctgggccgtgcttgggctacgacctcggcatggtgggccggcctggcacggcacgatcgaacaaaaatattatagggatgcaaaatatacttaaatagccatataatgcaaggcccaaagagaagaggaatacaaaatagacttattttccagtcatatgaacacagcccacagagttgatggatgaaaaatacacttattctgtggagaagcacgatgggctgtcgtgccttcgggctggcccagcatggcccgagttgtattgggccattcctgggccgtgtatgcagcccgtgggcatggcacgactaacctcgggcctgggccgtgctgtgccgggcggcccatttggccaactataaccacaaacactttgtctattcttaggcttatgccccggtctaaagtggcaggttaatgtgctactaccatccaatgcactattcagacagctaccaactcaactaaagtggcaagttaatgtgctgctacctactccctccgtttcaggttataaaacgttttgactttggtcaaagtcaaattactctaagtttgactaactctgtaaaaaaagtagttatatttacaacaccagcatagttttattaatctataattgaataaatttttataatatatttgtcttgggttaaaaatattactactttttttacagagttagtcaaacttagagtagtttgactttgaccaaagtcaaaacgtcttataacctaaaacggagggagtactattcaaactgctaccaattcagctcagcccagccaagtctgcagtttagaactgaacattagttggcatactacaaggttgggttactaagagaaagctgtctgcatgtctaacactcgttttttttcaacttttaacatttttcccctaaccaacataagccacatttctctaaccatcagagtagtggacagtctctaacaatgcagaattaccatgtctgggggtatgtgtgtgacatgaaagttccttggacatgcgcatgataagtgcctgctgttcataataataaaataatatattactcccttagttttttaagtagatgattcgttgaccttacgtttgacactttattttattcaatttttctgtgtaaatatgaaaaaaatgtaactcatcaaaccaagtcacaacaaaataaatgatggttacataatttttttaataagacgaatggtcaaatacatatccaaaagtcagcagcgttatctgttaaaaccggagagagtatgtagtcatacttaggcagcatgggcaaccacaattaaatgcatttttttttgccaaatgtacattttcagccagtttggatgttttgctcaaccatctgtgctaaatttatgctgtacggatggatataaaccatatctgtgttgaaatttttaagaaattttgtttgattgttgtatatgttggtgcatggtctttcctgtttctttcaatctacaaagttttgcatatgttgtcttgcaccgtctagttttgcttcctattgctttgaaggctttgtttctatcttgatgtatacgtgttaggttttacatgcagaatggaaaggcaacgtcacgaagatgagctgaaaagtcgctcaacaaagaaggtttcagatgcagaacctagcaaagtacgcttctgtatattgtatattgtgtctacctttacattgaacttttttttcgtacagatattttttccttggccatatgttttaatcattacttctgtgtgtgtaatattctacatcatgctatttccccagttaacgtgtggctttcgttatatgttgtcaggccacaagtccacaaacccaaacaaaagaaggatcaaatttacaagtcttaggacctgcaggagaaattactgctggtatagtcttaggacatatggcagtttgtttaaagcttatttattggacgtagaaatagtcaaaagtatatgcctattagcataatttactctaatttaaatctatgttttttaaagtttccaacaggtttattttcttatttaatagttttttttcctatatcaaaggtttccttttcaaaaaacgtgcaaaagcaaatgactggagtaaccgctggtttgttctaaatgagagaagtggaaaggttggctttctgtttaagcatcttacatcccgtaacgtcatttcaaattttcactgggtttttactactttgatcatgggacaatgaattttatccagcttggttacaccaagaaacaagaggagaggcattttcgaggcgtcatcaatttggaggtacatatcttcagtgctctttgcttgtgattcttctcatcgctcgagtaactttctcgagatgaatgtgatgatgtcatgcacgtagatggattctcggttgtgccagtaaatctataaaggcagaagaaacctaccattttgcatttctccaaagcaccagtttatttctatttttggatctaagcattagttgaaaacattttgattggtgaagtaaaagaaaaataattagctctaactcaattccatagcactagagcaaactgaccgtcagtagattatttttcctttggtgtgaatcccatgataagtcatcgctacattagatttgtactggcttttgcttgttaaagtttttaatgttttcaaattacaggagtgcaatcttgaggaagttttagatgaggaagatcctacgagaagccttaaagatcctaaaaagccaaatgtgccagatattggaactcctggtctcattttcaagattacccataaggttgcttataaaaatgttttaaaaggtacatttaaatcagttctcatttataccaggttgtttcatttcttagtcttcacctgttcattaattaccgtggcagctcacaaggctattatactgaaggctgaaagtatggcggaaaaaactgaatgggttactaagattaggagcattgttgaccaaaaaggagcttctgcaacgagtggtttaccaatgaagcaaagccattcggatggttctctaatgtccacttctaaaaaggatggttctctagtaagtcagaatccttcttttattcttcaaaaagttcatcgtgaaaagattttgaaaatcatcttctagagtagaaaggattaattagtatatcgtttttgtaatcctttcctattttcaggacacgatgcttagaaagccagtagatcctgaggaagagcttaaatggatatctcaagaagtccgtgggtatgtggaagctgttctcagcagtcttgcggcaaatgtccccaagttaagcatgtctggtgtcttgcttaagctttcctggtctcctttctagcttcttgcattaatatcattgatcctgttgagcaggctgtggttctttgccaagttgagaaggcaaaggaaggcatgcttaatcagctctatacttcgataaggttggagctaattgatacacagattgaactcagtataacactttgtttttagtggcccaattcatagttcttgctccttttgtaaccattatgtggcattattgatctgacagcaaaaatgcacctatcttactctgcccttgtttagttcccaactttttcttcaaacttccaacttttccatcacatcaaaactttcctacacacataaacttttaacttttttcttcaaactttcaattttagcgtggaactaaacacaccctctgtttcattaacaatgtgttaactatgtctagttcacaattgtcatttgtggttagcatgcgaagcgtagaaaggattgaagagctaatccaggaggaccacagtgtgaagcacaggcgtgaaaaaatcaaaaagcaatcatcacttctttccaaggttactcgtctgctccgtatccatgataatcgctcagctacttctaattggtcgaatgattctgctggatcaggtaaccatatccttgttcctcattagttgacatagactagggaaccacttgcaagatgcatgaaaactgccccaaggaatagccctggacatttcttacgaaatagtaatcaatacgaatcttacagttagtatattcgactgtaatgttctgtgactcattattctcttctatctttatttcttctcagcgtaaaatcagatcacatgattggctttcgttaccaactcactgaatttccaacttacctctttcagatagtaatccagggagcagtggccagtctggagacgaatggaaatctgcatttgatccatcacaagatgttgatccatctgctgctggaacaaacacggggagccgccgcattccgagccgaatgccgccgccacctccacagggtggttgatcagttcgtagttttctggtcctggggcttctgttttctcagctgcagggagtacattccattatactattgctctaggtgctcttgatcaatggctaatttgggtttcaagaagaaaacagttaacgggaattgaccggtgaagcgttcataggcctttgaataacttgttagttgaagatagaatgtcagtaggacctcgaatattgttaggcacataaccgcagtacgtttatctctgtgtttttttttctcatggaactctggcaaaatcttgtatttcatgataattatgttgtttttgagtattctaccgatttgctatccatctacctatttgttgtattgtttgggcattggttaatgttgagtataatatgaaaaactccaacaggcatgcttctaaaaaggaatataaaggtttaaaatagcatttacattgtgtttcatgcaatactccctccattcgtgtatgatcattgtatatatcttttcagtgataccaaggagagcttaaaccttcataatgcatttaatttctgtactaatcttatcttagggaaacataacatcgtctgattttcacgcaagcatggctaagggcacgtacaacggtttttattagtagactttctctattgtcatgcaaataaatttggtgatgtgaaagaaagaaagaggagaaaagagaaatacggtgaaaagcggtaagacttgccgaatatattaaaaggaataaacaaacgtgcaaaaacagcatagggagagacagaaattagggtacaactcgagaaagagcatattacataatctcgagaaaaggattggcaactagggataaccacattcctttaaagggtctgggaagctagattgatctgccctatattttcctttacagcgaaagcaacttgttcttcgtttcgatggatttgctggaagatccggcgattacgttctagccaaacattccaccaggttatgagatctccaattattttcttcctcttggctatcggggaaaggttacagagtgtctcccaccagttcgacaaattgtttgtcgaggaaatctgtgatgctaaatcgtgtccttgccattgacaaactttgtcccaaactgttgctgtaagtgagtcgtatttttgaaagcatttctacaaaggctacagatccaatcacagggccagtgtctctttagcagaattttagcagtgaggattctttgatggagtaaaaaaataagaagagtaaaaaaaatattttggtacattaataattagagaccatattgtttcagctgttgtaagacgttagttcttagatgctctagagtttatacatgtcctaacgattgaattaaggctgtgtgcacacgaaacaaagggacaaaatgcaacgatcaatcagaaagtgacttgtatactgtggaatcgataaaaacgaataggggaagtactatctgttctaataaggattatattttttgcacggtctttaataactagtattttattatattctatgttcctaacaaatatgaaattagcatcacataaaagtacttcaaaatacgaatccagtgatataacatgtataatgcttagtataatgcttagtataatgcttagtatagatataattagtatgattattagtcaaaagctaccaaatttattttttttaaaaaaaaatgagacgtcctataatttaggacggaggtagtactaactatggcatgttcagggtttgattttagactgcgcaaaacgagatgagttattaatgtatgattagttaaatattaaagcactataaagacttaaaaataaatttatttaattttagaaaacatttatatggaaattatttacattgaaacgcaccgacgaaaaacatgctcattgatcttccattggacacaacttttaattcacatatttgaattttaacactaaaatccgtgctctattttaacctttcaaactaaagacttggagtttggtcattgccatttcaactcgagaactcgattcagtaacaccatttcaactcttgctgaaaagctggatactcaatctctctatctattataaactaaaagtctattaaactttctacaaacgctcccaagccaccacgtggtgctcctacaaacgttcctaggccgccacttggcagagtctaatcttaccgtcgattttcatttaaattgatgggcccgttattctgtaccgttagattagatctatacctgccatcagcggtggagccaaacaaaaaaggatgtggggtcatcactgtgaaccaatattaccgataaataaaaccataaaaactgcttggttttcatacgtcaatccagtagtttgagaacgttttttttattacggagttgtgacaaaaaaaacatcgatatttttttttcttctacactgttgcttgaaaatcatccaatgagcttgcaaaccagccggctaatcacaaagattttaattagtagctgtgctcatacaagatgaccaggtggactggggttaaatcaataattttactgggagcacattcaactacaacataggtaacaagaaacccttttacatgccggtttttctaaaagacacccagataatgacacgtatgacttcagtcatcggtgttagattataaaatcggcacctataatatgtataggtgccggttttgtaccaataatcggcacctataccgacttataggtgccaattatggaccatcatgccacgtggctgcccttatatgtgtcgattatttacaacaaccgccactcaataaatcagataaatcgaagaaattataagaaaaaaagaaatacatctagccatcgattttcagttaatacggtggacccaatattttatatcgtcagatctatcttttaaaaaaaatcccaaaacccataaaaaatcatctccaccgccctttcctcctggacctcctccccctcacggtgactacgtacatacatccctcccactttccttccttctttctctaatttaactattcaactttaattgatgaatccatttacatataaatagctcaggcttctaatataaatgttttaagagcagatttttaagcaccatattacacaaatattaaatttagattctataaacgctcctaaatcaccacgtggcaattcgacaaacgctcctaaaccaccatatggtactctaataaattatgaaaaaaaaacacagaaattataagaaaaaaaaagaaaaacatctaaccattgatttttttctttaaattggtagggccaatattttcaatcactagatctaatcttaatcttaacctatttaaaaaattcaagatgacaccgtgctctgtcacttgatgacgctatccatgagtcaaccacacatactccgcgcgtgtgttccgttaatgagggagagagaaagagatcattcttatgataaaatcttccagcctaatcgtaatgcagtgttgcagtccatcgaaatcaatttttgtatatgttcactgcatataaattaagatatgaaacatcaatgaataagcacaaacaaagtttgacgtgaccaatgaacagaacaaggaaatttgatcgtatcatgcatggaggaagtatggcttaacatagcatgagatgataatcaagaaaaataagtcacaactaacctaattagataaaaccctgtataaggcaacgttaccgcataaatgatgtatgataatgacagaaacatagtacaaaataaatttatttcgtagctaaataacgtaatcttatatgttactttgtacagtttgcatctttagttaatcatccacaaaagctataaacacagttaagattatgtgctttgaaaatttagatcaaatatagattcaacatcataagacaaaactaaggtggtatggctttgtgaaagaagaaacaagagagagagctttcgaccagactaatcatcgaggtgctagaaattgagagatgagaaaaataacattaactatacttagtgagggttaagtgtataattatatatatgattgtagcagacataataaattggcacgaacataaaaaatgcctaactatgtaacacaaatttagaagtggaaagatgataagcactaatttatgcccactacaagctagctaaaattattaaaaaaaaggtcagtttggagcaaataaattataactctaatataattttatagaaaaatattcaatctatgatatcaacaaaaattttacattttaaaagcaatgacacgtgagcagttatgtttagacatcaaatcatatttccatcgaactacgtggagcctcgcacaatctttatgaaatggcatatgggttgtattccacatcgcacaattaaattggacctcacgaaactttttattttagcaatggaaaaaatgcaatactttgagaaaagaaatagaaagttagcagcatcagagcaggacacaatgaatgagttataatatctagcatgcattgctaatgttatttcacatacggactatcacatattagcacaaataattttaagtctcttatccaacttttttaatcgtttgaacaattatattcatcacaatgcttttactcatactattatatagatcagttacaccgagcttaaatcagtgtactcccttaactatacaaaatatctcattttatgtcctaacaatatttttttatttaattttttatatatgttttaaatgagtcatatttaccttcacatatataaagagacaagagccaatgataattatgtgatatcctaaattccaatgtgtcatgggtttttactcttgcgtgtatataagccactaatagcattgcataattgatggcctttcatatttaaaagttatatttttcatattaaatttacattttattactcctgttgaataggtatttttagaaaaatatcatatgggtgccacgtatcatagatagattgatgttgtgcaagaattaatatacttacatgcatatggactagaggtaaggatagcttgatacacataaaatatattcattaattaataaattcttaatatttcataagaaaagagcaagacggtgaacattcaattaaaaagaatgaaaaaaacatatcaatttaacttgtcaagcatgtttttaacgaactaacgcgcgggctacattcctagttaatataaaatgaaacatgctctgtttccaaacccacatgcagatactaatttttcaggaaattaatgaaatcccactgaaaaataaaacaaatatctactgcctaaaatatcctccgatggccgcaacgaatggctcagatttagccgccgtcggaaaatatcaaccaatctccttcgctgccggcgctcagcattttggctgccgcgactgcgcggggagggagcatcgttacgcgactgcccgccatggcgtctcctcgctgcgccgccgtcgccctcctccatcccgccggagtcgccgccggcggcggagctcgccggcgtgtcctcctcctcgaccaagagcggccgttgtgggggactgaggtgcgccggcgccggcgccggcgtttctcgagcctcgagacgccgccgcggtgcagcaagatgtacgtacccggtaattatttgtctgccctcctcttaattacgccactactccctccatttcatactgttagcttcaactttttttaacttatttaaatttagttaagtttataaaaaatatagtaatatttttaagttaagtttataagaaatatagtaatattcctatcccaaaacaaacataatatctaaaaatatctaatgttatatatataatcaaactaatttaatgttatagatgttactaatttcttctattaacttaagacaaatctaaagaaatttagctaagaaaaaaagtccaaacgacttataatattgaatgaagagaagttaaaatgatttataatatgaaacggagagagagtattaacaatttaatttttttagtcgcaatgtttgaaacagaatcatataatttacttgctttgcgtcagttttgcataaccatttcgaaccaccagccagttttggcaatttgacatgaaacagttttattgagttttcttgtcaaaactaaaggaacagtttgcctcaaatatgctaatcacattagtcatctgtcatcctgaaaaaaaataatttcaaatttaatccacacaataagaaaaaaaacaaattactacaccctaagtagtactagtactattcatagtcatagccagatttgttatttttcttcaacttgttacgtatttacatgttggtgtagtgatacaccacacaattatctgtattattattattattgtaatttttcataaccatttaaaacacatgtgaagaataactgtacatccacttaggtgacaaaaatgagttttcctgtttataaaaaggagagacacgtttaacctcgaaaatgaagatgagagagacgtaagctgggccagcgtttgatgttttgggcctcttgggtttggatttgtgccattgtgtgggcttacttacatgtggtgtgggtttgggtttgtcggtccaggcttcggagagggatcgccggagaagaaggcagcaagaaacctgcagcacttcttcaactacattgctgtcagggttgtgctcacacagcttgaggtacctactcttcattccatctattttatcttctcattgcttccttccaaagtttcatcctaaaattcaaccggcataaaaaggaataacaaatgttgttaagttgtatctaatgttactccctccgttctaaaataaacaaactagcacagaatatgacacaactacggttctgagcatcttattatactatatttgtttgttttgggatggagagaatagctctaaactttgtacataatgctttgtgacactctgatacacaagttatcttcgttccttttttttctttagagagagatattatgtcttgctggagatctgattagatagctctttgtttatcgtgtttgtatcatcaataaagagttacaaccgggaagcatatggtgagctgatggatttcgtgaaccgaaactccctcaacgacgctgatactttctgcaagaagttgatccgcgagtctccaaggcacaagcagctaggtaatgatgataaaacacttatttgaactcctgaaatagttttgaacttaatttgcatcctgccatgtttcgttcctgagtttttctaatcttatcaattcccaccttacgtgaatgatcaactctgccataaagattactgacgtcttaatatcttgttttcaccctggggacagcaatgaggatcttggaggtgggcactgtcaccaactaccaatgtcatcttctgaacttaaaccttttgattacctttctcccgccggattaactaatacaattgcaggtccgatctgcttatgtcaagcatgatttcgagtgggataatctgaaaaggttatctttcaaggtcagattaatattccattttagttatctgtattttgcagacagaaaaaaaactaccatatatttcttccctttctggttaacttaactaatatcctatttgattgatttatttttttgaacgaattagcgagccaccaattttatttaatagaggagtaaactgtacagtataaatggaaaaacaggaccaaaggtcctaacaaactatgttataagccaatttcccagatgttatgctcctgctaagatccattctctggcctcctctttgattttcgtcagcaagccattcgacgagagttccttttgctgaaaggttctacggtttctttcattccaaatctcccagatgaccaaaagtgtcaacgaacggagggccttcttgggggcttctttggtgcttgtgattatttcccaccattctaggattgacgaagcttgctgcctcgggttagggtgcaagttactacatgccacccagttcgccatagcctcccaaattcaccttgtgtagcggcaattcaccaagaggtggagggccgtttcctgggcctagcgacacagaggacagacggagccattcgaccaccccctagtagttagtctttctgaagtccaaactatgttctgaatgaccagccagacgaaggttttacattttcgtggggcccaaggtttccaaattagggtgttgaagttggtggccgttgtgccgagaagttgcgcattgtatgccgacgctgtcgtgtattcatcgtgattgttgagtttccatgttattttgtcctcctcatgctcggacaactcaactgtctaggtagtgctccatatcactacaagttggtcgatcagttccgttgtctatcctgtatccgttggaagggtcacgtcgagtagccactgatttgaccgcagtgcttgttggagcgataggttctttttctttgaggctgagtagactagcggcgccacgtctttcaacctcccttcccaccaggccaactcccataagctagtagttgccccgtctccaatttttatggtggttgttgcagcaaagaggagcttgtcgatgtcgtcatatggtgtactagatcccacccatgctttatcagacaacttccaatcatgccatggccatatgaggcgcaaggcacttatgaatattattaagtggattattgtgtggattatctacttgattataaggaataaattagatatttaagaaaataaatttaataaatagcttaaaattgtggtctaatcaatataagtagaagaaagtttttttttgagaaaacatatttcaaagcgtgaagcaaataatctgtttcaataactcggtgaatgagctgaaaagaacaggacctcgtgaagtctcctaagtaggaagttgagaacagtcctgcctaatgcacctagctgctagtgtttattccattgtttacctaatttttgttcttccattgtctgcagatggttgatgaggccaacacaaagctcatgagggactatgtcttggagaccagccacatcgaagacgataactgatgaattttgcagagtcccatcaggagatctatccattcatgacactaaatcaatgcccttccacggatacacagctacacgcgcgcatatctgacaatgttctgtcaatcttacatagtttgcatacaaggtgtatataaataacacaagctcaagccgaagctgaggaatctacaaagctctgtactgaaagtctgaagcatgatcccttagaacaccacaaagtgcagacagctgctacagatctgaaagatggcatgtacatggaacatggtatatgtagatagtcaaacataacttcaataaaaaccctggagataattctgcgtgcatgtgcagatggttgaaaacttgaacagtccataatagtgctgatcattagccttcagtaataatttgcatcatgttatcttctcccaatcatacatggacccttcatacaaacataccacatgtgaggaaccactgcaccattaggcagctgacgatttgctgaaacttcatgagcatttctcagtggcatcttgatcagtttcagaaagacttgctatgatctgtcatgtcttttactttgaccttagaattagtaggttcaatgtttcagaagtagcgcttgtggccttggaaatgcactgtagaatatcctgttgagttaaagccttgactgcaaagtactcccttcgtttctaaatatttgacgccgttgactatttagcacatatttgaccgttcgtcttattcaaaaatttttgtgaaatatgtaaaactatatgtatacatataagtatatttaacaatgaatcaaatgataggaaaatagttaataattacttaaattttttaaataagacgaacggtcaaacagatttaaaaaggtcaacggcgtcaaatatttagaaatggagggagtaagtagttcagaatttgaagaaaaattgcagggtgctcagtttcagaaaagaaaaatggccaatggctgtcattcacttgaggagacgggccaaaaccacagttattaagaccggtccggtccagtcaaaagatcggccatgcattcaaaccggaggaaatccggttgaaccgccggttttaggtatgatacggagaaaaaccggacattagacgggagaataaaccggtaacatgcagctggaacgtgggatgggagagaggagaaaattaagggaaaaagagacgcgcggtgtactcgaactaccgacctgtgctttcagcaatcttcaaccactgagctatgcactcgttgacgattttaataaatatgtgaatctatttgacccgtgttgagccggtggtccaaccggtcggaccatgcaaaccgtgaaccgacggcttcaccggtttaacgtccggtccggtcctgaaaaccgtccggttcacccggtccaaaacggttcaaatgcacgtccagatccggttttgttttgttttagtcgatctgggtttttatccaactatgcatgcagatgcaggctgcagcatgttaggactcaaatccggagagacagagatttttttttcttttctttcatgaacatgttttgtggtctatgtttaaataggcagcagatttccagattgatacatcggaattttgtgagtatgtatgtctctgctttcggaattcagataccatatgcatggtcagttatgacgagcaattggaagattctaaaatttttctcttccataacggaactgccatttttatatgttttgagttttgaagcatacaaatcccttgaaaacccctttttcttttgtaacaaaaacttcatctatttcaacatgcaattacatacacactactactaaatgcaaaaaatagctacacatgcaaacttacagtgccggcctattcagccatgcaacaatgccacaaacctacacatccctaatcaaaattctaacactccaaattaaaccttaacccaaaaaccaaccaaaacccctcctaataatcaactaaaattcttggtgttcaatccactcgtttaatcatcgatcgatcggcattattattagcagtcctcgccgccatcttctgggcgtgcaggtgcgcgaagacgccgaccatgggcgcggtgttgtacgtgcacgcctccgtctgcatgtagttgtcgcggctgtccctgaacctgtcgcggtcgtccggcccgccgacgatggctccggcgaccacgttcgggttcgcgccgccgcgccggaaccagcggtcgtacccctgcacgcaccccacgaaccgcccgtccgcgcggtgcgacaccatggacgccccgcggtggtgcacccgccgcgggaaccgccgcccgtacccgaccatgtagctcacccccgccgggttgtcgcccagcacgtagtccgcctgcgccctcgccatcgccgccaactcgtcgccggttgccatagccccaccggagcaccggatggtgtcgccgccggagtcgcggaggtagcgggagtagacggtgaggaggaaggcggcgttggtgacgtactgcatgttgttccagcggcggacgaacagcatgccgccggcggtgcggttgacgttgtcgccggcggcggcgttcttgccgaggcaggcgcagaggtagtgctccgccttggacctgtactgctccagcgttgccgcgtgcgccgccgggtggtcgccgccgtccatgagcaccttggcggcgaggatctggaggccggcgtacttgacgtcccagctgaactcggtgacggcccagccgacgccgccgagctcgtcggccatggcgacggcgtagtcgaggtagccgcggcggccggtggcgcggtgcagccacagcgccgcccacagcagctcgtcgccgtagccgctcaccgacgcgtagtacgccctcacctcgccgatgctgctgtcgtacttgcccctgtacctgtcgccgaagtcgaacagctgctcggcgtggcggaggaggaggcgggagtagcggggcttggagcggcggaacacgatggacgcggcggcgagcgcggcggcggtctcgccggcgacgtcggagccggggttgtgcgcggtccaccttgtaggcttgcctcgacgtcgtcatgtcctccggccgctgccagcagtagtggtcggtgtcgccgtcgccgacctcggcccacagctcgtcggcggcggtgtgcgccttcacgaggtagtcggtgccccacttgatggcctccagcacgtgccgccgctcgccggcggcggcgatctcgtcccagaactccgccgcggcccacgacagcatcgtcatcgtgaacgccatgggcaggccgaacttcacgttgtcgccggcgtcgtagtagccgccgacgaggtccaccccttgctgcagcccgtcggcgagccccgagtggccgcgccaccgcacccgctggttgtacggcaggtgccccgaccgctgcgcctcgaagtagagcagcccgctgtgcagcgccttcttgtagtcgaagccaccgccatcgccatcgccatcgccggcggcggccgccattgtcgacgtcagaacgaggagcaccgccaccgcggcgcacattgtcatcgccgccaccatggctagctagcgatctcgcgagctccttcttcctctttcttcttggctgtttgaattgcttcgtctcctcgtcgtcatctcgcgggtgctgccctttttatggtgttgcaaagcgccatggctgacctctcgtcgttgaccacacgttaacctggtcggaccacaacttagttaattacactgtcttagttaattacaggtgctaatcatttgattatagggtgtccaacagaaggatctaatgcagagcatgtaatggtggggccaaggtgtcagtgggtcatgaggctgcctcagcttgggggcagtttctgtcggtagtgatctagctggattaaatggagaatagcttaattaattaatttaatttgctagagtagaggaagaagactattatatggagattaagtagcttagcttgcaaattcaacagtttagcagctgtgtaatactggggttgacttgcatcaccaaccatgtggtttcattgcacatttatttatttagtaccccagatataatatgttgtagtcaaaccttcctatggaacaggggagcctatatgcagccggagaatattggaaatcaaatgtatccattgatcaacacgttgctatgtaatgagtattactttgccaaaaaatattcccaaattagtgttttaaaaaaataaaaggttgagcaggtctttatcaacttagaattgaattcaactgccaaatgaattccacttcataattaccactcattagttgtatcaattaattaactggatctgttccaaaaccaaattaatgttctaagtggaacaagagattttgtgtggtttcaatgatatacaacaggtaatgatcatgtttgagttaacaaagcatgtgcaaaagaaaactcaatttaaaatacaacttaagttaaaaaagttgatatacagcttaagttaaaaaagttgaaatttgaagatgcagatgttggttatatcaactatttatggtattactacctctacttttaaatgtgtaacactgataactttaatatatacatggtgattcatcattcaattcgtctcctctacccaaaatataagttttgggacgtaaatagtaccatctattttttttcctttttccatatttgcactaatcttgttttgagtacttatcttgggctatctttatttgctgaagtttcacaatggattagaagtaaaccaatcttttcatttaacatcacatatatttaccatctttaatttatactttggaccggggttagacagcttgagctgccatgttggctttggcccaagaacgacatgggttatgctgtaatttttgcattttgcttcttaagttatgagaatggattcgagggctggtgtccaccacaaccgaagtccttaccaccaaatacccaaaaaaaagttctttttttaacttactttgtatgaaataccaaagaaactttttttctcgcgtgatgaggatactcaattgctgccataccaatcctttatctcgcatgatgcaccatcagttgcggcttcatggcttggctaaaattaagtccctcaaaatgcaacaatggcaattatatatgtattatgtggaaggttaggcttgtcctagttcattgtgaaactttggttaataaaaataactttactcagctgtttttgggtctgtttgggggagttttagattctgagaagcagctgtttggtagccagcttctgagaatctaaaaaagctctgaaacctagcttcttcagcttcttgctttttagttcatttttcagaatctgtaactatggattctcagaagctgtggattgtttggggcggcttctagcagaagcagtttttgggaaaagctacagctgggacaagctcccctaaacaggccctttgtcaagtacccagagttctattccccttcgttttgtcctaaacatctgatgggatagcacctctactccaacgaatgatcgatcaacacctgcagttttgatatatttaacaacaatcaacttggtatctgctgatctatctgctgggggatctagagctgtacaagtgctgaattgaatccgacagtgcagggggttggatccaatgtaattaagcagtaattaaattaaactaagcaggggataagacagctaccgttagattcctttcccctactactagggtgaggaacaaaaaccgtttagttggttgctgatgcgtctttgtcgcatcgcattcagtcagtctacgcatgtcgcagcctacaggaacaatcgacgactaagctaggggctatagggattagggaagtggatgaccacaacacattacccatatagtagtatatgtaaactaaattaagcatagttgaccaagctatatacaaaagttaactgctactactaattaacttcgtttccccagcagtaatgagaatcttagctggattatatgttctgcagctgcaggggttgcagcatgcaatgcagcctgacaaaatatactagagatgaaaaattcatgtttattcgatccctagctagaccgtcagtattcgtcatatatagtatttgtaagcaaacaaatttaacgtaatatcccaatgcagtattaatatggagccactctatcaatcaggattttgagcacaagtgtcagccattttgtatcctaattttaattcgatgaaaagaacttctaaagaaatttaactatgaagcgtgcatgtgaattgaagtaggagtacttaatttggttttgttttgcatttgcagtcttggatctctctgtcaagcttcatgttatcgatcaaagctgacaagagttctgctatatgctagtaaacatttggttgtaataatgttattgtcagtccgccccttaaaaaacgataattgccagtatatgatctgtttaatttccttaacttgaattcttagttgcatagtgcaataattgtttcagtaattaaattaataaatagctagttgacaatagcacatctcgatcggtttcacaaagaaaaaaagcatttcttacctacatgtttctaaactaatatatattgtctgcaaaggccagttggcgcaatgcgatgcaccggccgtgtgggttcaattaagagaaaaacttttgattactgtctgtaaacatattttaatattctgaacttatgtatatcacatggaattctggacaagtcacctgatgaatggtcgatgtgcagagtgttgcagaccgtgtgtgcaacagaaaattaagctgtatgcaatcatatatcgtaccaagcctgttaattaattattttgatgcagagcagccggattaggagaaggtattttgcaggctaaaacgtccagcgtgatccctgatttaagttaaacatcatgtgacatggaatctaagcatgttgctcctgaaattctcagtaggttttttcagtatatttgatcgtgcgggttcattaaaaataatctccgggatcgagccatgatcaaattaatctctgatcagcatgatgacaagtacttttgttatttctctaatttacttttgtgcagagttgacaatgaactgtatgatgttttctttcttctttttgttttaattcataaattaaaattatcattgcttatgatatacgttatttcatgtttttggtgtactcgtaaacattaaaaatatgtgttcactgggagagtatgccttcctattcgttcatagtggaatacgcgtgtacttttggagacttagttatatatataactaattaatggttttatcagttccatttgtcggcgagagaagtcaaactcgagagttgagtttcttctacatgatcaggactggtttgatgtagttcatatatatatatgtcaacttccattgtacagaatttgcaaataacaaattccgacacttatggtgatcgatcgatcgatcgtcgtctgaacactgacgcagctatgctataagtactacttcctccgtttcataatgtaagtcattctagcattttccacattaataataatgttaatgaatctaaatagatatatatgtctagattcattaatatcaatatgaatgtggaaaatgctagaatgacttatattgtgaaacggagggagtactagtatacacaaatgtatttatttgacatgcataaaaatctaattaattgacatataggagtatgttgttatacacatatccgatcacagttagatacaactgacaacagtattggacaccaaggtatatttaggttgtgttcggtactctcttttcccaactctcctctcccgttttcgcgtgcacgcttttcaaactactaaacggtgtattttttgcaaaaaaaattttatatgaaagttgctaaaaaaatcatattgatcctttttgaaaaaaaaatagctaatacttaattaatcacgtcctaatagaccgttccgttttccatgcatgggagatgtgttcctaacacccacctccgaacacagccttaattggtatacacgagatatattgagagaacatatattccgaggccgtgtttttcttcctgaatagtagaatagttgagtaactaaatgattttgtgttcactattcgagggtataaatgaatgacctaactattataaagttgaaaaaagtatttgaaacaatttttaagaagttaatatatagaaattaagtatttttttaatgaaaaatacaccatttaaaagcccgagaaatgtgtcgcattaatccattcttccattccttcaaaaagaagatgcccatatggtatttaataaatttcagagacatcaaagataaaataaattattttttacttacctaaaattacacattgatgtctacacattgatgtctacaattatatatagtgctatgcaatatgcaattttttcattatatggttttagtatatttttaactatgttaatttgaacattgttacatgtcattttttttcttttttgtatgaactgtcaatttattttatgtttaggttattagaacaatttattgttcaaccatttatatctaggaaaagaggatctttgtttaaataagtaatagtaatataagtgatgaaccaccattgaatttctatccaataggtgaaaagtgactaatttagacattcccctattatattcataaagcaatagaaaaagaaagcccctacattcattttaaaggactacaaattaattaatacttgtggagaaaaatgtgggagagctgattgtaatgtcggttgaacaaaacatattagagttgttacaaagtttataggaatacacttgtattatccacaaagcaagcacacgagttgtattttaaatatgtcaaatgcatacgtgtattaagaataagaaaatttaaaacaacacactgttcatattaaactgcagtttccttacctaactttgataatatttatattccaaattaaatatgctcattggtgttccaaaagtaccctcctgtgcaccaaaccagaaaccatgtatttgggctcgaaaactcaagctcagccatgggctatgactcccactccttttttttaaaaaaaaaagaagaagaaaagagtgccttatttaataattaaagatagtttactatgcaaattcatggatataggtaaataatttcatcctccataatacgagtacacacaacatctctcgtccatttagctaaatctgcatttcgttatacctacaagcctaacttgatctctgtgcctactgcatgtagtacaaggctacaaatggaaaatgctaaaaaaaatcattagccttattcggataaggctagctaatgattttttttctcctaaactatttgactgatctgtgataataaatgtttacagtaaaagtttttatgagtatatttgatgagaggaatatgtatttttaattattaaaatttgatttttcatgtgtaagagtgaaatgtttcaaatagcgttttactatgtttgatattttctttcaaatactttaatgactaaaccttttgttttacaacgtataacttgatgcttcacctatgttcaactgaaatattttaaccgtttaatttttaagtgagcgatcagacttccgatccctaactttgtctttaaggaagcgtatatacttctttcgtcatcttttcgaagatcttcaaaaaaaaatttaatcacagatttcatatttttcttgttagcttaaatttcatgccatttttctgatttgaattcgcaattggtactggccggtttgcggttttctttcctgaaaaaatgagaatgcgcatgggagcaaaatgggagagaccgctgttttcttatttctttttgaaacagggagagcaccgttggttcatatgacgtgcagcgcgttgcggccggcccatgcatgagattcaccggagcagaatgggcctttacaagtttactctagctggggcgagcgctggacaggagacggcccagtgggccaggccagcacaactcgtgggcttccctcctccattttttttctttttcttataggccctcctccatacttgatccaacaaactgtggcatgcataaaatttggcatggcaactttgggagccaaccaaacagcccctaattcctcccccgtctatgaagaaaaagaagacaaaaaaataaatgctactgagaatattctcccttctaaaaaatgagaaaaagggagaaaattaatctacggttgagagattatcgtacagatcgataagtttatttccaagcacattcagattttagtactaaaatatagctatctttgagtaaattttgttttacatgctccctccaggctagaatataaggatttttatggttgaacatatgtattaattaagaaagtcaataaaatcaaatgagagaaggttatgattggttgagaagtgaatgtgggtgagaaaattgaatggtggagacttgtgattggtggagaaaagaatgttggtgaagaagttgttatattttgggacaaagcttaagggctactccctccggttctatagtaattgacgttttgaacaaggttgaggtcaaactttcataactttggctatcaataactttaaaatatttagtttaaaggaactataacaacatatatagatttctctttcaaagcactataatagaagtaaacatacatttatttattgaatatattataataaaaaaataaggtcaaagatatattttgtagaccgtgtcattgtccaaaacgtcatgaaaccggagggagtagaagttgttatattttaggatggagggagtagctaactatagaagtaaaagatgattttaccctcattacttctcatgctatctctggtgggtcccatcactcactaactcttggaacatgtacctcatccatactacctaggggtggcaatttccccgttggggccggggacctagcaggtacccgcccctacgggactagggacgggttgaaattctcacccgcgggtgagcggggacgggggtggggattcaaaactatctcgtggggccccagagtataagatactgctgtaaaagcagcccatttcaaaaatataggcccaactagcccacatataaattctaaccctaatctctccactctctcctcacccaacatactccctctagcctccaccccagccaccgccctatccctcccgtctcccgtgccatcagccgcctcatttctgcgcatgctcgccatctgccacgttgccgccgcgccccttctcgctgtcccccgcctcatccgcgccccccctctccatccgtctcatctcctagctagtcggtcattgccgagccactctctatccactcctcattagcgcacccctcctcgtcggtcgtcgccgagccactcgtcgtccgctgcctcgtctgcgtgcctctcctcgttggtcatcgccgcccccctcgccgtccaccgcctaatccgtcctccttgccatttgcctcatcctcgtgcccctcatcgcctcatcagttgtcaccgaggcactcgtcgttcaccgtgtgcctcgtcatccacctcatcctcgtgtccctcgtcgccgcaccaacgccgtctgcctcgtccccacgcccctctcttgtcgttggcctcctcatcgtcggggttacggggggccgttcgaggtgcgggtccccggaggggccgggggcggggagattttgccccgttcatcactccggggccaagggcggggatgttatagcccgccctgcccccgccccaccccgttgcaacccctaatactatcccttgctctccacaccaaaaaccaaaaaaaagtaagtagagccactcatctccacaatacactgtgtatttcagccctacctctgacgagacacccccaaaacaccagccacaaccatgacctaccagtattgccgtgccgatgaactcgttgtgccaccgccgctgctgcctatgatcccaccggccggttgtgccatcactgttgtcgcatccggtcaggggaagctagatttggctgcactggatgccaccatcaactagccttgaagctttccactgccacagctggtcgcgccgcctcgttgctcctgagagaagaacgaccacaccggccactaccatccttgaagctcgatcgctcggttttcggctagctgctctggcggtggcggagcagggaaatggagaggaatatggggctactgggg

SEQ ID NO: 74228 - DNA, 955 bp, Oryza sativa
atcaacgtagtggaaatcctggctattgtcgtccaataaagtcataaatttatgcggattggtgatgacttggtgtttcagtgttttaaaaaagtgttctgcagagcttaacggcacccttttttttagaaaaaaaaacattgatttgatgaaagaatatcatatggatatatttaagatcagaacttcataaagattagcccatggacatatgtaagggtcaaaatgtcacttaatttagtatcgaatggtgcaagtttgtatctttcaaaacttcaggagtttgttttttttgcacgacaatatgaatataaaatattggtagagtttcattttgctaccaagcattcatattttatttctctattcttgacctcgcttatgtaggttctaaatttacagtctgtgtgagaatggagtttctcttgaggttaaaaatgatgtttcatcactaatttgtatttgataacctgcatatttgaatgcatgaacatacaatgcactctgttttattcacatttttctcaatcagctgagttttaactcttatcttccatattctcaaggtgcacgggtatctgttagtgatggtacagtcactattgtagcaaaaacccaaccaattatggataaggctatcgagaaggtatgtatcaacaatacaacaatatgctatttattcattgtgcttatgaaagggtctgtgatctttgcttgcactttattcatgatcttctgttctataaaatttgaaatatgagtacaacacaaagtgcctgggagcaagaaccccagaccattctaaatttctaacttttctacctcattacaggtagaatttcttgtgggtcgtgaaattgaagttggcagaacggtcacaggtgttgtttcctcaataaaagagcccggtccttttgtggaattcaatggtggacagcaaggtctacttcatatt

SEQ ID NO: 74229 - DNA, 604 bp, Oryza sativa
cacaaaatatgaaggaaaaagaacgcacgagaatattcttcgatccaatcccagtaagaacgcacgagaatatccttcgatccaatcccagtgaccaccaacttctggtttttgttagttaaggcgatccatggcgcgcgcgcgcacgtacgcagcccacgacgcgccacgggccagaagcacagctgcacaagcaacaaacaagcgaacgccccgcccccgcgaagaaaagaacggcaaacaaacggctcgcaaaggctttttccgcatatcccactagtcccacactctccactctactccactctgcttcactgtctcctccgctccgttgcttaccccctcccaaaacccaccgccgccgccgcctccgccgcgcaagccaagctgctccctcccctccccggccgccggcggcggccaagaatgctccgctgccgcatcaccccaggtgtgcatctagcgattctctctctctctctggatcacaggctcacttaacttcgggcctttcttgtgccgggattcccatgggatgggatgtgatgtgatgtgcctggttggatttgggttgtgctggatggaaaatgggtaccgagctcga

SEQ ID NO: 74230 - DNA, 2770 bp, Oryza sativa
ttcagcaggatgaagatccaactgttcatcgtcatcgaaaatgccgccatccagcgtacgaaagatcgggagctgccattgccgggtcacgctgtctccgcgagacagcctgcggacaacggccattcgctgatgctgatgcctgtcatccagtgggtgagggttcactcgagctgttccaagaagactagcatctgctgctgctgctgcagggagagggccctggaacggcagctccttccacacggcgcggcaaatcgggcagacggtgttgccgtggcgaacgctggaggagatgcagtggaagtggaacttgtgggagcattccgcggtgaacaaggcttggccattgcctgaacacattcctccgaggcaaatggcacatatcttctgaaaaaagtaaccaagaaaagcaacagaagatagttagtaactgcagatcgatatagcaatcggcagagtggagtttctttgaaaaaaaaacaccaattgaagttaaataaaaaatatgatccagattcatgctaacatgtaaagctttgttccctagaatgaactgtacttatttcacattacaaaatgaaggaatgagttgttttcaagagcatcagatattagcaatgactgaaaagagggaagggagcctaaataatagccaaattgtatgctcctagtgagtcttagagaaaactatagtagtatcaacaatgtcaactgtcatcagcatcagcacaagaggctaatgtccagtccaagtcatgcaatccaagtatacaaggcagactgtaagtcgtaaactactactattattaattaaacatcaagcaaaatagtcaactcatgcagccggaccctgatattatccagatgctgatagaagacacgaaatcgaattagatgcagctagtaaaacattacaaaagcacatcaatcgatgacattgatgtcagctatctgtgtgtctatcctttcattattcagctcacccctttctggaaaagtatgaagcacacagtatatggggcagagcacatatactctgaattataccatatgggccaatctttcaagaagcatccacatattctcaaatacatgctgtttgcagcagaggatcacttgaccaattattgataaccagaaaaggatgctggtctccccctctgatcctctccctgtctttagatcaatgttgatatctaagtcaaaccaaccaagatgctttgcagatcaattttaactatagcatgataaggcacataattagagatgacattcgtgcatgtgaaatcatgaagtggattgatttaattgccaattgctgaggtaaatcttatccagtaaactatgttgaccaaatgtcattttatttcaagtatattttagaagctccattggaatattaggacaacatgttatatgataaatataacaggctacctcatcacatactactacttgggaatatttgtttgttaaaacgatccagtgttttgctcatcagagtgatgtcaagagctgaatttcctaaaaaaaaaaggtttctgtaagccttatctcgtacatggcatcacccaactgatcaaagaaaaaacatgggctggaaagggaaagaaaacagtaggcttcaaaagatgaggagagagttggtgaacaagagaggtgtcctgcccttcctcggaattgcacacataattatacaacagaacaagcaatcaaaattttcgtccttttctagtcctaaataattaagaaactattgcatacttctccggttgcttactagcacacaacgcgctacattcatgataatttcaatggataaaaaaataaaaaaaacaaacataaaagtattaaacacgcgcaagaaattcaaatgcaagaatcaacccaaagaccaaaaaaatacagagaaaaggtccatgcaagcaaccgggcaagcagaattccctagaagtaaaaacaactaattcttttagatggcaatgtaccaatcaaagcagaaaggtattgcatggtagtacgatgttaagtagcaacgacgttttctccaggtttttggcacagtttaacatcgttggcatgatatggtgttgatctacaagacgatcaacgaaatcaggtaccccgacaaaaaccctgtctcagatgaaacacaagtagcacaagcttgggtatcataatgaaacaaaggatctgttgatttcggtgaaagatggcaaagggagcaaaataatgcagaacaacaattgtattcggcatcatctctactactttggaagtcatccttctccttcaccactacaattcaccatcatagttcctcatgtaaacaaaccaactctctaaaaaaaatctccccacccaaaaaccattgttttcacgcgaagattaacctgaaaatccagataggacgtagcactattcttttttaaaaaaagatcaggcaaaagtttggccttcaggatcactgcagtttttctttttgtgacaaaaggcatatatcagcataagatggatatccctttacaaaaagaaatctgactaagtttcacaatgattccaaattgcagatatgattaaaatccccgcttacgtgcggggaacaaaaagaactagcgaacactgattaaagtgccgtgtttccttacctaaaccctacaaagttatgctaatctaaacggatgcagccctcttgatcatgaatcattcgaacaaaaatatcgtatcaactttccccaggcgtgtcctagaactactatcagatttc

SEQ ID NO: 74231 - DNA, 861 bp, Oryza sativa
attaattaggatatttcatgtaatttccttagagatatatttgggcaaaagtttaccgcaaagacttatggtatcttagagtttgttagagataagtgtcgtgtccggcaaggacatattttgtaatctcgggtataaatagaacccgaacccatgtaatcaattaacaatagttcaatacaatcttggtgcatcgccaccctttttactttcgttctatttcgacgagttcttgctttcgggttgagctacatcgttttgatcttcaactagaggtaaaacttgttatggcagcttgcattgtcgggattagtgcttccatctctatgacactctaatcttgattatgtaatctgtcgagttatcatatatactttgcaatctatgttagttgcgctatataacttgttatcagttggttcttattgttaggaagcaatcggtagagttatgttttgttattgatctagattgtatcgtgtatataccatcttttgtaggttttcatcatcttgtctagatcttatacttgtctttatgcttaatgttgcatcggttaggttcgatctattaagtaatatctataattatgatatctggcttcttttatgattatcaagagagatagtatcggggtttcagccgatcttacctaatttagctattttatatcttatatgcttaattgatatgctaagtctgccctttatattaagatcttattgcaataaagtatattaggctttctgtttgacatattctatttgttctagtaatggtatcggagtactagccgatacgtgctagatctatctgatcgtctatgctataaacatttataatctttgtattaatgtatac

SEQ ID NO: 74232 - DNA, 16246 bp, Oryza sativa
ccttgagaacacccttaaagactatcgaggagtcatcccttctaaatacggtcacatcaacatcggtaaaaagacaattgtagcccatggaacacaattgagaaacggacaagagattatagtttagagattttaccaagaggacgttagaaatggaaaggtcattgtagattgcaatcttacccaatcccattacttttccctttccatcgtccccgaagactatgttctcttgcaaagagccattaggatcaagggagcaaaacattgattcttctccggtcatgtgatttgtgcatccactatcgatcacccaacttcttccaccggagagatattcctacaagagatcaatttctagttttaggtacccacacttgcttgggtcctctcatgttagtgacaagtgccttaggcacccaaagaactctcttgatggaaacatttttgccccttgggcctacatacttagcaacaacacgaccactagcattcttcctaagaacataagatgcatcaaaagaacaatgtgaagcataatcattaggaaggatacttttggccttaacaaaattgctaagaccttggggcctcttgatcgtcatactcttgtccacctttccttttggtggaggaacataccaaagaccctcatggttgaagttgtccctttgatagcctaggtactcctttagggccttactacccatatggcacttaagtaggccattgtgaaggagtcccataagcttctcattttgcttttgcaaagcactcaaagaaatagagttagtagcacaagcttcaatatcaatatctttgcatctcacacatgattcattgcttgggagaattttggaacaagacggctcgctagggagagagacactattctttaaggtttcgaacttctcttcaagagagatgtatgctttgtccaagccatccactctctcttgaaattgagcgttcgccaccccaagattagcatgagactctttggtttgcttgtaaagccgtgccaaagcctcatttttctctctctccttagcaagctcactcttgagttcatgagatcgctctttctcacgaatgagcaaagcctcttgcctctcaagagttgcatattggtcctcaattctcccaagcaactcactcaagtgtggtagagattccttagttatggacttgaacaattcgtcatccataacctcatcctcaacctcatcctcctcatcactaacaagatcatcattaaatgatttgagaggagaaggtaccttaggctcctttgccatgaggcaaatgggagcatcctcatcacttgagtagtcgaagagtctcggcggtgatggaggcttgacagcgaacgtggcaactccttcttcatcacttgagcttgacttggaatcagagccgaaaatcatcccaaggtgagcttggccataatgttcccgcttgctatgcttatacttctccttcttctcatccttcttcttatcttccttgatgtgggaaccatccttgaggtgagggcaatccgcaatgaagtgcccgggctcttttcacacgtagcacactcttgcggaatgtcttccacttgacttgttggagtgatgcttggaagaatttcccttgaagaagccgcttcgcctcataaacttgccgaacttcttgacgaagagagccatttcttcatcatcgatctcctccttgctcttgctcttgtggttctcttcttcttcttcctttgccttcaatgccaagtcttccttcttgatgcttgtcgttgagctttggttgatgtattggatgacctccttggactcttgcacaagcatgtcatgggcaagaatgcgtccgagcaaatcatgaggtgtgagagtcttgtagtccggacgctcatgaatgatggtaaccaaggtagagttccttggagtgattgctcgaaccatcttcttgaccacaacctcatcggtcatgtccttggaaccaagtcccttgatctcattgataatcttgctcaaccggtcatacatgtcacttgggctctcaccatccagcatcacaaatctctcaaattgccccttgaggatctccaccttggactcacgaacactatccatgccttcatgcaagttccgaagcgtgtcccaaatcactttggcactctcaatgccatccacacggttgaactcacttccactcaaggcactaagtattgcattggcggcttgagcgttcttgtgctcattctcgtcgtcctccttggtgggatcttcgggattctgcaaaacatagcccttttcgactattctccaaatagatgggttaatagacttcaaatgcatcttcatcttatgcttccaagcggcatagtccataccattgaagtacggagctttgccgctataggtactcacataagatgtggatgtagttggatagtcataaggaaacgtagctcccttatcaccatctttgccttcccccgtttggcccgacatgatctctccaagcggttaagcctaattaggagattaggctctgataccaattgaaagggtcaattaggcctagagggggggcgaataggctaatttaaaactttatgcggaagctaaaactgagttagggtcggaaagtctgatccacagtcagactatccgaaaatatcagatagtctgatattggatcagactgtctgatccactaaaagaacactacaagtagatctagtgcacaaacaagagtatggcgcaaacagcgactagatctatagcggcacaaaaaacaaatctaaataatgggagaagagatatcaccaacaatgaagctcacctagttgttcctagagttcaaatccttgaggggattctattctccgttgaggagctcactaagagccgggtctttgctaaccctttcctcaagaggttgcactaagcacttctacttccactaaggggtatctctttccttgtggaggcgagatccggtcttcacaaacttctcccgaccaaccacacgtagatcggtggctcgggagtgacacctagccgtctaggagtcctcaacctccaagagtaacaaactccacacaactcttggtcaaccctagtgctcaagatcgagtgaaacacacactaggccctcaaaccccaaatccacaaccaccaagatccaccacacaaagaacaagaggggatttgagagagggagagagagctcaaagatccaaaccaccttagcagcaagctcaacccaaagtgaatatgaatgaatgagttgggtaaccctagaaaagggttaggtggggggtatttatagaagcccccaaaatgtggccgttgggagagaatcttttcatcccacctcggaaagtccgaggtgacatcggatagtccgatgtttttgaccaccaaccaggccagagacagagaacgaaattctggaaaatttcggacaatccgatcgatcggatagtccgatgtcatatcggatattccgttatttttgaaccaagaatttcatcctctcacagagactcaagttccattgaatttcggagtctctggatcatcggatactccgatcacatcggatagtctgatttaaaactcactcaaaaggaataaaaagcaattcaaaacagagagtgaagttctgagaaatttcagatagtccgacgtatcggatagtccgaccttatatcggatagtccgatattttttagccaacactcagacccaagacagtgagcaaagttctgtgaaatttcggatagtctgagcatcggatagtctgatcaacatcggatagtccgacagacataaaacaggaacacttcaaataaatgattttgagcactagtgttctaccaattatatgcatgtggcatccctcttaatagtacggcatcctaatactcaagaacacaagatatacatggattagaagacaattaccacaaaagatgccgcaatacttattgtgttgacatccactcctttttcatccttgcatatatctcaacaaaaagcattagttaccctctaactgtgttgtcattaacaccaaaataaatgaggggtcctagatgcactttcactcttctctttcttctcttctctcctcctcatattcctctctctctcaaactccccactcccgggagagaacattcttctctctctctctggggcacgcggcggcagaggccggtcggcacgcggcagcgagcgccccacgcgtcaaaggcgacgagggcaacgccggctctcccctacccagatccgtgcgaatccaacagcggtggcggggggagcacaggggctgcggcgggtgcatggcgggcggacaatccgcgcccagatcctgcggtggcggcagcggctgccgtccctcacccaaatctgatggtggtggccgtcccccgcccagatccagcggtggctggccagcaggcgttttgctatttttatttttgtgtgtggacgacataaacatccgcacacggaaatccgattttcgcatgtgggtgcgccaccctcatagaaaaatagagattttcatagacatttctgggcaaacggcccggaggtccgcaagcaaaaatcacttttggcctgtttgaaaaaaattatattttactagtcccggcattcgtcagccaatccgtcagcagttgcaccaacaaaattaacgaatctgaaaattacaattttaccactccacgctcatatttctatgactatcgtaccttcctacgtttctactttcattaattagagtggtagtacaattaaatcttacccattggaaaaataataattgacggtttagattaatttctaccagtagatatatagcatcggacagggactcgtgactgttgtcttgaagtatcccagcagaaatcaattgttcttctattggtgttcatttttttctgaatgactgcttttctagtactaaatattggtgatgaaacaatgtataacattgggtgtttctgttataataatctcaccacactggtgatgttaatgtatatattgtctgacataagctgtaaatctgagatctttgctgatgaaattgtttggttttgcaggtttggctgccactggttgctaagagctacaactgcttccaatatatatttaccgtggcctatgactctggttcatgtggatcaaagttagattctaaggagtagacttgtaagtgtgaaatcatcgtcatgattaatatttgtgatgaacaattggctttacaaatgatttaatcaaagaattggtttgaatagatgtgtggatgttggtgtgagtgcgtgtgactaatgtgggtcaggttgtgatatctgcgcccagaaacggttattttgtctaattatgtgcaggtgacttgaggtcagccttggacaatggtgaggaccgggactatgctcaggaagaagcagaggtctagtgcggtcgggataccatgtgaaaaggtgactagagtcagaattcttggaggtcaacttcggtcaatggtgaggatcgggactaaacttagggaggagttgaggtccagacggtcaaggataccgggtgacaaaattggatacgagatggcatacggtggatggacatcgtgtgggagagatcttcacaacgggcttcacgaggtgtgtgtgcaagcgtcggtgttcgcgaaggagattggagtgacaaattgagttagagtatatgatgctacagtacacgtggtactgtagcatgcatatatgtgtgcctactgtggattgcagtagcgtggtgatgcatgttgtgctatgcatgtgtgtatgcgtactgtgcagcatgcagcggctcggcttggtgatgcaagcagggcgtcggtctggcctgggcatgcggcaaggcaagccgagtctgactcggtgaattttatgtggccggctgtggctgcaggtttcggagagtttgtgagaattacaatttggtaaattgtaatttgatttggtgattaaggatagagtcatagtatgactaggagttatattcctactttgagtaggaggattttcatgtataaatagagagggagcatgaggctttccgggatcggttttaggaagccgagtttgagagattagatagggtttcgagagaaacttataagggtgctttggctgcaccttgtgaacaatacttgagcaataaagaccatattcaatcatcaacgcatcgacgatctatatatattccggttttataagttttacatttatgtttggttttggcattaacatgtgattgttcgttttgctgcgattttgttcaagttaatccattcaaaacctttctagtacttcatagatcagatctggaaagtttcgttgattggttcttgttagatttgaatttgcttaaattttaggttttgttcggatttgctgaaattctgatacagctgactttcgagggtgttttctcttaaaccgtttattagtttgcaaatcccttctgtggagttcttccttagtttgtctagtttattctatcaagtttgtaactcgatccaatggttgtttaagagaaatcgtgtttttgccgaagcgctgtcgtgctgttttcaggctgacggtcagaccgcgagaggacctgcgttctgaccggttagagttcggtcagaccgatcctagtaggtcagatagaccaccaaacgtgtgttccattggcttttgagattggggtgtgttttgatcgattaagattcgattatttgacttcgctgacgtaatctaccattcaccctttctggtaggcttggctactcgtgttcgatcctacggtaggactcaagtatctgttttggctgttttcctaataattaattcctagttgagagtcagtgattcatgtagacattagccaatagggattgctagagagtggctgattccattaatacaatagcatatgcctttttaattacggctggttagtatggttaatttttgctttgcttgtctagctagcttcggagcacatttgattacttgaggcaagctcatctatcattgaacgatttggtgttccatcttctcagtactcaataccggtgacggcacactgtttctttagcccttttactcgtactttgatgatgactgggttctttaagatggagcaacataaattttatatattttgtttgaaaataagtcgagttgaccttctgttcatcacagtaagcgccgttccataagcttggtcgtatgctatatggaagtggtggccagatcatacatataacatggcatctcgctaaactatttttcaagacaaagctagctaggctgatcatattaaatctatactttctataaagttaaaattaaaatggactaagtctaaagctcaacatacaaccatgccgcatcgtcagccactagcaataattacatatttaatctcatgcaagtatacaacatgatctacaatttatttaattctgcaaatcaaaatgcaagcatatccaatcatcaccactcatgtcatttgcacaatattttaacaaatctatctatcacttctacaatatttaacatatacttatcaataagttttacactaaagcacatgtatcatttgactgataaaccctgttgtttcattattttttttctttttactgctagcttgattgtaaaagaaatatatattgagaattacttagtaattcccacagcaaagcgcggggaatcacctagtataaaaacgaataaaaccttacacgaaaaagagattaaacatgccaacacataacaacgatgattcacattctataatgctacaagggatgctagcagaccagcgcaaccacaacgctgactaaattctatattcatgtaacgggacaaagtctttaaaatggcatattgcttgattatagaaaaatgatactgggtaagcttccaatgcttggatcctcacatgcagacctcggagaagttcatgttataacctcggataacttccattacacaaaaattgctaaactcattgcaaaagagagcactgagaggttgacaccgacggctaccctgtcttaggctcttagcctgctccgctaccgatagatccggtgcgccgccgtctctccttccgcgccaccgcacgctgccgcggcttaggccttgtttagatgggactaaaacttttaagtccctatcacatcggatgtttgaatattaattataaatattaaacgtagactattaataaaacccatccataatcttggactaattcgcgagacgaatctattgagcctaactaatccatgattagcctatgtgatgctacagtaaacattctctaattatggattaattaggcttaaaaaatttgtcttgtgaattagctttcatttatgtaattagttttgtaagtagtctatatttaatactctaaattagtgtataaagacagggactaaagttaagtctctggatccaaacaccaccttaccaccggtgagcgtatctgaattctattgataaaggaagactagtttgtatgtctgtgttcttatcttcttattgacatgtcatatattgtttttgttatacatatataggttacagcatgtgtatatcaaagttaggcattccaacgagtagtattgtaggactcaagtatgtgttttggctgttttgctaataattcatacctgtcgagagtcagtgcctcagtggttcatgtagatattagccaatagggatagctacagagtggctgattccattaatacaatagcaatctgctttttttaattacggctggttagtacgttaattttttgcgcttagcttgtctagctttcgagcacaattggttaactcatctgtcactgaacgacttggtgttccatcttgtcagtactcaataccggtgacggcacactgtttcttagcccttttactcgtactttgatgatgtctgggttctttaagatggagcaacataaatttctcatatattttgtttgaaaataaatcgagttgaccttctgttcatcacagtaagcgccgttccttaagcttggtcgtatgctatatggaagtggccagccagatcatgcatataacatgacatcgcgttaacttctttttcaaaacaaaggctgataatattaaatagaagaaacaattataaccttacatgcaaacaagacattaagcatgtcaacacacaacaaaggcgattcacattctataatgctacaagagattcgagcaaacgagcgcaactacaacgctgactaaattatatatacatctaacgggagaaaggctttaaaattgaatattgaatgattatagaaaattgatttatactgggtaagcatccaatgcttggatcctcacatgcagacctcggagaagttcatgctataattaccttggacaacttccaatacacaaagtgaaaattgctaaactccttgcaaaagagagcactgagaggttgacaccaccggcaaccctgtcttagcttgctccgccgccgacaggtccggtgcgccgccttctctccttccgcgccaccgcacgccgccgcggcttaccaccggtatgtctgtgttcttatcttcttattgacatgtcatatattgtttttgttatacatatataggttacagcatgtgtatatcatacatacctcatcttagagttccttgacttcagagttaattaaaaagcgatattgttcttgtgctgaaaagtttcaagttgaaagcaaaagcatattggatgcaataaactcaggtttacaccaaatgttaccctttttattttgtcacgtgtaactgtgtaagcaacgacacgaagtttcatgagattgttggtaaattaagttgcaatctgttgcaactctgcttttagtggacgattacttttggaatagaaatattgttgatgctatgcacctgcgggcaggggccaacacatgatttttacaatgagggtaggaagtttattaagaaaccaatgctatataatactagagtactgaagatttatgtagaaaagcttaaacaaaaatagttgtctcatatgctttaagtaggctaataattagtgttttggttgaaaaggcaattttttgtaccctactatagtataaatacctaattggcatactatctaatgaatattttaccaaaacatatataaaaaagagtgtgcatctgtacacctcttgtcccatactagctctgcctctgcccgagggattaaaatctacaattcatttagatggatctttaacatacagttttcatatgaccaggcgatcatcaatttatttggagcaaggacaatcatattgtctaatggatcttcaaaaaaacaagcataatgaattcatcgaaaagccaaaatggatagaggacaacatttctaatataaaggcattcacgaaagaagatataaaaggaattaccagtaactacagcaaaaggcttggaaatggtaaactcggaaaagtttacaagggtattcttgatgataaccatgctgttgtggtgaagaagtatattcatatggattctgaagaagagtttgctaaagaagtaattgtccatagtcaaatcaaccataagaatatagtcaggcttatcggctattgtactgagaaaaataatctaatgatggtcatggagtatatgtctaatggagaccttgattaccatcttcatgtcaagaatagcctcgattcattggacataagattgaacattgctatagattgtgcagatgctctagggtatatgcattccatgtgcagccctgttttacatggtgatgtcaagccctccaacattcttctagatgacagttttaatgcaaaaatatcagattttggaatatctaggcttctctcaacagacaaaactcatactgaaaatatgattacatgttatatggaccctctgtattaccaggaggggcgtctcacctcaaaaagtgatgtttatagttttggaattgttctaatggaactaatcaccaagaaaagggctacatgtctcactcaagctcttgctgaaggacaagagatgacagaattgcttgatcctatgattgctaatgagagcaacatgaaggttctactggagattgaaaaactagtgcaggaatgcctagcagaggatattgatagacgccctgatatatgtgatgtggctgcataccttcggatgcttaggaagatgagtcaacaagcaccacaagaaaattttggttggcacttgtttgcagaaacacaaaatgattttaaaaagcaaagccatcaaggtacaaacattatcagctctatcaagatggtgttccctaggatgatgggcattctcaacgtgaacatggccaaatctgaaaacaaaggaactccgctctatgttagtggcaaaagaatattcacagcattggaaataaagaaaataacaggaaactattcaagaattatcggtaaagatatgtttactgtggtctactctggaattcttgaggataacacacaggtggcagtgaagacacacaacatgtttgaacgtgggaagtggagatgtgccaatgaactgaatagcctttctgaacttatccataagaacattatcaatctgttgggtttctgctatgagatggacgctgtaatattggtttatgaattgatcgagcgagggcacctctgcaacattctccacggcaatgatactaaaagattccctctcccactagatttacgtctagacattgctattgggttggcagaaggattgtcatatatgcatagtagatcaaaacccatactacatggaaacataagaacagtcactgtacttctcgacgacaaatttgtcccaaagatatcgggttttgggtcatcaaagattggtgaagatggtaaatgcaggattgtggggagcgagatgggctacatggatgaaacattcgttaataccagagttctcacacggaagagcgatgtctatagttttggagttgttctcttggaactgattaccaggaaacgaatttattataatggtaaggacaataatactgccatcaattttgccaaagtttatgagaaagagggcagtgggagggctatgtttgacaatgagatcagtgctgacaaaaatatccctaccctcgaagacattggcattctagcaatgaagtgcttcaatccggacatagataagcgccctgaaatgaaagaagtatgcgaacaactgttgatgcttaaaaggtctagtaagaagggcaaaggaaaaatataagttctcacattgaagatagttaagagaaataaactaaaacttgatgcaggagatttgtgaggatgaggaatatgaagtacattacattagctcacaagatcatttcagcatttgtttgatcagtcaattgctttttctcgttgtttggtgttatggtttatcattatatatctgaacttctttttagtatttggaacactaatgttccaactctgtattttctgtagggtgtgattatagtgccaataattttttattccttttttatctgtggttaacaaatactattatcgtacataagaaaataatacaataacaagcaaaatgacacactaacatcaaccaatgttcttaaaaaaaacatcatagtccaccacattatgcattccatataattttgtagataaaattgcaaaaccatgtagattcagcctgttcttctgtcaaatatgccattttttcacacaatttattcaccaacagtacatctggttgttcaaaagtattttaagatcagggtaggaagttaaaactagcattacagtaccagataattattatgctggagagtggaactataatagcggcaggtggagctaggaattttattaagcctgggcaagtctaactaagatggtaaaaccgctaccgactgatgtgatgcttatatgctaattttactatcaaattgaacatggaacaattttctaatagaagcatagttcaacatgtatgtaaatttttacttgttgaaaaacaagccgactgatgattcgttaggctgctaattgagtggatcacatcagccatggtgaagtgggcaagtcggcaacaggtagccacggtctaattgcatgcaacagtgctgcaaagctagctggttctaattaaaattctagcctgctactaattttgtccaagatgtcagcaaatctatggaattcaacacagagaaatcattagacctcaatggatcgcacaggcaaagcccgggcatgcaactgcccgtggtgcccaggcggtgaatccaccactgaatagcgggtatccgagtatggactccgactcaccacgcgaattaaactgtcgacctttctcgtggcatgtttggagatgcttcattcattaactagatggaatcccacgcgttgctgtgggacactatgtgaataaattatgtacgattaaaggaaaggtttaaaaatgaagccaatcaataaaaggatatctacagtttggttggaatatgatatgtatgacatataagtgatctaacaaggtcatccataagttcaatgaagttatgttgttcacttcatactacacgcacgaaggaaataaaaaggtaaattgtacggttggttttaattagagaatgaataaaattgcttcttgctaatctggtaggaagtgcataggtgaaacatgagaaatcatgtcatgatttaatcatggtaataaataattgtcaaaggtaagtgtttgtgataaacaaaatatgtatccgttcgtggtcatttgaaaaactataaaaaaaaaattaatattgaccccacaaacaatcttaaattaaaaaaatcaactacaaagttgtatatcccgtcaagagatacaattttttatataaaatttgtcatcatccaactttatatgatgggcattgtttccatattagtgatgctcacaatattttactaacgcggaacatactgaggtgaacaatcatttttataaagagagcctcaagaaaattactgaaagacgattttgttccaaccggagatcaaattgcagacggcattttttttatttttacaaaagcattttcagtttgacggtttaaatattttaagtataagtagaaaagttgtgattgaaggaggctgttagataaaatgtaatatttcatgtgtatgttatcttgattcagaatgtaaatgcaatcctagagctagttggcaataccaatccagctgctcacgcggcaccattcttgtaaaaccacggcgatgcatgattgatatcgcccctatattaacacaggtgcggcccaagagagattaattcaacgcttccacagctcatccgatcgagttctttctttacacccgcccaagctcaaaggaattgtctcctatcaatgtatctgagagcatgcaagttggtgcttaaatggcagtggaatcaactcatcgttacatttagatatcaatcttatgttactgtcccctagtcattggtacatgcactgtagtgtagtgtcaataatctggatgctttggtaagtatgtacaactgtttaacaatgctgtcgttattttttaaggagaaaagtccacggggccgcaatcaagttaattaagcaagattaatcaaacgcatgcatgcacacatagacatataagtaaacaaataatccctctattaatatattggatgaagaattgaacaagtccacaagagctagcgcagtcaagtgcgattatattagcccagtccattggaactgagcaattaatatattacaacttgagtatcaatatgaccatatgcatggcttagtcgtgcgcttatatattggattagccagggggttcaaaatgaatccaactctgatctctcacttcaactctatgtgtaataggtagagatagatcgagcgcaatagatacacagatagctcattggctgtgtatacccactttgggtgtaacagactgggttttcatccattttcttaagaaaagatagatagatagatatagcataggtgagatatacggagagacagggagaacataatgggtctctctagtgctattgaatggtgggaggagtggcagctgcgcatcctcgccctcagtagtatgggcattcaagtgttccttttcttctctgctatgatgcgtaagcgtgctattccttcctggttcagatccatagtatggcttgcttaccttggcagcgatgctacggtaatatatgccatggcctctctcttcaaccgccacaagaaccaagattacactaatagcttcaaagtacagggcagctacagcctggaagtgttctgggctcccatcctcctaatccaccttggtgggcaagatgttataactgcgtacaacatcgaagacaatgagctttggaggaggcaggtcctcaccactgtgtcacaaataaccgtgtctgtctatgtgtaggtcctcaccactgtgtcacaaataaccgtgtctgtctatgtgttctacaagtcatggtggctggacattattcacagtgacttgaggatgatgcaggcagctatgcagatgtttgtctttggagttctcaaatgcatagagaagccgtgggctctcaggagcgctagcattaacatgcttgttagctctaatagcctcattacaaagatagaaaagagcaatgaagaaggggatagaattgatatttctcttgagtcctatgtggaagaagcgaggaaatttgtcttgaatccttctgatgttgacggtaatagatgccactttaagccctatatgctatttgttgatctttcattgccatattctcttcggcttagtatcctcaaaaccttgtggatacgtgatgatgtgcatttattgttgcaagaagaactcgcgcacacttttcaccgactctacactaaattgagaacgttagtaccagatcatcatgtcgtgtggagtacggattggaaaaatattccaaaaagtccaagatcgatccgatcggttctcgagagtattcaaggattttacggatattgggtttgttcttcctgtttgaagcctccggaatcttcctcctaagtcataaagaagtttataagagcaatgatatcaaggttacatatgtactcctgtgttgcacaacaatgatt

SEQ ID NO: 74233 - DNA, 1251 bp, Oryza sativa
tagatggtattggtagatatacaatgtcacgttctttgtcaatgctagtgctacatgcttacattcttcaaccgtattgatatcgttatgtaaaaaaaaagtttttgattgtttatgaatgtaaaatttagtttttctaatttttgcgggtatggtattgaagttgtcattaaatatactatatgaatataaaaaattcccaatcatacctgtactgttttcttaaaaaataataagagtaaattttacaaaactacacgttttttttatccaagttacagaaaaccacacactgacacttagcgtttaagtacatatattttggtagtgtagttttacaaaaccacactatcaatgaattgattcacctgtgatatggcgtggctgttccacttatgatgaggacatggcatcctattaccagccatcgcacaaaattaataggatgccatattctcgtcctaggtgtaacaaccacgtcatctcacaggtgaatccatttatttactaaaaaatatatatacttaagtgccaagtatcaaagtgtgtgtggttttttgcaacttgatcataaaacgtgcagttttgtgaaatttactcaaataataatgatgatttcgttttgacgttgtgaaatccctgggccctggcacccgacaagctaattctgtctccggtcgtccgccctggaccgcgcacctttgatctgaccgctgagatgcgatcgacgtttttttaataagggtgtggaccaatcccgaagggtgatactaacgcgaggaccaaacgagaaaattgccaaagggcgaaggctttttctcgggttttggcgcgcaccgaccgaggctgcggcggaagcggtggcgagggatcgcctcccgcgtcggaaccctaaaagggtccctttcggctcctcttctatgaagcccccacggcccccgcgtggcccgtccttccaggccccagcggggccgaggccccttccagagccctcctacccaggtatcgcccagctccatcggtggcgcttcttgtttctttctttcttggctttagggatctttttattgccggtgcatgatgcgagctaggatcgtggatcgagggagaaatttctagaaatcgggctggaagagttgggattgagtgggattgggggttcgtgaatgaagacgccgagttcaattaatccggggatcaaaactaaacaacgggcaatgcgaatccttgccctttggcgaatacaaaaga

SEQ ID NO: 74234 - DNA, 37520 bp, Oryza sativa
tgtatatatgtattaaaataatatatgcaactttatatctaatttatatagagataacaatgtagttatagtgtagttacactatagttacaatgtaattatagtgtaactacaatataactagcatgtaactagaatgtaacttgaacaaatctacaataaacatgtgatgatgggactagcttgtgaaaatagggtttagatccgatagcaaaatatctcagcacaaatcttaacacggaatcaatggtaaaaaaatttgacagttttcattaaaaaaaactgtcgacggttagctacatggggtttggttttggcagtgctaggttttttttctttttcagtgaatcagtgtcagtgctaagctttgctcttgcctcagaatagtcaaagactcacgtgttcaactggtgcggtgagtaaatatggctctggcggttatgtgggaatgtgaagtatggtcagggcctcttgctcctgagagatctgaaggcctggcccaaaattgtaagggcccattgacttcgtataccaaactgaaagctcttgtgggcctcaaaaaggtccgtcaaggcccacaaaaatcagcatctgctcctgcacgcgggcgagcagcttaaaattatcccgaactgattcagaacagtataaaaaactgttgtgatcgcaagggatttcccggagcgcaggtgaggcgactgctcaccgcgcgcgtctgtcatgtcaaaatccgtgtctccccgaccgccccacggcgcacataccgcaccacacgcgtttttgtccgtcaagtgaatggaatcctcatcgatctatcatcggtgtcaatgttgcacgtacgatgatgattgatcatcgcagggcagggcaggcaggccacgtaacatccttcctccaaaaacgcaatcttcactgcacctgcgtctcaacaagagtgaaagagacgacgccatgagagggatgcagctggtggcacaaattatactcaccatatacaaatgctgccactctacgacaacacacacctcgcatctgcatctgattccctgcactgcactgcactcctgctcccacttattgggtgggagggagataaaaatgatcacggaaatttgtgaccgagtatcgttttaatgtttctaactatttttattttagttatatataaaatttgattttttttttctaaatttcttttgacgtcgtattgtattgatatcgactctaaattgttaaattaataaaatatgattaattctagagagagaagagatatgttaccggttccaatcgatttcgcgagactcactctccttttacgtacggctaggtccaggcgaaatggaatgatctggaagctacaacagaagcaggtgagtgattaatgagagatggacccgatagatcgtgcactccatcgtgccgcccggtcaggtcccccaagctttttatgaaacgtcgtccctctttgtcgcatgcatccatccccatgctggtttggtttggaaccaatttttgctccattgaaattttaatactttaaaaccctggcaagcttttatgctaccaaatttgataatataaaatttaaattaactagctagctagcgtggataaaaattgatagcaaaccaagtatcgccgatctcggaggtccttcagtccatccgctcatagagccatctttggtcgttagctggcattgctaattttggggttttattgggagagtagtgggctctgccccttccagttggttggagtcgtactttccgagtctttttcctttggtcttttgttttcctcctcttttggcataagtcggtctggcttaatgcgttgtgtaacgaatattcttatcttctaatatattgacgtgcaatccttttgcgtgttcgagaaaaaagatagatccctttaacactgttaaacttatcaacactttagtaggacaaatatcaatcttggcttcaaaccaaacaaatccatacaccgtacatccaaagtatgaaccatatttcttttatcactaagattaagtaggaattaactcacccaccatatgatataaataaaaagctatatacatgaatataaccaatcaatactaaaatgacatcttaatatcttgtcagtaatttaatttagcacatagaaactataaatatgtttctctaatttgaaaattatgtaaaaaaaatagatatattatagcctcttggatgtagggaatgccagattttgcatgcagatctatgcagcatagactagtgcccggccctgatccatgcacagccgcacacgtgttacccagccaagtctccctcgtacgacctgggctccacgtcatcataatgcatatgcacccgatgtgccacgtgtgcatccacttctccaattgttgtacagtactgatcactaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaagagctgaatagagtctgtttggtacagacccaactcctaaatttaattctagaagttgggtctggagtaaagttgtagagctgtctaaacccagcttcacaattctagtttattttgtgatagagttttacccagctctactcccagttttggtggagctgaaattatttggctgagctccagttctaggaggggtggaactggagctgtagctatctcaaacaggccttatattgctgatgaatgtagatttgccaactgagagtcgtcacacgtgtcagccgtcctccactctctgtctctggtcgccactgcgcatacacgagatttccaattcttggccagcaattgcttttgcttggggccggggtccaataatccaactgaaagccatccatagaccaaccatgatggacgatgcgatgcatatatacatatatagctagtggcaccactttggtgctgtcatagatggagaggtgacacgtggctaatactcaatcatgttccaccgaggttttatggagtagtaggtcatctccggtttcatcccaaagtgtgcctaagatgaaggtatgcggaaaacaagtaatttagtatatgattagttaaattttgattattataaacttttaaaataaatttatctgatattttaaaataacatctatataaaaagcttttttaaaaaaatattccatttaacagtttgaaaaacgtactaataaaaaccgaggctaatggccaaaatattgaccgaacataatttggttagttggatcttaatcaaatttctctatctcggtcttttttttctattggttttagtcttttttttccttcacccctattggcacgatggtaatgctctactgaccgattttgcaaaacaacacgtgagtatccacctagtaagaatggatcaagctgagtgtttattagattattttttggactgtgtactactgtattttactttctccgtcccaaaataaatacagttttacattattcatatccaacgattaaccgttcgtcttatttgaagtcttatttaaaaattttttatgattagtatttttattattattctactactaataatcgaaaaataagagacgtttctgtcgtccggtggaaaaaaaaggcgagaaaataaaagaaaaacaacttctatccaaaaaaaagtccgactacttaaaaaatccgactcctcggtggaaaaaaaagagaagaaaaaaaaacttctatcgtaaaaagaaaccgtccgactaaaaaaaaagtctgactcccggtggagaaaaaaaggcgagaaaaaaataaggaaaaaacttctactgtaaaaaaaaggaaaaaaaagactgctgactacttttttaaaaatatatatataaaaaatgaaaatgtttttgccggtagttttggtacatcattcgtatatgggtcggtttttaaattcgttcgcttttgaaaatacaaattcgtatttgagtcgggttttaaattcgtccgcttttggaaatacaaaaggaatcgtataaaaaatctctttaaaaaactcgcatgctaatttgagacgatcggactcctaattgcagctcatgattttctaacaaaaatatatatccaagcgaatttaacacggtaaatttcatcttaactaaaccatataacaataataagattaaaatagccttcacccgtggcaacgcacgggtgttttttctagtagatgataaaacatgaatagtatttaatatgtgactaatttttttaaaattgttttttataaattttttaaataagataaacggtaaaacattcgacacggatacacagtataatctaagtgagaatctaaacttttaagagctacaaattttgaaggcactctcactgcatgcaggacagtcatctacgtcacctacaactgtatactggcccaaattattctaatacatatattaataattatatacgtaaataaatactccataaatcatcctcacactaaatctcaaatatcatgtaactactaggtctcaataaaaccctataattcctttcttaatttcttcattaaatgcattacaatgttaaatactgcgtagcaccttattaatttaattatataaaaaaatatacaacatgaaacactaaaattattatggctatgtttagttcagcgcaaaacttgaattttggttgaaattagagatgatgtgactgaaaagttgtgtatgacaggttgatgtgatgaaaaaggattgaagtttggatccaaactttagatcaaaacacagcctatatgagaattgagaagtcacagcggtcggaagcatctcagatactatcatggtcacgaacttatacagtagctctggaaatacatgtcggatgaaagttgatacagaacttatgtgtaaggactgagcttgtacgcttgaaatttacgtggttgtatacaccccattaatgtagaagttaggttttataaattctaattatctaaaaattagtgctggatgcctgtgttatcagttgacacacaaaaatatgcttatttaatttgtgtgccctactagaacaaaaatagctaaccccacttaaaatatctttcacagattgatagcccctgtatatcaataatatattttttcaaggttgctgatggttatttatttacattctcaaacatagtgatgtgccattaggcggatgatactgaaaccgcgctgttaattaattagcctgccatagctactacttatcccatcaattatctctcatataattcttttttctaattatcttggcacatacttcctccattttacgacataagactttctaacattgcccacatacatataaatgcatgtgtttagattcattaccatctaaatgaatgtggacaatgatagaaagtcttacattgtgaaacggatggagtatataactatcagggttatggataccacatacctaatagtagttgactaaatatcggcaagatccaccacataccatgtcttatacggaaactgacctcgagggagttccggataagaaaagacaaccagagttctacatagaaacgacaagaactactcggattgtatccatattggtttccctaattctacttgaacaaggggacacctatatgtataaatacaagcctccctaggaggacagggggacacccaccacgagacaatcaactccgaacacaatcaacatagaagccaacatacgtcaagacaagccgccggatatcgacatcagagatacgcctggatcgaccctatccggtaccttcagaggccggccgtagggatctagcactgtctctgattccgtcgggcgcgagctcgaggaggaaggctaccctgttgtcgactacgagtcagaccttcagaccgccatgtcgacaacagttagataggctaccccacatattgtattagtgtgattatggtgaataaaaaacaacatcggctccggccaacaggatgtagggctattacttgatagctcaggggcccgaacctgtataaaaatcctcgtccccatctcttttacctcagtctcgcatatatcctagcaccgacgatccccatactatgcaaatactagaattgcgacatcaaacgtcgacagtggcgcgccaggtagggggactttggtgcttcaggatctcgatgagatgggttcaagagatggattctccaacaacaagctactcgacgacttcggctgtgaggagatctaacccgactgaagtacatcttccgactagatcgaaaccatcatcgtcatcgacaacttggtctatcgagatcatccaagcctcaagatatgcggcgtaccaaaagatgtcagatcatatgatgtcgaacgagtacgcaataaggtaattggtagattggtttttcaaattaatctactaatttcgtagatacatccggcatgtatctacaaagatacgcaatattttctatgcaatttatcgtaccttttcagatcatacagcattatcagatctataatttattatgtttacctagagcatgttttttatacaatatctattgcgcggatgtttccgacattaaaccaactacggtctaacgctgggggctcgctctgttatcttctgtataaatcatgcttgtttacggtttacataatgtctgatatttacatctgctcgtcatatcctgataatactagaagatccatgcagtttttgagtacatactcgatattatctgctatatatcttgccttctagaaaatatttttcaagaacaattgagcactcgagtaggttatggtcgagtacactccattatcgagaacattctcgacaaatgtggagttatcgcacccaacctatcaacgaagaccgacgacctttctcataacgctggccatcgttggactactcgagaaaaggttgttaacagataattcctcgcaaacgtcgtcggtttgatcacccgacatgattgcgagcggacatctggatatgctataagttgggtacgtgagtcatgctggccacatgatatgcacatgtaatgaaccaactctagcgcccctataggtgattaagagactcctactcctggttctcgaaccagtaaaacgtagtgatctctctcgcctcactttaagtggtcgagttacgactactgcctggtcctcgaccagcgatgtagcgtctctcccactacttccactttaagtggtcgagttacgactactgtctggttcttgaccagcgatgtagcgtctctcccactacttccacttcaagtggtcgagttacgactactgcttgatcctcgaccagcgatgtagcgtttctcccactattttcacttcaagtggtcgagttacgactactgcctggtcctcgaccagcgatgtatcgtttctcccactatttccacttcaagtggtcgagttacgactactccctggtcctcgaccagcagtgtagcgattctcccactatttccacttcaagtggtcgagttacgactactacctggtcctcaaccagcggtgtagcgatttctcctactacctctacttcaacaaagttgatagcaggtacacaatatcgccaagtgttttacccagagatcccttaccacgacgacacctagcgttgaaacctatcctactgtccctttacgccgtcttgacaaggcctctgaggaacctaagggatcttcggctggggacgcccagagccggtaaggccttgccggatcctgtagagacgaaagaccatgtaagatctggtcgtgtaagagttcttgccgtgcatattaaccaagctgtgtaatcggaaattaactttccaacttcatggctgggggctaggatcagtgcttgttcaaccaaggcaggtcaagggtctaagagccttttcctccaagaacgattctccgatgacaaggctgggggctagggagagtgtatgactctacaaactgattgatcgaagtcggtaagagagaagacgctcatacacaaaacattagtcggtaaaattaattcatttttagttttccatacatattataacatgtcaccctttgagcgttcgctcgggggctatttctatttgatattcttttctgagtattgatttcaggaaaattctattcgacattgatgaagactccatgtctctatggttctacaccaagatcgactaaggcgagtacgactaatgttgacaaggctccgtcgcagactctacgcctcctcgatcgctcgagaacggttgctggatctcgacaaggaatacggaatgaagaaatggtgtacccgccgagataaaatttcttgacttcaatccaaattctcgattacagccagacgggagacttagtcgtacgctctgtactttctcggtcgacatcagagattgacttagataaaccctttcggtgcccgcacgaagctaataaaggaagtctaacgttatctctagactcaccgagaacggtcacgtgagctcgataacagttcctccgaagtctgcggttgagaatatgaactcgttcatttgcattgaagtcgggggctatcgtcagggttatggataccacatacctaatagtagttgactaaatattggcatgatccaccacataccatgtcttatgcggaaactgacctcgagggagttccggataaggaaagacaaccagagttctacatggaaacgacaaggactactcggattgtatccatattggtttccctagttctacttggacaaggggacacctatatgtataaatacaagcccccctaggaggacagggggacacccaccacgagacaatcaactcccaacacaatcaacatagaagccaacatacgtcaagacaagccgtcggatatcgacatcagagatacgcctggatcgaccctatccagtaccttcagaggccggccgtagggatctagcactgtctctgatttcgtcgggcgcgagctcgaggaggaaggctaccctgttgtcgactacgagtcagaccttcagacctccatgtcgacaacagttagataggctaccccacatattgtattagtgtgattatggtgaataaaaagcaacatcggctccggccaacaggatgtagggctattacctgatagctcagggtccgaacctgtataaaaatcctcgtccccatctcttttatctcagtctcgcgtatatcctagcaccgacgatccccatactatacaaataccagaattgcgacatcaaacgtcgacaataaccatagacacatcacacatagactagctaacgtctattgtcaatgactagttaaacgtcgccttcaatatatgcatttaccggttttgtgtacacgtttctatcttgtgttttgcaccacgaattagatttgcacaatctgatatttttctagccagttataagacgtgaatgcacgtacgtacacactacacactcgcgagtacatcttccagcgccctctcaaaaaagacagattatctcggtaattaacttagtagtaattagttaattatttcctccgtttcaggttataagacgttttgactttgattaaagttgaactactcaaagtttaactaattccgtagaaaaaaaataatatttacaacatcagcatagttttattaaatttataattgattacattttcataatatatttgttttcataacatcagcataatatttacaaaaaatagttctataaagctagttaagcttagagtaaaaagtcagagcgtctcccaaccaagtaggagtaacaaaaaaaaaatgtacggcactctttcacactttgagatatcacagaagcgggacatgtccaaagctagctatgccggcggcggagtgctcgacgccgacgccgcctccggcgagctcgcagacggcgtcgaacaacgccctcaccggccggtggtcggagatccggtagccgccgcagcgctcgtagctcgcctgcctcatccccttccctcgccacagtatcctgtcacacctgcaacatcgatcgaacactactcgtcagcttcaattcatgcatggcgtcgattggtcggagaaaatatacggacgacggactgaccatgccggcgcgcgctgctgctgtttgtcgccgccgccggcggcggcgtcgatggaccagtagaacatgtcggagttgaggtggtacttgtaggtcggggagaaggtgacgaggccctcgcgccagccgtcgaagctcccgccctcggcgagctcgaggaggagctcgtcgttctccagcagcatgctccacttccccgcccgcaccagcagccgcgcctccgcgtcgtccatggcgatccggtagttgaggtcgccgagcaacaccacccggctgcaaaaattgacaacgacgatggcgacgtgagctgcggcggcggcggcggcgcgcgtaataatggcgtcgacgggaagggcagtggcagtgccacctactcgtggtcgaggatcttcctcggcaacggcaactcctccggcgccggcgacgcggcggcggtggtgcggcggcggaaggtggtcctggagaggatgtccgccgcgtcggcgttgcggagctgcgcgtcgccgtccttgccgccggaggcgaggtggcagcagacgaagcagaagcttgtgccgtgcagcaagaaccggaccgacaccgcaccctgcaacgccgccattccacggtcaagccgagctgccctcgccgccgcgcgccattgctggctaagctaagctctacgtaccttgttgccgaggcggccgaggacgccggcgccgacgcaggaggcggcggcgtggcggacgtggcggcggagcccactcctcgcccacacggagacgaagatgcccaccatctgctcgctcaccacgcacctgaacggctgctgctgctgaccatgccgctgcgccccctcgtcgtcgtcgtcgtctcgtcttcttcttccggtagtgaacctgttcagcgcgtcgccgatgagcgagttccatttcatggcggccgagctcctcgtcgggccaagcacgttcctcgtgttcagcggcacgatctcctgcaacctgagaaagcaagcaatcgatctcacgccaagaactcgacatcgccattgccgatgtgattgcgatcaagaaaccgtcaggtttacccaagaacgtagatgtcgtaggagtcggccttggcgtccagccagtcaccgaggtccaggtcgtccggcggcgccacgccggcgacgttccacgtgccggcgaacaccctgcgtcacatcagcatcagcttcatatcaatccgccattttttctctctctcaaactcagctcaatgcaaattctgcaagaaacacacacgaacctgtacttgaccgtgtcgctctcgtgcaacgcgtcctcccgccctacgtcggcgaactcggagacgagccgccgccgccggtgcagcagctttcctggccggagaatctgaaccagaggtaggagaatttcaattcgaagctcatgtcactgatgaacaactgaacaattacagacatgaaaggcagcaaatcgatcgatgctgacctctgaaagcttcgagctaggatgcttctcgtcccccataatgcagcacctgcaagataattctcactgaacttttgaactctgaatttttcttcttcttttacagctctgaattttcgtctgaatttagtgagaaggtaaggagcaaatatgaacagcctggtgcgagatatatagcgagaggaggcagattgaagcgacaaagagaaaggcactggctgcgatgttgacaagaacacgagatactactactactacatgtcaagcatccaaccacacattcggtgagggagttgtcgagtcgcctgcatctgcaggtttataatttcactaagtgtgtgtgaccttggacctcacaaaaaaaaaaaaaccagccgcttctctttcatgaaacatgaccaaacaaagccatcgaaccagcttatggtttactcgatctccctgtcattttctcacatcattacggatttacattgtaaacggcaaagacttgaggagaagcattgtttgtgtggtggtgaagacatacgacaggagtataaatccacctacccggatttaagttctggtacacataaatatgactgcacgcatcgttagttagtgcagagatcggaagttatattttctttgtcagaaaaacaacaaaggttgtgtttagataggggtaaaaagttttggcgtgtcatattggatatactgacacacatttgaagtattaaacgtagactaataacaaaacaaattacatattccgcctataaattgcgacatgaatttattaagcctaattaatatgtgacggagctcgtggctcctcaccgggagaccgcgcaggcccccctttgccagttcggccgggggcttagggtgaaatctcaagctctcgctctccctctgtatctggaaagatcgtctgcccacaagacacacgagacacggcgatgtatacaggttcgggccgctgcgaagcgtaataccctactcctgtgtttttgtggatttgtgtatgaatgagctacaaagtgtgagccaacttcttccccgttctaagctctaaatctggaaaagaatctccctctaaatgggcaaggtcctccttttatatctcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacaatatgtcattagtaaatgtttactgtagcaccaaattaggcttaaaagattcgcctcgtaatttacacgtaatctgtataattagtttttttctatatttaatattctatgtatgtgtccaaacattcgatgtgacaggatgaaaaattttgccaggggatttaaacaggcctaaagactttagtataggcatcatcggtgtgatagtgaagatgttgatgtatgactccaccagttgggttcaaattctgatgttcagaaatatgattgtgcgtattcttagctggtgtaggtatcgaaagttatactttctttgtcaaaaaaacaacgaagactccaaaaacatacaactgttgattggccattggtgtaatcttcagcgttagataggttcagagtttgagcaggtaagctagtaaagtgggtccaagagcaatgaattccagatagttctgatagggaatgtcatactgtcatgtgcaacatgttttcgtgatttgtttggggaagtagtaaacataggccatctttaaagatctttctgagtgatggctgggtaaggatgggcaaaagattgtcagtttgtgcaacttgggcacttggctgcataatgtgtatagtttttgttatctgtttggtgtgctacctctggttgtggcaatgctaccaacaaaccatgcaactgtgcctgaattttgcctcttgtgactgtttccatatgtgcctactatttcatatcttagctagagatatctgaaggctttagcagcttctttgctggagatgacagttctgtagacatgtagatagatagattttcagatgctcaaattcttatcaatcattcaaccatctgcaactttggcactaccatgttatgcttttttttttggtcttttgagaatgctcgaaatctttgcgcaccatctcattaaagagatagatatatggaaaattgctgtacttcctcttccagataaaagcagaaccattatgcagggaatgtgcagtcaaagtggtaattggtcacattattgcttcatttcagaagcatgagaaaatcattctgattcggcgttggaagagacttttgcatcgattctgaaccacaagtagggaataacgttaggcaagcttctctgaataattcagctgtacgtcagttgcaaattttgactgccttccggcggcactacgtcaatgctttactttttgtgatgaaacttcggctgtgtttagttcgtgtgccaaattttttttaaagtatacatacacacatttaaagtattaaacgtagattagtaacaaaacaaaattacagattccgcctgtaaactacaagacgaatctattaagcctaattaatccgtcattagcaaatgtttactgtagcatcacattgtcaaatcatggcgtaattaggttcagaagattcgtctcgtgatttacatgcaaactgttcaattggttttttttatccgtatttaatgctctatgcatgtgtccaaaatatttgatgtgacggaaaagttggaagcttgaagaaaaatttttgaatctagacaaggacttcctatgattgaaatgaatcccccaattcattttgacttgacatttttttaattatgtagtttattccattcactttagtgtacttgtctccaatacatatttgatccatatcaccatatagtctacacatgtttgataattattttttctctttaaaaatacaactaaccgggagcattcttgtaacaaatttattgatggcctagagtttcttccattatctaaaaaagtctctctcccatcttgactgtagtgaactccaaatatgttaataaaattttggacagaccttcatatcactcatacaaatatcttgtatatttttttagtttctcacaactgctttaaagtgtcgggtatagcaccacaaaccatgaagagtctttccaaaagttaatgtgtttcaaaattattgtttagcaatcctctcaacaaaggagaaaaatccccaaaaggaaaatcccacttgaatctgcaaatggaacacaaaatctccaactattgtgggatatacagggacttcacatcaaaattattgaaacattttcatgattaaaaagctgtgaataaagagataagattagatatattttctatcatttccccccactaacagcacacacaagcacaaaacaacaagagctttaactgcaattattcatcagatcagcatgaatgctatgatctgtgacagcaactgtagtggcaggttaattaacttacctaaaaccagtaagagacaagcacaaggcagcaacttgttttgggagacagatagcagatggccaatagtatcatgaaaccagccaatcagaccatggattcagaattaatagcttatcacctcttaattcccttatctattctacattatctttgtgcctcaggaatggccatgttgttgatttaaaactagacactgcgcagaatgagccgcaatagattgagctgatgttttcctgcttccttgtcttatctccaagactccaagtgtgaagtgccgaaaagaaaattagattaagagaaaactgaggctagccagtagtcttagagacacgaaaaagagtattggattcaggagagaagcacgcaagattggatttcgagaataacgttactacctccgatttcataattcttaatattttatacaataacacggtctccaaaacatattttttattataaatatctattaatattcttttataaaacgagcaagaatttaaatttattaaagtatttttagactaatctatatatacatcgtattttagtgtcttcaaactaaatattttaaaagttttaattatttgaccttaaaatatcacgaattatgggtctgttcactttgatttaattttcaatcttaccaaattttggtaaagttgaaaaaaaaaatagatatatttagtttgttgacaaattttggtaactatataagaaaccctgctaaaattttagtaagtttttttaacatcaaagtgaacaggccctatgaaaaaaaaaagaggaacatgcatggtagcatgcattaattaagtggtagcttgcgcaaactggcaggtaactcttcaaaaggagtagctcgatattagtcacagatctatacgtgtattaattgggtttgacagatgatatatatccctctttaattattttattgtatgcatgcttgtgtctggctaaccgtgaagtagagaaaaagaaaattaaggaccccctactaataacttggttgtggtataaaaggagtcacgatttatgcagacagatgtgacgtcgacacctgtataatgtgttttttttcagccttttcagaaaatgcgtatcaaggatatggtgaaaaatccacagtacctaatcaatccgcaagataatgggtagaagtctgacctatatatatccacaaaatggatatgcacaatcaatctaccgactacctaactgatttgatgatagttgaattaaaagccctattttttttaggtaaacaaaatattattgtatttattctgttcattcatagacttttaaaggcaaaatgaaatatttaggttaccgtgatacttcctccgttttagatcattggttgttttggatttggtcaaaatcaaactatttcaagtttgattaagtttataaccaaatatagtaatatttacaatactaaattagtttcattaaatcaataatgaaatatatttttataatatatttgtcttgagttgaaaatattatattttttttctataaacactggtcaaacttaaagtaatttaactttaaccaaaagtcaaaacgacttaaaatctgaaatggagggagtatgtccgtgcatcccgatgatgtttttcctatggatgaaaaggggaaacacgaggagtagctaaactgttaatcatcgaaactgacttttttttaaaagaaaaaagaaaaagacattgcagaaaccgcagactatgttgaacaccgaaaaggaaggaattttttctgtactttccccttaaaaaaagaaaaagaaaagaagaaaaggaagcaaagtgaacctaactaaggacatgcatgattccagggtgaataaagaaatcagttcgaaatttcgaatgtatatcgagtacaacatgctgatgaatttgacaccggcccctgccaaggccagctgcaaaacaaaccaacaaattcattcaaaccagagcgatttgttgctcacgaagacttcaagcagaataaacgatcttgcgtgcttgcagcagcagcacgcaggctttgcgtggataacgatggcccattattaattcattgtacgattgggccggaacggtttcgacggttgtgcggcccatcttcgatacggagaggcgaatctgtgggccggacggctcctcctcctggtttggcaccggcggctggaataagttcatcttaggtcccttacttgtcaacgaatccgattttcatccatcaacaaaaaaaaaaaaagatacaatgggtccctcaactgttaaaccagtgtaaaataagtcttaagacggtttggatgacggttttagctgatgtggcgcctacgtggctaatttgactcggtcttcatctgacgtggcacatcaagcaaaatttaacaatttaaaaaataaaacaaaatacgttggtccacatgtcagtaaaataataataataataagattaaaaaataggaggacccatatattagtggaccccacttgctccacctcatccaccctcttttctgtatcctatcctctcttactctcatgcgaagcggcgggacggcggcgggccacaacaggcggagcggcggcaatccgccgccggcaccgatctccataacagaggtgtgcgtcctcctcctcttcgaacccgtcgccatcttcgtggtcttcggcgaccgcgatggtggggaagcgggtggggaaatgggagctctcccgccactgctcatggtgacgacgccatcgaggtcggaggatggcgggaacgggggcgggggccacaatggtgaggtgcgcgtcatcctcctcctcgaacctgtcgccatcgttgtcgtcgtcatctttggcggtgacaggagaggaagcaaagggagaagttggtcggctgccgcaacacctcttgccgtcgaccttgcgggggcgggagaggagacgcgagtggcggccggtgggagaggagctacgggcagcagccagcgggagagaagcggcgcacagtggccggtggccggtggccggcgggagaagagcgacgcgcgggctccggccgacgggaggggaggagccgtgggaggcagccacttatccctctcctttccctcccagatcccacgagttctattttttttctggatcgaattgccatgtaaccaccatgttactgccacgtcagatgaagactgagtcaaattagtcacgtacgtgcaacgtcatctaaaccgtcttatgacttattttgcaccattttttctattgaaggacgaaaatcagattccttcacaagttaaggggccatagatgaacttattcccggcggctgcagccgcgtgtggcgcccgctccaaggaggagatgccgggagacgtcacgtgatgtcacgcgcggtccacgagcgaatcacccatgatggcgcccacacccgataaggaggaatccgaatccatacttgcccgccctgcccttttttcttctccctcgcgccgcgcgacaaacaccgccgtatttatgtgcgcgccgcgccgcgcgggaagcagcacagcacagcacacatctcgtccagtccatccatggcgagcctgagcgtgccgccggtgccgacggacccgcggcgcgacgcgatcgacctccacagggcgttcaaggggttcggctgcgacgccacggcggtgaccgccatcctcgcccaccgcgacgcctcccagcgcgccctaatccggcgccactacgcggcggtctaccaccaggacctcctccaccgcctcgccgccgagctctcgggccaccacaagcgcgccgtcctgctctgggtgctcgacccggcgtcccgcgacgccgccgtcctccaccaggcgctcaacggcgacgtcaccgacatgagggcggccaccgaggtggtgtgctccaggacgccgtcgcagctgctcgtggtgaggcaggcctacctcgccaggttcggcggcggcggcggcggcggcctcgagcacgacgtcgccgtcagggcgtccggcgaccaccagaggctgcttctggcgtacctgcgctcgccgcggtacgaggggcccgaggtggtcgacatggcggcggcggcgcgcgacgccagggagctgtacagggccggcgagaggcggctcggcaccgacgagaggacgttcatccgcgtcttctccgagcgcagcgccgcccacatggcggccgtcgccgccgcgtaccaccacatgtacgaccgctccctcgagaaggtgatctaccgatcatgcacagcagcatatgctttggctttggttttctctctctctgaatttaatggaggacgcgtacgtgcgcacatacaccactacacacggattcatttgacgcatggcgcttcatacaagacacgtatgtgcacgcacaccactacacaaggattgagaaacgcagaggggtcttccggccagctccacaagatggtgggttggctggattcaaaacctcactcctatttatttgatattaggtcattccttaatattcgcgtttttttactacacaagaactcatatgatgcacgtcgcattacatacacagtattgatctatgagtacgtccctttaacgtaaggccagatagatatagtttagaggcaaaattctaacctcgttaaaatactattgaaaatgcacgcgcatatataatatttatggaaaccaagatttggtttgtgttttaatttctttttggaacaaaatttttgtgtgcgtttaattgtcaggctgtgaagagtgaaacttcagggaactttgggtttggcctgctgacaatcctcaggtgcgccgagagcccggccaagtacttcgccaaggtatatatataacaacccggagccccgttttctgaattatgtttaaattaaactcatcagtacacgtttctgtaaaatcaaaggaactgttaaaattcatgtgaaatgaatctcgatcatcccgaattcatttgttaggtgctccacgaggcgatgaaggggctgggcaccaacgacacgacgctgatcagggtggtgacgacgagggcggaggtggacatgcagtacatcaaggcggagtaccaccggagctacaagcgctcgctcgccgacgccgtccactccgagacctccggcaactaccgcaccttcctcctctccctcatcggccgcgaccgctaacgtcgattggtttcggtctctttgagcgtgtgttaagggacgcatttgttccatagcgcacaaacatggcaattatttatgtgcgtgtgtagtggtgtgttcgaacgttcgtttttcgtgtaataaaaaaaattgagtttgctgtcttgtgatgctgctgctgttcttgcattgcctctgctctgcattccatttcagaaacattcatgtatatacgtgtgtattatttggtcatatgtgtgtctaagtaatttgatgatgataaactgataatcggcatcttgcgtgtgatgagatttccctgtaatatatggtgcatcgatgcttgtattatttgcccctagatgctagtattgttgatggctattcaatccatgtttgcaaaaactttcaagcagtcatggagaacgaacaagtgctttgcagcacagcttattccatataccaactacggtgccaaatcatacaaactagagaggtttcagagagtgcctcacactaaaaagtaccaatatacagagagatcatccatagctgtactctgctacaatgcatgttctatacactcccaaaaactagacaagccgtaattcacatagaggcatagacaacagcacataactcgtagacgatatggcagccacatagctcacaaccgaatcacagatcgcctcagtcgataggcttctgctttgcatggcgagaagcagagtatgactggatagccgaatttgtcacgccgatcgagtgcttcgtgaggtccatgctcttccttgcagcaaaccaaatcatccaaaagaatccaagccaacctgcagcagccaggacattagtacaggtgatgcagacagcttgttaattaagaggtaataatctattgccatgtcctggcaaagaatagatccgaaaagagcagcctcatgcagagaagctgctttgtcaaaaacaatagcccccttttagggaaggaatccaatatgtgttcacatttctagatctgcagcatcacaatcttcatagattttgaagcattcaaccattcaccatcaatagctagttttgctaaagtagtattgctaaagtagtacctaattgttatgtcactttattcccgcttatcgcaatccacccgtgttcgtgtctatgtttctcttattctccagaagcaaaaaggtgcaagatagtgccgtggtgattgatgtctaccattccaaaagttaagaaggagttggcaacatattctacaccaccggtcaaaaatacattgcttttggtaaagtgttgtatgggagttgattcttaaaaccaaacatgtaaatcattgctaagtggatgtaatttgatctcatgctacatattcactctaaaatatacgattcaacgttccatggttgtgggcataactttctagtacgtcacgtgtgctaatgcgcctgagatttactaaagcagaaattattacacagccccttcactagaactagttaacagacttttcacccatggaattcactctgtacacattataaggggatctaacatgaaacataatagaggttaagatgcctccagatggcactcctagctaattagagaacactatcaagtgcattaatgacccaccaaaattacgtagcattactataaacagttcacttattggcttgagtaagttaacgtgaaaaaaaaacttcaagttgaaaaacttgcttcacaattataatttactctaacaaattaagagaaccagtggatgtaaataacatgtggttcctcttaattgctgagcaatttattacaaataatttcgttggatgccaagggaagcccataggcaaaccagtggccactatcaaactcacacatgctaaattactgtgttgacattgtgttagtacaagattgtgcccagtcagacgtgtcttcctagtaccagttcccttctttcagcaaaaaatgcctctattgttacttatcatgctctacgtcaggagcacctaatgtttatttggaaaagaataggcaaacttggactgtctagtcactcttctctcccctaaagcagcagccactggctagctgttatcttggcggtgcttacccaataacatgttagtacattacaaaatgactaagtgaactgaagacagaatgttttaaatactttttctcactggacttattgggacaggatagttaataatgacatatttatatttatagtattaataaacatgaccaaccagatatgttaaagtggtatgggcaacaaaggataactgtgttaatgttgcaaaacatgatatattggtggctattaatgtgctaacagaagatgtatgattacagattagattaactaacacacctaaaaactagtttgtaaatatggacacctctaagggattttatggttttcatgacagaaagagagagtaagtttgtaccagtagcaatcatgacgccgacaattgctgagatgactgtggcggaaatgacaaaaacagcaactgatactactccaatatacactgcaaccaagcaagcaaagaacatagccaggaatcctccagcagctgccagcgacatcaggacggaaacaacaacagcattggtggttgcaaccagcaggaagaacatgaagattagaaggccagtcaatgcaataagtgtgatcgttccaacctgccacaccaggaacagatgaaatgagggtagcttaacttaaaatacatttcacatattcttaaactaaatggcaaaagtaaaagatgatccaatcaaataaggaaatggcaaattcagcaaatgagttcatgcccacatcccacagcaatacacttctgcagttactgaacacaaaaagaaagcatgatcatcaaattatcaaccattcaatgaacacactcaagtagagccatttgaaattacattgtttatccatacaagataaatcagattgattacgctgatgcatgctagccatgtgatccaatgaatttaactgtaaatagagatcacacatccttctctggatagtgaaaacataccctatcatacctgctaaccgaccagcggcagtaatctatgacgtgttttctgtaaaatatggtacaattcatcccatccttccttattacactacagattacagaattctgtaacacattgaaacttaaatgaagaaatgtaagaacattgtggccattagagcttgataatcgaatggtcacatgctcacacggcaacaaatcaagtccctaatgacagcatgtatcagttaaaactgtatttacttaataacaaaggagacaagccacaaattaaagacatggaaatcacttcgcgcgcatctctatggggattagtcaaaggaaatgcaaaagaaggatccagaaggcgtccaagccgagaggggaaagggaagtgggggcggcgcgcggccggtgaggtggggctcgctcaccgagatgacgaggatggcgcggaggccgctgccccttctggtccactcgagcaggtcccgcgccgagttcctcgacgcctcgcgcagccgcggggcggtctcgcaggacgccgccctgatcctccgcagcagcggctcccctccgccgccgccgccgccctgcgagcagacgccgtcgacgaagctgcggagcacgccggggagcgtgtcctccacctccaccggtcggccgccgccaccggaggcctcgccgttgggggccttggcgcttgcggccgccgcgtcggattcctccatacctgggctgcagccggcggcggggactcgtcggcggcgagggaaacggatgggggataggggcgaggaggtgctggcgactactactactactcctagatttaagaggggttcggtgacacgtgtcccttctgaccgggaccactgacacgtggcttcatgtgaatctggtggacccacctgtcagtggctatgcgtcggccgaaaaccgaaagccgacgtggacggatcaggatcacacgcctcaagttatgaatgttttttttcttttttttctttgaaagaatgattcgtttgacaaattttgatggaaacacgatagctgatttggtgtgtccacgttggagacagtgtgtttgtggatgaggaatttgtcgcagttccgtgctagaatttcgattatgtttatacttatctgcacggtatctacacgatagttagtgatttgaaataaaatattttagagcaactgttgtaaaattcattatgatgaaaaaacataaaattaactttaaaattaaattttaatatttaaatggtagcttataagcataagtgaaatgatgggttgtaaatatctagattatgacattttaccacacaaaatcgtggtggcaacttccgattgtttcaaactctagcgtctctatcacgtgatactgtgatataaagcgatgagcaaacgtgtttttgcaacgtagacatgatgcttgatcgaactaccacgtactagtctacaacgtagccacgtaaaactgcatgttgtgattttcctccctttttttttgcaaaatatagcgaattatatgtgcaaattagttggaagcacaaataatattgttgtgcatgttgcatgacaattctttgttgcgcatgttgcttccctaacattcgcgtctcctttttagtagtgcgagctaaacgaaaactaaaagacagatcatatgtgggcaattaagagcattgagtgtctttaagactacctcatattagtgttgccttaggctcagttcgtttgtctaggttcccaacctctctttctcgattttcgcgtgcacgtttttcaaactactatttcggtgtgttttttacaaaatttttctatacgaaagttgttttaaaaaaaacatattgttcctttttgaaaaaaaaattagctaatacttaattaattatgtactaatggatcgctctgttttccgtgtaagaggcaagcgttccaaacctgccctctagaatgcaacctaagatgtcttcctgtgtaaattgttatatttttcgcatgtggtcgttttaattagtaatttggaatcatgccattataattttgtaaagtttaagatatgccatcgatatctcaatgacatgtaggacctacatgagtcaatgatgtgggtcaggatggcatatctcaaattttgcaaaattataatggcatggttccaattttcccttttaattaagacatttcttatgctaatttgtttacacacgcaaccatcgacccctctctctctagcaaaattaatgtagatggttttctttcagcatcacatgtcactattagaaaaaatgatttcctacaatataacacataatttttttaggcagaccttattttcgactatgattgtttgcttgtatagttgtgtgaagagaggtctattggctggccgcctgggaacataagtcccaggcttccaactccctctcctctcctctttctctctcacatctcctcagttcggcgatgagggcggtggtggtggggaggggagcaatggcggcgttccatagccgtggcacaaagtttggtggcagcagtggcgggatccgaagatagcaacgcatgggggcggcggatccgtggaaggcgacgtgtcggaacggcggatccggcgacggcaagagtgggggcggcgccggatccggcgagggtgacacgcgggggtggataatccagtgatggcgaggtgagggcgcaccctcctcgcgctgctcgtggtcgtttttctcgtcgtcatggcggagaaagctgacttccggatcggctcctcgatggcgacggtggcatcctccctgcgatgatgaccaccaccacgacatccaactgatgtttcttttttttttttgggggggggacttccaactttctgtgaaaaatatggatgtggatttgaatgtgaacttccacttctttgtagaacttccaccacggatgtgtgtttcaatgtgaatttgcatgctatgaataacaaattgcttcttttttttgcaccgaattcttttgcggacagtcctcttaatgggtccatttgtgaaaattgacttttgcaggcatacctatgatcgccttgtgaaaatgaattttggcagttgcataaattgtttttatggtggtgtgtagattacaatttacatattaatgtttgaccaacgtctgacaattcgtcttatttaaaaaaaattatgtaattatcatttagtttattgtgacttgatttatcatcaaatattttttaagcatgacataaatatttttaatatttgcataaaaattttgaataagacaaatgatcaaacgttggtcaaaagtcaatggcgtcatacgttaaaatacggatggagtatatcataacctgcagctgtgagtaggaatacaaatcagcgtgtcattgaactaagcatttttttttacttgtgtacactacaagtacattcaagcaaagtgatgagaaaaaaagaacaaacatacaatgagcatcagttgcttcggcaacagataattatctcattataatgagaaacctagacctatttcttcatctttcaaaagcttggcatgatccacacgggcgccggccagttgaaccaccgttgaggagagactatctcatcggagctatcactgcccaaactatcccgacgagcacctttagagtcgtacatattagaaactattaagtgtggcggaaggggcggccgctgagctacgccacgtcggatagctacagtgcacaggatggatttttttcgaaaaagccctccggtttatttgtaattcggtgtaggtctctcggaacagtaccgctgagacgatattttacgttgtgactcttcgaaaagcaagatattccatgcaaaggagagaaaaaccgagaatcaggactgcgctctaaaatgttgaatccgaggggttttttcgaaaaaaatacgcccactaacccacccaccaccaaaaccctagccgccgccgcccaatccctctccctctgcccgctctctccctctccctctcccacgccgtcaccgggcgccgccgcctccgcctcccccttgcgccgtccccattgccgaccgccgcgcctccgcctccccctggcgccgccgcctcggcccccgccgccgtcgccgcctccccatcgccggccatctctgcctcccgccatccccatcgtcggccgcctcccccctcgcgccatcaccgtcaccgagtgcacccgtctcttcctccgccaccgctgtcgtcgtcgccgagcgccgtcggtgccacctccgcctcgctccgccgctgctgccgtcgccgagcactgccgcagcatcgtcgtccactgccgccgccatcgccgagcgtcgccgctgcgtccttcgccgccatcaccaacggccgctgctccgccctccgttgccgctgccatagaagaaacggcagtggtgacagaaccgacatcttcggcttctccagtttccttccacctcttcccctcacctcctcgccgccttcggaagccctagcgaagcgactgacgcgagcgctgaggcggcggcagaggaggaggaggagcgagcaccatggcggaggacgactacaacgacatggatatggggttcgcctctcccccaccctccctcgctcgcttccgccgttacaatttcgcaccaacctagggtttgctggtgtcaccgatcgcgttcgggggcgtgggcggagagggggggttagaagggagcccggtatcttcgtgggtgggttgcgggaacgttgattggtaggggcgattcgtggggggagctctcctttctcaagggagggctctgcctctacctgctgggttggtggcagtacggagtttttctttaggcgaatatttcgtctattgtgagatggatgggtctttgagcttgattgacacatcgttcttctctctctttctcaaatcatgtcccattctgatgtttggctgctgatcgggtgacttcattgattcttcggtaaatcccatgcttgattgcttgtgtgcttgttaaaaggtggattttttcttagtctttaatgggattgctaaatggtgcagctgttgccaggtttgtcagcaatcaggtttcatacagaatgtaagaaactatgccgatttctgggtgaccaggtgtccaggtgtccatgaattatgtggggtttgagcattcctagccattagatggactcttgagtttagctcacccagcatccttctggaatgagaatgcacattatgatatatgtttgttgggataagatgatgatgtttcttggcttaagtataatccacatcttttgtatcaattaaggattggtcccagctattttaattaatggctcaaaaaaaatggagttgttttcaaggtgctggttgctttttagagttagctttttcaacgtatatgatgaccaatatagaactgaggaagtatagttttaagttcatgtctagcttgatgaggcattgtagatatgttgcatgaaaaatgcctatctttgcttattgttatgttctttttttttggttatgcttagcataatttattatatatagctgcagaatcattttagtattttatggatttatttatgaactaaagatgcctttccttttcttataggtacgaggatgagcccccagaacctgagattgaggtacagagctgctgctttgttatttatttctggactttactttatcaggaagagctatgtggcttatttaccttttctgaactggaaggagctgaggaagagcctgagaataacaatgaggatgctgtggatgacgtggttggggctgaagatgacagggagcaagaaaagacggctcgcccatggaaaacatcaaagtatatgacaaaatacgagcgtgcacgcatccttagtacacgtgccttgcagataaggtatgcttttataaaatgtaatctgtatatcatcaattaagttaattaatcatatcaattaagtaaaattcgagcttatctattgttatgcagcatgaatgctcctgttatggtcgagcttgaaggggggacttatccacttgaggtaaactcctgatttcagttttcatagcagtgatggaggcggctttgataaggtttccgggatggactcctgtaaatatgtgcactacacgcctgagcaggtggaggcgcttgagcgggtgtataccgattgccccaagccaacctccgcgcgcaggcaacaactgctgtgtgagtgcccgatacttgctaacattgagccgaagcagatcaaggtctggttccagaatagagggaatgataatagaattgaatctttctccgtttgttctctgtgacaaaaacttgctatggcagttttccctgttctctgtgacaaaaacacttgttatggcagttttaggtacccaggtaaccctcaaggtactcctgcactgtcacgtctgtctccccccgacactctgcctgatcccccaactgtgagaaggtcagtcaacgttcacgccgctgagtctgcatctacatcattttgtggcatgtatagaaagcgtcagatgcgtctcaggaggtagattctcaggaaaatcatgaaactgtgatgagagcaaggttatcattctttctatatagtatctgttagattgccatatttacctttgtctgatgaactcatcatcctcacctttaatatcttataaattgagttgagttggtgttagcatgttgacacgtctaatagggtgcagctatgtgttcatgaaattactatgctttgggagataactaccatccttccaatggtttcaatgcatttttatcatagaatgattcacataagaggataaatcaatgttctacagagtttagtaacaatggtttatcgaaaagtacatgatttatgtcataattgtgcagagccttaagtttcttggtggcacttaaagcctcaaatttgttagcttcattttaggttttgggctagatgatctgaacccttaactgccttcttatcagagataccatatgcatacatacatacatacatcaagaacggatagtccccatgtatcgtagcgactggatgtttcatcaatgctatttataatttttttaccacaatttaccaggaacggttagtcataaagaacataaaaatgatcatcactgtggtaacgtatgctactatgctatactaatcctcagttcctcacttatgaatcgtaggaacttactgcacaactaggtagctcactgacataaagagatatttatattattttgttttttatgatgaatacaggtagctgcacatcataatggacatggcacgagccatgagaatcacacacaagaaagtgagtcatctgttgagcaggtataatttagcttcattattataaagtactaagaattctactgctacatatcaccttaagtatatatataggtagctgcacatcataattgggtttgtatgtcagcatgatcctgaaagccaagacgacatcagcataaaagccacacctgctgatgaatcaccaccggaggagacatctgcagcacctactaaagagcaggtgacttaatagctgcttgcatctgagtcatttttgggccctttcgatagatgttttccctgttctttagaggcaatagtagagataaacttgattatattaataataggcatatttcttccagggattggacctgttccaaaaaagtattgtgcatttctctctattataactcaaatactgatatcctgcataccctctttaaatatataactttgtactgtttggtaaccttccttgtaaacattcctccaatagtccaatctaacagccctcaaatccaattggctgttgtgagttgagctacatgatggaatatgagccactcatctgcatattaatgaaggggcaatttcgttcttgcccctacttcgatgtccaatattgattttgccccagttttttaggttttcgtttttgtccctacttttttttaaactaaacagtcgtttgcccctattctgttaattcttgttaacggtgttaaatgtgggggtaaaaaggacaagtataaccttatatattttccggtacttttgtacaccacattcaaatttgacccaaattttggcaaactttcacaaatttttgacaaattaaattactgctatagtatggcatcaatagatttgtattttgattatgtcaaaagtacgggaaaatatctaagggtatacttctctttttaccctccacatttaacaccgttagcaagaattaatggaacatgggcaaacagatgattcatttcaaaaaagtaggggtaaaaacgaaaatcctaaaaaacagtggcaaaatcaatattagcaccaaagtaagggcaagaacgaaattgtcccattaatatgatagttaccgaaatctaattttgtaatgtttttacctattctttggtatgtgactgttttggtgtcccatgaaccggtactaccgtagcaaatttgccatgttacagtgtttgaaacattcaagcaaaccgtgtgtgtagtatgttgcgcgctgaaaattaagtaagtataaaaaatattagtttcatactcgtcctcaatggcatcaataaacaaaaatgacaacgaattgttagagtttgtgtcgaatatgtatacatagtcggttacagtttaggacttggagttgtaataggtattaggagtagagtaagagtcggactctatcttaggatctctcataaatagagggacgtgcctgttgtaaccgcatgacgacaatggtgacttagcatagcgagagggagcggctgccggcggcgaccggttgtgagtcgttgtaactctgatacgctgtaatatgctggatcggggaggagcgcccataatcagtgccccggagatgtaggcctcggctgaactcttttatcaaatatcgtgcctcggtgtcgtcgtcgtgtttggatctcctatggcgtttcttccgtgtttggtttccgatgtgatttcggggctggttttctaacaagtggtatcagagcctgcgggagattcatggtagaggtgcgagggaggtgctccacgccgcgacgaccgcacagggtgtctagggacggacatggacgcaaggtggagcacggcggcgatcaacggaatttgatcgatggaatcggacacttcaggcggcggtttgaaccgttcgatggctgcaatcaacagggagatgaccagacgtggtgctcggtttgatggcggtagaaacgattggcgatctaatcggtgggtcggacacttcgggcgggtggctcgaactttccggtgagctactctcaacagggagacgtgtggccacacgctcggggttgattgaagctggaggagatcggcgttctcgatcagtggaatcgaacattctgggcggggtggcctgggcctttcgatgagctgcgttcgacagggagatggctagacgtagcactcgggtcgttcggtggctgagaagacggcatgtgatttgtcggcttcggctcgcggctagattgacgggttgttaatcggaagtcggagcgggtggatccgtggtgctgatggagttgtgttgatgacgaggtggtgcatgatgctacaatggtttgtacaagcgactggactattcacagttatagggatggttagaaatcggcggtgttagtcatcgacggagttggccggaatatcttgtgggcagtgcgggagatcgtagtgtgtacgtgaggctggtggtcaggagagaccattgcgggcctggatgtagcgggagcatgcaagagattgactgtgtgtgcgggcagagatggacagcgactcggaccattgagtccttccggaactcggtctagcaccgaagctaagtcagggaccaagtctgacacaaggaggtggtggatatggattcggtttgcagtcaaaatcggatacaatgccatagtgatacgtcagcaaggaggatatccacgggattgcaagattgcaaccgtgcaaattatcaaagcaaaaagagatcggaattggatttcttggtggcgatgatttgcggcgtcaggcaggcggcaggaacacgtggctttggtgcggtcggcgtggaggtgctagcggaacttgacgcaggctgtctccggcgagaggggatggcgagcttacggctgctacatggtggttcggtcagatggcttgcacgtgaagaagctgagtagggctgcatgcaacattattttcgagatgcattgatttggccaagacaagactcatgcatacgtggagatgttggatggctgttgatcgtagctatgcttgtatacgcattcagctgatcgtgctgatcttgtggagccgcggtaatatgcaaaggggatggatgcatgtagtatattacgggagcagaaacgtgttaaagtttaaagtgacttggcggagcagccatagctaaccagaaaatcccgggcaacagcgggtgaaaatcgttgagggcgtcaacgggctgtttgacagtacaagatatatccaggatctgcggggtgtgcatgatagggatatagggaatctgcgtaaggagaagagtaaacgctatggtggtaatttcttcgggtgatttatggcaacaatgtattttctcaaattatcgcatattcagtctacggatgtgggaaagcgaggatattggatttattagctcggttcataagacgataaggaagaaaaggttcagttcttcaagtctggtgagtttgatttatctatttggtgataacatcggttatctggccatggattagatcaagtcaaacttaagatggtagatgaagttgaacatggtcttcggggagtctatgatgggatagctaggaagaaattcaatttcgcttggcaagacgactgtggtgatatgagagaaggtggagcactgttgcaggtggagtcaagagggagaagttgcagggatagcgaagtctcttgtttatggtgagcctggtggaggcttatcggggcagctcggcgtgagcggcgaaatgatcaactcaagtccgggtgcatggagattcgcgcatggtacaaattcaggttggcgtgtcatattcgccaaggtggagtttgttagagtttgtgtcgaatatgtattcgtagtcggttacagtttaggacttggagttgtaataggtattaggagtagagtaagagtcggactctatcctaggatctctcgtaaatagagggacgtgcctgttgtaaccgcatgacgacaatggcgacttagcatagcgagagggagcggctgccggcggtgaccggctgtgagtcgttgtaactctgatacgctgtaatatgctggatcggggaggagcgcccgtaatcagtgccccggagatgtaggcctcggctgaactccgttatcaaatatcgtgcctcggtgtcgtcgtcgtgtttggatctcctatggcgtttcttccgcgtttggtttccgatgtgatttcggggccggttttctaacacgaatcaatctggcattggatcttaatacaatggaatttgaaattgaaattttgcaggtttagataattttatgtgcactgcattcctgtttgtttttggaaaaagaccaaatgaaatctcctttatgatacatgcaaattaattatatgtagcaactgtagagcaaatgattttaaatctaaccagaggtgtccagattaatttggtatgtcgttatatgccccttggacatgaaagatcgtattgatcaagtctgataattttcaaatccccaccatcttctgttagtaattctcacaaaaacaataactaagtgtacaggtttatctaaatcatataggtacaagaaagtgaatatttcaatttaggtggcatggattgattaagctaaaagcagtaaagcatgcaactaattcaaacttaacattattattagggacccttattattattccactcacagtaatgtatctaagagagcaatatatttagctggattcaacgatatgttatgaacatcagcaacagaaagcgattcaacgaaatgatagataaacatattactcactgaggcatgcatgcgttcattacttgtgtaaaagctcggtcatctccagctactcaatgctaagccgttgttgctgattcatcagctatgtgtactctctcaaccgctcaaggcagtagcaaaaggagcaagcgtggaagaccagcgattgccagattggcctcactatggaccagatccggtttcttctaagaggaactttctctgcgactgtagacaggtatttttggcctttatatacatgccacaaaattatgtttactttaatcatgaactcagtgccatgtatgattagttatattgttcaaattatgctttctagaagttaagcaaggtgctttgagaatatcttccgtcgaggaaattaaacttaggtgtacatattaaatgattgaactgttaatctataagtttccgttcctatagtttgttagttgctaccatttttcttggtttcttctattcctcaaattgtctatttcctataaatttcaattctcagcagtcaccatgtgactgcataccatttctatagtaacatagccaactatttaatttcaaatcagcatctagcaaccattcttgatacctagaatttatttgcgatcattctatctgttcactatatggtgggttacttcagtatcatttcttccatttcctttcctttttcgattcttttgagaacaataaacttgattagcggcctttttttattaaagatgggcatatatctatataccgttttgtgatttatcataagaaaactaatatggcaacatctcactatcaatctgatttttccttcatacatattataggatgaaaacttcacaggaagatctcgactgttttgctattatacctagaaaaaaattacatattatagtagtagcttgacttattgattgctttgaagaaaaaaacatgaaatttttcagcagggcatcgccgcattgccaatcatctatcctgattgttaggctaatgg

SEQ ID NO: 74235 - DNA, 2723 bp, Oryza sativa
gtcaccgcccatccttgagccgccatgagcgccgccatccgcaccgttcgcgtcgaccgccctcctgcctgtccctgcataccgcccgtctcgtgccaccgcgcgccgtgcgcgcacccctgcccaccgcccatcccgcgccgtcccgcgccgccgctgccgcttgtcctgcgcgcgagagagaggatgagtgagagagacagagtgagagatgagagactatgacaggtgggtcccacatttttaaaaaaaataaaatgctgattgggctgccacgcgtacgccacatagaccaaaaccaccgcggattgggtcgagcggggtaattcgtccggtttgcataatggagggtgaagaatatccggttttgtggtttaggggggtaattcggacgaccgcaatagttcgggggggtaattcgtactttttcctttatgaaaactatgtctagtgtattgggttaggaatgaccttagacgcttcaacgtattcctccaacagccacgctgacctccacgtcgatcggctgtttgcattaattgcagcagcacgtggttccgattctcctctacgaggcggccggtggcagcttacggtgagcggaggcggtcgcagtccattgcccattggtgatgcacgggcgcgcgtcaattcgcgttatggacaggggcggataaaaaaataatagtggggctaaacaaactaggagagccttcagctcccatatcttttggatctataaaaataatttatttttaatgggggcttaaggggagtctctgtggtcccagtaacagtagtgggtctcaagaccactccgttcccacgttaaatctgccacggattatggataccttgtgcggttttctacaatttactttaaactattttctcctaactagtaatcgactcatgtgtattgatctcatgttctcatctcggtgcgtgtgtatatatacaactcttttttggtaagtgtaacatcctgaaaattcaagacaataaaaaaaatcactaaaatttcaaactttttaaaaacttttgcatcatgctggttgttatgattcctattgcttgccaaaccgtaaatgatcaccaagaaggtaaagaaaagaactacatttaagcaatagatatgatttatgagaatatatttaatcctacgaataattatgtgcaagatattaaaatcaaataaaataaaagttattattaacctattttatcaaatattaaaatatttgaataatataggtgggtgccataatacaagtacacatgaaatgatgatcattcaaatgaactgagctctctgtatatataatagaattacggaagtatttaattcgatatgtagatcgattttgcaccaagttcctaattgcatttagggattgaaatttgatatattaaacccctccatataaaataaactaacatatagataaattgagctaatgtgctattatgttaataacggtctcattagaaaaaattatagaatctttaataaaccttaaaaacaaattggtaaaataaatataaattaaaaataaaagattaggtacggatagtaataaataaaatattatcgcgaccatatttggatcaattaaatttaattgcgatagaataagaatttaccctaattaaaactcaaataaattatataaacaaaatatgagtgatatcaaattaaggagaattttagttaggataacacaaatatgggataaacttcatttatacaagatttagaaattatgaaattaaatttatatgggaaataaactaaaatcgggttaattagaaaacggcactattcattgccccctaggtgttcgatcgcgttccctagccctagcccctcctctgccgcgtgcccccgcgccccgcgcgccgcgcgccgctctgcctctcctctgtcgtcgccatcaccgcgcgtgccgccgccgcctgccgccgcgccgacgtcgccgagccaccccgagcccgcgccgacatcaccacccctaggccgcgcgtgctgccgagccgtcgccgtcatcgcctcgcgccccgtgccgcgccgctcccccgagccccgtgccgccgctgctaccgcgccgcgccgcccgttccatcgcctcgccgcctgtcgccatcgccatctcatcgccgctgccgcgccgtcaccatcgcatccctcctcgtgccgcgcgccaccgctgccgccccgtcaccacccgtcccgtcgccgcgcgcgtcccctcgtcgctccgagccgcgcgccgccgctgccaagccgtccccatcgccatcccgctgccgcaccgctcgcccgtcgcgtcgccgtcgtcgccacaccgagccccgtgccgagccgcgccgagccccgcgccgcgccgcccgctcgtcgccatcaccggccgccgcgcgcccgtcccgttgccacgccatccgacgcatagccgtcaccgcgcatcgccgtcccgcgtcgcgtcgcccgcccattccatcgccgcgcgactgtcccgtcgccacgccgcgcgcctatcgtatcgccgctgtcgccccgtcccgtcgccttgcgccccgcgcgccgtctcgcgccccgctcgccatcgcgtcgccgcctcgcgccccgcgccgctgccgcatcgcgtcatcatcgcgtcgccatcgccgtcacaccgagccgcgcgccgccccaagccccgccgcttctcccctctctacaaata

SEQ ID NO: 74236 - DNA, 2085 bp, Oryza sativa
aaggcggctcttctcctcatcttccgtcgccccgctgagcgccgagcccattctgcaggccttggccgccgcaaacaccgcggtgctagatgggttcagcgcccaagtggaggccctgcgcgcggaacgagcggagctcgaggccgcatgggcacgcgttgaggaggggcggcgctcggtggacgccatggtggaggtgggccgtaaagctcaccgccgtcacgtctcggagcttgaagcccggaaggcggcgctgacggagatcgctcgtgaggtggaggaggagcgagcggccgccctcatcgctaccaccacgatgattgaggcgcaagacgccctccgccttcaaaacgccagccgggaggcggagctgaaagaaaagctcgacgccgcccagggagtccttgactccgccgctgcccgagagcggcgggtaacagagactgaggcggcgtcccggcggcgcgaggagtcccttgaggcccgtgctatggcgctggaagaacacgccggcgccgtggagaaaggcttgacggaccgcgaggccgccgctgctctccgggaggcgacgctggcggcgcacgaggccgcctgcgccgaggaggagtgcgcgctccgcctccgcgaggacgcactcgctgagcgggagcgagctctcgaggaggctgaggccacgaccaaacggctggcggacagcctgtcccttcgcgaggcggcgcaagaggagcaggcgcgccgcaatcttgaatgcgtccgcgccgagagagccgcactggagcagcgggctgctgacctcgaggcgcgggaaaaggagctggacgcgagggcgcatatcggtggggcggccgcgggcgaaagcgacttagccgcccgcctcgcagctgccgaacacaccgtcgccgatatgcagcgagcgctggactcctccaccggggaggccgaggcccttcgcttggcgggcgagattgggcccgacatgctttgggatgcggtctcccgcctgaagcgcgccggtcggcaagcgggtctctggaaaggccagacgacggtgccccccaccaatctggaaggcctcgctccgcacctcaacaggatggcctgggttctcgaacaactccccgaggagcttgagaagaccatcaagtcatcctcgagggacctcgcgcggggagcggtcgaactcgtgctggcgagttaccaggcccgggaccccaacttctctccatggatggcgctggaggagttccctcccgggaccgaggacgacgcgcgcgcacgggtcggggttgctgccgaccacatcgtcaacggcttcgagggctcggcccctcggctcgcgttcgcccccgactccgacgagggggggaacgccagcagtgcaagcgacggtggcaacgaggccggcgacctgggcgcgtcagaatgagcccccaggcccccgccaatcttaacttttttctttttctttcttctaaggccttcatgcctcttttttgtacaaattaacttaatctgcaatcagaaatgatgaaaaaaatttttgtgttagttttattttgctatacatacgagatgaggatgatctgtgccgtggtccttttgcgtcttagcttgaaataagggttcgtgcccttggatggctcgggtcggggctagtgcctggggagatccacatgtcgagactggccaggccgggaacgtggtgaccgaggggtatgggtgacccgattgtaggtttttgccgattcccccccggagttcaccacgccccggggcacggctcggttctgggccccgtttggcgattttagctgaccgaaccgaacccccgagggcaaggtcaagcatgagtgaccttatttcaagtcaagattcttcaaaaggaaaaaacggcacagacacaacctttagaaaattgaaactgcttctattgaaatgctgaaataaaggaaaaaggaatatatgcgcatgtgtggtagcccccggccaatcctgcacacccgaggggggtgcggggttggcccgagccaaaacctgacacccgacccccccccttcaggggtagaagcgacgaaggtgttcgat

SEQ ID NO: 74237 - DNA, 5402 bp, Oryza sativa
ccccccctctctgtccattctcccccaccccatatcacctttcctcccctctcccctttccattgagccgccgcctccacgtcgccgcgccgccaccttcgaagccgccgcgccgtcgccccggagccgccgcgccgtgcgtcgccgccttgcgccgccgtcgccatcgtcaccaccaccgccgccgccggtgagccgtcttccccccccccccttcacctcgcggccaacgccgtcaccgcccggggaggcaaagagccgagagagaaagagagaaaccgagggagggaaaggagaggaagggagaaagaagccgggagggaggagagaaagaaaagaaaagggaaaggggagaaaagaaagaaaagaaaagaaaagaaagaaaagaaaagaaaagaggaaaagaaaagagaggagaggaaaaaggaaagaaaagaaaagagaagaaaagaaaagagagagagagagggaaaagaaaagggaaaaatttagggggaaatttaaaatatttgcaaatattagaaattaattataggattaatgaaaatataattagatgaaatcttactaattaaatacctagaatactagcatttaattataggatcaattatttaagaactaaacaattagatgaattcttatagactattatagattattttgggtaatctctataagtaattgagtcacgatggaaattcggatttaatttctaggaatcttagccgtgtattatatttaatcgtttagtcatagactaaattaaattgtataatatttctaggatttcgtccaatatttagctcataatagaaatttctaacctattatatacaatgctcggggagagtaaattattgacaacgaaataattatacccgcaaaatagtataaatcgaaattgggtttgccgtagttcgcagatagtaaagttaataaaaaggaatcgactttcgcattcgacttattagttatttaaatagagttagccttataattattaggtaagtagaatatagatacacatagatcggtcctaagctttttatggcaaataataacagagctagtgtgattaaatcatctatatgaaattaatcaacgacatatcccatataatagcatatggtaggagaggtgagcaacccttagttaaccaagcagtaaatagaaactattcaaataaatgattcaatatattaagatattgtgcacacatatattgtacatcccattatagatatatggtatcgtattaatttgcttgttgcatatattaatttagagggagtatatgacaaacatgaatattagataaatactagttatacatcttgtcctcgtataattacagatcaactgtaaatttggattattcattgtaaaattatgtgatgggataatccgtaaccataatatgattgacctaaacgattctaacatacaaagcatgggtaattgctaaccttttataatttattttgacaagtgaaatatgtacataattaaaataaagcctccatcaataaaataaataatacaaatgattcactgtaattgtttgattgatcctaaatccatctagcaacagaacctctagtatataaccgttctatttagatagatacatacatagccaaaatccttccatagccatttgatagactaaaccactgattagccaaatatatacgtatcccataaatgctatgttggttaactcctaaataggccacgatgacaatagaaagattaggaaactttagccttagcatgattgggatccattagcaaacacgaatagtgcattttgttgcgcatatttgattgttgtttgaatattggtttttctcgcgtattatagaccttgtgtatcggttagtcgtgaggcaacgtctgcaacttccaggaggtgaaggttgatcaagattatatcaataataaggattatcctgagcaaggcaagtcatcactattctttgaacatgttgatcctaattgcgaaattgttttgtttacaaataaaattgcatgcaatgatgaacgtcctacttgtgattatgccatgccttgattattgtttacccttaaaatccttgtacccatgattacgtatgagtccctagtcaattatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaacggttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgagacatgtgcgctacgatgggacagccgttgaggtagggccaagaggcgtgccctacatcggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgatgaattttatgctgatggagccacttcccgagaggagggaaggtggacatcctcagaaaaccatgacgaatcaatggcgggaagctatccttgggatcacaatggatggtggacagaaccgtcgttgtttaaagtgaacactggtactaaaatttgatcagtctatgctaggttttaggcttgtgaaaagaattgtaaaattagctttatgcaaaagaacctgaagccattccttgaaataccctctatcatatgcattgttattgtggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcttgtggcatgttaaccgggcccttatattattttgtcttccgctgttgttctctgatagttgttggcctacctggccctaatgtaagtatttaactcttttagcctaaattcattcgtgatatgttgtgatccaactatgtatgtgtgtaccaactactgatccagggattggtacggataaacacagaagatttccgatttccaaaatcgggggtctacagtaagagttgacacaaatttgtaagagactgttttaacaatgaccttgttatttctaacacaaagtcggcgtgggggcagtttgtcaagtcaagaaaaaaaaatatatcatggaccccatgctggcgtatccaccctagctggcttacacacatgtataaacaaattgtccattaactagtgttagatgaacatgacatatatgtatgttaagacttgaacaagtccacaagagcacagtcaaggaaaatatatgattacaagttaatttcctgtatgataaaatgttgccgctgttaccggtcgcacttaattagttatatactactacgtatgtgcttatatatattggatacgcgggggagtttcaaatcactcaaatccacctctgatctctcgcttggtccgcatttgtgtgtaagtgagtagatagagagagagagagaatgggtgtctcaggtgttcttgaatggtggcaggagtggcagctgcgcaccctggtccttagcagcacagccattcaactgctccattacctctttgctaacaggcgtaagcatgccacttcttcccagttcagaaccataatatggctttcttaccttggcagtgacgctatagctatatatgctctcgctaccctattcaaccgtcacaagaaccaagattccacatctagctccaccgcacaaggcagtagaatcctcgaggtggtatgggctcccatcctcctaatccaccttggtgggcaggattctataaccgcatacaacatcgaagacaacgaactctggaagaggaatgtcgtcaccatggtgtcccaggtaaccgtgtctatctatgtcttttgtaagtcatggccaggcggcgacaagagattgttgcaggcagctattctcctgtttgttcccggagtcctgaaatgcattgagaagccttgggctctcaggagtgctagcattaacagcctagttagctccgatgaccttgttccaaggacaggaaagggcaatgaacaagggggtagtatttctcttgagtcctacgtggaagaagtaaggaaatttgtcataggaaacgtgatccttttgaagttaatgttaatgcaagcgactgttggagacaaccatgagccctataagctattcgtagatctctcacttccatactctatacggcttcttgacctgaaatcatggtggaaaatgacgcaattaatttgacgcatatatccagttgacaaaaaagctcaccgaaacgttttatcgtctctacactaaatcaaagatgctcgacaaacaacaaaatagatacttacttacaggctttctacgggtagtatctgtttacctaccgtttgcagcaattggcttatttcacaatagtcatagacaagcttataacagatatgacataaaggttacatatacaatcttgtgttgtactgcttttgtcgaggcatttgccgcacatggttggaacactcctatgatggataatgttctgccatggttttacaaggtttcccagtgtaggttaataggttcctatgctggtggtagcaccaagtcatgtgactcagttgtcgacattatagaactggtactgcaacatttaaaatctgggtggaaggattgcataacagattttccctcttatagggcgtttagtgatcataggggtcaatgggcgcttcggcgcaacaactgtgaccaagaagacctggcttggagtcttagagtaccatttgatgaaagtgtccttctctggcacctcgccacagatttctgctt

SEQ ID NO: 74238 - DNA, 712 bp, Oryza sativa
cacattaaaagaaaactaaattctattttaccacctaagttgtttcttatcagtttaatattccctccattttagaacataaggtgttttggttttatcctgtattaaactttctgtaagtttaacccagcttataggaaaatatagaaacaaattgttaacgccaaaatttggtaagccccgaggtcatcatcggcctaggaaccgtatcggcttcagagttctagaatcggctaatgggaaatgtcactcgccagcggtcagattcttagtggattcggggcatggcaattacaggaagattatcgagaacagaccaagtttaaagagtatgcggcatggcaatttttgtattaactagatagagtcagttagttccttttatttttaggaaatattgtttagagtctgatcaggacttgtatattttactttatctttaggaaagtttgtgtctttttccagcaaggactaatatctacccatgtgtataaatatgtacatcccgtatccttgtaatatatctctcgatcaatacaattatggcgcatcccaccctttttatttccttctttctcaacgagttcttgtttcaagttaggtttcattggcgtcgatctccgatgaagggtaaggcttgttaaggatgtttgatcggcagggctagggcctcgatactataatcttgtcgatgtaaagggtaccgagctcg

SEQ ID NO: 74239 - DNA, 8038 bp, Oryza sativa
actgaaagctagcttaggagcctagaggagtggtacccatacgagcgtggtaccaccaataaatctgtggtcagatatataatattaggcaaaatctaatccgcgtgcgctctccgttttgccttatcgcgcaacacgctcatcggccgtccgattccacaagtgctggtgcgtccgtacatagcctggtgattcacggacgtggcatcatctagagggatccaaattggaagccatgtgatgctctacactacgccggcttcaaaaataattttctcttaaactaatcatccgatctacgatccgattacaccgttgtgttcgtaagaattgaatctttataacaagatctcacatgattatattttgatgaaaaaatagaaattatttttataatatatctaaattacttttagatttcactaaattacttctcagacacataaaagtatattcaataaagcctaaaagtaatttacatatattatagaagtaacttagaaaaaaagaaagtaactttatcatgacattaaaagtaaatcagttacggaggtaaaaacatgagtctatgtagaaactaaatttaatcagcataaattacatcattgactaaaaatgattatataataaacaactcataacacgaatgtatagatttctttcgatgtcttgacaagttacttcacttttgttacttctataatataggtaaattactttcaggttttattaaattacttttatgactaagaagtgatttaatgaaatctaaaactaatttagatatattataaaagtaatttctatttttttcatataaatatagtgatgtgagatcttgttataaagatttaattattacgaacacaatggtgtaatcggatcgtaaatcggatgggtaatctaagaaaaaattccataaaaagaaaaaaagtgcatgcactcttgagtatactagtaacaactacatatgagactgaggtagctggttattaccatacatagaacggtgtcgttgtattaataccacttgaatctgaccccatgatatagatgcatgcgtgtagagaaacagaagtttctagaacgttgacagcggatggattctttatacggtagctagctatatatacaatatatatccaataatgctccagtataaaaccatatgcacctctagtcatctactagctaactaaactagtagtgtggtacacagaccaagcaggagataggccacaacatggtggtccaacccaggtccagcctctgtctgtcctgctcgctacagcagatcatgccggctggttgataggcacatacaactacaaagctagcctgcgacgataatatctccccggccatgcatggacgcgtggctcgggacctcctccagtttcaatatttttttaacacactctgaaaaaacgtattttacaaatagactctcagggatgccgaggtgggatatctcagcaccatatggtgctgacgtttttattacggcgccaatcaatttggtgctagtctaccatctaggttttgtccaaatcctactgatttgatgctaatttattgggataaaacttacaaattcgatgtatcataattcattaccgcttatttatttttagttaccaaatcttaatatgggggaggatgtatgtccctccctcattatacctaaatcctgtttttttaaatgaatacctaaatcctgttggttagctttggggaaaaaattacaaataatgagtcacaatccaattttgcctcttttcaaaatttaatagcaaatcaagagaatttaggtattgggaggagtgaatgatcgacattcttctctcagattaagctttcactaaaaaagttatcagaatgaactaggatacatcgatttgttaggttttttcttttccaaaaattgatggcaactcaatactcggcctatcgtcaataccaaaacaacctcggcgttcaacatatttagtcttaaggcatcccatcttggtgccaatatccgtagcaccaaggtggttccataccatatctataattagttttctggggacctatatgtaaaacatatattttagaagggctaaaatataaaaaatccaggagtggctggccataagaccgtactgcatgcagttgtgtgctgctgagccattcggtccctccatccatccatccatgtgagttcagctgggcctactgcactgcagtcctcaacggtgcatgccccagttgcccacggcccacacaggtttttcttcagctttaattaacccaccgctgagtattcagcaagagagcgtactggatggtccagttctcggttacgtgaccagtcgtcgactgtatggcgagctactttcatatatgcgaatgtaatctcttatgtgagtgtgtggcgggctacattcgtatctaggaatctaatctcttacctgtgatatctacccgtataaacatcttcgcaagactcgtatctgcgaatctaatctcttacatgtgatttctacccctataagcatcttcgcgagactgagccaatatatcttgagattaataaagtcaccatgggtgtctcgatgtcaatgggtacatcgtctactactgaaagaataatttgccataaatgcgagtacccgtatcaagtctagaacttgaacccggatggattggttccaccacaaaaaaatctaactagttgagttacgcccacttcgcttatgtgtgattttagatgtgtatatattgcgtgatgattcatggtgatcaacttaattaattatttaaaaatcaaatatataatatttatgtgtatatatatagggtgcatttggtttagcatagcttacttaggttagacaagagggtgcatctgatttaaccaataaattagtgacatattttgttgagtccggtgaatcacattgacagggccacctaagcggtgcgtacgttagtaatagatctggcctgtggaggatgaagtcatcacaacaataatgtcgtatccctctgtcgaccccattcattattgctgcatggtttcatttgcaaaattatttctcttagttcaactatacacttacttgcagaagggatgcttttgttctatattatctttaattttaatccaggtgatgtaccggggattttatgtctcctgaacttttcttttcaataagttgctttgttatataaaaaaaaaacctaggctatatcgcatgagaagatctattgtttagggagagcatggacctatgagaaaacaagaatggagcttcgatgctagcttgtaattggagacccaataccattagatccatcgttagatcatctcgtcgccttgttggtatcctatcttactataatattgatgtccactaacttttaaagcttaaaatacaagtgtgtgccacatcgtcacttactatcaattattatttagagtctttaaaatcatatgcaagtgtgccacatcattacttactagcaattattatctagagtattttaaatcatatgtaagtgcaccacatcatcacccactagtaattattatctagactatttcaaatatcatgcaaatatgacatatcatttataattttgttatatttttataactcaatatgcaagcattgtcaaatcattaattatcttcacatcatttttatattatttaaatatatatctaccatttctataatatatagcatgtattcatccacttattctgtagcaaagtgcggggtacgaactaattaccataatttgtaagataggcacagtttagtcacctacccctccgtccaaaaagaatcaatctataaggggatatgggacaggggagtatgttataaagcaaccagtcacttcattatataatttgttttggttatgtgaatcccatggaacatatcaattcacgtgggttgcctgtaaagttggagtcattatggggacgtagctagagtgttggagccatcacacgggaatcaattctttgattgcgcctattccaatggcaattggcaactaagggaatattgttcttgtaagcgcctccactctgtattatgagccacaatatgatcccactgtcaaattgcccgcgctcatcggggcacacagttgttttaatttatttgatcggttaagtcttgtacatgcgttatgccacgattagctcgagcaatttgacagtgggatcaatttgagctagctaatatgttaaaaaacgtactattgcattattgttgactactccctccatcccatttcgagtgaagccataattttctgtgctcaactttaatcgtccattttatttaaaattttttttataaattaaaaaacataagtcaagcataaactactattcatgttctatcattttataacaacgaaaatactaattataaaaattttcaaataagacgaacgatcaaaattagacacggaaacttatatggttacatttaaaaaaggacggagggagtattttctgaatcgcgtgtgatcttgtttacgacaaaagaaatcggtgtgagacttacattttggaaaaaattgggacatggcacatgttggacaagatttccatcgcgaaataagatgagttacttgtttgagcaatttgttttaagataatgcaaatgttttatacacctctaacttctatcatattacacacagccataagctaaaaaaaacaaaatgagatctaaggtgatatatatctcattgagtagcatgggataaatccccgactccctcttactattgagtaacattaaaacaaataatttttttagccagcatattctcattgaacaccacccgtaatgaaaaaaaaatcccatctttgagcaatttatgatatgtgatcaaattttgtctaaatacatacggacatggcatggtgaggcaaattctcattggaccgacttgtgacaaattaaatttttgcaacatagaagagggaagcacatcgttttgtaggggataagcacgagagattgttgtcgtggacagctaaaagtttagagcatgaatatatgcaacatacacacacatagacatagacatatggatatggtgggtagcctagacctgcattatcacatctatcttgatcggcaggcccatgacttttgatgacaaaggttggtggtatctcccattctagttgttccaatttttatacataattggacgcactcggagagcgaatatcttataacgtacggtcgctattgtgcttaaaatatcacttatctgatcaaagcagtcgccctcaaactgctgggattgcagaaaaagatactggtataacaggaacgttttctgctgatatatttaatatatggagaggcattctaaaaaaaggcaaaaattcagcgctcaacagtaaaactaaaaggtaccacttataaggtatttaaatactggcacagttaattaggtagtaaggataaaaagataattttctaggggatagagaaggatataattgtgttaagtattagttctatatgtacatatgtaccgcatcggtacgagtagttatcatctgcaggacgatatttgcgtgctcttttgagatttacattttttttcttaagaacaaattcgcctagtaatcatccatttcattatttacatgttttgtacaattcactaattaacacaattttacatatcttagggaattaaatgacttattttataatgtcatgcatatacttagattttaatattcacctgagaataaccatctccctgatttactttacttcttataaaatggaaaccacctccacattgcaagtccatttattgggcatatatgtgcatgcattttagaaggcaggcaattgccgcaacgtacacaccacatgccaaattgttagtgatatgccttagaggcaatcatagagatgattgtatcatacactatgtttacatatttatccgacattgttctttgaaatagataactccttattggttaatgaatatgtgattcttttatgagactctttatgttgtttgttactatttctaaaggatccctgatcaaatatcatatgtggaacaaatatgtttatatgatcagcacatgtattaattgatgatcatgtcttatggattatggtatagacataccaaattaataatgtggacacatgttggtgaacatgttattggatagacccaacatgagacactgtaagagccatatgtgttgtgtcatcagtgatctcttttagtgttggtgttgaatccttagacctaagattatcatggttctcaacatgtgtagtagcttacttagggattgctaaacgctactccgtaattgggtagttataaaagtagttttcgggtatgctatgaaacatgcagtgggatatgaataatcaagatgggatttgcccctcctatggagagatatctctgggcccctcgatgttgtagattatggaagtgcatggccatgccaaaggtgaatgaggagtcaatcacaagttatataatctattaacaggttcgagtgaataattaagctattagaggatgtcacatatctagccttgagcttaatcgatatcgtgaggcaaaggggttcatacaagtatacactacaggttcagtcgatatgatcattatgtatgtccggtgggttaatacgttctgctaggggccgctgttgacgtgtggaccgaaaaggagttttcgggttacagccgaatatacatgaacctacagggtcgcacgcttaatgggccggaataaggcgattggatggagatccaatataagcttaattcggatagggatccgaataggagtcctacgggccttggaggcccgagtgatggatcctatatattcgtgaggggtgcgaccggcggagatattgcatcacgtgagaaaccctagccgtcacttccctccccacgcaaaaccctagccgcgcgcgggtgctagcatatctgcgcgtggcgttctgtccctgtacgtgtagataccggtagaggcgccgctggtttgcggtgctgattagcgtgggagtacggcgaggagaacgcgtgaggaggagaaggtcgagccggtgcgatcgactacttcctctacatcgacgcgcgctacttcgcgagagttccttcgacttctcagtgtcttcttccgctgcgcagcgcgtcgagtggtaacgatctatgatctaatacttgcatggttcctggtttacgcgatagaaaattttgatatatgctatcgtagcctacgcgtatcccaatagtggtatcagagccaccttttatagtttatgatctagatcattgcatatagttgatatgcggatgtagtagatgagatctattatgttgtatatgagttcttaggtgatcggaacatgcgatgaaccgatagccgcatgggttgatgagatcaatcggtatgtgtgttggtgacttcactggaatgtctagtactcaccaaggccaagggcgattgtgttcatcggatagtccgatgtccacaagaaccgcacgccaatgagaaaaacgagccattgagattgactcggtttcggcataatttgattacgccgttaaggttttcacatggcgaatcgtatgtcgcgaccgggaaaattgccttttcccgaacgctagtgtattaatccccgtcccaggaaaagccggggtacaccatacaaacatgatataaaagacacatctttattacatcgataatatttacattattacaaaggcacttaaggcctgacaatcaaaaataaacagcagcggactagcgggcctacggctccatcttcacaggcgctcaactggggtataagccaggactccacctaagacatcttctccaacgcttctcttactgaagaggggaaagattgagcaagaatgagtacaacaacagtactcagcaagccacaccggagatgcataattaatgcaagggagtacaaggggataataatataggg

SEQ ID NO: 74240 - DNA, 39486 bp, Oryza sativa
  unsure (1)..(39486): unsure at all n locations
gccggccgttttatggtgatggcggcgacggtggaggagaaggaggagcgttggcccttggcctcctcctgacgccgccgctggcccccgtcgcacgctgccgaacgccgccgccgccggccgttcttgctgtccccgcgcgccaccggccgaagggggaagaaggggagagaaagagagagaagggagtgagggaggagggactgacatgtgggccctacatgtcagtgggcccacatttatttttgggggaatgactaatgggtcccacgcatattttttatttctaccgccacgtaggtgccacgtcaacgtcacgtgtaacgaagacttgttcaatattgccatgtaggcgccacgtggcgccacgtcagcaaaaccgcctcccaaaaccgccagggagtcgaattgcatcagttttaggagtttgggggtcgagatatccggttttgtagtttagggtcatcgattagatttcgatcaaatttgagggtcatgaagtgaacttattccgaataacacctcggagaattctagccatatgggcctgagattatggacagaaacactatggctagtctcagcccaaagaatagtttgcttatatgttgggcccataatgaccggttaacatgtccgtttctcgatctcagtttcgactgcaaacctcagtaatgtggtagttgcagtattggcttcaattcaaaaattcaaacaagcccatagtacctagataacagcaacactgatggcgctaaaggaacatgttaatatcgtagtgcatcaccagtaatttgactaatttccattcatggggagctgaatttgaagcattatttgtttctttgcacatcaggtactacagcatcggtatcacagcatcatatgtaagttttcattcctagctgttacagatgccagaaagacactgaacagctgaatgtggtagacgccagacataccacgtcttacgtttaagttaaacactgcagagctcaaccccacaagtgtaggcattggctctagttatttaccaaggcaacagtttggctcgaggacaggattggcaacgctccaaatagacagggtgcagctactcgttactgttcttccttgttcttgtcttcgatgggatcaccattctggatcaaatcctcaggaggcaaattcatacactctacaggacaataaacaatgccatcatacaacataagaaaatgaaatgcacgtacacggagttgagatgcattcatgtacagacaagaagtaccatcattgtcagcagatgcatagggagtccgccgagcacgtgcatgttgttgagtaggctgaaagtggattgggacacagtaaaacaccgaaggaaagaaatgaatatagtagcatgacatagaatgcaatatgacttctcatatacttgttcagagtgataaaagaaatgttgtcagtcttgatagcaaaacatgtaggggagagcatatcagaagcaacatgctaaaagcaaatgatctgggtattcactttcagccaggagcgggaaccaaacttttttcaagactagggctgaattagtgtaatttgccttttttttcttctaatttttaaattttgaagtgttatctcaatgggtgtttaggttaaggactcaggagtagggcactagccccacctgccctactcctaattccgcccctaaattcagccataatcttccagcgaaacaaaaacatggcaaaaaaaaaaaaattgtgcatcttgtgtgctgaaatgtcagtacctgaagttttggtcgaagtgcttcaagaggccctttaggtttgtggcttccaccttgctgcggcaagcaaaaggaaaaacatggtaagaattgaattcttcttcgaaaattattgaatattaatgcagcactcaattcaacttcataatgactttagtattaccttgcctagagcccaatcagcagaatcaaagtaagcccgatcatgatcctgatagattattccagtttaagtattacataagctcagtaagaaatgcaacttaaccatacatctgtttcacctttatacaataatcatcattttaacagagaaaaacaaatatactaaaataaagaaggcattgaccttagttatatgtggcgtcctcttgggcagtattccaccatattttttcttgatggctgcttcctgaacatattcgcatataaatattagtaatctaattaatagatattcatactatttatggaataaatgccacatgaataagtacacacagtaacatgaaaaatggtgtagcaaaagatccttttcactttgcctgactccatttttcaccctgaacttgtaatcgggtattttccaccctaaatttctcaaactgttcactctattcccttgaatcatttccacccagttttggtacacagtggacagcccatgttggatttaaccttgctgatgtgtctgttgattgtggacaacaccagaaggcttgcacctctatataaggtgttgcatcatttccaaccgatttttggtctcacaacatggcttataatggttagaggccttccagcgtcatccaaaagccaacagccacatcagcaaaggtcaaagccaacgtggccttgactactatgtactgaagcaaggaggaaacgtcacaagggggtaaagtgaacaatttgagaagttcaggatgaaaataaacggtttacgaatttacggtgaaaaatagaatctggataaagttcaagggtcaagaatggacttatatgaagatagtacctcttcttgtggtgagggcattccacttgcttcgctctgctcttgagttttttcttcctttttgtcagaaacatctccttcgagcctcacttgaccagttgcctcatcagatggcattccagacatagtgaacttaagctgcagagaagacttcaatttcagtgtccacgctcatggtgcaaagaatcatttaatagcacacagtatgcgctaaccatctaacatacacaaaaaaggaagataatgtatttgatggcccatgagggtggtaaaagtttctcagaaaaagaaacagaataaaaggcagatgtttattgttcccttcctttatgcaatagaagaaagcagaagtacataaaataaataaggagactaataccagcttcttatttctaggggaggagggatatgtccaacacaagaacttctcaactgtaccaaaatttatgccgactcactgtttgtcactgtaagcttgttaagcattcaatcagaggaaaagaggaaacaggggatgcatacattgcatgtttattttcagctcaagaagagttcatattattctgattagtctatgataaaaacaataccgttcccattattaataccgaatttccaaacaagtacacgcctttataaagcacaatgatcttgcaaaataccatgtatgagcacaattgaatgaggatggaggacagacatgcttggcacagattgcagttcaaccttcaaatatttccaacaactagattcgatactagtctatttgggcctttttcttgacaaaaggcacaagcatttaaaaatatatatataatctaggctgtacaaatctaaataacagtctagagaatatatatgttttcatacagctgctatcctatgtctgcaggaatttcaactgcacatgacaaatgatgcaagcaatgcatatttagtcaaaagtggcttgaaaagatgcactcacctagacctcaattcagaacatgacatgagcaaagaagcactaaccacatcagtattcagtcaatttctctaccaaaaaggcatcaacctttgttttaaatttgtttgttgtcaagtgcaatacaacttgaatgggtcagcagatgaatttattgtcaagtgcaatacatcaagaactggtcagcaaacggactcatatataggtcatcagccattcagcccagttttgttctagaattactgacagcgtgcaaaactgatggtgtcatgactgcaatcatggaaatgtcagctagtcaggtaaggaaaaaaacagctgaccttcctaacttcatttctgattttaattacgtcagtgttagcagtccaagatccatctaatagttcaaattaatcattccatgccttgcttcaccattatcactgcattgatagtgaacaattgatatggttccactttttttttcttaaaaaaaataaagaaaagaaatgttgtcccacttcagacatgccattggttgtaaagggaattgcaatccgaagtgttctcccagatcagatcaggagaggacctaacaaggggcatgggattcagttgaacacccgcaaaattctagaattttttttttgatgaaatataagcacactaccaaaacagcaaatgaatcagcaggaaacagcaggaaactgcacagattggggattccattcattggttggttacatttcccagacaaaggatttgtgtaagaaaacaaaagtttaacagtatgataaaatctcggaacaagcaaagcagtgtaggctaaggataagggtacgtcaccggcgaggtagatcaacccagagccccggatggatccgcgggaacggggagcagcacgacgatggcggcggagctttcccccttgggtgggaaggagggaggggtttgccgcagagagagctcgatcgagggtagcgtgagatcgacgtggggaaggagaggaggaggaggtggaggaggaatcgaggggaaggcgatggggatgggcgaaaactttgctttggatcgggagggacacgtgtctgatgttaggcggcgtacgcggaatttcttcgttgggaatggggcagagtgaagagacctgttgccgtctctaccacggattaagacaccatgtatttgtcactcacgccgtgtgtgacaggtgtgctcatgattagcggacttttgatgcgtttggttcactcgcccagctagcctagctcggcagtgctaaaccatctctttgccagcttgctagtcttgtcgtggcttttttttttggatggttttacttcatgtggcaaggattaatggttatctgctacatatgagttcacctcttgttgctaagttttttctgtaaatcgatttttttcttttaggtccagactgattgttcactgtgtttatgggtttggtagagagggcaattttcgataaagcttgagcgagagttcgcaacaagaactggaagaaaaggccggcaagattgggtgagtcgttgaaaaatatcactgattttacgtcgctgatttcagagaagtgtgtgtcgccctcgttccaatattttcgcgtgagcaaagtttgccgtcgaaggagatcgctaaatgggctctccctgctagctagatttttcttgccccgctaagccagctcgccccaaaaagctaaattattttactggcacgtagctttgcttgggttagagttgttttgtggcctatctactcttgaactaagttggcgctatggaactaactgttttaagcagttttgataggccaaatatacgtgtagattttgactgaaattacatctaccaatgggtctagggaatttggccaatacattcgggctaatgggaaatatatgaaggaggtttttttaacagttgagcctgataatcgtcggggtccttttttttagtttctataaatcatgtcaactgatgtgacccttctgcttcatagcttacccatcgtatttcctctaatcgtcattgagatactaagaatcaaacctaattttcattgagaggttttatttatagtttttaaatgttccattaaccgccatcacgctgctcttttatagcatttgccaccactgtattctagatgaactgcttttagtactccttatttttattttagtttttatttctagattgtattggtactcgaactctcatttttggaatttatattattattattatttgttttaattaatctcgtgttgtgttatgtatgaacttttttttcaatatttattttttattctgaattttagttatttctaaattgtattcatacttgaactctcaatttttatttttctaatttctgaattgatgtttgataaatcgtgaggttatctagtgttacatattcaatatttcagaattttatccttgcacgttcaaggcctcattccaattccttctacaatcattcatattatcaaaatatattcaatgatcgatttttaattaaactaatttgatattttagatattgctaaatttctctatgaatttggtcaatgactaaaaaagtcaaacaaattatataatatgaaacggagaaaaagtactattttaggtcaataactgggctcattaacgaccaattaaccttcacaagcaaactggtgacaccacacacaatttgagcttcctctccaccattgacagctagtgtaaaatcaatggttcgtctgtagtagttaacaccatcaccagcttgtgcaacaattgtcactataccagcatctcatccaaagaaacagccatcacacggcgcaatagtgggatagaatgtccattgccatcggcagccaccacaccagctgctggaaaattgctatcatgaagcacaatgctatcttggatggtgcattcagcattggtgctggtgcaaagctgtgatccctccacagaaatgtcctccctgattcaggtgacctctgaggcgacgtgcacggtgcagagcctgatgctgctgctaggaagagcgagacttttgaagtttgaaccgcagtctgcatattgctcaatttttggtgcaggctgtacgccatccaacactagcagtcctttactaagttgtttgtccgcgtggcctcgacgatcatccttcatcttgaggtcaacctcaaactacacgctgtcatatagcaccagtcctcgatgagggccggtcaatgtcaaagattcatcctacaattgaaataaattgtactgatcgttcgatgatctgttgtacataatgcaattcatggaataggatgcttgctagtgtagggagggtgacctctgaggcgatgagttgagcatcttgtctggagcggcggaagagaggaacacatttcagatcaaggtggtccactggtctagaagctcatggggaagggaaacacacatcatcgtcgtcgtcgtcatcacacaaccaaaatcaaaatcggggtaggaggggacgattacgcggatggcgagcacgttgatcatatcgcacaggaagcggagggctcgggccggtggggtgtaggcggtgtcgtcggtgaagcgcatcggagcaaggccggactcctcgtcgaggtcgaagtcggacatgtctccctctcttgcttctcgtgctccagcctctccgccgccgccgccgcctcggccacggtcgctgcctcgtcgtagaaggaaggctccaggttcacgcggtcgctgtcgccgtcgtccgccattgccgccgctgccgccgagaggaaaggagagaaacaaccccttgccccacttgggccttggcccccattatacggcccattctgaatctgcacacttcttgatgggtcttttctccctctgtgacgcgccactataggccgaaatacacgccattttacccaggaatttggagcagttttggaccaaaaattgcacctgttctatcttgggccgtaattacgcgccacaagaggccggatttttcgcttaactttgggctgaaaacctgaaacaacacggaagaaataggcataagttcactttgtctccctcgaatatagctccaatctaattcgtattctttaaccacaatactgatatcatgactctctcaactattgaaaccggtgtaatttgacttcctcagcagttttagagaacggtttcgctgacgtggtgttttgacctagtccaaccagctcacttagcatgtgggacccacatgtccgtgtcacattttcttctcccctctttcttttctctttttctaccctttctaacccggcagtgcgaggcggccagcgagtcgacaacagtgtggagaggacgatgggaggagggatggatggaggtgggggagccgctcaacaccgtcatgatggagcctactcccatggaagtcgcatggtggagggcggcgccggtgccgccccactaggcaagctcgaggctgcgctcctagaaaagccgctcaatgacgctgccccgctacctgctattgatcgacttcaacgaggtgtttgacaagctcgaggcgaagcttgcccccctaactccgtcaccgcctaggacggactcgaccctagcgataaatggtcggatccattggggagggagccaccacggatctggagtacgaggttgcacctcctcgcagcacctgtgctagctccatgcctcctcgattgatgggcaccgatgaagtgggcggcttgggtgttggaggttggccgtcgggcaaagaaggaagacaaaagcacgctgctagctccctgcaccctacatcccgtgtttcgatggtgacctccatcatcgtcgacggcgtcgcagctgcctttggatgacagaagcagtaacagcgttcagggtctcctatctgccgaacgaggccacgccgctgctccgcctcgagcctcaaggccctaccactgctacatgtcaggatcatcccgttgctgctctgcctctatcttgggccacgctgggtgcgagcttctgtgtcatctgcgcacctctgtctgggctgactggcctctcgacatcgtcgctgttgtggtagtagaaaaggagagagggaaagtgagagaaatgtgacactgacatgtgggtcccgcacgctgagtcagccagttggaccgggtcaaagcaccacatcaatagaaccgctttccaaaaccgttagggggggggtaaattacaccggtttcaatacttggattttcaagatatccgatattgtagttacttgcaatgcaacatgatacggactttgggatttcttctcgcgtttttgcttggactctcactagtgccgagggacttggtttacaccggttttaaaagatggaaggatatgtatgttatatacttatatcaggcttcgtggttaagggacgtgattataactcgactcttagatcagggaccaggcctggttaagtgaacttttgccttttgcttggaccttttgttttttttttccttctgcttgaacctctccctttttccgggttatataaatcaggtaagatcaattttgttctcccaatggacagaaaagaaacatgtggccaacaggccaagtaaacccgaggggagctaggaatgtccaagcaaaacaaaagggcacgtgaagtgaagagattggttggcattgtgacaacagctcacctcgacgagcgtttaagcttagtatattctgcaagcccccccacctaaccctgaaagtcctcaagaccacaactaaacaacatcaagcaaatcaaaccggacaacccacaggataactagtcagtttttccaatgaatccatcctcctctgcaaaagctgttttttttagaagttgcaaaagctgttaggacgcacattttccttccttgagacgagtaaactatagtgtagtacagtacattattgctgccccgtcgatctcaaatcatcagcaagcatgaaggcacatacaccctcctagctactagtctttcttttttgtgctagtaaagaaataaaaactagatctatttcaggttataaaactttttagtattacacatattcatatgaatgttaatgaatttagacgtatatgcatatatgtctagattcatgaatatatatatatatatatatatatatatatatatatatatatatatatatatatatatatatatatatatatatatatatgagcaatgctagaaaatcttataacttaccatggaggaagtaacagatatacagctgggcatcgtcacaccagacgactttcaggttccagcttgcgagaacatatattaaaaaaacgcccaaaattcccaaactataaaagaatcgacgccaaacaaccaggccgacacagcaacaacctacaaggggcatgattagcctgctccccccgtacatcaatcccgaccgtacagtgaacgcattgcccaatacagatcgaggctgaggccgaatcaaggccgttgattttatagtttcagtatagctggacgtcggtcaggtgaagaaaagaaacagctgctgctggattcctgggattcataggtgcgcgccatgtcgcgctctgtcggtcactcggtgtctcgcggtcgccgcgacgaaaatttgcaggccaaacgcgggccgcggccggcaggcggcagcaggtggcctactcccgcaatccgcggccgcgcgcgcgcccacacgcataccaaacggccagttggttactggtcgatcagcttgtcgtgcatgatgatagttttcatattttagacgtttatttattgatctccaattaacaagacttgtcggtacacggttatttgttatattgatattatatataaaataataataataaataaattggagtattcagtttgaagtctcaatttttcacaacgtgtagaatagatgggttcttttttttttcggggaaaggagaatatattaatcacagtcctcgcagacaaaatgcaagataaaggtacaattttctccaagccaaagactagatagggactcagctctagctttgtttgctaaaaagtgactaataacattctgactacgctgaactttgcttatggcgatttgctgatccccagccgttagtagtttagcctcctaaactatattagcgagaactgagcgatctttgtctgagtgatgtaagagctggatcacaaagctgcaatcagtttccacttggattggaagaagagaccagtggagcgctaggtgaagaccttccacacacgcgcgcagttcggcttccaaggggccactgcaactgtcaagagatctgcaggaactgaagatcacactacccaggcaatttctgagaatcattccgatacctcccttctcagagttgatgtcaaaggagccatcaacatttagtttcatccacccattcctcggcctctcccaacgaaggttttccgctccaggagcacgttggattgctgtagatttcgggaaatcagctctcaccacatattttcctttctccaagttcacctggggattttgtcggatcatgaacagtgagtcaacataactcactataaatcttaatagatgggttcttaacgtggtccacaatgttaaattagaatttattatcatgataatatgttctgtctatgggaggcgcaatttttataagcttacttattataatcacattatgtggttctttaaatttatcagttgattttctttgttagggtagtttgggtttgtccattcacctactattttttcagctaaataacttattatctatgttatgtcatatgacagaggctggagacataacacatttctattatctaaaaaggtatgttctttgtaatcaatggtcagatttttctttctaattaacgtgtgagattatacaaagtgcctaataagtataggtcggcatagatagtttttcaagggctattaattagatccatgccattacaaatgtaccatttcagaaaaatacaactactattcgtatccatgtcatccaaatgcgtacaaaattgaacaccatcacacttttcattttcttccccaatttctttttatactctctctcccttcccttcctgctggccagccacaacaacaacgttgatgtcattgtcgccccacatctctagcccccctctcccctgtggagcaaatgacaacagtgcccgacaacgacggtggcggcgggtcacgtgtcttgcaatgccaaatctccaacatcgggcttggggctcctcatcctcccgctggcagccacaaagacgatgatgtgacgaggacgggcggagcttgtggcgacagggagggcatcaacctagatttggcaagaaccataatgtcaggagtaggtggggccatagggaggagcttggtgcgggtggcggcatagcaatgagctcgagcgggggtggccttggcttccctccttccttctcaggccagtgggtaaatgggaaccagcgcttcatcattgcgctggttgttgcctttccattcgcctctctcgtcgacctatgcttttggctcaacgaggtggagagagataaggaaaaagaagagtgaaggatggagttagaagatgcatggaactaacatgtgggtctcatgtctagagatattttggtctatataataaaaaaatgtgatggcgatcaggtgatggtatggttctaattttgtgcgtatttggatggcatgaatatgaataaatgagtggtagtggtattttttttctaaaatggcatatttgtaatagcatgtatacaattaacttttttaaatagtactctcatcatttcatattataagtcgttttaataaatatttttttctagtcacattttttttatgattgatagactttatagacatatttaaaaacatttacaatatcaaattaatttttatcaaacctaacattgaataatttataataaaatgtctgtttcgtgttagaaatgttactatgatttttttttataaatccgatcaaacttaaactgatatttattctgatattttgtttcaaagaagttagtattatcacatatatctagtggtagctaacaaggcgacagataatcagatatggccattgcattctggggcctctgcctgaactgtgattatcccttggccataatggcatttaggggcgcctaatgaagtgtgtcccctgcttcgtatgattaaagacgatcatgatgggagcagcaagccagcaactaaccaagtaaccaactctaggcgtgcgcatgtagctagcctggaataaagttagcgcaattatgcaatgctatgttgccaacacctaacatttgttgagtgcaaataaaatagtgatactaacttatcaggtcattcacagatcgaagtagtacataaaattgtcgtttttatatattttcataggcgttcaatcctctccaaagacttgactgtgactgactgagatcgaatggcctaattacccgtagttgcaggcaacagacgagattaattaaggttagcgtagccggattagatgggggcttgatcgatatcgcctcttggtgatgaaaagagtatttaactgcaccgaaagaacttatgtcctccttattccttaaccatgcactgtcatgagagcatactagctaagctagctagctaggaaataaagtgcatttttgcatatatgcatgccctactcaacaactcgattgttattgatgtaaagcttacctatgtatatcggtacgagtacgcgtcacatgaattaggctaaagcatcagcttttataatttgcttttctgtctcaatgtttgtcgtgctaaacatgttcaataccggactgaaaaaaaaacattttcgttttctgcagactgatcaaaatagtataggatttcatttttttatatctcaagcgcgtctctgtcaggactcaggaagttgaccagcaaagaattgtttttttgttgtattttaagatgttgctaaagcggcgagacaatcaaattgttctctccaacgacaagtacacccaagaaaatggtgtcttttttttctatatgggaaaatggcgtccttttggcaattaataggatccagggaaagacagcaaattgatttttgatggactctcaagcacatcggatagctacagtgacaacacagtgccaccagctcaatctcatccgtcggatcaaacaggaaaacagacattcaaagtagtcagctatcagccatggtaccaatgatgctaagcagtgaatagactttaattattatgatttatgaatccctttttccccaatgatcatatatatttgagattgcactgtacgctgccattataacatgaagagttttagaagatgaatttgcatacaatcgaaataggaacgataacagatccgccgccatactaccctctcactttaagttgatgatatatgggttccacaactaacaggttcacatgtgagtaactcacgttagagaatagtacgttagagaagactcatctagccgaaatagtatggcgtcaaccgtcaaatcatgtaatgtgtctctaaagaaaatttagatgattcaacactccgaaggtgtttacaaattacaatgtaattatagctttccaagcgtttcttctgctggctatctggttttgcaatggggaagattggttccatgcataacatgaagcttcaccgtcatgagcatgacgcattacataagcatctggtcaaattcaggggttttatcaacgagaagagctgcatggaacccgtgcgtcacgatagtatgattggcacctgctaaccaaagaggcaagtcaatgttttgctaaaataaaaactgataaaaaagcgtgttaccattcttatttcattatgtactcacgttatacatcatgtatgaccgtaaatcgcccctataatgtcacatagtattcatgtggtcataatctacctgtattgtattgcacactaaattgattgtatttttcacacattttggtaattcatagctgctattccacatccgcgctaacgtccattacatatgaaataacgtactagcaacaaattagagaagacgtcccaatgcttcgctaaaagggcgagatatcgtcgtattgccaggttaataaaaaaatcacgtcaatgcttttataaaaaaaataaatacatgcgttacaaccccttacttcatcacctactcatgtcaacacatagcgacaagctatgtcaagttgttatgtgattatcataagagcaacatacgtaaaccatcttcacaactacacacataacatgcatacgaccaaatctacccgcccgatgtacgaggcgcaggctgcattgaccacacgtcatagtaattatagcggctactccacgtcaatactaatgtccattacagacgtaataacacgctagcaacaaaccgacgaaggcgcaccccgatgctctgctaagaaaaaaaaagcaagatattgtcataatgccaatagattaaagcatttgcatttccaactaagcaaaagataattcctcagcacgtttgacttccctcccctcaccctccacatgctggtctcaaccatcaggccattctccccaagcattaattaattgattaattgactgattaattaattaattaaatctcctcctccctcctaatttctttattagagtatttccaaataacaacctccttgcaattttctttttgattaatggctcctctctctctccttttccacacccccacctccccctttaattccaaatgctgcaacctcttcttctcctatagtcctctcccctctcccctttgcttctcctttactctctctctctctctctctctctctctctctctctagcttcatcttgtctctcttcatgtgtgcatgtgtgctgtagtgctcgtctttccgtctcctccatctctctctctctctctctctctctctctctctctcttgcaaagaagcaaaggcagctcgcccttcttgcgcattccggtgcacgccactccactccacacacacacacacacacacacacgggcaagaactgccctttcttttgcagctctgacgacgggtttgggggtggttcttgatgggattcttggccaatggggatgagctgaaggcgctgcagaggtaatctcccggtctctttcctcttcgtgttttgttgggggaacgtcggcatctgtgatcttgggaggtgtttgactctgtgcctcttggaattgtgatgggctttgggatttccggtgtgggttgggggtggtgtcggtagaattctggtttgtttttgcaatttgcattgtgcggatttttttctttcttggacaccctgtatcttgcatttgaataattttatataggcgtggttgttgaataaacagttcagagttttgagtcccatcaggagtccatgcctcgctggtggtttgacccagaaatggacattttttttcctgtttgattagtttgcttgtgcgaattgtctgtacagtgatatgaaagataatattttttccccctgaacatggaagaattgggccatcatatgcgcgcagctttattacttttatagttctgttcatgtgctggttcaggtttcagagttaagtaatagagtaccttttgttttttaacagataaaagcaaaccaggataagtttgtaaattcagctggcaaatccgtgcaagattctgaatttgtgagagcatctctgatacaattcttgatcttagatagactgaaggatagatatgtcgtccgacagcaactccatcagttcagcactgtcacagacaacacccgtgcttcgcttgagagtttgggtcctgattgccatcggcattgggatactgatggcaattttgttcatcatagcattgtggctctctatgcggaggaaaaagaagacggcggttggattcgacgggagatcacatatggagatccctattgtgtcgaaagatatcaatgttgacagagttgatgcacagagcctgcatgacagtggaacacctatcatgccagtgcaggataaatatgaacagatgaagggtgtttcgcacttggcagagagtagatctgtcgatgtcgacgcgttcagccaatgcagctcagtgtacaacatagagaaggctgggagctcatattctgaagattacagcagctctgggcctggtaggaaaggcagttcatcgtatgggtatgcgtccgcttcaccgctggttgggttgcctgagctatcacatttgggatggggtcactggtttaccttgagggacctcgagtacgcaacgaaccggtttgcaaagagtaatgtccttggagagggtggctatggaattgtctacaagggtcgactgatgaatgggactgaagttgccgtgaagaagatccttaacaatgtgtaagtttatattgccttagtgagtttactgtatgttaacttggagctaagatttctttgctgggtttgcagggggcaagcagagaaggaatttagagtcgaagttgaagccatcggtcacgttcggcataagaatctggtgcgacttctggggtactgtgtggaagggatacacaggtgatcatttcttcctctctgttccctttgttctgcataattaactttgctgctcagcccagtttatacgaatccaccatgtgcaagttcattgtgatactaagcattatgttcttaaggttcaaaagggaaaatgaattatccatttcataagatggaaattctgttccttcccttgtgcataatcaatatgtgttttccttgttcccttgtttctcactgtacattgaccttttctgaatattcacctgcaggatgcttgtctatgaatatgtcaacaatggaaacctagaacaatggcttcatggggccatgagtgggggcatccttacttgggaaaaccgtatgaagattctccttggcactgcaaaagcgtaagatcacagtctggaccttacttgcagttatttcccatgaaatttacccttctcacataaatacaggttttaaagatcaatactactacatgctaatgtagatgagtttcatgattttcaggcttgcatatcttcatgaagctatagaccccaaagttgtacaccgagatattaagtcaagtaatatactaattgatgatgaatttaacagcaaggtttctgattttgggttggccaaactactgaattctgatagtagctacatcaatacaagagtgatgggaacatatgggtatagcttttttttgcaccatgtttgttctattttatttgtcttctgtaaatttggaaaaaagcacatcttaattttcttcttaatctgttgttaggtacgttgcacctgaatatgcgaatagcgggatgctaaatgaaaagagtgatatttacagttttggcgttgtgctcttggaatctgtgactgctagagacccagttgattacagtaaacctgcagatgaggtagaagcttttcctatttttcgacaatttgaatgaccagtctatcatctagtactcaagtcatttttttatgtcatttcagacaaatctggtagaatggcttaaaatgatgatcagcagcaagagggcggaggaagtagtggatccaaaccttgagattaagcccccaaaacgtgcccttaagcgggcaatcttggttggcctgaagtgtgttgatccagatgctgacaaaaggccaaaaatgagtcatgttgtccaaatgcttgaagcagttcagaatgcatatcgacaagtacgtttagtacattttttgtcaccgtttttcaaacttttgttttacacaactgagcatctttcttggagattttgtttctaacaagtaaatgctttctctcttttactattggcaggatcagaaaggcccagcagccagatgggaagcgtcgatgtcgagtcacagcaatctgcggaggagatctcaaacagtgccgattcctgaggctccaatgctgaacagatacagaaaataggacatgaaaacatttcattatcctgtctggtttggtcaaatattcaatatagttcaataccgtgattgcaacaggtttacatttagcaaagactggaagacataaaggcataggaatcgttcgtttccctttcttttcttcttcttcttcttttcgagaagtgcttctatgctcccctaaaatatccgccgtactatgttttctgtagatgagtcctccaactcgtttactctacgatatgtgtagttttgttttaggggagcacagaagcaccttcttcatctataccgtttaagttatcaggaggagctgacctcgaaggcatgaatgactagtaaccagattttgttacccttgtaaagaacccttgtcgatcctcagttttaccatgaagtacaaagttttgttggtgtaccatgtgcgcaaattttcttctccattactagtttggatcaaagcagtgcacagttgcaaatgcatggtgatcttctcacacttatcatttctgacagatgagcagagaactttttctgggaagatagttccatgtttcctccccatagctaaaattcagaggcagttgtttcgtccttgcaccttggtgatttgttttttcatgcatgcacatgattacagggtaccaatgattagtgcctgcttgttttgcaagtgttgccaccttcctcctttttcttttgaaggactgagttgagtgtgtgtgttaatcattggcgccttttgtccctcacctacttgcactccttccatttcatagctttccagacacaccattcgatgaggattcgactctgaaagtgcaatggctaatggtttgctttaggctagaaaagtgtactcatggctctggaaagagtttggtaacctacttaattagcggcaattttaattttaccgggtagtcgtagcaatcgattttttatccacggttcgtgtacatgcagacatgcagtgagtgcagggctactggtagtgccgatgcagatcatgcaatgacaagattgcgtcaacctaacgatgtcaagattgcgtcaacgcaaatcatttaaaccagtggcacgagcatgatatatttaaccatttacttcttttaaatgtagcaattaactatttataagactcacattgtcattgacacataaggaatctacatgtcattaacatatgagtgaaaaatagttaaacgccaaatctacttctgccatgtgccccgtggttcatctagggtgagtttgagcacagggggattgagaagatacgcaaaacgagataagtcattagcgcatgattaattgagtattaactattttaaattttaaaaatggattaatatgatttttaaagcaactttcctatagaaaatttttacaaaaaatacaccgtttagtagtttaagaagcgtgcgcatggaatacgatgtccttttctcccccaatcccccagaactcatcacaaagaacgcagccctagtttcaagacattttgactcatcctttctcaattcggacttccgagtacaatggcagaacacctcaggttggtatacagaaaaggaggccaactcgttactcatatttattagcatttcgatcacattttcctcagtgataatccttcccagtcacaagtatatccgtagcatatcaagttaaccattatactctaatctaaacctctatacagatcaccaaacatagttatatacttatatggcttatactttagtccttaccaagaactcttctatccggaaatccttttttttttctgtcaaatctctttgtactttattctttttccaatcccttttaggccttgttcagtgaatccctcccacaaggggattaatttcacagccttaagaaattagaacgtagtctacattagaggccgatgatgacttaggagacgagctgtgccggctgagaccttccctcaccttgccgtgctgttctgcttcatgctggaacgctgaaacaagatcctggagctcgagcttcctcaccttgaccttctcattggtcactggattttgtaacccaagatagagtattcctaccccaataaggacgaagcctacaaagaagagaagtcctgcaaacaagccaaaagcgtatggagtattctgcgctcccggtatgccatcaacattgattccaaaaaggccagtgattatggataaaaccatgccgccacccccaaaaatagccaaattgtgggtgatacgaaggcttctatcctggagaagagcaaaacctggctatcaattacaagtcaagtcaacagtaagaatgaaaaatagctcggtgcatacttgtaaccatgctcgaacagtgctttgcataacatcctgaatagtgaacaagcggccacggacagcttcctgctcctccaacatttctcttgtgtcctttctaatgctatctaagataactcttgtggtatttcccctcaaatgtctaaggagctcaattatgatctcttcccttgcatgcagagaccatttaactctgattacctgtagcacgggctcatgatcattatgtatcaaaaaaagagaatggcatgcacaattgccacgtggaacttgaatgtgctaacactattctgttcacaattgcacacttatctgaatagaagttcctacatgtaattcaattcctattttggatctaccctatctaaatttttgtgcattatacttcaacaagtagaaacgacacattggccaatctaataaattggtgttttatttttcaatgaggtaattatatatagaaggcaaattagggtggcatacttacctgtgttgctaaccttctgatttcttgattcaatatgatgctgactagatttagatcttcatgatttctcctgcgaaatggttgtttggaactttgaatatgtaaggtaatttaaaatgttatgaaatcacctcattttagggcacaggcccatcaattcaaataatatgctctgctagttgagatatgcctgttcagtttcctcacctattcacaaacttcagttcaatttcatctgcttcaccaaagacatatttccggaataacctgaaataaaataacacaactattagccatgagtagacaccattgtttgctacagcaagtacagttgcaggcataaaagaaagaatgactaaaatggattaaaatgttaggtttcctgataaaagaaatgctgtgggcaagttaatatggctagataaaaatctataataacatcttaatcaagaaaaaaaattgagtataaattgtgcccccatcgtagttcaagtcctcttcaacttgaattttggtacctttgttattatttgttggaaaaaggatactagtttccactagttatgctcaatcttatcattatcaagaacaaaaattgtcttcctaaagcaaataatatgcatcttcttttacaaactagacagtagacgttcagtaatgttgaggaggtaatggaatatagagaatgcatagttagaacaaattgctcttgaaagttgaaagtcctcatatcaaatcattttttttattatgcagataaacagaacaccaagggtccttttggcatgcctgagcataagttaatcaacagtataatatagtattaagataaaatccaatgagattcttatttgggggtgttgaattttgtcgtggttcttttggcaatataaggtataagcttatagccaacatagtattaaaatataggccaatggtgttcttattttgggggttgaatttcattgtgtttggtttcattttcaaagttaaatccaagaaagtaaatagcagtatgatgggtcaaacctgtataagtgcaatctattgatgtatatagaaactttttttatgataagtttgagtgaggtaaaaaaaagaagtgtcatgattacacagaacaaacgaagatttttttttcttattgatggatattttatctctatgaccaaacatcctaagaaaataaaccgaaaatgatggtagtggtagaagttggaacatagaatgaacctgtcatcccatcgggaaagacggccgatcaaatgtgcaattacttcatgagctgatctaggtgtttgacttccaccagcactaagcaactcctgcacagagttccacaagcatttaagatgaaaaattcacaagctaaatactattcagttcataccagcaaataagcctttgtttcaaaaggagtacctgcacttcagtcactcctaaaacatttatattggatgaagggcctttgacatgcattgcggtcacaagaaagttctgtgcttgccaagaccgaagcacaatgggtatgtcttcctcttcacggtttggatctccgactgattgaccaagaagttcaaatagcagtcccccagcaactctaactgggacctgaatagctaacagaagtttatagaataaatctgatgtgcacatctgatagagcatcatcacactttctaatagacattaaactattttatgcatctaaaatgcacatgagtagttctatgaagtagtcaggctgtttagctgttctggaagcagaccaaatcagcatagtttgagaaattactgatttgcacataataagaccatagaactcttagagagaaaaacagtgctgaatgatttgaccaaacagtaaatattgctgcctactattcaggttgacagggcacagttatcataaccatatatgcatcgactccatgatagactactttggcaatattatatgaatatagaaaaaaaacagttcaatagaagtatagaacccattaagtaaagaaaatccatgaaaatacctgtacataatgcaggtgactttgacagatctaagataagtccaaaagttttatgacaaatcaatgggtcaagccagtctcgatgttatggacatgggccaacattataggaaccaatccaatctctatctctattttactaacaaatctcatctctttcctaattagatatcctcctatctttatttgacttattcctaatttatcatgcctaaactaacgcatgagcctggtccagacccataatacttgacccacccagttaggccataatgttattgttatgttaatgctttcaaggaaaagagggtgggttagagggaatgatgataaattgatagtagtatttcatacaatagcctgaagcaatgaaatgattccacatagaaagaggtcttcagaatattgtggaaaggtcggtgtgtgctcttgaacaaaatcacaaatattcattctaaaactaaaggtcttcacagttaaccatgatcatagaaaaaaaaacctacaacagctcaggagttggtccttttttttcacgaaacatgaaaaggtatagaatagaaaaaacagtacaggctacagcaagtttagaagttcaggcagataatgtgtacaccgcgcagattgcagagcattcaattgtagaatgattaaaaaaggtcttgaataacggacagattgaaggaagaaaaataagtatataaaattatgaaatgtctcggaaaaatgagaataagaaagacaacctcatagagaaggtacttcatccgatcacttatcagccggctttcatctctcaatgcagttcttatagccggatgcatccagtgagcactattcagccatgcgtcaactgagggatggcctgcagtgacatggcaccaccatgtaggtcctaccggacgctgccagtatggagctgcaacatcagctacagtgtaatcatcctcactgtcggtcatctccgccggctcactatcccagctggcatctgactgaaccctctggaccagttcagcaatcctagaccatccgataggcacccatttgtgatccaggattgccctgacatgcaccggcctatctttgaacagagaaggatcattagcaaactctgtctggcggggattctccaccacatcgcactcttctggtttcatggttgcgacatgatgcccgttcctacttatgtgccgcttcatatgcatagggacctctttctcctgcatgctatcaatcgtcggccatgatttgtgctgaaccagcttcttgtgaccctttatgagctcaaaagcacagatgagcccgtcggtccagagctcgcttcctggcacatgctctttccccaaactcaccttggcaaccccgtcttgtgccctggacacaccactgacctgatgaggctgttggccctccacatcagccatgtccgctccaattctgtatgttggagagagatgcacattcatcaggaaattatgtcatgtaaatactgatttctagtacaattaaagtgtatagagcaatcagttgagaaattgggccaaaagatcaaacaactcccattgggatggtttaacaaatatacttgctgcatgagaaaatgatgcagtataataacactacttccccatcccaaaatatagcaacccaatactgaattagacacacccagtactacaaatatgaacaggcgaaccgcggatgtgtgtaattcagtatactaggctcctatattttgggacggagggattactaattactggagcattacaccacagttgtaccataggggaacacgagaatcatagcgacgaggcggaggatgtggattttcatccctcaaggggacatcccctcgttgtttgcatgtcatctagatagttatcaaaaaaattgaaaaaaaatgacaacatagattaatataaaatgtatcactccacaaacatgcaagaccaaattcaacttctacaagttgcaacaaaagaacaaattaaactgaaaatagttattgtacattcgcagctatatttgttatttttgttacaacttgtagaatttgaatttaaacttgcatgtttgtggagtgatatatttcatattaatctatgttgccaaatcttttcaaatttgtgatgactatttaggtgacatgacatgtatgaaacgaggggatgaaatcactttcccagtatacaagtacaaactagaaactactactgctacaagtccggatgcaagtatacaagtactacaacacaagcatttgggaattggaaaaggtagggcaaaagccacaccgtgtccggagcccagatcgcggcacgacacccgcaggcagcgccgccaccggccaccaagtcccgctcccgccaaaaacccgccgcgcgccactgagctttccccgcgggccccacgcgcagagccaacctagcactcccgcggggaagacgttttagcctggagccctggaggtggaggaggaagagagggagaaagagaagaagagtgggcgaggggagcgcgccggagactgtggaagtgtggaggaaggaggaatcgtgggggagcggagcgggcgcttcaagacgggaagggaaggggatgcaaaggcaaatgctcgctttgcttctcgcggtcggtcacctcgctttgcaaatgtctcagcctctctaccccatgcgccggcacacgtactcctcgctgagctttggatactagtactccagtagatacgctgtgcggtgtacatgaaacgtgtaccacgtcctcgtaaaccgccaggagtttgacatagggatatgtgtttttttttccatttttgaattagccctttttcacacaggccgtatttaattcgtgtaccaaatttttattctttttaaagtactccctccatactcataaaagaagtcgtttagaacagcgacacggtctccaaaacataatttgacttcttgtttctataaaaatatttattgaaaagtgatatatgtatatttttatgaaagtatttttcaagacaaatctattcatataatttttacattttcaaactcaacaactttagagttattcatgatttatattcccaaggtttgacttaaacattaccctaaacgacttcctttacgagtacggggggagtatacagacacacatttaaagtattaaacgtaaactaataacaaaataaattacagattccgcctgtaaactgcgagacgaatttattaaatataattaatccgtcgttaacaaatgtttactgtagcatcacattattaaatcatagcgtaattaggctcaaaagattcgtctcgcaatttacatgcaaactgtgcatttgattttttttccgtccacatttaatactccatgcatatgtccaaacatttgatgtgacgggatttttagaagtttgaaaggaactaaacactgcaacaatttccccaaaaagttttaaagctggataatatttttagcttcataaatttatgaatctagatatacgattgctttaataatattttaataaattattttgtttctattttagaaaaaaaatattaaatattaaattactataactttaacatacaaacttcaaatctactgatataaagttgtgccaaacagagttagcaagacgagaatcaaacaaaaccgaattgagtttatactttgaatggggaaaaatgcacctgcaaggtttttttgttgttacaaacattttacaacaagaagtttgtaagaaaagaaaatttaagcatgcatagcactgctgtattttatttttgctacgtgtaccattttccggtgggataatggcatgcgtatacgtgtatttcatgtctaatgaagaaaacaagtttggatgaataaacagtagctctgcgtctatggagaaaatactatttttgagaaaattgggattatactatcgcaaaagagtggtttcgctggaatactatccctcttgattcattaaaatgctattctaaactagaggtgttcaccaaaattctattttcgctcttttgggtaaatagaaatgcttttactccaagtttaacttttttccggaccaaaatacccctgatacgggcccacctatcatactctctccactctctcctcctcttcctctctctcgagggagcgccggccactgctctcctccggccaccggcgctccgcttccactgccatcggccaccggccgttgctctcccccttcccgctcgccgccctccgcccgccccgcccagccgcctccttcgctccgccgcggagcgccgccgccaccatagccgtgcgtgcggccgcgacgtccaactccccggcggccgcgtccccgaagaagagggcggcgagggtggggcaggcgtggcggcgcggggccagcgagggtggggcgggactaaccctgtcattggcgacgacgaatgcaccgtcgattgctcctcggtggcggcgatgcggcgcgaaaaggtagggatttggaccccccncccgtgcgcatggctacggtgccgccggcgccccgcggtggagcgggtggagggcggcgagcaaggaggaggagagggccgcgccggcagctgttgcagatgactggggcggcagcggcacgagcagaaagggggaggagcacgtgggggagcgtcgggggccggcgccggagccagagacgatgcggagggcagcggcacgagcagactaatgcggcgacgcaaacagaaaagggagagggaaggggaggagcaggtgagggaagggtattttggtcacaagaaaactaaaatagagcaaaatcatttctattaacaaaaagaccaaaaatagtattttggtgaacacccctcagtttaggatagcattttaatgaatcactttgaagggatagcattccagcgaaaccatccgtttgcgatagaaaaatcacatttttctcgcgtcgtatgcccctcttgcaattctgtgcggaggcagatatacacctcctttaagtaaagttgcagtatgaccttgctgcatactactacagaacaaaagctatttacatattggtgttgatgtattcagagcattgtcaaggcaaatcatgattagagacgcctaaatcagcgaatataggggggcgacttcgataaatcctccactgaaggcagcactgcagcagaagccattctacatgcttacggctgctctccagagtggttcaaacttgtaccgacgctcgaggtagagcttatcatttcagcactcagctctcagctcaaccgagagatcattgtacaaaaccccaagcatccattatggtccaagtctgtaactagttgttcatctgttcatctcacactgcaaagataagagctggaaaagttaacgcggacagtaatgctcatcagtaggtccaaacccatcaacaagcaggcaaaaagaggcgccttatgggatggggacatacaatctagaatctacacctggtggagaatcatataccggggccaccatttcatcgtaagtggagggcctactcagttgtgtagacagtagcccccagtattgtgaagttaaagtgtgcgtgcccaatgcccatgtcttactcccactagagaagacctctatgatttattgattaacattgtcaattttgtgaaactaataactggtattaaccaatcaaagtggcaaaggaaggtatttctctttggaccatgttcatcaatccatcagtaagtcaagcagctagattcttatctattgctgcaagcaccaagaagctaagtacagtcagccaaccaagatttgttcatcgttgcaacaagtacccaagcattattagttttccatccgtcttttctatttattatcacaaggaaaatgactcattgcagatcaagaattttcaacagtaagaacagaacatgcaagtgtaaaaatttcttacagctgactgaggagcttcagaataaaccacatcattcagcttaattctttgcttcggcaacgtgaaaggtactcggtggcttcattgaaatctgtcacaacaggaaattcagtgttaactgcattatatacatgagtggaacaaaagaaaatgggtgaatgtgagttgcaccaggaatgcggcggtagtctggttctatgccatttccatttatgtctttgtgatttggtgtcacatacttgcccactgtgacgacaatgccagaaccgtcatgaagttcaaatacggactggattaagccctgccgcatccaaggcatagtataagccagttggtcacagagagtgcttttccttggatatgctgtgtttttttttaacaaacctttccaaaagttttttcaccgaccagaacagctttgcagttgtcatgaagtgctgaagcaacctagaaaagcgttagtgcattggtgagctcatgctgatactattctaatactaccagtaaagttaaattggtacttactatttcactggcacttgctgtcctgttattcacaagtacctatgaagaagttgtgaatggatatgtgagatacaatgagcatgtggagatcttattatagcagacaaaagagagaagcatgattcagctaaaatttcagtaaagggtacgtatatgattaactggatctgtatcattccacttctaaatcagccgatcaaaaaagtgcaaataaaaaactatgggcatgaataaatcataaaacaccctacagcttgatgattctcactgtcaaagttagaataggaaagccagaattctgtatgtgcaacttaataggtgtctgtatatgtgtaatttgtcggtcttcgctttctgttgcatgtaacagtgtaaaattagttgaattggctagataggttcatgtacatcacaatagcatacataccataagaggagtagtaaccaaaggttccctttcagcaacaattgtattttgtacttgacgatcacgaccagcagtataaatcacctgaagaagttccataggggcataaatactacatctcagttcttctttaagaaaagtacacctccaaagttcagttcacgatataaaggataattaacaacagtttagtcaatcatatgcctggctgaaagccctcaaactttttaatatgcacaggacaagtatatgaatttcaacgaagattctatccaaatgcatatcaagaattgtaactacaagctcttaatttataattccaaacccatgtctaacataaaaaataactgttttcgagaaaacataaaaaaaactagcatggcttgatttttccaagttcaaacctaaactagaaccattttagccaggaagtaccttcattttgatgtagtatccatgaacagtaacttttagctgaggtgggcacaaaaaggttgatggattttaaaagaagttatgtagaaaaaaaaggttgggttaacttctatggacagatttttcaggtaacagatattgtgctagaagttgacaaaatatggaagcaagtaaaaaattaccgtgtctcctttattcaggaagagctttgcagtctctatcccagcctttaaagtaaacaaaagtaccatgagtaagaataaccccatccaaataaattatatcagtgtctttcattatccaaatgcataagcctcaactgtttcaagaagcttacaactcaagaacttcaaaggaaaagaatggcacccacaaacacaattttgtttagcagaccaaagactgacatggttatataattgaaatgaaaaaagcatacttggactagtccaccaagattgtccctcaaatccaaaacaaaataggaggcacctgagttctgtagacgctttagtgctgcacaagagaacatatgttagtggatataacatgccaccatccaatgtaattatattaagttatatctaccgataataattttaatggaatatcaacaaataatatcggaaaattttgtaacatcaaaatagtttcatacagaatcagcagaaataacatccttagatggccaatttgcagaagggaaaacgatattttaagttctgaaatagcatcgttagatggccaatttgcagaaggggaaacaatattttaagttgttctcctgatgctcacagtttgagccaggaaaatagttatatgtacatgcatagcagttttggcttaagaattagatactacatggccatttgcaataagttctatgcatagaacggttcagctatgaaagcaatgcagctaagtgcagctaaaaaatgaaagttgataaggttaacaaaccagcaacacaccactaaccaaatcttttttggccactgcattgaattctttaatgtgaatatatcctatagctgaatcctcattttctcttttctccaatcgatagaaaactggtgtgcgagcaaccagttgtctctgtaccttcaatggctcaacaggaccacagttcccatgcttaacctatacaatatacaagcaatattgagatagttataataaggagcgcaaagaagttctgggcaaaagacaagtatgatgtttataagattattcataaccttaattgtaacaaaagtatcttttggaccttgcaacatggatgacacatcaaatgcagatttacccataacatcaatgccattgactgacaaaagttcgtcaccctaataagagataaaaagacaggacaggaaagataagtatgtgcatattatccaaaaaccagctaaataagactacagtatttcatacaaaaaaaatgacaaacaacagttctctgtgataagaatactatcaacaggaattacataaaacataaaaataattaaatagtcaatcaaaccaatgttatgattgaaaagcatgcctactaattgaaaagtatatatgttgagttgttgatacctgtctaacaccagcagagtgggcaggcccatctaatatgagccctaataccatcaacttggaagagccattgccgtcaggaatttctctcaagtttaatcctattcccgtcatgtcatattttgacatcttggagaacttcaccagattgatttaacacatgcaaaatatcatcagaactgaagtacagttagaagatatagcatatcttcatgcaaaatcagcaataagtaaaatcagtgaaacaaaggaaatgcgtcaaaaaatggttttgtaatatcatcatttcatcattgtggagcgttgagttttctggtgtctaaactcttgacacaaattcgctattccctaagtgtaaaagtcacgcaaaacaatagttggcagtaaaggtccaagtcacagggatcccaaaaactttttgatggtcaatatatagtcatttgcacacgattctgacttgccaattaaaaaaataatggtgtcatgagcattggcccgagaggccgaggcccatggtcaacccagattctaaaaacaggttcatgccaactttagcactaaattcagaaacaacaatgtcagaatagctaattgctacaaaaaccatggatcactaggagaaacaaggaatggcatttagtggacccaccgactataagtaggctaaacatgttgggaaatgtaaattattcaggctcatactctctcctctctttctctctttaaaaaaaacaagttgtacagttctactcgtgtaataggatgatgttttctccaatatgctgagcttccatttgtcattctccaaaaaaagaacagtgccatttgtaaggtacttacttcggagggagtcaggaaccttgtgtatgggtcacccaggttagccagcattttctgaatgatatcatgggctctggaacgggatctgattgaggtttggacaatatcttgcttctttttctgcattgcattgaagcgaagcaattagccaattagcatattcaagatataacgtttccctgagataaatctatggaggataaaatatgttcagaagactggccattccgactagaaatccattaatgtacaaagagacttccatataggcaattgaaccacttcatagttcatattcaatcatttgttaagtgctcaccatccacatctccggcgaccagggacggcttccggcgtccgggaggaacccctcgttgaccacctcccacgcctcctccacgagctgctcgttcgtcaccacttcgctcctcctcacctcctccttggtctcggcggcggccccgtcgcggcagagctcggggccccgcggccgctccgcccccacggcgtcgccggtgaggagggagagggagatggacatggcggccgccgtggccgcggcagcggcgcggagggcgtcggggaaggggagcgcgcacggcggccctggcttggtcctgcgggtggcgagcgagcgctgcggcggccgcggcgacggcgcgtaggggagtagccgcatggcggcgtggcggcggggcggcgggcgtgggagccgcttcggattagtggtgggagttcggagtggatggggtagagggggatggcccggctgtgcaacacactgtcagagattttagctcgtggagatttcataggatttttcttacgggaaacaatcatttttctcacaaatttcatgaaatttctctatttcaaaggaggcctgttgatgaaaaaatcgaacacaccggcctgggagatctgcttagctccagtgcaggtccaaatatgatgagatgtgggtgtgccagtcagtttgatcctgcaattgacaagatatgcaaatagtagatcaaaacagccgatcggctgacaacctgatggagtagttccggccggtagccaataatagccgatgccgataccagccgatagcaatagggtttaagcaatcggctatatgtccaatgtagataatgatataaaggtaatcggttgatgatgatgtaacaaaataacaatataatccagtataaaccaatcggctagcaatgatatagtagaacaagtattgatccgaaggttaaagcacacatcggctggaggtccgatgtcataagatccacaagattagattaaacagtgaaacctttgttgccatcggctaaatccaacttatatgtatatgcaatccctacaagccgatgcaacgtccagataacttatcggctagcaccccgataaaatattagcatgaacctatcggcttaacaagacttatattatcaacaacaatctagtagatcgaacctaaccgatgcagcacgagattgtatatgataatctaatactcgatgagccgatagatctgtctaatgtgatggatataacaaatctatttagaacagcattatgattgtagagatatatcggctaagacaggagatcatacctaaccgagaccgtcccaactaaaccgatgcgtctctaaacacaatgcaattagagatagaattgagatatcaggtaggcaaatatatcaaccaaaccagagcgatccaagagatcgaatcaatgcagccttgaacaacaccaacgtagccgacagattcaccagggcccgacagaacgtaggacttaccccttcgccggagatcgaactgaacagatgcagccccgcgtcaggtgcccaaatcccgccggaagataagtaaaaacctcgggaaagagggtggcgatgcgccgagagtattattgatcgagagtgatagattacatagaccctgggtgtacatatttatacccatgggttgataaaagtccttgtcagacaagaaagaaactaacctaaagataaaagtaaaatataaagtccttatcggacactaaacacactttcctaaagataaaaggaaactaacaaactattcctaattaatagataaactgccatgccgcatcctctttaaactcggtcacttagggataagcttcctttagtatattgatttccttaaccgaatatagaaggaatccgactattggcgacttgataactcccatcggctgattccgagatgctacagccgataatgattctaagccgatgacgtctttgccgattaccaaatttcactgttaacaaggccttaaggactaaatgtattaacaaaaaataaatatgataataatgaaggtgtaaaacaatggattgtaaaaattaaaaaaatagattttcaatagatcaagggttaatttgatccatgccattgcaaatgtggatattaaaaaatgtcattacaatttgtatattcataactgtgccactccaattttacgaaattagaaccatgtcgttgctgtcaccttttccatccatcatcttcctttccgtcttcttccttccttttccatcttcttcctagagtcgtgctaggccagcccgcccgccgtcgctctctggcggcagcgtcgtctcccggagccaagtcggtgagctcggagagagggagccaagccggcgccaccatcccctccctcagcgctgccgccccctccttccatgcgttggagcccgcgccgtccctctctccgcacgtcggcgcggacgccgccgcagttgaagctatcgcgtcgtctcctccctcctcacatcggcaccaataccgtgcgcatgccggcggcgcctctgccgtcccctttctctgcgctgccgccccatccttcctctgagcaccgctcgccaacgtcgccgccccatacccctgcgtggccgcgccacggctccttccgcgtgccgagtcggcaccgccgcccggcttcctcggcgcccttgctccttccacgcgttgtcccctccctccacgcggaggaagtcgttggtctggccctccccaatctccaccgtgtcgacgtcggcgagcgccgcggggtcctcgagcacggcgtggaggcggcggagtcacgtggtgtcgttcttgccgaagagcgtggctggttggcgcaacacgtgcaggcaccggatgacctccttggagaagagcggcgtgtccttctcctcctcgtcgccgtggtgttcggcccacgactcatcgccgtcggaagcccttggcgtggagcgcgacgtggcgcggtggtgggaggaccagagctgcttttgttggaggtggtggtgctcagtttcccggatccgcctcgtggcggcgtggtgctcgatctcggctcagcgacatgcgatggccgcgaagaagatggagaaggaaggaagaagacggaaagaaagaggatggatggaaaaggtgacggcaatggcatggttctaatttcgtaaaattagagtggcacggttacgaatagacgaattgtaatgatatttttctgaatagccacatttgcaatggtatggatcaaattaatccatagatcaaagaaaaaaacacactttgatgagaaacaaaaacacaaatagaattaaggtttgataggatttaaagatgatcgatctttttccataaggaaccactaaaaaaatctagtatgcattcgaattcttaaaaaaaacacaatccctttttccatgagagttataaactgttatacttcgacttcaaactataattcatttgtactaggatgtgccccatcttagtactaggttgttttttttgacggagggattaccattttaaaccacaccattatttggtgaagttaacagatgtatggtagtatttagtttgttaccaaatatttgttgtgtttagagaattgatatcatcgtagttaaacctatcatgccaaaacttagtaacgttgccaacttgctaaaattttaaataatgccaaattttcgaaaggttaaacatggccatgaagtgaacaagactagagtttcgtacgagccctaagacacgcttttcggcgacctggtgcaaacacaaagttacaaatgcatgactccattcaacatattttaaaccgtattgcacatatatattttacaagacactaaaatacgtttctacctaaatctatgcatattaattttgttatagaataagcatttgggatgttgttgatggttaaacgtcaaatgctacctaagacatgttgtcaaataattattgctgtggagttatttatataggtaactcgtttggcacaatatatagaccatcaccccaaatgttcattttataattccaactagacgtgtaattccaaaaagaaaatggaaaacaatcacggtgtttaccctcacgtttccctctctgtggtatcaattcgtgttattttacatgccatcaagcacatcttttgaaactttatcattttttttatcccaaaggaatctaaggaactgacagctaaagtcatatgagattccgtgatactctattcgtttcaggttataaaatagtttgactttggttaaagtcaaattattttaactttgaccaagtttgtagagaaaagtagtaatattttcaacccaaaacaaatttattgtgaaaatatattgaattattgattcgatgaaactaatttaataaaaatattactatatttgtctataaacttagtcaaactatgtcttataatcggatagagtagcatactcgctttagtgttatgtggagctttttacgtttttttattacacgtactatcgctttggctatttacatgttaaagcaaatacattttaattagtacatgtaaaaacgagtacttcttcagttgtgatatatgatgctggtaacttttaggtacgcatttgagcattcgtattcattcaaaaatgttgtgtaggtttgcaaaatataagccaagacaataaaacaaattatataaaaataaataataattatatattttttaaataagatgaatggtcaacctataatccaatggcgtcatgtattttctttaaaaggagggaccactttctgaaaagaaaaaagatgcactacattttatgtccccggccgcaaaaaaagaaagcaagcactgtacatgtttggattgcatgtattgattgttagcgggagaaacataaatgtaaatatttaattaagcccacaaaacagcagggtgcaaacggcaaattcgaaatggaaaatattcctgtctatacaaaggaaagaaggaaaagaatgttacgacaaaaagaaaagaacaactgtttaaaaaaaaccctggacattaacgaatttctggtgttatttttttgcgtcaaaggaagaagaggaataaagtgatccaagaagaggagaggaatctaaccaaatcaggaaaaacccaactaacttaccactactggggcgtactactacagatctccgtttactgcccgcctaaattcttctcgcaaaagaggaggaatcccactgacccacacaaaaaaaaaaaaaaaccaaaaacgcatcgtcactttcatcaccaccggccccgtggccccacgcgtcaggtccgctcaggataactccgaggccacgccagtcgcagggttcgctgacacgtggggcccaccgaataattgcccccacatgctagcctcggggcggaagtcttccgtctctgtccgcgcgagccctcgcctccccgagcagacaatcccgtgcgcgcctatagttacaccggaagatcctacccacgagcgaaccacatactgcaggtgggcccagatggtggtgtccccaccatgtcagcgagagaggtttctgtgcgcgtttgagatcccacaccgccgcgacaagtgtacacggggatggatagagaggagagaagaagaagcttaaggctgagttcggatgggggagacggggaacctaactctaactcctgtgcacggaaaacggagtggt

SEQ ID NO: 74241 - DNA, 14570 bp, Oryza sativa
aaaagaataacagaaacgctacttgagtttgatttaggacctgtttagtaaagttttcacttatcccgtagagctggagttatacaactcgggtattctactcctaaaaattacatataaacataaagcgacattcttttcctccaactttaaaataggagatgtactaaatggaccttaaaaccttcctcccgccacgagccacgcaccacatggcgtagcatatactatgcgtatgtttgggggagctttgtagcagttgtatcttctctcagaatcaaaagctttcccaaacagtccagcttttcaagctacttctctcagtctcaagcttttatatagctgtgcggctgtgttgggcatgtgagtgcgagggtgtggcatcatgcaagccttgggcttggcacacgacgcaaggctaagttcactctaggtccctcaatttgtcaccgagttcgaaattcatccctgaaccgaaaaaccggatataatgtatcctccaacttacaaaactgtgcaaacaacgtcccttggtggtattatcccctggtttttgctgacgtggcacatggctcctttgactaggtattcatcccgcatgacattggcgtggcgctcacgtggcagtttggtgtaaaaaaaatgaaaactaaaaaagtaaacaaatatgcgggacccacaattcagttaaacaaagaaaataaaacagtgggacccacatgtcagtggccccactttcctccatctcaccctgagatctctctaactggaggaggagacgaggaggctgaggccgtaggcctctctgccacctcgtcggccaccgcgcgccacttgtctctccttccgattgccgtgtgccgttcttctatcccgtcggccactgcgagccactcctttctcccttgaccaccgtgcgtcgtttctctctccctgccgcgccgcgcgccgttctcctctctcccgttggccgccgcgcgccgctcctctctccccgccacgccacgcgacgttctcctctctcccgacggccgccggacgccgctcctctctccccgctgcacaccgcgggccgttcttctctctcccgtgagccgcctctcatcgctcctctctccctccggccaccgtgaccacaagtcgctcctctcgccgcttctctctccccgccgtgtcacgcgtcattcctctctatcccatcggccaccacgtgccattcctctctctcgccgtgcgctgctcctctccctcacctgtgtcgtgtgccgctcctctctcctgccgaccaccgcgcaccgctcctctctccccgccacgccgtgctccgttcttcaatcctgtcggtcgccacgggccgcttctctctccctcaggcggccgtgcgctgttcgtctcactctcgccggctgccactcgtcgctcctctcccccatcggtcgccgctcctctcttccgccgatcaccgcgtgccactcctctcctctctgcctgcaagttcgggcgcccttcccgcaacccgtcgctggtcgccggccgcctgctgagattggaaaaaggaggaagagagagataggtgcggagagatgtgaagaaacgctgacatgtggggcccacgctgactcatcgatgtaaactcgggtcaaattgccacgtaggataaaaccactcaccatactgccttaggacttatattgtgccggttttgacagttgagggaccgttatgtctggttttctggttcagggacaaaaattagatttgttgtctagttaagggacctaaaataaacttattccccagcgtgcaatgtgagcagctcaggctgggccgaggtgcattgtttggtgatgccttcctcggctaggcctgccttagttgtgggctaggaggtagcggcctggcctgcttggttggctaggccattcggcctgctttggctcggccgtctagatcggtcttcgtgcccaggtgagcctgctttggtttaaggaaaaagtacaccgaaggtccctcaacttgtcagcgagttacaaaatcatccttgaaccgtaaaaccggataggacgtatccctcaacttataaaaccagtgtaaactatgtccctcggcggttttgacgactcagcgtgagacccacgtcagccttttttcccctcccctctccacctctcttcctctctcctctcttctccaatctccacgggcggcggcgagggagcagctgcacgggcagcggggggaggagccacgcgcgggcagtggtcggcgggtgcaggcggcgggggaggagctgcacgggcggaagacgacggccatggtgcacgccgacacacccaccgcctgctcctcatacgccacgaaggcgtgggagatgtgcttgaactgcatctccgtgtggctgcgcccgtggacggaggcgtcataggaggacgatgacgacgtggatgcgttgatgaggaggagcgcggaggagcggccaacgaactcgatgaggtggagggcgtggacgccgacgggcgaccggctggacggcgtcaccacgtcgtggagcgtcagtagcgcaggcacgtaggccaggatgcggagctccgattccgggtgagcccacgccaccgtgcaccgcttgtagaacacgaggcgcccaccatcgccgtgaatccgtgatcagcgattcagtgtcgacacgaacaccagcactgtgaacgactggtaactcatgctctacacaacacaagcagctacctagccttaattaatcacgacatgcatcgcatggcgatcgattaagtaattaactaatggattaccccattgttccttgcaatgttgaggatgacgagctcgatgatccccttggtgttgagcagcagcccgatggatgtgccgtcactgaacggcatgccgaacacaccggcgacgccgacagcggcggtagccttcaagaccgcagagaccatggcggcgaccatgagtagcacggcagaatgcatgctggtgatatcccaaccatgaacaggtccttgttccccatagcctccacgctctgtatctccaccaccatctcgctcgcgttgaacacgtcgcgctccctgtactccaccgtcgcaccgtcgccctcgttcgccctctccaggaagtcacgcaggcacccctcgtcgcctcatcggccttccgctctttcagcgctttggaggagctcgtgcaccgccgcccagctgctcccccgccggcttccgcccgtgcagctgctccccacgccgcctgcgtccgccggccgctgcccgtgcagctgctcccccgccgcctcccatggagatcggagaagagaggagagcggaagagaggtggagaggggagagaagagattgacacaaggggtccacgtgggtactatgctgagtcaggtgccacataggacaaaaccagagtcaaaaccaccgagtgacctagtttgcttgattttgtaagttgatggatacgtcatatccggttagttcaaggacgattttgtaactcgatgataagttgagggaccttcggtgtactttttccttggtttaaggcctgagtagtattagagggtctaggttttattgggccttgtgtttgggccaggtcgacctaggaggagtgaagaaatttttataacaggtttgagaattctgaaaatactccctctgttagacatattccatattttggtttttccaaccaagttagttatatttgtagtttttgtgtataagatataaattaaatgtttaatcgaaacttgaggagctatcttaatactcattagttgcatatgtatgcatacacttcttgatcattgttacggtcccgtttcacacagctccagctccaaactctaacttacctagagctggagttgtgccaaacggtatagattgtctattttttcggagcggagtcagcagagctgctccattaatttgtactacgggggtggagctaggtttttgctgctccacagctccactccacctcaaaagacctagcaccctttttttaagtgtatttacaccaaaataccactgaactaccccttcctaccccatctcctcatgttctctctcctcctcatcttcttcccctcttcttccattctcttctcccatcagccaccggcgacaggatgcggcggtggcaagcagcgcatggttggcggcggcaacgacgtctacagggcgatggcacgcgcattcagaggaggtggccggttgagcgatgggcggtggcactggcggcgacagcgcacaggctaacgtgcggcggcggagggttgagcgacgggcgccgtcgccgtcggtgcgcaggctgacctacggcggcggttggtggagtgacgggcgccgacgccgcgcgggctaacctgcggctgtggtgggtggattgacgggcgctggcgccggtgacacgcggcggacctgcggcagcggcgacaggcaggctgaccggcggttgcggctgcagggcgatgcacttgctaagcgacaacggcaggaccacgtcaacaaggtgttcgataaaatggcgacgaataacgtggtggagtggagctgaccagtgtaaccaaacactttcatacgcaactcagctcctataggagacagctctcactggagttgaagttgggaattaggagttagagtttggagcccaccaactaatatgagttaatatggctaattctccttggccttcgtgataaaaataatatgttaattctcgcggatggagggtgtactttgcacttttcggaacacagtactcctttccgttttaaactacttgtctgtggtagatttgtccaagatttgacatgtctatatttagccactattttagaaatccatataattttaagaacatgtgaattatgtactactcccctgttccaaaaatacgatgatttctaggattaaaatcttattccactgtagaagcaaatggcgattggactcgatggcggttcggctgaaccacactagtggttcggccgaacccaaaagcccacctctcgggctatcctttggttgagaagcttcttattgcgcctccaacattatgtactatgttttggctcaattataagttgttttgattgacatatgggtcctccaattcgtgtaatcgcgtcctgattttctagaggtgtattttatcgcatgacgggtgattttcatccataaaatacctgcatacacatatttcaccaacactattaaaaatgattagtaataatccctaccactaagttgaataccatattttatttcattatgtgcagacattgaatgtcagatattattatttgaggaccgtcaaaatacagtaaaatttaattgacttttatttattatagtagaactagaatgaatcactagttttgaaaaaataagtacttaaaactaaatgtgtatagacaaaatggtcaacatacttaagttgttggattacttattaattaattgtgccaaaatcacacccagctcacttattaagttcatatactaaattgcaccctattatactagcacactcacttcttgagctcttacactaaattatggcccacctaccaatatatatagtgtaaatgcaatttatactccttatttctatctattattattatatactaaaagtccatcaaacttcctaaaaacactcttgagtcgccatgtggcacttctattaaaagtccattaaacttcctaaaaacgctcttgagtcaccatgtggtacttctacaaacgctcctagatcgctgtaatgccccgattttcgttcgagattaaaaatcattaaataatacatttcctagaaattaaataaaaatttaatcaatttaatcaagtaaaattatagagggaatttaaaattttcccttaaaaatcatggccgagaatattttgtaatattctctgtgctctaaaatactctccggatttttccacgaattttcggagctcaagaaatttaaaagtcacaaagttcatttaatcaattaaaataaatagaaaaccaagttaaatctccccttcctccttgggccattttcggcccaagatcttctccccctccttggcccgctcgcccctctctccttcccacctcccaggccaggccgtcctcccctcctccctcctctttgggccgctcggcctgttcgccctctctcccttgaagtctgcatcgcgtcccccaaccagtctcctctctctctctctctacctgacaggtgggacccaaggccccacctgtcaattcctccttccacctccagccggccagcaactgccattgttgccgacgccactccaccaccaaatccatgccattctttcccgttttctctggtcaaacgtgtggaaccgcatcctctccactccctccaccatttcccccacttttccccaatttttggcgccaaattgaacccctctactccccgcttcgcccacgtcgtcgtcacccacgtcgccggccgttgccgcctcgtcccggcctcctcgccacctcctcaccctataaaaacaatccccatgcctccctctctcttttccccttttttcccgagccctccgcatcctccctcgctctttccgcgccgagcccgtgcgccactgcattccgacgagctccggccgcctctagccaccactcccgtcgctgccgcactgcgccgccggccccaatagcttcgctgcgtcgtgccgcaccccgtccaccgctccccttcccaatccattgtcgaagtctaccccggcagccgctccattttccccaatagccaccggaaagccgccccaccgcaccaccaacctccgccgctcgccggcgtcgttcagccgcccaccgccgccgttcccgtcgccgtcgcgctgccccgccaccgccgtcggcaccgctgcgccaagctccacctcggcctccactatttccccattccagtgccggagctccgcttccaccaccaacccgagatcgccgtcgtgtttgctgtctccagctgtgtcgagccgcctccccggtcaacgtcgacctgcgtcgtcgccttccccggcaccacagtcctcatgtgtagctcggccacccctctgcctcttcgaatcgtcgccggaaccgggttcccttcccgcgccggtgagctccactaatttccccgatcttcggccggctttccgcgcctcctattcctcccctagtccctcctccttgttccccaggttccgtcggtcctcggccgcgcctccgctgtggtcgggagtcgccggagcgccgcctcgcctccatcatggggagcccgccgccgccggccgtcggccgtcgccatgccccatggcggccgctccttgtcggtgccagctcggtgagcaccctcctccctcctccttgccccctccccttcaccgctccccgcgccgcccgccggtcgccgtcgctggtggcctcgcgtgccgtcggtccaaggctcagctcctcgtcgcgcccgtgctttggccgctcgtggaccactcctgtggtccgggtccacggtgccgctaggccgcggtggaccgagtccaccgtgcgccctccccctttgacccgctgacgtgtggggcccgcctgtcggcgctggttcaccttgctgacgtcagcgaatgccttttcctttgagaaaataattaataaatgcgtcatagaccgataatagttatagaaattcaattaaatggctcaaaacttctaaaatttatatctaattcatccgaactccaaattgagccattcaacttgcaaaattcatctaaaattgagctctacatatttgtttacttttatatactatttccttggtttttattagtgtttttcctcgttttgcatgccagcgtgtagtttccgtcgtttcagaagtccgcggttgtgaggataagagttcggaagattgttcgaagaagcaaggcaagtcacacattccccttgagcattttgatcctactttacaaatgttttaccgtttgcaaataaatatgcatgttttgctaattacatgggatcagaatttacctatctgctcgcttgtgccatgtttacttgttatctgtcccttgtcaaccttgggtgataaatcgactagctcatgttacttatgtgacacagctagaactatatgctcagccatgcttaattgccactagctcagtagatgggataattgcagtattagacctttttagtatcagaacgagctgcgtgctcgagacatccggctatgtttcatggccgtaattatccaactaaaatgcgattgaatggtgggctgtgggtgcatggttttgcgagtcgcacccatggcaattaaggaccggctcatgggaaaccctggaagactaacagtgcttaccacaagcgggagtgggtaactacttgatctgaagtatagctcgaccctttcctaggcaccggtggcgagggtgggcgtgatggagttgggtcggccggggtgtccggttgtccagctgccgaattcaccgcggcgcatgaggggactacccgttgccttgcgaggagtgggggtgaaaccttagcgtggtgtggatggttaggggagagttatatgaaggatcttgtcacaatcactcgatgtggtgatgtgttcatcatgggcacatgatgacacggtgacatgccggtggattgtgttttgtgggtacagttgtgcacctctggctagagtaaaactattcgaatagccatacccgcggttatgggcgatcgaccagatttactgtgattagtctcacccctaataaatcgacccaatgcactgtagttcaggtgggttggttgggcctgttcaacgtggtgtagcgttgataagtgaagatctaatttactttaattaatcaactgttttactgttttgcttaataaaaatgttttacaaccgcctttatgcaaatagccacaaacccctctttgtgtccccttgcacgaatgcatagttggtgtggcttgctgagtacggtggttgtactcagccttgatattgtttcccccttttcagaagtgtagtgcttctgagctgaagacgaagttagaggaccaaggcttagaccccagttgagttttgcctgtggagtggagctgaagccccgctaagatcgcctttttccgctgctgctgctttcgtttcggtgtaaggactaagtgcctcttctgtaagtattttacgctttatttacgtttggaactgaatattacttgtcgttttgtataccctggctggttctggacagggatttaatacacaaaagtagtctggaaatttgggttaaatttatgggcatgacaatcgccacatagcattatctaatcttaccgtcgattttcatttaaattggtggcccctatatttttttaccattagattagatctgttattaaaaaaataatacattcctcccacacaagaaatatataactgtttgtactacgtacgattcaaaggaaaaaaaataaagcttacctactgtgccgcaagaaaaaacaaaaaccatatacatgtacttatatatacgatatatagaagaaaataaagccaaagaaacatatgtacgtgtactatcgttggaaagaaaatcgacgggatttcctacaatttttttaaaaataaaatatatctatctatctatctatctattatatactaaaagtccattaaactttctacaaacgctctcgaaccgtcacgtgatgcactaataaattagagaaattcctagaaattctaagaataaacaaaccaaatactatggggttccacctctcctcttctctcgggcatgtgtaggtatactaaaagtacattaaacttcctacaaacgctctcaagccgccacgtgacgctctaataaattagagaaaatcatagaaattctaagaataaacaaacaaaatactatggggtcccacatctcctcttctcccgcgcatgtgtaggtatacgtatgtacttacattcctcgcctcaaccgccgccggccatcgccatcaaccgccacggtgtcgtcatcctcctctatggtgtgtcgccgatctgtgtgctaggatggtgtgctaggatggtggatcgattcagatccgaaaaaaaggaaaaaatgaagtgggggcgagagtggttggttgggtacgggaaaataaaatatataccagaagtagagaagttgttttttattgaagtaaatcatttactccgataatggtggaagcacgatgcgggacgtggggtgggatcagaagcaggggagttgtttttattatcgaagtaaattgtttactctgacaatggtaggagtgggatgacgggacgtggggtggggtgggcctgggctgatgcatgtttggcgcttagaatattctatatttattatatatatatattataatagaaaaataaggtcaaagatatattttgtagaccgtgttattgtccaaaacttcaattagaatgaaaccggagggagtaagataatttccacttaaaccgtcatactcattactttgtactattattttcaaataatacactattttaaaataaagtttatacaattatattgtgtacctatcaaataaaaaatttaagatatatattaactaatttatacgtgcacttaaaccggtgaacccattatttaaatcatcggatcaatttttattacattggactatcattctcaaataatgtactgtttcaaaacaaagtctacgacattatattgtgtacccactaatttacacttacactataaccggtggacccattatttaaatcatcagatctattatttgctaataaataaagcgtccaaagttccctttttggcccgctgcacaatacacgtctgctcatttcccttttgcacacgtgacaaagcatcgtatctgaggcataaggtgatcacgaccgccgtagcactaccgctttgctacatgtcaaatcatatatggagatgataaattttgttaataacatgaaaagaaaattaaaggtgtgatgtagcgagagaagaattaagcaccgtgggttgtgttattaaaaaacttagctccatttaagccgaaccgatagttgattacagaataattataatgtattgtagtattgcgttatgtcgtattgaattttgtactatttgttcgtacaagtgaaagaaattattatattataaatgtgagcacaatattaacgaatatcactagaactcttataagacaagggagtttaagaccctctttttttcgactccatagtttggattttcatttgcacgctttccaagtttctaaatggtgtcttttttaaacaacattttaacttttagaagtcaattcattcgtttataccctcaaatagctatcatgtaaatcagataattcatcaatttcaattgtcctagaccctaagtagtacatatttttttcatgcgagtcatggtgaacagtaaattggggatcaacggatacccaaaatcataagatgagtatgtaagagctactatgaacaactgtaaataggtgccaaaattaattgcgattaattagatatctaatggcttgctagccatatactacctccgtcccaaaataagtgcagccataagtttccgcgcccaactttgaccgtccgttttatttgaattttttttataattagcacttttgttgttataagatgataaaacatggatagtactttactcgtaacttatgtctttaatttttttcaaaaaaattttaaataagacgaatggtcaaagttgggcgctgaaaaccatggctgcacttattttgggacggaggtagtaattaatttctctctacattcatgtatataaacattgacgaagctagaataaatattaccatatgccccacatatatatattacgcatttaatattctaattacatgtgttaagtcctttaaaatttcttaaaatactctccgtggtgctctaataaattagagcaaatattaaaaattctattgaaaaaagcaaagtatatattacttaaatcggtacgcctaatattataaaccgttagattaaattgatcttagaaaaaactaaatactacgaggtcacacctctcctctcacggcataggtgcgcacctacatacgtgggtacatacacttcccctcccttttttcattttcccatttgttctttctttttcttttttcattcatacacttcctttccttttttactatatcatgcgcctttatgagacgatttaattataagaattttgaatatattgctctcgcatttttcatttttggacatactacgcgatatgtatatggatggattgtatgatatataattaactagcaatttagtttgcctttaatctatttgacaaagttttttaacaaacaataatcttacctttcaataattaacaataatataagtgcccaagcatgcgcgcgggccaccttcctagttaactaaatgagaatattgaaatcctactattacgaggaagagccttataagagctgccaggaaacaaacatagactgtccacatcttgatagggataataattgcacttgtatgatttgccaaattttattagaggatttgactttataaattttaatttctaaatattaattgcatttatttgctttggtactggcaataaattaaagaaacaacaaaaatcatccgcagattaaaaaaagatttaaaactttaagttctccaactttaaattcacaactttgaggttgttaccttcctcttctagatctgcttccgtcgcggggcaacgcagacgccgaacagccacagctcgcacgcgatacggacagccagcccaagcgcgagcaacaactgatcccttgttggctttgttgcaaactgtcctactacacctccagagcaaggtaattagtatagagataatatgtagcatcattttctgatttgtagtatcataatatcggggtacaccataggatcgggataatattagattttacaaagtacatatttttatataaaatatataatatgtggtataaattaaagcatatataatattgattttgataaatttaattggtttttatgtaaacttaagcacatttgttcacagtatttttaattcaccatattttaaataatatttgatgggatcatagggatcgtagtatcggatactatctaagatttcttaaaatttgtaaaaatgaagattaagatcaagatactaaaaaattaggatatcagatgggatcatcattttggttttataggattgtagtatcataagatactagaatacggatagaagaatacggatagagatactaacaattttgctccagagatacagatatgctcaaattgattgcgtttctgacaattccgagactcaaatcaacccgagtcaggatctaactagtcatctccttcacctcgtccaattactccacgccaagctaggttcgttattaagcccgtacaccccatacttcccatccatccatcaatttatgtttcctggaccttgacatgtcgatcgctgctgcctccgaccttgacgcctcaacatacgcctccagcgtccttctcctcgtcacgtatgaggttcatcgtcttcaagctagcgtggcgacgagcttggccgcacaggcttggctcggattcagtagcggacgcagaatttcagcgagaggtacagagttactcaagcaaaagcattatccaatgagaaaaatatcaaagtgctaatatgtattattagcgcaaatagaaatcattattatatatagaaaaattataaaatagttaagggaaaatgataataatcttggaaaggataattacttacaaatgattgttttgatgacttaccggttaggtacatgtataccaaacatattaaatcacatttgtttgaaaaaaaaattggggtacaactgtacacccatctcctagtgtaggtacggccctgagcccattggtgatgatggatgggtgctcgtcatgtgcgggtgaaatgtataacatgagtaagactcatcccatacgcatccgcccatgtctctccaaagaaaaacaaggctcatccagaatcccttcaatcatcccatcccatccatccttttctctatcccaaccttccaatcaaatacaagtttatagttaaagcctcattctctttgcgacacgtgcggaatatcctccctcctgttctcatcaacagagaattgtgtttttttgatggcctggaaaaacctgtataataaattgtaatatgcttttctaaatcagtatcaccacttattattatatgaccactatctagcaattggtatattcttatttttctgtgcttaccattagccacaaactgaaagtatttggtattggaatcatcttccaacaagtcctttactttatcacgttggtaccacttaatctcctcatcttttagaagcatagctaatctattcaaaaactgctttaa

SEQ ID NO: 74242 - DNA, 17487 bp, Oryza sativa
gctttaaatctaattcctcttgtgatagtaaatttattatcagtgtattaccataatatctacacaaataatagtggcaatcgttgtcgttgtaccaggttggtgatgggtggtaatagtggtgtggtggtggttgtggtaggtagtcaaggttacggataaaatatactctctatcttaggaatcatcagatatacggatacgttgtatcctcaagtataagaaagtatccatttgagttaaggaaatcagtgagttcttatggagatattctttaaggatgggaaatatcagagtactattcggaggggataaggaatgtatcatatcgtaaggggtccgttgtctctgtgttctggagagcaagatgatctgcggtataaacacatacctgtcagggttatggacccaccacataccatgtcctatacggaaacaacctgcggatataggagaagttacggataagaaaagacaagtagagttctacatggaaacgacaaggactactcggattgtatccatattaggtttccctagttctacttagacaaagggacacctatgggtataaatataataccccctaagaggagaggggggagccaccacaatcaacaatctacggaacaacaaaagccacaatgtacaagccagcatacgccaagacaagacgccggatatcgacttcagggataagcacggctagtcccctacggtgtctccggatactgtcaggagagacgaaagcgttatctctgatctcgccggatgccgattcgaggaggaaggctaccctgttgtcgactatgagtcagacctacagaccgccatgtgacaacagttagataggctatcccaaatattgtactggtgtgattatggtgaataagatcaataccggctttgcttaacaggatatagagttattacctgacaattcagggcccgaacctgtataaaaatcctcgtctatgtctcttttacctcagtctcgcgtataccctagtaccaacgatccccatactatgcaaataccggaatcgcgacatcaaacgtcgacagatttatattgaaaaaaagatttatgtgttggagacttcagtgcacaagcgttggttttcaggagaaaaattgcgtgttccagagtgctctatgtgtgtcgtgtgactcgtgtcccaacgagatcggaaccatcgtcatcaacaatttgatctcgcgagatcgaccaagcttcaggaaatcgtcgccgcagagaatcaacaatattcgctgcatacggaatcgatttgatatgagcctgttctggatcgggatcaatcagtgctccatcttccttcgtgcagagttgctgatcaagttctccgcccacgacatcggctggtatggctggtgcaaaagcatcagcagcccaggccgaacacgacgccgtgtccgagccgagcacagtgcaatgctacatactgcacggggactcgttcgagtacctatgcctttgtattactgtgttctaatcggagatgatcaacagagggtatttccctaatcacgtcacgtgcatatgcacacgcgtgcgagcatatgacgggtcatcatgctccacaagaccaacaaacaatcaagtctaagtttactgcatacatgtgtcttctgcagtgtgtagtagacactaacaaggtaattagtagattagattaatctaattaatctactaatttcatatatatatccggcatatatctacacaggtacgcaatattttatataaaatttatcgtacctatttttttagacttatacagcattgtcagatttataatttattatgtttacctagagcatgtttttatataatatctattgcgtgagtgtccccgatgttaaatcgactacggtctaacgctgggggcttgctctattctcttctgtatgaatcatgtttgtttacggtttacataatacctgatatttacatctgctcgttatatcctgataatactagaagatccatgcagtttttcgaatacatactcgatattatctgctatatgtcttgccttctagaaaatatttttcaggaacaattgagcactcgagtaggttgtggtcaagtacaccgcattatcgagaacgatctcgacgaatgcagagtcgtcgcgcccaacctgccaacgaagaccgacaacctatctcacagcaccggccatggctggactactcgagaaaaggttgttaacggataattcctcgcgaacgctgtcggcttgatcacccgacatgattgcgaacggacatccggatatgctacaagttgggtgtgtaagtcatgttggccacatgagatgcacatgtaataaaccaactatagcgcttccattgatgttcgagagatgattctactcactcgctggttctcgaaccagtacgtagcaaacttccattggtgttcgggagatgattctactcgctagctggttctcgaaccagtacgtagcaatctcctgcaccacaaacttccattggtgttcgggagatgattctactcgctcgctggttctcgaaccagtacgtagcaatctctcgcaccgcaaacttctattggtgttcaggagatgattctactcgctcgctggttctggaaccagtacgtagcaatctcccgcaccgcagcctccattggtgttcgagagatgattctactcgctcgctggttcgtgttcgagagatgattctacacgttcgctggtcctcgaaccagtacgtagcaatctcccgcaccgcaaacctccaatggtgttcgggagatgattctactcgctcgctggtcctcgaaccagtacgtagcaatctcccgcaccgcaaacctccattggtgttcgggagatgattctactcgctcgctggttctcgaaccagtacgtggcaatctctcgcaccgcaacttccattggtgttcgagagatgattctactcgctcgctggttcttgaaccagtacgtaggaatctcccgcaccgcaagctccattggtgttcgagagatgattgtactcgctcgctggtcctcgaaccagtacgtagcaatctctcgcaccgcaatctccattggtgttcgagatatgattctacacgttcgctggtcctcgaaccagtacgtagcaatctctcgcaccgcaatctccattggtgtttgagatatgattctacacgttcgctggtcctcgaaccagtacgtagcaatctctcacaccgcaacctcagatggtcgagatacgactacagcaataatgcagcggtcctcttaccacgacttcaaatgatcgagagacacctactcactggttctcaaccagtcaatcgtagcgatctctcgtacatttacttctagtggttgagttacgactactacctggttcttgaccagaggtgtagcgattctcccattacctctacttcaacaaagttgatatcaagtacacaatatcgccaagtgttttacctagagatcccttaccacaaagacacctagcattgaaacctatcctaatgtccctttacgccgtcttgacaaggcctctgaggaacctaagggaacttcggctggggacgcccagagtggataaggccttgtcggatcctttagagacgaaagaccatgtaagatctggtcgtgtaagagttctcgtcgtgcgtattaaccaagccgtgtaatcggaaattgggttttccaacttcacggctgggggctaggatcagtgcttgttcaaacgaggcaggtcaaaggtccaagagccttatcctccaagaacgattctccgacgacaaggctgggggctagggagagtgtataactcaacaaactgactgatcgaagtcgataaaagagtagacgctcatatacaaaacattggtctgtaagtttaattcattttcagttttccatacatattataacatgtcaccctttgagcgttcgctcggggggctatttctatctaatattcttatctgagtattgatttcaggaaaattctatttgacattatcgaagacttcatgtatctattgttctacaccaaaatcgactaaggcgagtacgacaaatgttgacaagacttcgttgcagattttacgccttctcgatcattcgagaaaggttggtggatctcggcaaggaatacggaatgaaaagatggtgtacccgccgagataaaatttcttgacttcaatccaaattctcgattacagcaagacgggagacttaattgtatgctctgtactttcttggttgacgtcggagattgactcagacaaaccctttaggtgcccgtacgaggctaataaaggaagtctaacattatctctgaactcaccgagaacggtcacgtgagctcgataacagttactccaaggtctgcagttgagaatatgaactcgctcatttgcattaaagtcgggggctactgtcagggttatggataccacatacctaatagtagttgactaaatctcggcaggacccaccacataccatgttctatacggagacaacctgcagatataggaggagttccggataaggaaagacaaccagagttctacatggaaacgacaaggactactcggattgtatccatattggtttccctagttctacttgaacaaagggacacctatgggtataaatacaagaccccctatgaggagaggggacatacccaccatagacgacacggaacatagatcaagacagaagatcaacatacaagcttacatacgccaagacaagccgccggatatcgacatcagagatatgcctggatcgaccctatccggtacctacagaggccggctatagggatctagcgctgtctttgatctcgccgggcacgaactcgagaaggaagactaccctgttatcgactacaagtcagaccttcagaccaccatgtcgacaacaattagataggctaccccaaatattgtactggtgtgattatgatgaataagagcaacgaccgtctttggctaacaggatgtaaggttattaactgacaattcaggggcccgaacctatataaaaatcctcgtctccgtctcttttacctcagtctcgcatataccctagtaccaacgatccatatactatgcaaataccggaatcgcgacatcaaacgtcgacaatacccccagggaggtacagggcatctaatcttagtataagacactcgccaccacaagcaatctgaagaacttgaagcctgctcgctgatagatctcgtcacgagtacttcttaacaaggatctcgtcagtaatctcgaaattcagttgttctcttttatactctgtagttttctctataatcccatataaactggattagagctattaccttacgagatgtctgaaccggtataatccttgcttttttgtgtgcttgatgtcgtatcatgtagatcctcgtatcaatgtaccccaatactctcagaaaacggttcatgggtatccccgtcgaaagtaatggtaggctctgttagtaatggtggcattggtagtattcgtttgttgtcgtagtagtggtggtagcggtaactgtaaaaggattttcttaagaggatttcactttataaattttaatttctaaatcttaattgcattcatttggtttggcactggcaactataatatttaaagaaacaagaaaaatcatccaaagataaaaaaaatatttaaaatttttaattttccaactttaaattcacaactttgaggttgttaccttcctcttgctcacgcgtgatacggccagccagcccaagcgcgagccacaattgatcccttgttggctttgttgcaaactgccctattatgcctacagagcaagctaatcagtatcgagatactaggtatgattgttttccgatttgtagtatcatagtatcggaatagtaccatacgatcaagatactatcagattatcgaaagtacatatttatattgtataaatcaaagcatataatattaattttgataaatataattggtctttatgtaaacttaagcatatttgttcacattattttcaatccaccttattttaaataatatttggtgggatcgtagtatcaggatactatctaagatttcgtaggattgtgtaaaaatgaatagtataataattaatcgaatattacgaaaattagaatactaggtgagaacagcggaggagaaaaaagcgttcatcaatcaattgcacaagaaaaagagggtctaggtagcaatgtacttggggaaagcgatgctcacgcaccaagacaaaaatgccctaatggtcccttccactttgccgtaagtgttacttccatactactgtttccataatacaacatcacctgtaattctctgcagcgaccactacatactatttctagtatatccgtgggaccacttggtcgtcgtgcttgatccggcacattatgccgagaagacattcacggaattccttgtgttgttgaacttgtaagtattgttatacactacgcaataactattggctcttgtactcacaattgactcaaacaaaatttttggctacatagagcacacaagtattacaaagaccaaagcggacgagtaaaggatgccagtaagagtaagcttctcgtgaagacacgatggccggtaatgaatggtatgtccgctatagtaacattttttatacttgttagattgaaatattgacgtatacagaattttcaacacagtgttgcaagcaaccaccaggcactaacttatgtggatactacatgtgcgagatgcttcaaattaatgggaggtacacaatagagtttgcagatatgagtctagaaaatatcgtgtacacattaacatattcaataatttaatttccctaactttcaatatgtatttttcttaaacagatcatgtcaattccatgggtagcaaacctgttcgacaaaaaaaaccattctcaacttgtgtgcagatatttgtcgttacatccgccacgatgtttgtaaccatttgggcgaattctacgatccggagagcgaccttgcaaagaatgacgctttcaaacgcctaagagagtgggagaaagaatttacgtgaaaaaacaatttagagacataaattgtatttggttttgaattattgtaaattccaagacaataattatatatatatgtgtgtatgtgtatatgtctattacatattttatgtgaatgtgtgcattctactttcttatttatatcataatgtgatttcttaattcgtgcgactaatgacaaccctgatatgtagaacgcgtaccatttgataatccggtattgctaccggttgagataggacgagatactcccaaacgcctaggttattgtatatagtgccgcacgggataatacatcttcccgtgcggttgggtcaatcgcatgcgaaaatttgattatcgcagaccttctcgggcgggcgtgccggccttccgcacaggaagatgcttttcggtccacacgcaaaaaccctttctatagtaggataagatcagtatcgtttctgttattttggttttgtaggatagtacgatacctcacatccatccatcaatttatgtttactggaccatgacatgtcgatcgctgctgcctccgaccttgacgcctcaacctacgcctccagcagccttctcctcgtgacgtacgagtttcgcgtcacgaggttcatcatcttcaagcgttgtgacgagctgggccgcacaggcttggctccgattcagtagcggacgcaggatttcagcgagagatgcagagttactgaagcaagaattatccaatgacaaaaatattgaagtgctagtatgtgttattagctcaaacaaaaatcattattatagaaaaattataaaacatctaagggaaaaagaatgataataatcttgaaaaagataattttgtacttacaaatgattgttttgataactaaccggctgggtacacatataccaaacatattaaatcacatttgtttgaaaaaaaattggggtaagctcctgagcccattggtgatggatgggtgtttgtcatgtgatgatgaaatgcaggacatatgagtatgactcatcccatccgcgcgtccacccaaggctcatcaaagaaaaatcccttcaatcatcccatccatccttttctctccaatcaaataaggcctatcccaacgaccttccaaccaaatacaagacaataacatctcatcatttcccactttatgttgaaatcaaacatatatatacctaggatacacatgaaccttacaaaagctcctgatgttatctgtttgttccttaactatatgtagtactatagttctcactccatgctattggcctcgtctacagtagttcactgtcattagcccatctaaagcccaatcaatccatctgtggctggtgctctctcttctgtccgtatgctagcttcgaaagaactacactaatattgtcttgttgcctaatggaatgagattgcaaattaaacttgcattatttggatggactttaagttcaaggttatcagtgtgttactataatatctacacaaataatagtggaaattgttgttgttgtactaggttgatcatgggtcctagtagtggtgtgatggtggtggtggtaggtaatggtaggttattgcagcaatggcggcattggtagtattcgtttgtcgtcatagtagtatagcagtagcggtagccataaaagtaataatattatctattagtttaaaaatataattacttctccacctattttctcatcttaactaatcccaattatatactatttaatttctcaacttactttttttcatctcactactacagacaagattttttcgtgcggtggtccggcctatttgcacccaggtgtctgtgaaaatcattattttcacgtgcgggtgggccgaccgcacaggataatcgattatcccgtgcggtcgtgttataccacccgtacggaaaaaaaaccaaaaataaaaaaaaacaagaaaatcgccgccggccgccggaccgcacccacccggccgccgccgagcccgccatcgtcgtcgctgttgagcccgcccgccgccgccatagttgtgccggccgccaccgccgccagatccgctgccttgacgatgcacgtgatgactaggaggaggacgacgagcgcacgacggaaccttgccttgccttgccggagcgcacgacgtctgttgccttgccttgccttgacgtagccgagcgcacaacgaggacgacgaccaagaggaggggaagcctggccgccgccgctactgccgcctcgctactcgccgccgcgcccggccaccgccgtcgcccaggccgccgccatcgccggcccaacagaggggaatgggaggaggggagggggaggaggaggggaagccggccaggaaggtgtgggggaggaggtgggaagccggccgggtgtgtggctgggagaggagtaaaaggaagagataaggtagagagagagagaggggagtggttgagggagaataaaagggaaaaaggaagagagagatgggaaaattttgaagtgggtgagagggaaaggacggaggattatcccgtgcggttggattaggacgtccacacgggaaaatcgattttcccgtgcgggcgacagcccagcgctggtccccctattttttcgtgtagttccacttacggaccgcatgtaaacaaaagggggggcgtccaggaaaatcaatcctgtagtagtgtcttaaaccaatcacaatcattccctatttaatttcagatactttttataaatccgtcttatattttaggataaatgacacattttattcgggaatacattacacaaattacacattacacaatattctttgctatagcatgtaggggggtcgccatagacagtgttattccaaacttttctgccatgtctacgccaccgttcttcttcactacttcaggcagtgtccactgaaactgatgaactagcgaggcaagcataacatgcagcattctatttgctaccggatatccgaggcagaaacgtcgtccggcactgaatggaataagttccatgttggtactacctgatgacaaactgatctccttttgtaggaatctctctggtataaacttgtctggttcaatccaaacctctgaattctgatgaattgcccatgtatttactatcacagtggtttctttggggattttatacccttgtatttcaactgggacggctgctttgtacattagcagtggtatggctggatgtagcctgtgtgtttccttgatgactgcttgaagatagggaagttggtcgatgtcttcttcatctatgcaagtttttgagccaatgacctttttgagctcttcttgtaattttgtcatagtttgaggattctgcagtagctcggccattgcccactctattacagctgagcttgtttcactgcccgccattagtaaatcctgaaattggttaagcaatgtaagtaatttagataaatcgaatatcttaaccaaaaagtcaatctttacagaattcaatcttaaaatatatggttatttgctactgaacaccacgtacattaatcaaaatattcattttcgattgaataggagagcaaaaatagtgcgaaaggacaaatatgccaccggccttggtcatttcgctagctagtacatttgtcctttcatactatttatctctcttttatttaataaaaatgaatattttaaccaacatgatgtccctagtagtaaataaccatactttgaaagtatctttcccaaagatcaacttttagtgtccaaaagctaaaaccacttaggagccgtacgtgatgtcctcccgtaaaatttgcctttaaataaatgtgtaaataccaccaaacttatattgaaaacacacccacgtgcaaacagaccaacccagagaaaatatttaaagcctaacaaaaacctaggcagatgattatagaaatcaccttatgcataaaatatagtttgttctaaagtgttttcgctccttcaatctttatttttcatgtacctaaatagttgtaaaaaattttggaaaataactttgttagagataactctagccgtggtcactgggcttccgtccacccattatgttttagtgactacgaagtctaattaatgaaaagtagccacaaactgtcatgccatgattattactatcttctataacaatcacgttgtttattgctcagtagcatttttttgcctctttgtaaaacatatgtgcatgcggtgagaaaagttacttttgggcgtggtttttctgttctgaaagggtgatgaattatccaactttttataatatgttaagatacaataatcgaacagattaactattataaagttgtaaagtaattggaaaaacatccttaacaaacctatactccttttttaaaatagatgatgtggctacctttttatatgatatttaaccattcgttttattaaaaataaataaatattattttattatgacatgttaattatgtattaaagaaattttagatatgatttatattttagaatatttatactaaaatttcaaaatatggcatacagtcaaaatataattaaaagtaaactgtataatctggtaaaaaactgagatatataggatacatatacttacggccataaatgctcttatcacaccccggttcatggtgaggctgctgtcgtcattctgctcctctttctccgacatgtccagcatcacatcaagcaggtccttctccttctccccgtgcgcggcgccgcagccaccggccgtttcccggccacgcatccgccgttcgacatggccgtcgatcagttggtacatccacgtgatgtgcctcgccgtccttcgccgcaggccctgcagatcggccatggccaccaccgggaagaactccgacacgttgggcgtcatcgtcagcagcgcgaactcccgcgccgcgtcgcggaaccggcacgacgtcgcggcgtcgatgcccgccgagaacagcgccccgaacagtaggctcgccatggccgcgaacgccgccctcccgacgtcgaccaccgccgcgccgcctccgccggacgccgcagccagctccgccacgtggcggaggaggccgcgcacggcgtctcggcgcagcgggcgctgctcctcgacccgccgtggcgagaacagctgctcggcgccgagccggcgcagcgcgcgccaccggtggtggcgcgtcgggaacgcgaagatggagttgccgtcgtgcccgtcggtgctccacgcgtccggcgtgccccggtcggtgatgctggcgccgtgcctgtgcaggacgtcgcgcgccgtggccggcgaggaggccacgacggcgagcatcgtgcccaggcggagcgtcaccagcgggccgtaccgctcggcgacgcacgccaacgagcggtgcgggagctcaccggcgacgtcgaggaggttgccgatgaccggaagcggcctcgggcccggtggaagacggcggcgagcgtctgagagaagctggaagacatgggagcagagcagcaagagtgcaagtgaacagatgcatccgatgaagatggccattgatgaacgctggactttggagaatgaatgaacctgtactgccgatcgatctcgatccatatggaaatataaaagcattacccgttgaagagtatgcgttttatgatttgatgtgaagtgacaccgtgacagaaattaagaggacaataatttaactgaacattttcgcttgagtcgtgtactaggctttcatctgttggcctcttttgatggagaagctagcagccattcaagaattctttagctttggttcatccgttgctttccattatgtccttgcatggtaatacatgggtttcttttcctgctagttgatactccattcgtattttaatgtatgacgccattgactttttattaacgtttgaccattcgtcttattcaaaaaatttatgtaattatcatttattttatcgtgactttatgttattatcaaatattttttaagcatgacataaatatttttatatttacataaaaattttgaataagatgaatagtcaaatgttgttcgaaaagttaacggcgtcatatattaaaatacggagggagtaataaccttcattcaacaaaaaaatccctccttgccccctcagtgtcttgcagattttggacccttcaatagtcaacacctttaccttacctcccgctccgatgatctcgttgatctccggcggcggcaacggcgtagggaagaagaagagggcacaggggaattattcctaacttctccaacgaatcaaaacaatccaattaatggctcaatattcctaaaattttagagggaattttctatcaaatgtagagtaggcagtctttttctttttcacataccttcttttcctctgccgattttgtataatgtttgtgttcatttctagctatatgcagaagccatgagttacacttcttaaaccaagacaacgccacagttggttgatgtagcaatttcaaattagatttggagatagaaggacaaacaaataacagaagaatctatagagttcatttggaacagacgaagaggaacgatatattaaaaaagagaaactttctcatgtacaccagagtttggttcaattccatctacgtccatgagtaacagaccgtcttggcctctcggtttctgtgatgaactgataatgcacgtgattacctgttagctaggactgttcatcgtttagttaattttgtacaatttgtgctaaacagaagaattaatgtgacatactattacttggtattacgagaaatgtgaataatggatggttctcattatttagctctaggactttgctccagatagtactggttcttctgcatatggttgcttaccactttaatttgcaagaagttttggaagctgcctatgccttaaaaaaattatccgtttaattgcttggagatttatgaatgttgggaaacttttttttagcaaagggcacagcttcattttcattaatagaaatgattcgatgagaaacagaatggaaaaacaaaagaaagcacaaacaaaagaaagcaccccatacatgtatgtatgtatgtgtgtgtatatatacatatattcctctgaaggggactatttctcgagatgagaatgacatctcattctctgctccactattcatgttctggcaagacaacgtagaataaaacaacttttcccaacacaaagtttatctaaattgtcagcttttttttctaggcaccttgaacctaaaaaactcaaggggcactctcaaaacaacataaaaccagctttcattccatcttctcgacacttagagtcgattgttggtagccctcatgccaacacggttgtgtcttcgatggtacttctcctaacatagctgaagacttgctgtttgcaagagaagagttgtatgaatagggtttggccgggcctaagggcattcttgtcctcatgccgaacagtaaatagtgtttgcttgtaataggttgaagttgtcttttggtctcgtgtaaggtctattgtgtgtgttgtaagggttcttatcctcttctttcttctccttaatataatgataagtagctctcctgcgtattaaaaaaacgtttttgggatctctctagctaaacttggacttgaagatcttacttgtgacttgtctgagcagtcagctcgccctagcacaatcttccttgctttccacaattcaagggaacctataattgataaaatgtacagacatgttgtatatatgtgaaattgattaaagggagatatggaacacactatacaccacaacatcaaataggaagcgttgtcatgcgcatgggttccatgcctttgaaacataccttcatggtttatcatatatatatagttatggatggaaggcatccttcgaaacctctgcaacttttctatccaagataacacagctgtggcagataaatgctactgttttgcagcgccatgtttacaccatcatcatcttgttgctgccatcagccatcatatttcacaagatatagtagggaaacagtagggtggcaccacatcaaacaaaggagcagtgcaatgaatatacaaaacgtaaataacaattaaacatgatacatatacgtactatgttgtacgaaatttgaacaattgacaacttcacgtactgatgggagaaatctacactggtggagaaaggggctttactcctggttcgtaacccccctatagtcccggttttcaaatcgggactaccaatccgggactaaagatcactatctttagtcccgggtgaaaaaaccgggagtaaaaatccatttttagtcccggttggtgttaccaaccgggactaaagatagagcctttttagtcccggttggtagagctagactagctagatccggttgctccattattattttcttttcttcattatattgatttcaccccatccccttcccaaaatcccaaataaattatccccaaatcctcaactccccaaatcgatacatcacagatacatcacaaattttacaaaattcatcatagatacatcacattcacatcacacacaaatcaaatacacagatctgaatcacaaattctaaaaagaagaagaaaaaaaaagcccgttgccactgccgcgccggccgccagccgccggccgccggagcgccgcccgccgcgaggccgcctggcccttcgccgcaccgcccgccaccgcaccgcccaacgccgcgccgcccccaaccaccgcgccacccgggccgcagcaccgatcggccaccgcgctgcccgcgaggccgcttgggccgctgcgccgcccggccaccgcgctgcccattaggccgcccgggcctccgcgccgccggccgccaggccctccgcccgccggcgctggtagaggagaaagaggaaaaggaggagagaagttaaaaggagaggaggaagaagaggaagagatatggaggaagagataaggccagggaggagatagaatatattaactgctcctcctcctcctcgatctggtctcgtactcttcgccgcccatgttgcgcatgccgatcttttattccggttggtgttaccaaccgggactaaagataaaaaaaaactctatccttttgaaccgggactaaagatatctttagtcccggtttttattgcaaccgggactattgtgtattttggccgaccgaccaaagatggtttctccaccagtgctagttatcttttctgtgcatatttttgaaggtaattaattactatacgtgttcactctatatatcaagccatatgcatgtaggaagttcaatgttggttcagtatctatatattcacagatgaaccaaaatcttttgcctccatccattaaaaacaatataatccacaagatttttttaaaaaaggagtctgcagtgaaaaaaaaaagtgaagtaatgaatggtagtggaaaaaaaatatcatgaagataactttgatatactttaaccaacatagatcatagaggctgaattggaaatcaataggaaaaataagctagatgagatgcaataaccagattttcatgcgtccaaaaatccaccttgatttcatacatgagtctcacaacagaagttacgcatgcagtcattgaacaacaaaaatcatctaagagagtacaacgagtacaaagtcattgcaacaaacatattacatgtattatttgtatcaaacaggttcaaatttaacgaagcaaaaaatcacaaggcatccaatccctaaaaactccattgcaccttcatcattaatcttcagcgacatttgttgtagcatgtcaaccctgttttgctgtttcttcactgccttctgaaaagaagtgatgagaaatagtgtgatcagtatatatgttgcactcaacaagcaatttaattaaaactatacagttatatttaattctgcagaaactttgtcaaggatgttctatcagacgacacatgttactcgagctacagcaaactttttcagtagggtaaaactcccacaaacagtaaataatggaatattcatatatattgcagtcgcaatatgctttaacaaatacggttttatatgttttcttatttgcaagggagttttatgtacattcatattcctagatcagattaactgagtcccaaaagtaccattgagctaagttttgttacatatttacagcaaataaaataactatttctgaaacagaatggccacatgtatcttatagtaatctctaaattaatgtaaaaatggctcaacggacaatgattgaagcataaccgcacagaaagctaaaaggttcagctaaataacaataattcacatgt

SEQ ID NO: 74243 - DNA, 1481 bp, Oryza sativa
gtcaaccccaaaagcatgggcttgaccacatcaataaccttgataatcactacaaacaatagcctatagatgacaatcatgccacaaagtaccgcaagatccacccatcttgaatgacctgtttccacttgaaataactcaacaataactttttcaccactcactgtttcctgtcctcctaggttactttggaagactaaccctgagaactcattcttgtaaaacccctgcagtgcatacttgtgaaaggaaatgtagtacattgggtacttccatactatctttggaaggttattaggtatttggaagaatccactagtaagcatcataataccttgtataccagcacctgtgattatccccattaggaaatctggtacaatggttgctacgatcatcattagggcttcgactagcattgtgcatgcacaaagtactagcgcaaaatagacaaaatgttcaattttcccttgtaagccagtaagatagtatgcaattgcaccatgtactacagcattaaggagaaggtatggtatggatgacaatgtattggagatgacaaatgcggccacaccatagtgtccatttagtcttttcctgaagatctgagcaacatgagacatacaagagtttaaatttcattaggcaaaatttgatgcacaaacgcaaattcatttgataaatgaatgttttttctaaccagattgataaatgaatgttgtcttaaaatgaaatatttagttttggtcaggctgcagaatgttaggagctttattctaatatttttggttgtaagcttggatactttcctgtaagatatcttggtatttctatgcattttaggaaactaaacaacaagggctagaaaacaattgaggaaagaattgacaagaaactttgtagttgtctgtagggggggagattggtgttaattaattctgtgctttctagtttagccatgtttatcatatatttttttgagatttcaaaaggagttcttcaaaaaattgattattataggccacgtttcttttggcaaggtgatgagcataagaagaaatatagacttacaagataagatattatatgtcatcctaaagatcagggtggtcttggagttcataatttagaaaatcaaaattaatgtctttttagcaagttgttgtttaagctaattaatgaacagggtgtttggcaagatctatggaaaagaaaatatttgaataatcaggcttttaagtcaagttgagtggaaacaaggggattcccatttctggtcgggctttatgaaagttaagagcacatttctaaatatgggttcttggattgtgcataatggtcagcaagtgagattttgggaggataattgggtaggaaatctttttttaaaagataagtacccctcacaatatgctatagttcgaaggagaaactcttcgattgcaatattatggcttatgtttctctgaatgtttctttta

SEQ ID NO: 74244 - DNA, 9957 bp, Oryza sativa
tgccatataaatcgcagcttactgactcttactactgtcatcagggagctaaggtctgattttcttaagaaggaaaaaaaaaactctgggtctattatctcttatctgcactaatcttgaaagtagttgctgggttacctcattgcactcatgggttagtctcatttctaatgttatcagacaatagatcattggatcagatggattacatccttctctacaattttaatgctcttagctggtagatcattgaatggttagtatggtcaattatgggttgtatgctgatatggtgtatatttgtctgcaggattttttttctttcctttccctattatcattctctatggtgaggtatagctttttatttgtattttactcatttaggccttttgcgatagctatcttgatggaattattgtagtttccataattatattcagctatttgtcttttaaaactgaagctatgagcttagaatagcatagtatttgttgtcgaaaatagagatgatttcctatagcccactatggagtgatggcaggataggtgtggctctctgtttctaaccccagtcgtcatttatactattatgcggtctgtgtgccagcactgtagttagaaaggaccactcttgcaaggatatttctccactcttgcaaggaccactcttgaacgccaacggattaaattaaattttcatttactcgattttaatcgaacggtgatttacgggtttgctttggattggctagattgggaagaatgctctcgcaaactgtattatcaaattttctgggttacctacaggaaagcgaagtgtgggttgttcgtcacccatagggtcatgccaattgccaagattgatgttgggcgttcggtttaggctcatgttgttagtgtaaatgtgccacactgatagagatgcagaaagggttattttgtataaatgggagtatgggttggtcctgttggacagggttagtaccatcagaaaggattctggcagtatgtcaatgtaggtatcattaagttattttgcttttgaaagaggaaccacctgtcagggaaaaaagactggtgcatgacaaggggaaaaaagtagtcgcaaagaaaattcgcaaacgaagttaggtttagatgtaaaaccacaattatggtctctggttgactttactaaaaaagatgagtggttttgttgtaagaatgttaactgagatttttctatgtaatgcttgaagcaagcacatacacacgtgttggccgcttactgatatttgaagatgataattctggcattcgcgtggtggagttgtggtgaaattagagaaaatgttgattgctggaattgtgcagagaacagcttgtataaaccttcgggatatgcaagtgcattttcattttacaaacttatgtagccaatgtaacactggtgcaatgggtttattattattctttttcgcaaatctaaatacatagttatttaaggaaaaaaaactattggggcatgagtttcttttagtgtaaaaaagaaactctggttaaaaaacaacttttgaggttgagtaaatgtgatttaaataaaaattagcttggctgcattttcttgttagattgaagtgtttaatactgaagaaactgagcagccacaaggaggctccaatggtatgatgtttgtgttatgcacttatttttatccttcaatttgcatgtgttattttagagctgaactatttttcctgtcgtacaggtcaaataaatcatggcaaatactcaacaaggagtctctcatctaaagagtactcgcagctaactggatttaactaataatgataccactgttgttggcattgtatgtatatgttggctttgtatgtacatgtttttcaacaagacaagtacaaattagtgaatgatccttcatctctagccttgtataaatgtgtaatatatgaaatctgcatgtttctcgttactgtagcacaattgtgtacaggcggcgcgccaatggcgcgccccatcatctagtactcatcatcgtcggtaaaatagacgtgatttggcagcagggcagggtaatccttggtggaaagacaaagggtgccattatgcccaatgaacaatgcctcatcttccaaggaatcgataggcacgacatcttggctgtcgaagtcaaccttgtatacatggaatccaaccgtacgcagttcttcctcctcgtcttctggcaaatgcgtcaacctccagacctgcaatgaccaatattttaaatagcgacctaagtcatttaacagttagcttctcaaacagctatagcgggctaaatggagctataacggctaaattgcggattgggatttggtgacattgcgccggtgacattccccgtgacattgagtcactgacgtgtgggacccacatgggtccaggcatatgtgagtcctacatgtcagtgactcaatgtcaccgattatagcgagagatttaaaaccctgcctgcaacacgtcccccgacgacggcgtccaggccatgtacgcgtggtgcagcgtgtaccccagcgtgtcggtgagaaccaccgtgcgcgtggcgcgggaatggtggatgtcgtagcggtggatcccgcctaggaggttcatggcgtagaaggcgccgtcgcggtaggcgatgtcggagtagggagaccagtagtaggaggaggtggtgatccagtgccactgcttgtcgtccccgaccctcgcgaacgacggctgctggtagacatggtagatgagcagcacgatgcagccgccgcatccatcttctcctccttcgccgccgccgccgccgcggcggcgtgacgacgacgacgacgggtcgcacgacaggatggccttgatgttgagcaggtcgcagagctcgtcgggccggtagatgccgggagctcggtactccctcatgtcgccgtcgtagaaggagacttcgtacccgcggaggtcgccgccgtcgccggcggcttcgaggatgggcctcacctgctccagcgtggcgatgggcggcagctcgatctgctcgcgggtggccgggttcaggaggtgcagctccgagcgggcgtcggcggtgaccagccacccgtgcgacgaccccacgatgctgcgctccgcgatcggcgggtccgggagggtcaccgtgtagggcctctcgtcggcgaggcagtagagctcggcggagcgcgtgctgctgccgccattggcggcggcggcggcggggatgtacaggaggcagggggttcgagggaacgagtagacgccacggcggcggaggtcgagggcgggggcgcgccagcacgtgcagacggcggcggtgcggatgaaatcggggagctcgagcttgcagaggacggtgtctaccatgtcggccagcaggtcggaccagtcgcggccggctgccggcggcggcggcggcggcggcggtaactccattattacggaatttggattgtggccggcggcgatgtagcagatcgcgcggccgatccactgatctgtagtgatttctccagcaatggaattggaattggaattggtatatgaacaggagtacgagtcgacctactcggctgtttcgccggcgacgaaggcgtgcgcgagaaattcgtgggctttgttcggtacacgggtcaaaaggatccagggcctatacggcccagcaatgaacaggattcgtgggctttggggaattgaattgggccgaattgaagaggccggttgggcccaatatgccttgtagtatttattcattctgggccggtagtttcgtgctgttaattaatttcggaataagttaatttgaggtcccttaacttgtcaatgaatctgattttcatccctcaaccgaaaaaccagacacaacaggtccctcaactatcaaaaccggtgcagattaggtccctcagcggttttggctgacgtggcgcatgcgtggctaatttgactcggtcttcatctgatgtggcattgacgtggaacttacgtggcaattcgatctaagaaaaacaataaacaccatgggacccacatgtcagtttcacacgcattaataaaaatggtgggggccgcgtggaccccacatgtcactctatcactcttcttctcctctctgggactccaggcaacccggcagacgggtcacgccacgcacgatggcgtcgagcccgggggcggaccagggcgaaaggacaagctcaacctcggcgacggccacgcggtcgaccgtggctgggaagaaccccgtcacggcatcaccgagtgccacggcgtctagctccatcccgtgtgccgacgaacggcggggcgaaggcgtccctgacgcggtcggtgtcgccgaggcctaggttggtgctgatgcagccggccagcaactcggcgagggagaccgcctgcgtgatgtacgcgtccagggactccctcgccgcgggtgggatgtctgggaagtcggcggcattgttcttgtggcggtgctggacgaagtaggtggcctcccagtcccaatcgacctggtcggctagggcgttgtcgctgccgtcgacgaggacgtcgtcgtcgtcgtccttgtccagctggaggttgttggcgaggtcggaggcgtagaacttgttctcgagatgctcgtcgtagtggcgagccccttgagatcaatcaccggagtctccatcgctcccaaggctatctagctacttctagaagatttctactgatattttcatcctgaaatatactccctccgtttcccaccggccagaggtgaggaggccggcagtgaaggcacgcgaaagagggaggaggcggggaggccgacgcgagcacacggggagagggaggaggtggcgcgggagcaggccgaggcaccgagcctaccgagtccacctccgcgccgccgagcccgccgagtccaccgctgccatgtagcctcttctcccatgtcgccgcgctgccgcgtcgccccttctcacgcgtcgccgtgtcgcctatcgacggccgccggccaccggactgcattctctcccctctcctctctctccgacgcgacagagagggagcggtgtgtggcggcgctggtgggagaggatgccgtcgaggtcggagggccgcccgaaggacggtggaaacgggggcagggaccgcgatggtgaggtcacgctggcctcgggttaccacgcctctgccggcgcggcgctgccgacgtcgccgtcgcaccctggcacggcgttgtcggcctggtactgccgtcgcaccaacatcaaccctcgctgctgctcgtgcaagctccgccggcgggagatgaagcgagggaagatggggagaggagaggggagagagatgaagagagggagatgggggtgtgaatgacatgtggggccccggccccaccattttttattaatgcgtgtgaaactgacatgtgggtcccatggggtttattatttttcttagatcgaattgccacataagcgccacatcaataccacgtcagatgaagatcgagtcaaatcagccacgtaggcgccacatcagccaaaaccgccctcaaaaccgtcaagggacctaatctgcaccagttttaatagttgagggacccgttgtgtctggtttttcgattgagggacaaaaattggattcgttgacaagttaagggacctctgatgaacttattccattaatttcaatcgctcctgtcttcatgtcactgtgtgttattgtctgaatactgaagaatcatcaaatacgtaagcattcaaggggcctcaacgatgtggctttacaatatttttaaggcatactccctctaatatatgttgtaactattttttttcgacggattataatataaaatcggcgtattcatacatgcaattaattttcctgttccaaattattttgtttaaatataactcttaaccattaagattttaaattttattgggtacatgcattatacttattgggtttggtccaaacataatatgaaatgtgacaaaatcgtactataaatttggataggacttccatctggattcgtacgtagtactgaagatatgttacatcttatgctataatgatttattttaggatcaagaaagaatatatacactgtggtccatctatatataatccgatggaacctctcactcaattcaattcgccatttccatcaccatcaacacggagtaagggtcctctgcagtactcctggtgcatcattttgttattagtttatgtttaatactttaaatgtgcgtccgtatacatcaaaaaaaaattagaggaggaactaaacacgaccattcatgctaacgcggtctaacatatttaatgatttattgttccatttttagaaggtttcgatcttcctcctttattattgatttggttagaataggattcttgtgttcaaatgtgttcgatatgataatcacggccacttcatagaactacgcggcttatgatgatgatgatgttgtgaaagtgtattccaggtattaagggttttattatttttttagtaaattgcatcaatagtacaagaacttggcagatgggtacgatttagtacaataagttgaaaaatatgcagaccgatacataaacctggcaatcaagtgcattttggtcaaaactctgttacatacaaatgattcaacctattttgtttgatctattataagcataactactagattattagtcatgagtacaattgaatatgtttgactaataaaatcgcttggaaattatgttacaataatttttatgcacttagttttaacaatcattatatttttcggtttcaaatcgacattttattttttattgtaagcaagcaaatacaatacatgtagaccattattatttgacaatcattatgcttattagattattggcaacggcgactgctttttttactacgtggtttaaaaggtgtggtgtctaatattgatttttaaaccaaaatgcacgtactagccaagttgttgcatctaaatgatcatttttcaagttgttacactagatcgcacctacctaccaagtttatgtactgtggacgtaatttactctattttttctacttaagaaaaaacctacatgtgcatgtaacatgcatgcaaaggtggatctaggctttaggccacccgggccacatatcccaaggcctgcgaatgaaattattagttttttcaacatgttgtttggaatgtgtcctatttcatggtgggccgggctcaggtgtatgacccaaacatagatctgctcatgcaaatacgcatagttgaaatttatctcaaaacaaaactatttcttctcacctatttccttaattcgcgtgaaaaacatcaaaaatccttacagtatgaggaggaatatgaagcctatcctaatgttcacatacaatgaggtttgactaagatttcacactgcaacttggtgcaaatttgctcaaatttatttttctataccctagctagtgtcatataaaagtagtatgcgctaaatttggtgcagatgagactaatttatgttaatgatgataaatcatccatccatagtactacctctgtttccaaatgaatgacattgaataatgcaattttgaactaaccggcgtcaaacaaaaagaaacagagagatacttattagcgctaactctaaaatatttctagacataatatatgacatcataacgtgcataaaaaatatttctagacaagctctaaaaatgcatttttcatgaggctcacatgtcacaccaaacatcacaattcctgaagagagttcccccgtacacacacacacagtagtatataaaaaaattaatgatgaaaagcacagctagaaaaatattaaaccacatcttttgtcggctgatctgaccgtacatccgatgataaggataactcatatcaaaatcacgtgtatgtaagcataaaagaaaagtatgtttccatgatcgatcgatccaggaggagagctagcactgaacaaagataggaagagagagagagagagagagagagaaagagaccaagaggtggttgcatgcacagtgaactggtccctgggtcccaacccctctgtactgtgccctctgtcctttgtaaaagagaaatgagagttgtgcccatgcagcagtgcccatatcatgaggccatcatcatggccgatcttttgcgtcagtggcataggcacacatgcaaaaaaatgaatggtgacagtagagagagagagagagctaaaggggggcagggaggggtataagatgtagtcagcgggtatggaccgacatcactcgtcgtgtatcatgtatcctggtgaccagactagctaattttgtagagacccttcctcctaaaataaaattatttttatcctctttcgtttatttagagtttgtgtaggtagatgatgataaacacattggaaatagataaggtatgagacagttgtattaaggtttgataaagtgaggatatcgtaatctttttgtttctgtattagtatgtactggataggagaaaaattaatttattttggaatggaggaaatgaaaggttatacatatatatgttaaccgtaaggcactaatgcatgttatttacagtgtgttgtgggcttgtagccattgatgaccatcaaactatgattttaacagtctttaaacatgtgtatcctttgaactaatttgttgtagtttcttggaggcaaaggctaaaatgaattctattatataaaagaatcgattagcctaggcgattgctctttggttgggttttgggtccactcataatgttgtatcctgtcctgcatatattcctctgtgttgggattggacatgtgaatacccatttgctttcgtattgcattggaagttttgggagtaatcataaggatgtagggctacgttgtaagatggtgaataaactgcactccataatacatgtttacttgctcatgaaggcaatatgtcaacttattttttcacctcttcctcatgttgccaatatttaagcacatataagttaaaccacaatcattttctatacatgtcacatttttcactaaggtggaatcaaaatcagatatagaaactactgaacaagtatgcctccattattttttaacaaaagctacaacaattattacatagctcttggcttgaaataagatacaacaatatctaaccatggatgaaagaaaacacattaaagagctgccaacaataagaaagagatacaaattattcagagagcaaatttaatctacctctattaaagggcatctcgagtggaggccacacctatagcaatgctctcacgtgggccatatggactaagattattcataagacacccatctttcaatggagggcactctctaagacaacaagataaagagggcacggtctacgcccaacgcatggccagcaagccgtggcttggcgaaaagcggccaagaacactaaagccgcacatacgtaccttgcctgggcgtcacgtttctttgcaggggcacagttccaacttggaaaatggtagctaaacaccatgagcagagctctgatctgaaggtacgcattgaagatggcctaatttgctccatgcaactttgatcgttcaaactatatagatccaccccaatttgtatccctatatgtgtgggagcggtgacaaggggcctaggggacagcagtgaagtgaggaggggaaaagctcatcaatcataaagcaatggattacagaatcatttcatgtcctttgctggtcctttcatccctatgttaacatctgagatcttgccctttactcctgcctcaaggcagcaggcaagcagcagtctgtggcctctgtgtatctatctgtgacaagtccacaggagtccacacacatatgcatctgcatcaatgcattcatgattcactatcacaat

SEQ ID NO: 74245 - DNA, 7007 bp, Oryza sativa
cgcctgtcagtggcgcgcgcgcggggaggaggccgatgggccgcggggaaaggaaaaaaaggaagggagagttgggccgagccggcccaagagaggaagggggggaaaagaagacttttagagatttttctttttataaaccttttcaactttgtttatttcttctcaattattatttgtgctctgaaaattccactaaaatttgagggctccttttagaccaaggagaatttaacaaaaattctccgggccacatttgaatttttcttgtacgtattttagtgtttaccaatttcttttcgaattttaactaattctattattccttttagagaatgatttttaatttcgggatgaatttatcaggacgtgacaaatccaccccccttacaagaatctcgtccccgagattcgaggaggctagcaagaagataggttgggcggtcttctcttcttgtctgacttcttccgctctggactgcttggctcgatctcctgttgcagaagaaatcttctcttcacccgacttgtccctggttgcacctttaactgactcagactaggctgcggtggttgaggatggggcttcagttctagaacttcttatcattcatatctttggcgtcaacctcataccagttaccaccttcgtgacatgcgtcgacatcagctttgtcattactaggatatcatgtttggcaacttgcccctaactgcctcatattagctttcctggtctccgggtgctagctacttctgctattcgattccagggtcaaccactctaactataagttatgcttcccaagagaaccaatttatcccgcttgacatgctttgacgtcttcccgaatgactttgctgctggacttgttattgtctgatcgtgatcctgccagatctgaagcttcgttgttagaggtgattttaatctgacctctgtagactatcttcgaacatatcactggttctataactgggaatggctctcacgaacaagcagctcggattcactttctttatgttcagtttactttccgctattctcttcatgttgtcatcatttagcattcaacgtattcctgtgcaccttcagccttgatgtgttctttctcgatggatcgattgctaggaaaatgcgttgagcgatactattgcaagtgcttttattctagtagcatctgatacaaagcccaaggttgaaccgagctttagattccactgttcaggttttacttcttgacttcttggtcatgtcacaaaagtttccatccttgtccccatagaagtacttctacctgcggtcatctctcttactcgtgaattcacctactttaatgacagggcaactgttgtagggttgtttgctatcgggagtcttcctcgagtgacacaaatcatggttctcgttatcctttatcaatcacctttcgacctacttcttttcccagtaaccaaacatcttttccgatctcttccaaaagaatcccatggaacttgtctgtattacacatttctccctcattacatgaatacgaggcactgccttaaacaaaaagggacggtgcttaacatcggtacattgtatcctcaacatgaatcatccataagcatagcaagctcactgtttatagacatgaatatatttatgtattacatgattgctgcaaactttcgattacaccatgataagtagcgaactgaaaaccacaaacatggctgctcattttgattctggagagatatagctggcattgttctagtgactgcatcatccttgattggttctgtgattatgtgataggactgcatattgctatcattcacaggagaagcttccttctgattgctgtttgaagcggatgacggtcttctgcttggtatcgccctccggaggttgattgccctttgcttggcctggagtaggtcggggagagacacaactttttccatcgacgacaattccttgctgaggctgtcggtgcagagaatggttaatgctgaaggtattattgccatgatttattgcagagttaggtggagcaagaggagcattggtgctgtggatgatatcatcgatgttgttgttggagctgactagctgacgagacaatcgtagggttgttcgttggatttctgcggtcttggtcaacaacacactgagttggcaatccttgggcccacggtttgctccttcgcacagaaaacatgtcaccttgcgagtgggacactcccctggtggatggtcttcttcatagggagtgcagagtgtgagacacatgctagcaacgtgtccaatttctccacaacgggtgcatgcctttgatccgaagaagacacatctgaaactcttagtccaaacaaatgtctctttggttgatcacttgattttcttcgccatcaatcgcgaggttatttgattcataatagattatgagcttacggagatgagaccctgggtctccctaatcagcaacaaagtgtacacaactcaccggacttgcgatcttaacatggatccttcataaacttatcaaactccttcataatctcatgtttctctgttattacatgattgacggggaacaactataaaacataagtatatgattactgatacaagagtattatggttgcttctgactagcgctaggcttaacaggtactgcatttgctccagtgaccacttggcgattggcacgtctgcttccttaacaggtactaccgttgtaaataactttcttacgcttgggttcttcatcctgtacttgatttcttggctgctgtgctggaacatccaaaggtacaatgccgatactggcctctgtcttgtcaactgatggctggggctgtggtaatgcactcgctggagttggagctgttgcaacgcgggctataggactgcttcgggatgcatggatgacaattcgctgaggagcaagcttccgattgcagggagttgcgtggactgacgtgctggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggattggtgttgccttgatgcttctctccgttggaactggcgggttggttagccatcttcttcgtcagcagaaaactgaattgacaatcttttggtacatgatcagttccttcacaaaagaaacaagtgatcctgctcgttggacacctgtcgggtggatggtcttcctcgcaatgaacgcatatagtggcacacgagctggcgacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgtcttgtcattcctggtggaggccattctgtgctggtaatgatcatcttacggacttcatcttcggttcgcattggtgtttttcttttctgctgaggacgctcccttgcatagtgcccttgctcatcacacataaagcaaatgttacttgcttcttttgggtcaacatgtggcacgtcaccatgggtccttcgggatgctggcggcatgctgacttgtggtgtgagtgcttggactgcctccaactgcacttgaggttgtatttgactcaggttcagaattggcgtctgatgctgctgtagtatctctataagcaatcggttctggttaatcaggtgttggaccagtgtcacacaactggtgtctggtgcttcattcactcgggagcttgaggtaccaatgtcctgacttctaaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacaactaacgactctaccctagagggtggcttaggttctgcgacgggttctccaagatcttcactcttgcttcacatctggcttcactgcttcctttgctgcgctgacggatccaacagccttctggagtttcgacaaacaactgacgatgtcttcttcttcactgacctgaccaactagtactagttgaaatccgaagaaggaagaagggagtaaaccttttgcaaatagcattaagggaaggagaaaaaaggaactttcgcaaatagttttatttataaaatatgtccttaggttttatccacttggcttatcctacagtcgagatggctctgataccatcttgtcgcgaccgggaaaattgccttttcccgaacgccagtgtattaatccccgtcccaggaaaagccggggtacaccacacaaacatgatataaaggacacatctttattatatcgataatatttacattattacaaaggcacttcaggcctgacaatcaaaaataaacagcagcggactagcgggcctacggctccatcttcacaggcgctcaactggggtataagccaggactccacctaagacatcttctccaaagcttctcttactgaagaggggagaaagatagagcaagaatgagtacaaccacagtactcagcaagacacaccggagaatgcatgattaatgcaagggagtacaaggagataataatataggggttcagttttacagtaaacagcatttaaaagtcacttggttgcccaaagctattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaatttgaaacactgacttgggtacattgctcggcttgcccataaccgagggcgcggctattcgaatagattatactctgatcagaggtgtacatctttacccacaagacacatcttcctcgcgtgcaaccacgtgccacataccaccacggtatacggacggaagacgtgacatagttcccaacccatcctagccataaacaagagtaccgacccaatccccctacggccgggacacccgggacaggcaggcaggactgagccccctagcagcagggcaccaaccctctgccatgacatctcgactaccgggccgcagctcgtgtagccttcatttgccctggagaatgtccatcgacccccgacttcatccatctccaatccgtgtacttttgtttatgaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgaccaaatgatatgaatatacccaaagtctaaaattataaaatccacctaatgttgtcctattaatcagcgaagcatctacctaaattcatactagtggaaccataaatagagtgtccactagttggggttttgtttattctagggtgaacaaggtaataatatcaataacaataatagtatggtcataacaaaggtaaataggcatggctaaataaaacagtgataacgcgggaatttaaataaagcgataatgcattaatttaaattaaaataattttataaactgggattcaatatgctcaaggatgatgtgacttgccttgctcgctttcccaaacgctggcttcaacttccacgaagagcggatcttccgaagctgcagcgtctacacgaccaacggaaaagaaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaatctcatttattgcgtcagccgagggagagggcgcgcggaccgggtccacgggagtggggcccatgcgtcaacctctcggtccacggtggaccgggagcacgcggctggcggcggtcggcgccgtgggtcccacgcgtcagccgcacccgcgggcgcgggcggctgacggccgggcccacttggcagccgcgagggcgcgcccgaaggcggccttgccggcacggccgacgggaggggaacgcgcccgcgccccgatggtcaccgccggcgaccaccggcgcggcggagcggcacccgagagagaggagggaagggggaaggcgaatggaacggtcttcggctcaccccggtcgacggcgacgacgggaacggcggccgaagcggaagaaggcggcggcgcggttcgggacggcgaggacgacggtgctccggcggtcggcgagcaaaacggaggcgcggacgaggtcgacgggaacgcggcgaagccgatggaggtgacgccgagtggggaggaggtcccgagcgacgacggcggcgaactggagctcggcggcgacggcggagagaaggtgcgacggtgcgggctcgattccgacggggaggagaggcggcgagtggcggaaacggaggaggagagcacggggaacgcttatatagcgccgggagagagagaga

SEQ ID NO: 74246 - DNA, 9037 bp, Oryza sativa
agttcgaagaaaaaactcttcgattgccaatattatggcttatgtttctctgaatggttcctttaagagagccttagtaggtcaggatatgactaatggccatatttattgtgcttcaattgttcatattcatttgaccggggataatgatatttttagatggaattttcatcaaaagggtcaattctctgttcgttctatgtatttagttttaattaatcatggttatgttggagaggaataagtttatatgaaaacttaagatgcctcttaagattaagatttttatgtgatacctacttaaaggggttgtcttgacataggacaatttggctaggaggaactagcatggtcgtatgaaatgttgcttttgcatgaaaaatgagactattcaaacatttatttttggagtgtcattatgcaaaatttatatgctctacagttttcttgtggtttatatgctccacatagtatatctcatattttttagaattggcttgtgggagtggataaaaaaagtagtaaacttattcttgttggagcatccgctatttgttcggccatatggctacataggaatgatatgtttttggcaagtcaccttatgtaccttatatgtaggttcttttcagggcaaaatactggcatgtcgtaatattgattcaatggttaactattgttgttggagcatccgctattcttgttggagcatccgctatttgtcatgggctcaactactaatgtttgatgatgatatcaagctagtaaaaactgcatgtcgtaatattgattcaatggttatgcatcttttcgccaactttggatgaagattcacaaatagaattcaataatcatgtgttcttttaggttggtttttgtttgtgccccagttttgaaaggagtgtgtttttaagtacttgtgtgtgctcctgttttgtgaggagtgtgtttctatgtctttgttttatttagttcgagtttggttgaactggtgtaataattgtctgtacctctttaagtaaagtccgggatttaattccattatctaaaaaaagaatgttgctaatttgattatttcatatgtcataaaatgtgacctcttgtgcaaatggcaagtatttaaaatattttaataaaattatgaaaatcatcactctatatttattaataaataatttattgcttcaaaatctatatatactaattagagaggcttcaccaagaggaaccgacataaatcccaataaaagatagaaaagttagaaattccaatattgaacttgtgagttcatctatcaaacctatggccagatatcgtccaacaaataatatttggatttattaaaactcgagttagtaatgagttagtaaatacctagttgtactcacttggagttctctgttgaagtattcattttagcaatccaaatttcagaatcaataaaaattaataatttcagtttgttttttcacgatcaaataatattgaaatcagaaaatattaatcaaataatatttgttactccctccgtttcaggttataagatattttgactattgtcaaagacaaactgctttaagtctgactacgtttatagacaaatatagtaatatttacattaccaaattagttttattaaattataattaaatttgtttttacaataaatttatcttgcgtaaaaaatatattactatttttttctataaatttggtcaaacttgaagcagtttgacagttgtcagagtcaaaacatcttataacctgaaacagagggactactggttctaaaatctgatttacaatattgtaagccgatattaattttgtaaaatacgtagcatgtatggatggacacgttgatgtagttaaagcttaatggtaattcagtatactcaatccagtaaaaaatagaaatgagttagaattattttatctccctgaattttttcaggatactaagagtttttttaggtttttctatgcggaacctaaattggaaatgaatttatttttctgttctttctctcttagttaaataatgttcttccttttcctctatgtaagaaagtttgatgaaactttgtgcttcagttaaataaactttaataaaaaaaacttcaaaatcaacttcaaatttatggttcaaaattcaaattttggcagcggctgatgatgaatgggggaaacgatgggagcctcggttgcgttgatactttgttgaatcattataaagtattatgattttgcactgttgtatacacaaagtgctggtgaaatgcataatcgattccagacatcgcttctatgctcacctacaaatttatttatgttggtatatacggtcgaatttaaaaaatcatatagagaaaacacgtttgatctttctgttcataaatatacatataagttaaattcataataccttcatgtcctccacgaaggaggggaaccctccaattgccataaaggttagcagtgtggcaataaacattagcatgtgtgatctagcctgaaagaatcaaaattaattaattaatatattaatttttaattgttgatgcatactcgatcagcaatttgcgagagaacaaccaatgttttatcttcacttacttgaattgaatcgggtccatagcccacatggtaaaatatggtcccaaggcaaacagttatgcaaacgtaaatggccaaccgcaaccaataatatccaatatctctatacatattgacaaatgaacatctagtaagcacaagtgtcttagtaacaaaaccaggtcggtttcttccaatcatcgcccgatcctgaatgaaaagaatatgttaaacgtaacttgtgatatataccatgaaaatataattatgctaatgtttacatgtaattatatacgcaaaattagaatagaaaccacctcgtttacgtaacgcatttcctggttcgcaacttctgatgtattggaggatttgtatgagttcaccaaaatgtctattgcttcctcttctggcatgcacgggagtccttcttcactctcctgtatgtgtgtcagcaaattgaaagacaacaattccgaaacaaagaaattatggcatctatatatagcatagatatgttcactttgtcgtgctgaaaaccattcagttataaatgctgtcgtccaatttccaattatgctttacttccagattagagaaaatcctacggtggtgttactcgtagcctatctttttaacttctcttttactgttgggttgtatacatagtatgtgcagaggcctgaggtttaaacaatttttcattatctaaaacaaattatgatattccattaactagttatactgcgtatgaattgtgaaagagcaatgctacacgtactaaatttttcttactaaacttttactaacaatcatctcaaccgtttgatttaagtagatagaagttacaaaaaatctagatgcacttatagcatgacacatcagtgttagtaagaatttagtaagaaaaagttagtacgtatagccttttccattgtgaaatgcatgtaccctagtggttgcagtgacctgagtagcaccccaatgtctgagtcaaatctctataggagtgaatttcaaattggattatttgagggctaaatttcctatttgataggctaagttactaatttaaaaaggctgcatatatccggttggatatagaggccgggtaaaaaatacccttctctagataaaaatgaattgtattcatctaccacactatatatctaaccttatcaaaaatgaatcggagtcacagaccacactatatatatatatatatatatatatatatatatatatatatatatatatatatatatatatatatatatatatatatatatatatatatatatatatatatatatatatatatatatatatatatatatatatatatatatatatatatatatatctacccttatcaaaatctttgttcacagtcctcaagaaatgatccgatgggttcctcattggcgggcaagggtagccattcgaagcaaagaactgcaaattaaaccaattagaaggtaaagacagtaaacacgtacatacatagacagtatatatgggaaactctttaatcccagggactgatgtatcctcatttgttcaaacatcctccaaatagttactaaagattttcaatcaaaataacaacattcatacaatatacatatactctccaaaaaagtcaagccaaaaatcaacttacacaatgaaaaattaaaaagataagtccatcatattagcaattccaatgctgttcacattcatatttgtcctttttttctccatatgtagatcaaatttgaaattgatttttggtggagtggtcgctagctatatatacactacattatcaaatttaatttttcacaaccatcacgcattaaacattgaagaaaacggtacacgagaggatacctcctaagggattagaattcaattcccactatatatatcacagttagatcgactaacctcggcagcagttgaagctgggccaaagaagatggtactcccagaggcgagcaggcagagaccatggaagagctcgaagacctcgctgcacggctggtgcacgacggcgacgatggtcatgccctccctggcagcgaggctggtgattcggctcatgacatggaaggaggcagcactgtcaaggccgctggtgggctcatccaggaagagaaggcggggacaggtcaggatgtcgaggcagatgctcagccgtttctgctgcccgccgctgattcccttgctcgaccgcccgccgatccggatgtccagcgcgccagtcagccccatctccctcaccgtgtcgtcaccgcgcgccagcttctccgccgtcgacatggtgtccggcagctggatttgcgccgagtagtaaatggcctcgcgcaccgtcagcgttgtcattagcacgttgtcttgagtcacgtatgcctgatcggtccatgtgtgcataagcatatatccaatcatttacgttttacgatcgccagttgctcggttttttctctgcttaagggtgtgttcggcgatacacttttcaaacatcaaaagtttttttttcacaggcacgcttatcatatgtctaaacaacgtttttttaaagaaaagttctatagaaaagttgatttaaatatttgtgcgctgacctaccaatttgttttacgttccggaaagggttcccaactgcaaacgaacactaccctctaaaaaactccaaccgaacacaagcttaatatatggagcaatttcgtttatgccctactttgatgtctaatattaattttacccagttttcgtttttgctcctattttttttaaccgaactatcgtttttgcccctagtttggatggtgaaatcaacggtgttaagtaattggtaaaaggacatttataccctcttctttctctgttcattaattgtgtttttgccctattttatacatgtagctttgaaactttatttggttagtatatttaaaattaaatgacgcacattgattaatataacaatttagacagattctgaatttgatgaaattttgacaaaatttaagcagcattttaactggaacttgaccaaaattttgacaacatttcaacatcttacacaatcatatgaaatcatagtagccaataccaacagagataggagagtgtataaatatacttttgctaattacttaacatcgttaacttcaccgtccaaagtaggagcaaaacgataattcggtaaaaaaaagtgggggcaaaaacgaaaaccctaaaaagtaggagtaaaatcaatattaaaaatcaaaataggggaataagcgaaatacccccttaatatttctaaacaagtgttttagaaaattagattgtccagttacactatagctaaatattctagttctttatagtataattgtttatgtcgtcaactttgactaaacttcaacttattgtagacaaacttgtagtcatccatctatgtacaacgactcatattgtagtgaacatgtttgcttcttcgctcctatgtagaaagtggcatttatttgcacagtgcagctcaataaaagctgactaaaaaaatcaataatattcaacatgatgtgtgaaattttggttttatcaattaaatgcttcaacgtattttctaatttgaactcaccgaggttccaaatgcaagtttctgagatcggccataattaaaatttgtcctctcatcttcaagttcaagtccaatcttcctgcgtatatcaacatagtaaaaataaatacaaattgaaataggacgcattatgggccgaacttagatatacaccaacaatgtaatataggaaaaatttgctgctgaacattatgactcgtgactttattgttctcgtaggacactgtaaaaccaaaataaatctttgagagaaatactattaaaatacgttatttgctgatggatactgtcaccgttattttgttattgtcagcatgacaagctaagggaggacaccaacaaggtcagaaataggacgctaatgccggagaagagaagactaaccgcgcgcgagatgaactgccgaccatatcgtgcttacagacattctcttacgggacttagctcgaggtaattaacttaagagcaagtctaatataggatagcccactactaacttcaatttatctatagccaatcaaatagtcaattcatataataattgcttactatactattaagatatggtcccacctatcatacacacagtgtgtcttgaagtccgtgctgcagctggctacagatctgtagtccgctgctcttctctcatcatttatctcattaaaatatatttagagctggctaatagcctgctattgtacctgctctaatgccactactaaccaaccgatgataattaattaactccctgtcaaaatttattcggcaaattggtctgtgctgccgttcgtgtgtgctgagcagttacaagatttagtttagtatcgtacgcaagaaacatgtattgaaatttgatttgaattttacttgaacatggagcacactaaaatatagtcattaaatgcgtgcttatctggcacattaaactccttgggcaagtactatatactaatgaaaggaaggggattagacaaacaaataaaataaaggggtgtttagatctacaggcgtaaagttttggcatgtcacatcggtattatcactagtacagaaccttccatatgtgacgccctctaacatgcctggaattcactactacaaaatcaatttttcatagcgtcattctacttttttctccgacggccatatgcataaaccgccattaaaaatataatgaggctgaggggttaagtaccgccagcgaaaaggccgagttaagatagccgccagcaaaaatatgtccatttttgttggcgacccacttaatgtaccgctagcaaaaatatgtccctttttactagcggcccacttaatgtaccgccagcgaaaatatatttccttttgctggcggccaacttagtgtaccgtcagcaaaaatgaaatttcacaagcagaggttaagagcaccgcctacaaaaaaaaatccttaaaatccctcccagcctgacaccttctcctcaaccttatctgctcatctcccatccccaacccatcgctcccactcaaccacctccaccgtgcgcccttcctcctccgctcctctcccttctgccgccgccaccgcgtgcccttcctcctgcgctcctctctcacccgccaccgcgtgccctttcctcctccgctccgctcccacccgccgccgccaccgcgcgcctttcctcctgcgctccgctcccacccgccaccaccgcgcgccgtcgccgtcgacactcagcgaccacgacgacgctggcggtcgggagagtggatccaccgccaactcgggatctggaggctcctcccctccctctgtaccctctccctctaccagatctggttggaagggagtggtcggcacggaggaggtgatgacgcggtggaggaagaggatgaaggggaggcgcggtggaggaaaggttggggagtgcggatcagcgacgggggtacatgagagctccagatctgttgggcggcagcagtgctcggcagtgcgctggtggcggcggtggtcggcggtgaacggacggagagacgtgcgagcagcggagctaggttgcgtgaggcagatggcggatccggcggcgactcgttcaagtcctgcattggcaagtcctccatcggcaagccattaggcaatccggcagccccaagtccttggatcgacgacggcatggagctccttcctccgtgacgagctgccgccgtggagcttcgtcctccaccgccgtggagctccttcctccgcatcgagccgctgccgggagctcggagccttgggttcagcaaccgctgctgttattctcgtggtgaggcaatgggtgatgcatgctgggattgaaacattttttgttctgcaggatcgacagcatggttggcaaaattaattttgatttttgtgatggtgaaattgcactgtgaggtcaacatatttgaatcgatgcttgaatttgtgattttggacttgtatttgtgaatttgtgagaaaaacaggatgcacgaattcgtaattgagggcatatctgaatcggtttgaatttgtatttttgttttttttttgcatcggagaatattttcgcaggcggccctcttaacaacgcggttgctaaaattggttttcgcaggcggccctcttaatagcacgcttgtgaaaaattgaatttcgtaggcggccatcttaagaacgcccttgcgaaaatcggttttcgcagagtattatgaccgcttgtgaaaaccaatgattttctctggcctttacttactggcgagctgcttagccgccagcacaaacctctttttgccgccagcataaatgttttttagtagtgattagtgggctgtcacggatg

SEQ ID NO: 74247 - DNA, 31140 bp, Oryza sativa
  unsure (1)..(31140): unsure at all n locations
cggcatggggcatggtcgcatggacggcggaggatcctgcatggtgacagagacggcgccggcgacgagcttcggcgtggggcgtgcacggcggaggatcctgcgtggtgatggcggcggcaccggcgacgagctccggcgtggaggatgcagccaccgactgaggcgtggacgatggacgtgaccgcaagtgacgaggtcccggcggaggacgcggtcgctggcaacgagctccgatgtggaccatgggcgggggaggatgcggctgccggcgatgaggttcgggttcagtgtggagcgtggacgggggaggacgcggccgtcggcgacgatacctcgacgcctcgacgcccagctcctgtatttagttagtatcatatgataccttccaagtattaccctgatacttgtagaaatcgcgcgatacctgataggtatcacatgatacctcgcgagtatcgtctgatacgtgataggaatcgtctgatacctgatacgtggtagaatcacatgatacctggtaggtatcactcgataccagctaggtatcaggacctgatacctcgcaagtatcacgctctacgtggtaagaatcgcatgatacatgataggtatcatctgatatctcgcaagtaatcacctgatacgtggtaagaatcatatgatacctgatagatatcatctgatacctcacaagtatcacctgatacgtggtaggaatcgcctgatacttgatggttatacctgatgcatgttaggatacttgcgaggtatcaggtatctataaggtattaggcgattcctatcacgtatacatgtgatacttgtaaagtatcaggtgatacctgtaaggtatcatacgattcttaccacatagaaggtgatacttacgaggtatcaagtgatacctatgaggcatcatgtgatacttgagtaggatcatgttaaacctaggaggcatcgtgatcccccttagtatcatgttcggtttcaccaggtttcataagtgatactttgggaggatcatgtgatacctggaaggtatcatgatcctcatctgtatcatgtctgctatcatcaggtttcacagatgataccctaggaggatctgcatgaccctacttaggtatcatgtctggtaacataatcctataaatttcacagatgatactttagtaggatcgtatgatacctgtgaagtatcacatgatcctacccaggtatcatgatacatgatcctcaaaagtatatatcattatgtgtgatacttgtgaagtatcacatgatcctatctagtatcatgtctagtacagtggtttcatgcgggtttcacaaatgatacttgagtaggattatgtgaaacctgggaggtataaggaggtaggatcaattggagtataaggagtacatcatcctcctgaggccgcggccggatgccgccaccgtcggcatggacgacgacggcgcgcagcgagctagtacttacccttcctccccggcaacaccaccgccggcggcaagctgcggctggtctgctcgtacaatcacgccattgacggcttcaccgccgtcgccgtgtccaaggagctggcccagctccgacgctgcttccaggacggcatcgcttgcttgtattactggtttaagcaggaaggaggatggcaaccttgccggatccggccatggcgacgatgcgctgcgcgtggcggcgagagcacccgaggcggagttgctgcggatgcaccggggcagcggcgacggcgacgcgccgcctgcgcggtggaggtcaatgaggtgggaggacgcgagggacgacggcgccgccattctctctccaagccaatcccttcgtctcgtgctgcagcggtggatgacgcggtggacgaaaggggatcctgtcccgtcccgacgggatcctgttatttagcatttccctttacttttctatatgtaccaagtaaatttgtgtcaactttttaaactaaattaatggatgtactcttctgtttgtgaagtacgtacgaactaatggtactatacgtgtaaaggaggcagagatataattttttggtgtttttggtacatcttattagtacaaatctacaaacatctttactgggataatgaagtagttgcggtgtcagttaatttgtcaccctaactactttgattgtaaattttataaatttctttatactttttaataaaaaaataaaatctagctaagtggatagcaaatccgctgctggtcaagtttttaaaaatataaattaaattaacatgaatatttcctatggtaaaaacataacacatttcttgcaaaatatattgtttatgacgtgtatatatattcttctatttgtaacaaatgaaacaccgctggagaaaggggtatcactcccagttggtaacacccctatagtcccagttttgtaaccgagaccacgaatccgggactaaaaatgctcacctctagtctcggttaaaataaccgggagcaaagacagatctttattctcggttggtgttaccaacctggagtaaagagggaaatctttattcccggttggagttaccaaccagaacaaaagagggtagtgctaggctctctaatgcctattcttctctttttctttttcattgttctttgcctattgatttcacaccaaaatcacatagatcaacatcacaaaattgaacattgacatcacaaatttacatataactgacatcacaaatctacacatacatcacaaatccacatattattggcacaacaatttcacaaaaaaaaatcaaacaaattctcaaaaaatattcacactgctggggagggcatcaccgccttccgccgccgcctgtcgtcgcccctcccaccggatccgatggaggggagggcgaccttcgctgcccgccgcctcccacttcgcgcgctgccaccgcctgctgcctgccgccgccacctcctgcccgccaccgccgccgctgcccgccaccaccgcctcctacccgtcaccgccgccgtcacatcgagaggggaagggcggaggggaggaggagtttaggagttagaggaggagtggaggagttagagctgcgagaggagatcgaggctagataaggacgagcgatatgatcgaggtgtgtgtggctctggtatttagtcccggtgggtataaacaaccggggtctaaagataggtattttttcccggttgtttatactaaccgagactaaaggtaatgggcctgacatctttttcaaccgggactaaaaatgatctttagattcttattgaaatcgggactattgtggttttcgcccaacccatcaaagatgcattctccattagtgagagcacgtacgggtattcaatgagaagcttaaaaattcaaaaagaagtgtacataagtagaattataactgatttccataaacacaaagtccctaccggtcccttccttaattgatgccgggtaatattacaatttggtacattcaatactactagttactctacctcttagtctcggtacctctaggaccctagaggtactctttgttttaattctactagttaatttaatttcatgccccagcaaattctatcgatcatgcatcaaccacaaaaaatgaaccaagaaaataagcagtaagtcgatcatgcatggttcgcttgaatttgaatttttatatatacatggcgcggtggatacactcatattgtcaatctgttgattaattaactattttaagagtgtgttaagcatatcatgcatgacatggtactacgatacttcctccgtttcataatataagactttctaacattgctcatattcatataaaagttaatgtgtctagctaaaaagttttacaatatgaaacagaggtagtactccttagccctaaagcataataaatatcaggatttctggagttttacatggagaataaaaaagcatacaaaattaaaggaacggttgtgattgattaaaaaggataaatgatagaaaaattaaattagatattattacgattggatgatattgaagcgtataggttttagggtttagtacatgaaaaagttgctatatatttggtgacaaattactattacacaaatatttttttaagcacccttttttttccaacgactaaaagaacataagtatgtaaaattgtttggattgtgctaaggccccgtttagttcacaccaaacttcccccaaactcccaactttccatcacatcacatcacatccaaaacttttctacacacataaactcccaactttttttcaaactaccaacttttcccaaacttctccctaatttcaggaattaaacatagcctaagtaaggaactttatgcgaaaatccattttcatagacagaccacttaagtagtatagttttcgaagtcaggcctgctatgaggcacgtctacaaaaccttctaattttgacgtgaactaattaaacacaccctaaatttactaaggcattgtttagttccaaactttttcttcaaacttctaacttttccaacacatcaaaactttcctatacacatgaacttccaacttttccatcacatcgttccaatttcaaccaaacttccaattttgacgtgaactaattaaacacaccctaagtcttctctcatccagcctctcccatagatctacgcctctacctcattcttcacctcccttccctctcaccccctcagctccacagcggagtcgcactccgtggacgtgggtcggcagcggtgcagtgagatccaacgacaacttcggcagcggtgcctgcccttgctcacgcagcgttgtgacgcaattcgatggtggcctcagctgtagctccctgcgttgcttgcatggcggtgcggtgcgatctgacgatgacgatggcggtctcaaaggcggtggatttggcaccgctatcctggaaggggcggtccgccgtaggactttccctttcctttgcgcatggatccatcggtggcggcggcgggaggggagaaacaggtggcctctcccccttttgtgcgcagatccgccgacaatctctccctctcccatgctcagagacctgcctgcagcgatgataggaggggctgagctagcgaccgctccccctatgatgatacggctaaataggtggatccagctccggggaggccggtgatggatggattcctatcttgggttttgatttttctttttgaaattttaaattttttgaccgaaaattatttttgcagtcaggtggccggcatagcgctccgtgcgaaaatcatgattttaggtgcggttaaactgcccgcttagaaaaatcactatttctgcatacaggcaggggcaagcggatgctacacccatctgcgaaatgtattttagccgttaacaaaaattatgtctgtagcagtgaattttaaacgactaccgatcgagtaccggtggcacccaagctcactaacagtgtagcagtagcgacagacatgcattcatccacgtacatacgtacatgtacttgtcaaccacacacagtatatatatattgtccataaaggcaacagtttatctgaatgagtgaatcaatcaaaagaaggcacagagagctagctagctactccatctgtcccacataaaaaaccaacctaggccttccaaactttttcttcaaacttttaactttttcatcacatcaaaactttcgtacacacataaactttcaacttttccgtcacatcgttccaatttcaaccaaactttcaattttgacgtgaactaaacacacccctagtatcgaatgtaacacatcctattaattactagtacgaatttaaacatacatctgtctagatttgtagtactaaaatatgtcacatccggtattagatttgatttttatgggacatgagtacatgtataggccggccatgagagaacgctcgttccatatatgcacagttgcacactttatctctatacatccaaaccctcatgttcatatgcaatgaatggtatagtagtagcagcagcgtgcctctcagctctgcttccctttttcagctctgctggtagctacttcacccgtctcttaaaatatactccctctgtttcatattgtaagattttatagcattggacaatactagaaagacttatattatgaaacggaggaagtagatacttatccgcctgcttgtttaaaccactcacaaccatcttaaacaatcatgataaaaactatcatcatctattttgacatctctccgtctttaatctccgtataaaaaaaattagctccagcaataattatattttagaacaaagaaaacaaatatacctcgctctccttaacctccattaaaaatctcttgaaactactttctccgtttcaaaatatttgataccgttgactttttagtatatatttgaccgttcgtcttatttaaaaaaaattgtgaaatatgtaaaactatgtgtacatgaaagtatatttaacaatgaatcaaatgatatgaaaagaataaataattacttaaattttttgaataagatgaatggtcaaatatgtactaaaaaatcaacggtgtcaaatattttgaaacggagggagtattatatttgggacagtgaagccagctgatctgcaagagcctgcacgtacaggcaactgccgagcagagcctataaggttaccttgactccctgactagcttatcaccgcgatgcatgcatgggcacatctgatctgcatggatcgatggccagggcggaagagcaaagtgaatggagctaagagcaggtacaataggagctgtaaacatattttaaaaaaataaataagaagaaaaaagagcagcgggctacagatttatagccagctgtagcacggacttcaaaacgcagtgtgtgtatgacagtatgacaggtgagactaggtattgatagtgtagtatataactattgtatagatgagatattagattgactatatatgaattagagttaatagttggttatactattaaacttgctctaacagtacactctctggatgcaaatgccgtgccattattattccatgatggcatcaataatttgcacccatcgtcatgtatgtgccgcagttaaggtttgtgactgccacccacagcctgccgcatttatgctacacactgcatgtggatccttttctgcttcccccctccgccacctctgaaggtttcctagctttcaagtttcatccaactaacccaagttataaataaaccatatagagtaaaaccaactaacctgagtttaattctttttcctcgaatacgactaacccgatttataaataaaccatatagagtaaatttcacaaaactacagactatcgtaaaactacaaatataagattatgttttatataaaactacaaatttaggtctaaatttatcacaaaactataaacttaaagtagagtatcgtaaaatacaaatttagtacttactccgttttacaatgtaagtcattctagcatatcccacattcatattgatgctaatgaatctagacatatatctatctagatttattagcatcaatatgaatgtgggaaatgttagaatgacttacattgtgaaacggaggaagtaacaaaataaccacaaagctacaaatttagtgtcaatttaatcagaaaatttgagcgtttataactcaaccatgacattagtgccaaagatttaaactctgaagtttatagttttgtgataaatttatttttaaatctatagttttgtgataatttggttaaagtatatatagttttgtgaaatttactcaatcatatatatgttccaaaatttacttatatttacgtttcttctctattctacttgcaggcctccgatcccatcctcttacctcttctctctactacatttctttcttctctcctctctaaaagtttttggggaacttttcatgttcagtttagtaagataatagcaattttgtatcaaaactctgatttgatattctttggctagttaaaaactaatgaaaaggttaattaaaatcttattgctctcgtgaataagctccaaaagtgtccctacgtacaggccctcaaacagcttccataatttctatacctattggtttgtaattgtttttttttgctttttcgtattttcaaactcctagtttattgtgttatatgtggctttgcttggcatggctccaactcatctcaaattcttgcagaaatagagtttacaaattaaactagagttatgcgcttaatcctacaattttagtctaaaatatgaataaattgtcttacccaaatgacttaatctatcaagagctccaacaccaagataaatttctgaacctagaaagaaaacctgctgctaaaaaaatactccctgcgtcccataatataagggattttggttctatatataatttgtcctacaatatacaatattttttatcccatttatcaactcttgtattagtttgttttcccatttatcaactcttgtattagtttgttcttccacctatcaactcttgttctaatttattcttcatctatcaaatattgtactattttattctcccatttatcacaatttgtactacatgttcttttgctacttccttaattcatgttaaaaatgacataatataatctcttatactgtgggacggagagagtagagttggagctatgttgataaatagtacagtatatatatgttcatgatttgaacttcgcactttcacttctcttcggctaaattaattatacccaacactcacagccattcatgataaaccccttatttatgcatagggcccactgcgccgccaactagggagcaccgccgcgcgtcgccttgccggcctcgccgggcgcctgcccagccacccgccgctctgcggccctcccggccgccgccgccaggcccccgccctcccagcctctgttgacggtcattatcgatcagtttcgaccgtcaatattaccaaaaaagaggagaactagtgattcttgcaatgcataaatatgttagaataataatatttaactagtattcggtatactaaccttttgcagagaataacaataaagtgaaggaggatcgacatcaactcaaacaataaatcaatcggacgatgtcgagaatcagacttatgcatgaatgggccaagaacttagaattgacacgatgaattgggccaaaattcacaagtctacaaagtgaagcaatagaggaggtcgccagctgaagatgggctggtttgggccagcccatggttcggccgaacccccatctccaccgttgaggccagggttcggcatggacgtccaagattgcaccccaatgacagttggagagtacttcggacaattccttccaaccgtcaaacacctctatataaaggcttcactctcttacttcaacacacacctcaagcaagagctctctcatttctctcaagtttagtttagtagtatctagctggtggaataggaatagagtagaaatcaggagtccggaagccttcagaagagttcgggtatggctctagtagcttttctttcctcttttgtaagctttgtacttttattagaatactcttctatgtacatttatggtattgaaatatgttctgagtatatgagtacctactttacattatgttcatgttatactgaatatacagctaacttatctgggagatgctttggtgcgggtataatgtttgcttatgcaattactctatgtcatgacgatgatattagagtagtatctagtagtttaagcgtggtgtctagattacgggatattattatttggggttatatgctgcggatgagaggtgggccgctgatggtgacagctcaatacgggtattcctccgcgcctgtatataatcctaagttaattccctggggagggtattcctccgtatttagcccgattttatggtcatgacgggttgtcgtaaggaacttggcagtcaggggtggtgtcgacgtttgatgttacgactacggtatttgcatagtatggggatcgttggtactaggatatatgtgagattgaggtaaaagagatggggacgaggatttttatacaggttcgggcccctgaattgtcaggtaataaccctactcctgttggctgaagcctgtcgttgctcttattcatcataatcacaccaatacaatatttggggtggcctatctatctgttgtcgacttggcggccataaaaccatcccgtagtcgacaacagagtagtcttcctcctagaatccgtgtccggcgagatcagagacagcgctagatccctcctgacggtagtcgtaggaaccgtatggggactaactaggcttatctccgatgtcgatatccagcggcttgtcttggcgtatgttggcttgtatgttgatcttgtgtcttaatctattgttccgtccccctctcctcctagggggtcttgtatttatacccataggtgttccattttccaagtagaactagggaaaccaatacggatacaatcagagtaatccttgtcgtttccatgtagaactctatttatctttccttatccggaactccttctatacccgaaggttgtttccgtataaaacatggtatgtggtaggtcctgccgagtttagtcaactactactaggtatgtggtatccataaccctgacaggtggcttctcgaagtaccatgagggcatcggatagagggtattagctagtatatcggttaactagaatgcatgtatactatgtatattagaagtatatgaatagattttctttctcttttctttccacctatcttagataatatattatgagaatgagtagctaatgcttgtgtgtcactctacccttggattatcttaacccctgcttagaatataattatcacaagtaatatataaactattagttaagttctctctacatgatcttcccacgggataaaataaatacgatacccttggaatactctcgggtgaaatgctacaatggtatatccatgcgcttgtggatgaactctgtaaccataatataccagaattatttttgcgccattgctgagaattgtatttctattaatgacgttaagaaatatcaacagcctcacgtggtaggaggtggaggaagagaggagaagagggaggaacgggagagaagggataagaggctatttaatgagaggggaggagagaggaagggggagggaccaagatgagaacttgagaagtactggcgcgtggcttgggtgatttttttttattttggtcccggttggtataaacagccgggactaaaaatagatctttagtcccggttgtttataccaactgggactaaaaataattggggtctaactcgatcggacaacttcttgaaccagaactaaaaatgatataaagcttaaaaagtttttaaccaggacttaaaaataaattttagtcctggttcctattcgaaccaggaatattgtggtttttgagcaaaccagcaaacatgcattctccagtagtgagaattagagattttaaggctggaggattttaaaagtaataatttaatagagaaaatgtcctagttatctgcatacatacatgcatgccttatattatgaaatatctaaagaagtagttgtgtcttatattatggaatagagagagtacttttatattatggaatggagagagtactttgaacgttttgttataaagaatttgttaatatatgctatttcttatgtataatatatatatttaaaaatagttaattatgatcgaagttatagcttatattgacagtacgtacggattgtaaaacaatattcttttgtgattgaagtcgatcaataatatcgccaaaagctttttgttagaggcggtcggtcgaaccatctttgcgaatgtatttagtcgtcttcaaattaaattattttctgtagccgcagtgaatgtatttcgtatgtcactacagtacatggtagtactgtattaaactaggcggtcagagcacagtacgtgacacttattttttctcagataaaactttaaacggatttgaatcgaaaaatcactgcacggaactataaagtctgggaatatatatatcttccgaacagtagcgatgttgtcagtacatatggtggccctcatccgctagaattcaataatatagtgttaatgtccacggttacgtacaaaatgtaacattttcagcgctaattaacttggtaattagggttcatcacggatatatcaacggcatccacttattaagcttgcgtgttaaattaaaatgcatcgatcgtgtgagtgtataattatgtgtatatgtgtgatatcttccaacgatgtattatggacctttcatcccaaatcccaatccttaatcctcaaaactctattttataattactcatatttttggacgacaaaaagtatatattacaattctctctatctttaaacacaagtggttgttgactttaagacatgacagcaatttacacaaaaaggtaattaatatagagagatttctggctgctcgatcatcatcacagatcccaaaattaatatagagagatttttccataaggtacatatattgtacatactccctccgatccgtgatgcttttaacttttcttaaagtcatatatataagtaatataataatatctacaacaccaatttcatttcattgaatctaacctttaatatattttctagatatatgttttattacatcactgctacgaaaactatttttcgtggcggtcattttgggttttcgctggcggtatttgaggccgccacaaagcaaaggccaatgaagatcaagcatcttcgctggcggtgaaaaaccgctagagaagttcagttttcactggcggatccacataaggcagccgccantgaaaataatgttcaccagtggctgccttatggaccgctagcgaaaatatattttcactggcggtggacagcgggcagccgccagcaaaaagccggtttctctggcggcaagtaagaagacctgccagcgaaaataatttcggagaaaaaaaaaataaaaatcacattccccaattcacatcccaaatccacaattcacatcccaaatcacatttcaaacttcatgttctcatttctaaatctactccacaattcatactcctgcaaaaaaaacccaaaaatccccagtcccaaatccatggaggactcgacgtagtgtcaacttcggcaccctcctccaatcgctgcatctgcaccacctcctcggccaccactcgccacaccttgtggcagtacaccggcgtgccggcgagcaagaagggtcgccaggaagctgtagtcgtcgtcgtcgttacgggagccgtagccgtcgtcatcgttcgccgccggatccacctccttcactgccgtgaaggaccgcccgagcaccgacgccggcgaatccgagcccaccctccccgtcagcctcccccgtcgtcgcggcggcggatccggcctccaccatcatcacggcggcggatccggcctccaccgtcggcgtcggcggcggatccggcctccccggtcgtcgtggcggtagatccgaccactcttgtcggcgtcggtggcagatcctacctccccagtcgttgtggcagcggatccggcgcgcggcgtgccgccaccgcgagtccccgtcgcgccgccgccgcgcgccacccatgattgtgggagaggagagacggccggtggatctgggagaggtgagaggagtggttggagggagaagtgggatggaagggagaggagtggttggagggagaagtgcagaagtgcgtgaacgtgtcacgattaatttatgcctatcccatgattttttatggcggtggctattacaccccgctactgaaaatctatttttactagcgggtcctagaagcaccgcttgtaaaaatagaggtgtttttgcaagcggtactcttaagtaaccgctagcgaaaactgattttcgctggcggttctaaatttaccgccagcgaaaatattttcgctggcggttctaaaccctctatccctcgttagaatttcacaagcggatttctcatataaccgccagcaaaaaaaaataggataccgtcatgaaaaatcatttttctagtagtgcatgttggaaatactacgttttactttgtcaaacttatttatttgttttttttaaaaaaagacaaaacctcaaacaaaaggaaacttggaaagtcattagcttaattaaataattataagcaacatttttcaccggttgggtaatactagtagcacacgtacgtacatagtactacatggttacgtgtttggccgtgagctagctagctatacgtgttcggcttgagctcgtgacatggacgcaatgccagaattctataaaactatagctgattgctgatgcatacccctccgtaattaaaaaaaaaaatctgggcgcacgtactccctccgtatcagagaaaaagcattcatagcattacaagttaaaattaatgtgaaataaaaacgatcaaaatatcccacattattaaagaaagtgatgatggtgatagatcggtaaatggtatttaagggataaaattagcttctcattttacgtgttgagggtaggtacgatggtataagttttgtttttcatattttaaaccaaaagttaagtttttttaattgacggaggaatatctgataggattagttttttgacggagttgtacgtgagtgcgcacaagaccttggtgtcacggctcagcagtcagcacacatgttcatcgacatcatccactagcttaatcaactcttctacttaattacgtacctagttatagttaatctcttgtacccaaggcaagcgattggtcagtgcatgtgtgtacgtactaagccagtactataagtacctaattatttatcctaagatatcccgtagacttattttggtgatatgcgaaagagagaagtgaggagagagtgcattggaggtattaagatttgagtgttaaagcctaaaaattgtacatattacctcttaatttacgatatataagataaataaaattagagagagaggatgtttggtttctagctatactttatcacaccacacttttaaatatcacagtttgtcataattgcggcttgcgacgatttttaatagcatatgtcccgtatatcatagactaaggttttttctcaacttgccacactttcgtggaagcgacgagaaaaaaacttgaagttagtattagaatcatttttttattgtttatttttatctcagttatgagattttgcactgcattcactggtgtaatcgttggttgtgtatgtccacttatgaatatatagaagaagttagatttctattcaatatttttttgaaaaaagatattttataaggttcattcaagcctccagctcgctttttaaacagtcatgcatgtgttagatgattcccccacctagtttatatggtttaagttatgattctacatttatgccacacacacacacacacacacacacacagatatatatatatatatatatatatatatatatatatatatatatatatatatatatatatatatatatatatatatatatgtccttcaccaaaaaatatgtaaaatccatggattatttatacttaaatgataattgcccctgtatatgtgagcatatatatgtgtgtgtgttgaagaggcgttctcgtgctgtgcctggagagtggagagttatatgtttggctggtgggaaaaagtcgaaatttctagttagaaatatatgtgatttatgactattttgataaaactaggcacaattattgtcacccatttgtaaaatttcaagctaattaaagtaaaattaactaaatttcaagttaatgtaaatttagattaaagtttgaagaacctagttacattttccttggaatttactcccacatatatcaagtaatacttctaagtaaaaaatataaatcactagcctggctggcttttttgcgatagattaaaaaaaatcaagaataaatgtctcaactatttggtataagtagttaagtacttgtgacattttatatcgatgttttccacagtcagacgtacataaatgtacatgaaacagatcaattacaaacgagcaaaaagggacatgcatgcacttgcgtattggcattcataggcagcaatacagattgccaattggctcaaactgaatacgatcaggcaataactggcctagtacccacaaactaatcatcttcagctgctctgccaataatactggtggtccagtctcagagtcagtcttacataaaggccctttgatttgattgttttttctatgtgcacacatacgtgtatttttttcaataatggattttattaaaaattaaagcagatagcgctgtgcgaactcatcactagaaatgcgcacgcacacaccctatcaattatccatatgaatatatttgaaagattggaccagtatatcttgggattgactaaatcatcacgagcttatcactattataattgaaagaatgttaaatctataacttgaatccgaatggactagttccaccaagagtgatctaactagttaaaccacgtatgctcacttcgcttttaataatggatttagattaaacctggtcaccacattcaatttgatatacatagccaacacgtatatgaacatagtttaatatgtgattttaacttttacgatatttgagaaagtagtgtattaaaaattttggaatctgttaatatctgcacacgaaaactagagatcagatgctagagggctccacaaattggcgctaagaacaagagaaaacaatatgatatctattcaacgaccctaaaatcacttgtgagtagcatgaattaacaccctaatcaccagggtgtaccatggattttcagctatcgtcatcagcactaaagtgtttaagcctcctttagaatttagtaattaaattgatccaacggaaaatgcgagaaaaaaattctacgtcccaaaaagaaattaagcgcaggaattatgtaacttgacaaaaatgatacacataatttgttgggttaatttgatttatgccattgcaaattacatgatttgaaaatatactactattatgcacctattcgtatcaatgccattacaatacatctaaaattaaattcatggtatttttttccaaattacagaataggtgaatcctattatgtactccctcctaaacgactttctttacgagtacggagggagtaaaaatgatggcataatttgttgggttaatttaaattttggtcatgggtcaccggattgaagaagttcataaaccaccaaaactccaaaacatgagtttttgtcatattgaagtggattgggtgcgttcgtttcgaaaaatctctacgtgattagcgcggtgaacttttgttaatcaatacccataatgacttgtattagcacacgcgggtgctatgtcactggaacaaataaattcaaaaagcaccaaaacatgagttttggccctattggagtggattgggtgcattcgtttcaaaaaaatctctccgtgactcgagcgacaaacttttttcaattaatgcccatattattctatattggcacacgtagatgcgatgtttttcaccggaacaaaaaaaatcaaaaagcacaaaaacatgtgtttttctcatattatagtggattgggtgtgttcgtttcggaaaaatttctctgtgaatcacactgcgaacttttgtcaattatctccagcgtcgacgtgctcgcctcgccatgccacacaactatcgcagttcgtacacacgcggctaagaaattagaacacatctatatatatcacacacatgtgaaacaaaaacattaagctagcaatggattccaccctgcgaatcatacccaccgaggcattgttcggtttggaggggattaaagaggattggaggggattaaaggggaataattccacactacaataggtgtggaataaatcccaccaattcctccctcatggggattaaccgaacaaggcccgagggtggagatgatgtccatggactcctcccgtggctcgacgatggtgaaggcaccgctggctgagaaggtgcgaggcacggaggcattgccgctagagtggccggtgcagtcggggacgtgaagctcagctggggacttcatattcctgtggccttcgcttcaccgctttgacccagatgtgatgtgaccattgttactatagatacaaccgtcgctcacatcaagatcaaatgttgtggaatccaattcggtcacctgctatactgttgacttcaattggccgtcaaagttgcatacgagctccgttttttggtccatgagtacttgatggaaagctcttggaatcctctttccaatagatacagcctcattactaaattccatcccagtcatccacaatcacaaaaacaaggtgttgcgttacttatattgggccaatgggtttgtaaattcatttggaaccccggcccaagtgggacccatgtggggtgcaccccaaacaggtggagcactaccctagggacccctaggtcgtcctcccacttccataaatagctaggtaccccttcagagtttctcggattttgtttagataaagtttagcttcgctactttgctgagtaatctcgtgatcgattagaacgccggtttgcttgttatggaaccccaacttatcattggtattcaattcctattcgcaattcagattgcttttatcttgttcttgcttgtttcttcgatttgcatgcacgaataaggttggactgcatcggtaagatcaacaacccacggagatgtcccagcaaaaaaaaaaacaacccatgaagaggtgtatcgatcgctaaggtgcaacacaacaatgtctcgtacggttgtagtgtggtcgtcaacgtttatcccaaatcgtagttatcatcaactcatcgaaagatcaggccaatcaaagccatgagtgtctcgagtggaattcaggctttatcaagacggcggctaccggcgcttccagtcaccttgtcctctattggacgctactgccgcccccaccgctcggtgtgcccctgtgaagcatctaggccctcgttgttaattttggtaattaatgacaagcactaattatggactaaccattgtctttaagctatatattttaagttaggaccaagtcatatgtgggcatggatgattatcgatggattaaaattgacggcgcaaagcaaagagaaagaagacggtaaaactagtgcttttatttagaattgatcgaggtgtagggcgatcaaatttgctagtttatttgttagtttcgcggtactatcaaggagggtaatgacctagcaaagagttgattttaattgccacattaggtcattatgcatttagacttgtgctcacactatcacaacacacacttgctatatatattggtctctgtttcactgggttcggcctgactaggggcggccagaccggccacactggcggtctgaccggcgtgccctggccggtctgaccggcgccacaatggcagtctgaccggcgcataaggccggtctaacaggcggcacatgcgcggtcagaccggccccctggaggccgggatggtgctgctcggggtggccgatacagagccgacggagccgtattcgttcagaccgagccgacggcggtctgaccgagccgaggccggtctgaccgcccactcaacgccggtctgaccggccaggccgatggggccctctgacagcactacaacggctagttttctagccgttgcagagtagcacggtctaaccggccacatacctccggtcagaccggcagagtacaaagttgggggattttgccctcaacggctagttttggttggtgggagtataaatactccccctttagcagcaagggggctctcttggcacccaatttaattgcatacaccccttgcacctctctcacacccacttgagctttgtgttcatccatctagtgtattagagggttgattagccaagagtcaagtgcattgcttccatttgtagagctagtgtggcacttgattgatcatctccacgccaggtcattgcttgttactcttggaggttgccacctcttagacggcttgtggaggagttgcccggtgaccactccgagaagattgtggaggaggcccggcgccggtttgtgagtggtttggagttcaccaccttcggagtgaaggaagaactaccctagtgatcgaggcttgggtagtcctctccatgggccggctcccaccttgcccaccccttgacgaaggaggtgtgcggtggcttcgtggttgagtggtggagttgggctcgcctcaacggggagtaggaaaccggcgagtttccgaacctcggtgaaaaatctcttgtctccttgtctcatttgattgtcgaatttacatttgtgaaatttacatttctagagacgtacttgagatcatatcaccctaggattgctaaactttgacataggagtgtgatttactttcctagagatataattgagccactatcaccctaggtttgcaaaacataacttagttgcttagttagagttgaccctcaccaagcctagcaacttaggttagttttgattaggtgtcatttagttttaaatcgcctattcaccccccctctagtcgacatctcgatcctacaagtggtatcagagcttggtctctcttgattgggcttcaccgcctagagagaagatgtcggacgaggtgaaccatgtagagaaggctcccatgtttaatggcacaaaccactccacttggaaaattaaaatgtctactcacctcaaagctgtgagcttccatatttggagtattgtggatgtaggctttgctatcaccagcacgcccttgacgtagattgatcaccgtaatctccaactcaatgcccatgctatgaatgctttgttcaactctttgagccaagaggagttcgatagagtgagcaaccttgagaccgcatatgagatttggaacaagttggcggagatccatgagggcacaagcgagtacaaggatgtcaagcttcatttcctcaagatccaatatgagacattctccatgttgcctcatgagagtgtgaatgacatgtatgggaggctcaatgtcattgtgaatgatctcaaggggcttggggcaaactacaccaatcttgaggttgcccaaaagatgcttagggctctaccggagaagtatgagacccttgttaccatgctcatcaactccgacatgtcaagaatgacacccgcaagcctcttgggaaagatcaacaccaatgacatgtataagttgaagaagaaggagatggaggaagcctcaccttccaagaagtgcattgctctccaagtcgaagttgaagacaagggcaagggcaaggtgaatgaagccaatgaggacttagaggaagagattgcccttcttgctagaaggttcaatgatctcttggaaaggagaaaggagagaggtagggactccaactccaataggagaagaaatagaagacccaacaagactctctctaacttgaggtgctttgagtgtggtgagaagggacactttgcttccaaatgaccttccaaggatgatgatggagacaagtcatccaagaaaaagagtggaggctacaagctcatgaagaagctcaagaaggaaggcaagaagattgaggcattcatcagggaatgggattcaaatgaggagagctccgcctcatccgggtccgaggaagaaggtggtgatgatgcaagctccaagaagaagaagatggccgttgttgccatcaaggaggctccatcactcttcgctccactttgtctgatggcaaaggctcctctaaggtaacatctcttagtgatagtgagagtgatgatgagtgtgatgatgtttcctatgatgagcttgtgagtatgtttgaggagctccatgcttatagtgaaaaggagattgaggagctccatgcttctttggaggtcttgtatgaggagctaaagacctctcatgagagactcaccatttctcatgagaagcttaaggaagctcatgacaacctcctttccactactcaacatggagctctcattgatgttggcatatcttgtgatttgcttgatgatagtgctacttgtcatattgctcatgttgcatcatttagcatttctacctcttgtgatgatcttgtggatgtgcctagctctagctctagctcttgtgtttctatttgtgatgcctcacttgttgttgagaacaatgagcttaaggagcaagtggccaagctcaacaagagtttggagaggtgcttcaagggtaagaacactcttgacaagattttgagtgagcaacggtgcatccttaacaaggagggacttggattcattccaaagaagggtaagaaaccttctcaccgtgccactcattttgtcaagagtaatggtaagtattgctccaagtgccgtgaggttgagcatttggtgaatgattgccccagtggtaagccttctaagacatgcatgtttgattctcattatatgcttaggaaggctcatgatggtagcattgttgctagatatgtgggttcccctatactcggtggtaaaaagaatgtcatttgggtgcccaaagctttggtctctaacctccaaggacccaaacaagtttgggtacctaaaagagcttgatcttcttttgtaggtgaactaccgtaccggtggaagccattgggtgcttgatagtggatgcactcaacacatgaccggtgatagggcaatgttcaccacatttgaaggagggaatgaacaagacaaagtgacttttggagacaatagcaaacaaaaggtaattgggttaggtaaaactgctatctccaatgatttgtcaattgataatgtctctcttgttaaatctctaaatttcaatttgctttcggttgctcaaatttgtgatcttggcttgtcatgtgctttcttcccgcaagaggttattgtttctagccttcttgacaagtcttgtgtgttcaagggttttagatatggaaatctttatttggttgatttcaattctagtgaagcaaatttgaaaacttgtttagttgcaaaaacttcattgggttggctttggcataggaggctagcctatgttggcatgaatcaattgagtaaactttcaaaacgtgatttagttgtgggcttgaaagatgtaaagtttgagaaagataagctttgtagtgcttgtcaagccggcaagcaagttgcatcttctcatcctactaagagtatcatgtccacatctagaccattggagctcttgcatatggatttgtttggcccaacaacctataagagtattggtggtaatagtcattgtcttgtgattgttgatgattattctcgctatacttgggtgttctttttgcatgacaagtctattgttgccgagcttttcaaaaagtttgcaaaaagggcccaaaatgaatttaattgcacccttgtgaaaattagaagtgccaatggttccaagtttaagaatacaaatatcgaggactattgtgatgatcttggtattaaacatgaactttccgctacctactcacctcaacaaaatggtgtagtggagaggaaaaatcgtacattaattgagatggcaaggactatgcttgatgaatatggtgtttccgattccttttgggcggaagccataaacaccgcttgccatgcaaccaataggctttatttgcatcatctcttgaaaaagacttcctatgagctaattgttgggatgaagcctaatgttgtctattttcgagtttttggttgcaagtgttatatttactgaaagggtgttagactaaccaaatttgaaagtcagtgtgatgaagggtttcttctaggttatgcctcaaatagcaaggcataccgggtctacaataagaacaaaggtattgtggaagaaaccgccgatgttcaatttgatgaaactaatggctcccaagaggggcacaagaatttggatgatgtaggtgatgaaggcttgatgagagctatgaagaacatgtctattggagatgtcaagcctattgaagtggaagacaagccatccacctccactcaagatgagccatctacttccgctacgccaagtcaagctcaagttgaagtggaggaggagaagagacaagatccacctatgccaccaaggatacacattgctctttccaaggatcacccaattgaccaagtgttgggtgacattagtaagggtgttcaaactcgatctcgtgtcgcttcgatttgtaaacattactcgtttgtttcttgtcttgagccaaaacatgtagatgaagctttttgtgatccggattggatgaatgctatgcatgaagagctcaacaactttgcaagaaacaaggtgtggactttggttgaaagacctagagaccacaatgtcatagggacaaagtgggtctttaggaacaaacaagatgagaacgggttggtagtgagaaacaaggcaaggttggtgacacaaggtttcacacaagttgaaggtttggactttgggaaacttttgcccccgcggcaagacttgaggctattcgcatccttcttgcatttgcatcatgctttgatataaaactatttcaaatagatgtgaaaagtgcttttctaaatggtgaaattgccgaacttgtcttttattgaacaacctcccggttttgaagatcctaaaaatcctaaccatgattttctattgtcaaaggattttaaaaattggaaaagttgacaccactcttttcacaaaaatcattggtgatgatttctttgtgtgtcaaatttatgttgatgacatcatattcggtctactaatgaggtattttgcaaggaatttggtgatatgatgtctagggaatttgagatgtccatgattggagagttgagcttcttccttggacttcaaatcaagcaactcaaggatgggacgttcgtgagccaaaccaagtacatcaaggatctactcaagaggtttggcttggaggatgcaaagcccatcaagacacctatggcaaccaacgggcatttcgaccttgatgagggaggtaaactggtagatttaaagctttatcgtactatgattggtagcttgctttaccttaccgcatctaggccggatatcatgtttagtgtttgcatgtgtgcacggtttcaagccgctcctaaggagtgtcacttagtggccgtgaaaaggattctaagatatttaaagcattcctcaactattggcttgtggtacccaaaaggtgctaaatttaagcttgttggctattccaactcggattatgccgttgcaaagtggatagaaagagcacatccggtagttgccaaatgcttggtagatcccttgtgtcatggttatccaagaaacaaaactccgtagctctctctaccgccgagacggaatatgtttcggcgggtagttgttgtgcccaattgctttggatgaaacaaacattgttggactatggcatatccttcaccaaaaccccactcctatgtgacaatgatagtgccataaagatagccaataacccggtccaacattctagaaccaagcatattgacatacgccatcacttcctaagagaccatgttgccgagtgtgacatagtcattagccacataagaaccgaggatcaactagccaacatctttaccaagcctcttgatgaaacccgcttttacaaattgagaaatgagttaaatgtcatagatttctctaatgtggcttgagatggtgcaccatggttgtttcttttgtattatgtatttttgctctcatttgctcttatgctttggatttgttgccatttggttcttcattgtgaaaatggagcatgtcacattaagggggtgttttgcactcttgcatgtgctctacttccctttatatgtgagcaaatcaactagttatgctagtagtattttcaaaatgcccaagttaacataagtcaaaacttttgcaaaatcaatgtaatttgaaaactatatcttggaaaatgtttcaaaaggttccctttatgttttccaagcctcacattgcaagaaaaatgatttttgaatgaaaatggcattttggccctcttttgaagaatctagattcttagttttggccaaaatgagatttatctccaaaataagattaagaaggaattagagaaaagtttcaaaataaagttggtagagaagaagatttgaaatgtttttggtattcaaacctatttcaaaaaccaaatcattcaaaagttatttgaaaatcaaattcgccccaaaacccctatagaccataaaaggtcacctcctagcactcaagtgagttttgttgcaaattttcataattttcaaatgttatgaatggttagcaatatttcaactcacacatttcaaaattgctccaaaaatcaaatttttttgttgatttttattgagtaggggtagccgaactgtgcaagggctgtgcacagtcggctgggggcctagcggtctgaccggccaggtgcggcggtctgacaggccacatagggccggtctgaccgactggtaggtgggcctaggacttttgtcctttttcttctcccttcttcccctacccaacccaatctcctcccattcagccatcttcttccccaactcgaaaaaactcctcctctctcctctcccaaaccctagccacctccctccatcaaatccattcggtttgaccgcggatttctctccggttacaccgtaagtgactctcctctgcttcctctctctattccatggattagtttgtgtttttgttgagtttttgatccatggcatagaaccctaggtgaagcacgaggtgttcttcgatttgcaccaatagagggtagtttcttggtgtgattcaactcctccaaccggtaaatcactctccctcttgtgcattctctcaaatcgatctatttcaccctagggctatgggtagttgttccaatcttgatgaaataggttcaaccctttgatgttcatgttccaatcttgtgccatattgttctagcaaattttagactcaaatgtgtagatgtgaaaatttttggatgcttgaacttgtgggaggaggtctgcccggagccacaggcggtctgaccgtgggtcaaccgccggtttgaccggcgtgtgcgcccggtctgaccggccggcagccgtcggtctgaccggcctgatgccgtcggtctgaccgccctactggctgtggtctaaccacccctccacaggatataggcaaattttcacctctccaaattgtttctataattattgctaatatctatcatcctttgctctttgacagtgatgcctccccgcactcgccatggtcgtcgtgtacccactccggatcccgtgagtgagcctaaggaatcgagcggagatgagtacgctcaaagtgatgaagaggttgaggcccatgttgaaggggctagtgagaaggcaagtggagatgatgttagtggaagtggagaggatgaggacgaaggaagtgatgatatgcacattgatccctccatccagtttgttgtgaacatgaggaatccatcgtagtataccatcttgaggcaccatgttcagtttttgaggcctcgggacaccccggatccccgttttcacaccactttccagaagagtgtgtatgagcaggtttatgtagggaaagcttttacagagcataagtggatttcttagagagatatcaatgagacttcagagtttgagggcttacaggatctcttcaagactgttggcattgaccggattgtgactctcaaacaagactacaatgaagatttgatccggcagttctatgctacagagtgggtggctagagactatagtgagatgaagtggatgtccgacacccttcagtgttctatctccaggaggcaattccggcggctcctcaatattcgcttggactttggagatgacttgcatgaggagcacacccataatccgctctccatagactatctctctcagttttatgaagatggagtgcggtacacacacgggaaggttgccggcctgaggactatccgcagtgtggttaataggattgtgagagctactatcctccctcgccttggtaacaatgatgatattagggggtggcttggtatgtcatcgatgcaaccattcagggctgtcagttcgacattgtgtctctcatgatgcaagagattgccatctccaaggggaccttcactcagggaatctattatgccccttacatcatgaggttgattcaagacaagcttggggctgttgggcaaaatttgaagaagcacaagcagtacaagccccaccttcagcttggagctccccgtgctcctagggcggtgccctcctctcatcctggagctagctcaagctcagcacctcctcctcctcctgggtatgatccaaatgctttcttccatccacaatatgcttattttggaatgcaacccaacgagtacttcaacccggtacttggggatattaataccctaagtgaaagcattcaacgcttgtctaccgggcatgaaactttgcatgacgatattcgtggcttgcgcacggatgttggagacttgaatgcttccatgggccgattgcacactagagtgggtacattggattcttgagtccaaatgttggagagctcccaagcatttgtgtatcatcgtcgtcatgatgctcctcatccttccacttcggcgcgtcctccttctcctccacaagagtgaagatctttttggtgcttgatgccaaaagggggagaaaagtgtgctatatgttttgtgggttgggactagtagtagtaaggatagtgccctcatatctaataggctaaggtactttacgctatattttgtatgggtatgggatatttctctatattgtgtgttctttgtcgttttgttaaactctatgtcatttggacccttcgtggtcttgtaatagcctatgtttatttgtgagcccttttaggatgatttgtgacttttgtgatttgaatggttaagtgatgtgaacttgtgcgatgatggatggtgtatgcgatattgatatatatgtgactatcttatgcttatggatgaatatttcttgaagttcacattgagttattgcttatgtgtttgtgcttgttggaatatgaaattgaaatgtgcatcggctccatatttgtgtctatgattgatatgcacatgtttaggggaagcttttgatttccattgcaatatatatccatgtgttctatgtttgatcatacatatatttgtggtgtttgtcatcaattaccaaaaagggggagattgaagcatctaggcccccgttgttaattttggtaattaatgacaagcactaattatggactaaccattgtctttgagctatatattttaagttaggaccaagtcatatgtgtgcatggatgattattgatggattaaaattgacggcgcaaaagctagtgcttttatttagaattgatcgaggtgtagggcgatcaaatttgctagtttatttgttagtttcgccgtactatcaggggggtaatgacctagcaaagagatgattttaatttccacattaggtcattatgcatttaaatttgtgctcacactatcacaacacacacttgctatatatattggtctctgtttcactgggttcggcctgaacaggggcagccagaccggccacactggcagtctgaccggcgtgccctggccggtcgcaccggcgccacaacggcggtctgaccggcgcataaggccggtctgactggcggcacatgcgcggtcagaccggccccctggaggctgggatggtgctactcggggtggccgatacaaagccgacggagctgtattcattcagaccgagccgacggcggtctgatcgagccgaggccggtctgaccgcccactcaacgccggtctgaccggccaggccgatggggccctctgacagcactacaacgcctagttttctagccgttgcagagtagcacggtctgaccggccacatacctccggtcagaccggcagagcacaaagttgggggatttcgcccccaacggctagttttggttggtgggagtataaatactccccctccagcagcaagggggctctcttggcacctaattcaattgcatacaccccttgcacctctctcacacccacttgagctttgtgttcatccatctagtgtgttagagggttgattagccaagagtcaagtgcattgcttccatttgtagagctagtgtggcacttgattgatcatctccacgccgggtcattgcttgttactcttggaggttgctagctcctagacagcttgtggaggagttgcccggtgatctctccgagaagattgtggaggaggcccggcgccggtttgtaagtgatttggagttcaccaccttcggagtgaaggaagaactaccctagtgatcgaggcttgggtagtcctctccgtgggctggctcccgctttgcccaccccttgacgaagggggcgtgcggtggcttcgtggttgagcggtagagtttggctcgcctcaacggggagtaggaaaccggcgagtttccgaacctcggtgaaaaatctctcgtctccttgtctcatttgattgtcgcatttatatttgtgaaatttacatttctagagacatacttgagatcatatcaccctaggattgctaaactttgacataggagtgtgatttactttcctagaggtataattgagtcactatcaccctaggtttgcaaaacataacttagttgcttagttagagttgaccctcaccaagcctagcaacttaggttagttttgattaggtgtcatt

SEQ ID NO: 74248 - DNA, 11426 bp, Oryza sativa
gtcacagatgactcatccgtgatgggctttatactaatgtccgattgagatgacttaatattttttttccattcatcatatgaaatgtttataattgtgagatgacctaaagcaaaataattaactgtagtgtaataacttattttattattcaaaataattttttgggtagtaaagaatttctaatggaaaaattaccaacaataaagttgtataacttataaagatttacaacttttattttggtcatttttctatataactttttttaacagtttaaatttaaatttaaaaatatgataacttcaaacaacatttttaaatactaaatgatttgaaatggaaaaattatcaacaacaaagctgtataacttaccaagatttacaacttttattttggtcatttttctatataactttttttgaacaatttaaatttgaatttgaaaatatgataacttaaaaacaacattttcaaatactaaatgatttgaactaaaaaagtcatccacaacaaagttgtataacttcgtcctccactgccgtggagcaccttcctccaccaaaacattctcctatattgcatcaattgtattctgatgaaatccgtgtccatacggttatatgatgatcaatttgagaaattttaaattccattacacgataaataatttgggaaggagggagtataagcttacgtggagaagtgaggtaaaaaaaataaaaagtgttggctcttataccagtgctagcttaacacgtgttccaagataaatacattaaataatatataagtgaggaagagatatgagaaaaaattgatactaacctatagctaatatattatatatattagctttaagatagactaatagtagtaagtgagctctgctatatattatctttggtgtaatctctaaatcctgactttgtccatgaaaactaacccacaggtcctacgctaagtcaatatcctagttgttagtagtaatgaaaggtcatgatgtaaattttaaatagagtcagcatcgggaagtttcttgtctattcactgtcctaatactgttggctaatcaaagggcatgcgtggctcacctaaattcagtcagcgccgcaaaatgaattcacccttcaactgcctaaagaaatacatgacgacgttgatttctcgtatatcgttcccatcattcgttttattaaaaaaaaccatataatcttttatttattttccgtgacttattttctcgttaaagaaattgtaatgttaacttttattttaatatagttatacaatttttttaataagacgaatgatcaaacagcgaaaagtcaaacgcgtcgtatattttaggatggagttagtatcttataaaattataatactatgtgtgattaatgagtcctccttactacctcattattaatgtagtttgtcggtaagtttgattatcacggtaaccacaagtcaagggaaagatatggactccttaataaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaacactgaactgatcaaagagcatttattatggaaagatgattgtgtcgtggtaaatatgctctcgcaactcgtgcatgtagtcgaaagacctcttaattgcaacctctcttcggtcccccttccgcacttctcctcactgtctagcattcttctcggtgacaagtagaaagggacaggtatctcgtttttctctattactatttatcccatcaatcacaacacatttcaatttttccatattatacccctcaaccaccgttttattctcaaccataaattatttgataaagttattatagtattttatttcaaaccttattgtatgccaaactacctagaaagataagtaatttgagatggagatagtactactcactaaaggttttagaagttttatatcatagtcgattaggtttgcctttgaggacggacgtttgtataactaggattgtatatctttctcaatgtttacgttataatattatactaccaacataaaaataatacatttctggctacgcacatgtgcatatatttctttatatgaataaccagaattgcacactgtttttagacggaggtagtacttgcgtcgttgtttaatttatgtaaaagaattaactagtcgaatttatcttattatcttaaaaattccagacaatattcttctatgatctgatgagaaatttgtaatctataaaaggtataagtaccatgattagcaatattaaaattttagttgtaacttatctatactcgtgctgttaaaacaatgatattttaaattttgaacatttttaaaattttttgtcagggtcaatgctgggttgttttttattaactgccaaatttggagattcttaaacgttcgttttattttgaaagggaccagggtgattccattaattggatccaaccaaatcgctggttaccgcaaccaaactacaagcaggatcaccgtgcataccagacgtggaagaccagctaggtacgcttgaatccaaacgtggcatatgaattttacagacaattcagtggtcggggaaaaacaaattaaaattttcagattgaatcttaggccattaaataacaggacccatacgaagaccctatatagttaccaacacacaatcttaggctgagttcttctctctatgtttccaatccatctctcgtattctacaagcacgtttttcaaactgctaaatgatgcgttttttctaaaaaaagtatatacgaaagttgcttaaaaaatcatattgatccatttttaagaaaaattagctaatacttaattaatcatgcgctaatggatcgctctgttttccgtccacaacagctgtgttcccgacactttcaaacgaacacagcctaaatattttggcacgcgcgtaatattacatttctagggagttccactcagctatttgacccttatataatttacagtgtagaatatactgtaatttcaatgagataattccttatatgctactgaaaattggtctgatcccttgttgccactgaaaattggtttttttcttatatgccattgttccaaatttgcgcaccctctcatgctactcccgtctgttaactatgtgttgaccattaactctcaagtaaaaaagacatatttgcccttctaagtataggatatgcctaacaactcaaaatggcaaatacatcttttttttacttgagagttaacggttggcatgagagggtgcgtaactttggactaaaacatttagtagaagagccaattttcagtgacatataagggatcagactaattttcagtggcatataagagattttctcaatttctattgatgctcttggctagaaacaggcaaatatcctgtctacatgcaaaaagaaaaaaaaactttggatgtttggacactacgtgcaaattaaaatgatgtaacactgcacattgccatgtttatggtataagcgacctcacattaaggaaaattcagttctcaaagagatgacgccttatgcttagagttaaattttgaaatgttcaattaataatagaataaaatactaggattttatatgtgaaaatgatatcgatatatttgtcatataggaacttccgtaaagttttttcttcatatagtagttctgaggcaagtagtggagattagttctatctgtgaaagtttaactatttaaaaagactttctcatgtactatcttcgttcgttttttaatatatgtcgctattgatctttttgaaattcgttttactattcattttattcaaaatttatgtgcaaaccaaccaaaatataagtcatgcttgaagaaccttcaaggataaatcaagtcacaataaaataaataatagttacataaattctagaaataaacgtatgtcaaaataacaacagtgttatatattacaaaacggttggagtatgctacttgctactaataatagtgtggttggaggatttgatttttttttaattccaaaactgtcaaaatgatatgtaagcacatgtacagccccttgccgaattcaagatgaatgtaattaagctcagatcagctagcatgcgatccatggggagaaactaactgagcaaagtgtacgtgttgggttaccggcgagggtgtcgagcagcgtggtcttgccgcagccggagggccccatgatggccagcacctcgccggggcgcgcgcagccgccgacgccgttgaggatggcggcggcgtgccccctgctgtccaccgccgtcacccacacgtcctcccacgtcaggaacacgcccccgccatcgccgtcgtcaagccgcttctcccctcgagccgcgccgacgacgtcgatacctatactatcgaacccgctggcggcggcgtgctccgtcgtcgccgccgctgccgccggatgtagcggacgaggaggcgccgtgtcgccgcggggagcggcgcgccgaccgcggagagccgcgagcacggtgcggaatggggaacgcaggaagccacggacggcggcaccgtcaccgccgccgggagaggttcgccacagcgggagcgacgggcttggcgtcggtgcccagcgtggcagcggcgatgtcgccatgccaacagcctattagcgcttcacagttattcagtacaagtgtagaactgaaaccactaactagcgttctcttacgttttttctctcatctcctcgggttcttttctaaatgtactataatagggcttattaatatagataactccacatatgtaggcatcaactttaaatacagttggttgcggatgtctgtgtttgatgtctgcgtctggcaataacactatacccaagttcgttagcatcaggatttgctagcatatttggtgcgttcgtttctggcggttgggaactcattcactgctacacgatagatttttctggacgtcacccccatttattttcatacggtccgtaagtggaaccacacgaaaaaatagagggaccggcaccgggctgtcgcccgcacgggaaaatgcattttcccgtacgggcgtcttaagagtaccgcacggaaaagttctcattatcccatgcggtcgacttaagaggaccgctcggaaaaatcaattttcgtgtgcgagctttttaagtggaccgcacaggaaaatacctccctcttttcacttccacccacttcaaatttttcacatcctctctcttcctttttcccttttattctccctcaaccactctcctctctctctaccttatctctattctcagccactcctccccaccttcccctactccttcccctcccctcccccgtcaacggcggcggtggcccctcccctcctccccgtgagggagcagtggctcggcggaagcagtggctcagcgagagcgaccaggaggaggagaaggtggcggcgggagagggcacgggggcagcgtcggcggctctattggcagggcgcgacggctgctggcggaggtgacgcggcagctcggtgagcggaggagcggcggccgcgggacgggcggcggacggcgcggcggccgaggcatcgtgcggctcggcgaaggagcgacaggagtgggacaagcggcagacgccacggctgccacggcaccgcgcggcttggcgaaggagcgatgagcggcgagcggcgcacgaggcgacggccgggcgatgtggcagccgggctcgacggcgactttcgatttttgtgttttttttatttttggtttttttattccgtgcaggtgaaataatttgaccgcacgggataatctattaacccgtgcggtccacttaacccgaccacacgggaaaatgattatcttgtgcagttggccgcccgcacgtgaaaatatttatttttccagacgcgtgggtccagacggggaaaacctccgcacggaaaaatcaatttgaccgcacggaaaaaatagtttatgtagtggtgattctctccgcacggaaaacggagcggtctattatcacgtaattttttttaaaaatggatcaacatggtttttttaagcaacttttgtatagaaaatttgtgtaaaaaacgcatcgtttagtagtttgaaaagcgtgtacacgaaaaacgagagggtgagttgggaacaccctcttgcaaacagagccggggaccaaaatcttgtgaatttcagtaaatttcaaactatttgaccaaaaaatcacaaaaaaatgggtaacaaaatgaaatttcaggataaatagtttcgtcctgggtttgctgaaattgaaagccctattaggattgactcataatggggtcttttcataaatttaatttagtggttcgactccattccgtatcaatatcttcaactaattttgacttgggatcagatgacgatggatgaatctgttccattatatagtgtacttagaatcaagtggtcaattggcaacacaattctccgtccaaataaccctatgacgctacaaatacatacatggatgtatatgctaacctatgattctaatatacgacactattgatattttagatacgcttgaccattaatcttatttaaaaaatatatgtaattaccatttattttaatatgatttaatttattatcaaatgtttttataccacgacttaaaaatttctatatttgcaaaaaaaaatgaataagacaaatgatcaatggtaaatttaataaactaatttggtatcgtagatgttgctaattttttctataaattaggtcaaacctaaaaaattttaactaagaaaaaatgaaacgacttacaatatgaaatatgaaatagagtattaaaaatcggaggtagaatatatatataggcagatagaactatatgactattcgttctattgaaataattttataaataagttattactaaagtacatatctatgcttttataaaaattgaaattgtttccgccagaattttggtatgtcatccgtgtttgaagcaattttaattttatgtttctaccaaattttttcctttttttccaactctagagtgtctctcttacctaagacatacgcgaattaattgggcccgtggcttttcacggcgtagcacgccccttgccgcacgcagcgatcgggtccgcgcctaagtccgttttccacacgcgacattgcgcaccaccgcggttgggcccgtgacgccctcgcgcatgcgatttgcccttgccgcatgtccgattgttattgtttcgccctcccccttgatttaaaaattgaagatgtttttgtcctgagttcattttccaaatgcgacattgcgcgccaccgcagttgggcccacgacgccctcgcgcgtgcgatttacccttgccgcatgtccgattgttattgcgtcgccctcccccacgatctaaaaattgaagatgtttttgtccaaactatggtacgtcgtccgtatccgattcccatgtgcgtaacattcatcacgaagtcacgacttacgagtgaactgtgaaagagatttcgtgtgatgtggatacgaagcgaatgaaattcgcagagtccgtgtggataacatacatcgttgcccagatcatccaatctattcgtattacacgtcacgttttctgggatatgctaatatgattttaagtcagtctctacacatgctcgtatgtactattaggatactgttacaataatccacaagaatcaattttactttcggaaagaacatgccaacggaaataaaggtaaatgaatattgtgataagagtaaattaattagtcagtagcaccgcaaaaacctcataaaaatggaaagataagagtagaagaaatttatttttgaaaaatccaaagggatctgtatttcaagttcacctcaatttaccattcttcgcttatgtgcacccagtcttctactaagatcagtagcatacaatgcgacaatggtcgagaggttgacaacatcactgcacagactttcttcctcactaatggcgtcgctatgcggatctcatgcccccacacgtctccaagaaacggtaaagccgagcgtatacttcgttctattaacaatattgtgcgctcccttctgtgtcaggccagccttacaggctccttgtgggccgagaccctccacacagctatccacctcatcaaccggcatcctacaaaaatcctacaccaccactcctcctactatgccctcatcaacggatttaagattattcaaaactttattaactaggtgaaaccccgcgcattgatgcgggaatttaatataataaaaataaaaaaataacgtgtaagatagatagataacattatattaagtaaattaatgtggtttatgataatttaaatttaaaagtatgcagaatggtgattcaaacgtaaaaaagtaaggtcgtatgacttagtggaagaagaaaagtagggagatagtttggaccgtagattaatcatctaaaggctaaaaacaattgatgtgatatgacttaattaaaggaaaaaaggagaaagataatttcgaccatagattaatcttttaagcactaactaagtgagggtgaactatataagtacataggatatcataaatcataataaagatatacattaaaacattatgtgaattatgttggatgatttaacatgtttgtatttaaaaagctcttaaattataaaaactataaagatatagcatgtttgcatgatgtttaaatatgatgattgttagtggatgataatgtggcatcttattaattagtggatgatgatgtggtattttattagtggataatgatgtggcatttttgcatgttaaacttatggagttagtgggggataactttacagttagataggataagcggggggaggtggctcaggtggggcaggtggcgtatcgtctggaattttccattgtgcaccattcaccgcggggtccatgtcacacaattgcgttgagacctgctaatcgtatcactgcagctctccctcctgttaaagatgaaccagaaccgattacaaggcaggtggtgaacaacgaactgattcgtcgtggtgcagcggcaatcaagtaagtcaaggttagccggcaagggcggccggtgttgcagaggatagctgtggctagatcttgggggaactaatcccttccgtatgtaaaatatagtgactcattaacacaagattagttaagcattaactttttttttgaaaaataaattaatatgattttttaatgtaactttcccacagaaattttttacaaaaaatatactgtttagcagtttgaaaaatgtgcgaaaaaaaggagaaatgtgagttagaaaaattagggaaataactcaaccctatagctgctgtgctctccttttttcgactgatccgacttggggacaagccatctgtgatggaggggagaatgttatgcggttatgccttaggatcggcagcaaccaacgtctaaaggaaagaggcccatcagggagtcgcggcccaatgttcgctgcattgtgccagatagggtggcgtgagagggagttggtgtgcgtctataaattggcaaaggccagcattgcaacgcaatgaacgcattgcaactcaaaacatttatccccaaatcaagtcctcctccccacgtcaaatctatgttcttctccgttgactctacttttttataaactggaaaggtagcccacgcatttacgcagacatgtctcatacactaaatttgaggtatttataaaagcgatatattaaccggagaacatctgacactatttctccacaaattgtttttgttagcattaattaattatttaataatattttaacctattagccttatattataccatatataagtaatatctataagcaattatttataatcttcttcatcatttagaaagaaggtagatttattttctttagaaaacatgtcaacgaaagtaaaagtaagtgtaaaataaaagttaaggtgtttttcattgttttttgattgtataatatattatcataatctgttaaaagatgaattgggtgggaggtgaagctccacaaaatgcatgggtttatatagcataatatgattgatatattttgagaggcgattcatctataagtatttcatttagagtggatgagaggctccacgcaacctaataggactacgataacgatgaaatatcattgcacaataatattttagaaacgtcatgtaccatgtataaacacttggttttttatataagatagatctaatggttagaaataatggttctaccggtttaaaaggcataggggtatttaaaaatgtagcttaaaaattatggttatttttatccaatattattacgaagtgagcatagctcaactagttaggtttcttcttatgaaatatgtccacccatgttattaatcagaaggtttaaaatctattagattcttaagaatatttgaatcagtgaacaataggtgtagttcgtagaatatttatgactaaaattaatgaacttctttaagcctgcaggtcgactctggatcatcccctaaattttatagtaaataatctaatagtgtgcacaaataaatttattttatatgatttagattgtataattgtttaaaattttttatcataaaatatttttaacatctaactaaaagaggaaaataggagagaagaaatatgtgggggaggtgatattttttccatctaactaaaacagaaaaataggagagaaaagaaaaatatgggcgaggtaagtacacatatgcatactggcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggattaaagatcatctttagtcccggttcgaatgctgtcaggacctgtcaggcccccccgggatctttagtcccggttgg

SEQ ID NO: 74249 - DNA, 1533 bp, Oryza sativa
gaacgaatccgagggagagagagagggaaaaacgggggaaacgggagagggaatcgcggggaatgattcccccctcattatggcgcgcagggacggtgggatgcggcggaatctgcggcggcggcggcgctagggcacgggcgagcggcgggagcggcgggaggaaggcgatgacaggtgggccccacccgtcagcgagggcggcgggcgggcccgcctgtcagcggcgcgcgcgcggggaggaggccgatgggccgcggggagaggagagagagggagggagagttgggccgagccggcccaagagaggaaggggggaaaagaagacttttagagatttttctttttataaaccttttcaactttgtttatttcttctcaattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagagaatgatttttatttcgggatgaatttatcaggacgtgacagtttgccatagtaaagtgtcactttttatcatgataaaataggatagatgtcggacatctatatgcggagattattggtttacttgacaaggttattggaccttggggcataggttgggttggacatggagatgtcaccccaacagcacaagagtcacatatgatgtgattagcaaggtgttgcttacctgttttgataattgtctagcttggatgccaaagctcactagacactaataaaatgaggatcttaactcactatgttactagagggaattttgtttcacaatacataatgggagtatcttttgttaaattgtttgatgaaaggttaaatgtaaacatggtgctgattttgcatacatatatttctattgtagattatggcagctcatgcaccatccaattttaacttgcggtctattcttgagaaagagaagttgactggaacaaacttcatggattggtatcgcaacctgagaattgttctcaggcaagagcacaaagagtttctgcttatacagccttttccagctgacttgcccaacaatgctcctgctgctcaacgtaggaagcatgaaaggcgatgcaatgattaccttgatataagctgtctcatgcttgctactatgtcccctgagcttcaaagccaatatgaggcattggatgctcatacgataatcacgggactacgtaacatgtttgaggaccaagcaagagctgagaggtttaatacctcaaagttcttgtttgcgtacaggcttgcacaaggtaatccagtgagcccacatgtgatcaaaatgattggttaccccgagagtctggataagcttggttttccccttagccgagagttggctactgatttgattctccagtcgctccctcccagctttgagccgttcattatgaatttcaacatgaacaacctgaacaggaccttggc

SEQ ID NO: 74250 - DNA, 4085 bp, Oryza sativa
aaaaagagatttgtacctgagcaataagccagcccgaccccccctctcttgtcttctgtggatgagatgagagagctgttcttagtcttcagtatccaccctgtaaatgtgtaatcgattaggttgcttcggatcgtgtcggtatctttcaggattgctatgggtcgtggataaagtgttcattggttctttttaactcgggcttgcccttgtgcaaaattagaattcaagtcaaattgtttacaactttcttcaatgctgaggtatattgactttgatttggtcacctgatctctaatcccggagcatgaaacttccagcgccaccggcgagcaagaacaagtcccaattatttattatttttcagtctaaatatgaaggaaccctcacagcgcacattggcatcaaatgttagtgtttaattgaagatcaatctaatatagggctcattagcagtgttcaaataattgaagatcaatctaatatacacactaagcaatgctagttttcgagtctcccaacaccagtacacaaatgtacaaccaccatctagcctgaatatcaatcagacgacgaaacgggctcgtggttactttacaacaatcacgactgcatccccaaaatataacaacagcagctgtgcacctcaacatccaacaaactaaccgatggttcccccaaacttcgcattggaggaagggaaactttgcaagcaacagcatcattgcgagcttggctgttgcttcccatttcgcgggacgacctggcacacaaatgctagaaacagagggtgagattttatggcttgtatatgagcaacaggggtagagattgaatctcatgtgcttaccaaactagacgagggatatctatctatctatttattcctggagagctttcacacgggaggtaagctctctgacttgattcttgagtcgctcggggttgctgaagaaatcgacgaacacttgcctctccctcccaacttcatgagcgcgattctcaaagatctaatgtgcaattgagaccatgatgcttatcgatgaatatgtaacgcacaagctttgccatgttatttggtagggactagggaaaagaagcacatgataatacctttatcttttgggtgcgagccttcgttacttcttccacagaaacttcaacttgtgcgttggcattttccatatcatcgagtgctcgcatcagaggctgtgccaagcatagatttagttcacaagcacaggtaaaaacaattcataactttcaaaaggaaaaggaaggagtgctgaaaataacacgggagatataagaaatgggataattttaaggatgaaagaatgtacccaaggtgtcaatattggttctgcagtcgtcgatgatgcaaatagaagttgttccactgtttgaattagggtgcatctgcaagagtggaaaggatgaaaaatgactgctaaatttgaatttaaggaggccaaatcagtatataaatggactataatccgtaatgctaaaaactgtaggggctagtttttagaaaatgtaatgtagaggattggtggcaccgtggaagattcaccaccaccagctaaaaggaaatttatatttgagcagtagatgagggggctgagacaacagttcatcatgtataggtgaagacgcaaagttaagccaacaagcaaaccgtaccaaccaaagatccgttgcaaacttgaaaagtatcatctgtctcaatattcaacttgattatacatgaggacctcagagtcagtgacagttgacgcactcatggttgtctcaatattcaacttgattatacatgaggacctcagagtcagtcacagttgacgcactcatggttatcaaggcatcaccatagcgtcgctatggctgtaaggcgctgccaggagtaatggcgtctggcccaccttaccatactgcctatggactgccaggagttaggatgccttaccgccttaacaacatgggacactactgttctattcactaaaccaagaatgtgggtaggtttgcttagatcagaagaaacactaaaagcaacaattcaaaaatttgattttgcgtatttcaggcaggagataaagtaaaggcaactgatatttagacatagtgtgagctatagtatcacttacagttcattgatacatcttttgcgatcggctggcagagcactttcaagttcagactgaagagaaagcaaatcagattgaagggctgatatctgctgaaccaaggcatgcgctgacatgtatgttggcattgttgcttggacatctacagaagtgacatgaaacattgaatatcgaaattaaaacgttcaaacagctatctgagtagagttgtcacttgtcagcttacttgagtgaacacataagagatcccgtacggcatggaggagagtgtcacggtcatcaattgcaccttgctcacgcacctcggtcgcagcttgaattaatgaagtacaatggccctaaagaattaaaaaaaacatttctttgttaggtcaactaagaatcatttcttggaaaactaagaagggcagattgaacaaaaactaccgagtgtagcatgaaacatgtagacacataaaaaagaagaaatgacaacataggaggttctcaacaaatgagattgcttaccaaacgggtattgacagctgataggtagctttgcaactcggattctattactctaagcagtgaataggcgctagctatgtttttcctttcaagctggcaagcaatcttcagaaactggtgtctggctagctgattagccaagtgactgatgaactgcagaatgaagacagtgcagaatcagaaggatgtgtaataaaacaatcatatgcctggcagtatgtatgaccttggcagaaaaatgtaaaacactgttccatcaaatgcaaaagtagctggcttaaggtgatctcagcatgtattggtgcaagctagcagcacatttttcactgatcacttaaatttgtcttctgagtgtatacgaaaaacaaatagggtcaacaaggtgtagaacaaccagattttctaatgaatactcccaggggccaactaaatctaaacattgaaagtttgtcacaagaatatttggccccctaggctatttggtgcaagtgtcttaccacccatagatttgaaggcagaaggaaaaataggtaataacactatctgaatagttatctcgattataaactttcataacattatagaagataccaccaataagcaaacaaaggaactgctacaataaataagtgtacatgacatatataccatgtgatgaatgtgcataccgttttttgcctgttaatgtagtattcctggcgcatgacctttaaatcgtagtcccctacatatttgaatgctagaatatcaaggaaatgatacaacagaatcatgtaagccagcgaaagtaatgtaaatatcatcaacaaaccttgcaaaatatatgtgccttgaagttgagcgagttctgagcagaggcatggtatagtctggagggggagaacgagtgaatactgggaaaaacaagcctatctcgggaaaattttaaccatatgctaaaagaagtatgtctgatgcactgcagtaagaattactattggcatattatcctctaagtgctgaaagtatcttataagtgatgagtgtttttctttttcctgagaacttatagcagaacaaagctaatatctgcataacagattataatttctagctgcccgtggtttagagatttcacaactgaaagctattttatgacagtgcttggaacactttttcttctgaaataggaatttaatctgcaatgaatcattaaatcctaccagatgcaagtatgcaattcaacccttatggtattaaatggatgtggcattacgttgatgaaaactctgtcgaaaaccatatacatttcatcaattgacacgcaaacccatatgcatccagctaaacagactcatgaagtgccaatttttgtaactagggaatataatgtaagtattttgcaagaaaaggcagtgcctctacatgggtagagcatacctcagatac

SEQ ID NO: 74251 - DNA, 3288 bp, Oryza sativa
tgcaaaaagaagtgcaataggaagaaaaataagatcacttgaatatctcaataggcaccatataacaagattgcatgaaacattagcaactatgatgtgttcaacatagaggattccccttctgtttcatggtaaaaaaaaaaactatgatatgttcaaacagaaaggtttggaactttggataagcgataaatcaagggatagttacattgaacgaagtcgttgcaattcagccacacgctggtgatgatgtgatttttcagaatctcctgcataataggaatgagtttttcataattagttcattcaaagcacatcatactaatctaggatcagagttacgctctttaaataatataatcaatctattcattgcatacaatttactataactggtatttacctcttatcaagccattggtgatgtcgtcaagactaacccaggaacatttggacttcccttcctcagcaacaagtcgaaatggcccctgacagaaagtgttaaataaataagtaagcagaataagtgttaaataaataagtaagctgagaataacatgacagccaaagagaacctaccttctcaaattgcttcgagaaccagcggttcagctcctttgtacaagccaagtctccaacaacataagggtggaagtctgaatatgctaagtatatactttcatctgcacatatgaatgatgaatgagttatagaggaatcttattggataaaacacaatgttcatataagtgttagtattaagaaatagataaatatgaaagagagctctaagaaaacatggaatgttaacagctgtttgggatgggtacttgtttttaagatttcaaatttcttagccacagtacataataagaggattccattctgattactgtagttctctatgctcttgttgtctgatgattcgtaagccatcagtggcgcattattctttcttaagttgcatgcatgtaaaggtagcattaatcctggagtcctggacccctccatatatgtagtttacgtatatgtttgtataattataccagtagaatactcccttactattttctgcaaaataagctaaaaaaacaacagaactattatctataggtaaagagcataccatctcctgaatgataatgggccaattcctgggtagtagcagtgattcttccgagaactgcattcatctgaaagttagaagataatgaatcatcttaattgaacaatttcctcatgaaagaaactctagatatcttaaatatcttattgcataaataaatatatgccactgttcggaaatgaatcatggttaacaaagcatatgattgagatagaacttccacattcaatctttttaaggagatactaataggagatcaaaattatggagattgttggaaagaaaaatataagatgcaacataatgaaatatacctctaagtttctagaagaaagttgttcatccaatgatataagttgtccactaactgcagacatggcagttacacgtgcccgtctgccttggataagagtagaagcttgccctgcaagcaaatcaaactgtgcttgttgccgcgcaagctgcttctgtaattcaaaaacctcagctctgtatgctagtttttcttctctgcagcaatagcataataaaatacatgtcaggaaaagcacatccaatgtccaattggtaacttcaactagctagcatttggcaggaaccgggctccgcacaggagttttaaagtttaaaccagactacaaaatactagtgtcttgacatagctctccacattttggaattttagtcatggacttgagtggtatggtctgcgttacctggctagtttctttttcaccaaacagctattttacttgatttattgttttttgttttgagatttcaatgttttatactagttaaattatcatttccagcacgattcaaaatctggtcctagtatgattttttgagaaattggttctcagtagtgtgctccgtttggaatataaattctgaaaggacaaagttttttcccctataaaaactgaggtataatcgcatttcagttgggttctaggatttgagcccaagaatcaatgtaaatgtagtaagtgttcaatggtgatgccaatttccactataattttataagattgaacttccaagcataccggatatcaaggattgtttcttctgatccaaatacagcctcttgattatctttcttgcttgaaaaggctgaaatactatcaaaagcagagtccaaatcctcaccctgagaaaacaatgccaatgatagcatgagttttaaggtttagcaggatcacagatataagtgttcaaaaacacaagtggacaatacagcttatgttatagaatgtaaagaacaaaaacccaattttgagtttatagtttgtaagcagagtcccagatcttggatgggaatagttccttgaggttcagcatcccatgacaaccattgaaaactggctaatatcttatattttgccagaaaatctaggaaatttttttaatatcttagttgttcacaaactggaactcctgtcctagaggcatccaacatttggaagttggaaccatgcttgcacaatctgacaggagcagctccgcaacatcctatactgttaaagataacagaaattatacgttccagaaaggtcttggtgaatatacctctagcagcctaccctcttccacaagttgctcatacctgcaatgcaaaatctattttgtcatttgagaataactcaagcaaaagaagcaggggaagctttagaagtcatctatgcaaatatgttactaattaaatatggcaaccaaacaatggtaaattgtcctggttcatccaagattacacaatacaaatgcaggtgtgagtgaaaatgtaaatttagaagcatctcatgcacgatagtgatacagtaaaaaccaagtttttcaacacaatgccgcacatgatttgatagagtttgcccaatagttccgcaggatgttgagtactgctatgtgtttaagatgacaaatcaaaatgaatttgtaaaaaatcaggaatcctacgaaaaccttagctgcaggttcaatgaggttggcaaggaatcaaaagcgtagaaactatcataaatgatctctatgtggcataggtcacttctaaagccccattgtgccaggaaaaggagatgccagtagaatttcgatgtggcattgccatatgtcacatttgtacaatccatttttttcattatcccaaatgggcacacttt

SEQ ID NO: 74252 - DNA, 1456 bp, Oryza sativa
aactcacagaagatgatgtagctgctagtaatagctagctaactagtatgtatgtataaggacccgtttggtaaggctccaaacttcaactcctatctctaaacttccactccagtgggagctggctcctatgagagttgcagaacagctaaaaagtgtttggctagcattcagctctagatctgaaattgaaaaaaaaaatgaaagaaaaaaagaaaaaagaaaaaagaaaaaaaaaccgatctggacactgtcccggcgcccctaggggcgccgcccacgcgccttccccacgtgcgtagccagccaccgcgcatcttctccccaccgccgcgagccgcctgcacgccgtcccgcaccgccgctcgtcttctccccactgctgcgcgtcgtccgcacgccgtccccgcccgcgcgtcgtccccccaccggcgcgagccgcccgcacgccgtcccccatcgacgtgcgtcttcttcccaccgccgtgcgccgcccgcaccttccccccaccggccagttaggtgatgaaatgtcactactacaaaatgcattctcccaaatggcaaaacctatttttaggtgaggttaagcaacccatctatccgaaaatgtctgagaaaatcactatttttccatgcgggtggtgcacccgtacgtgaaaaatccaatttttgcatgtggtgcttatatcatccgcacacaaaaataaaagtccaaaaaaaatccccaaaaatcaaaaccctagctaggtgcggtctaccgccgccgccgtcgttggatccgggcgagggacggccactgctgctgaatccgtgcgggggacagtcctgtcactgttgttcgtcgcgcgcccgccgaaggcgcccaaggtcatcattgccgcctgccagtcgcccctcgccggcgcttgggaggaaagttgagggagagagaggagagaaggtgagaaacaagagaggagtaatataaggaggagaggaggtgagagaaggaaggatggtgacttaaaaaagttttgaagtgtgctgagagggaaagaagaggtaagtgaaacttctagacagacctataagagtcctgcctgtgaaaatacattttccctgccgtttaagaggcccgcctgtgaaaatatgtttaatttcacataaaacttctcaaagagattctcttatgaaattatattgccgttttggattcggaaccgagtctccttacaatatcaactttaaacggacctagccgttgatatagaaggaatttaggggcacatgaatacttgttggaaagcttatggaatatactttcatattattttggttccatgtaaaattcctgccaagttatcaggtatctataaaataggtgacgtatctcatctaatccaaatctgatttaggccttgggccttgtgattgtgtcataggttatgcacaagggatggatgccctaggacta

SEQ ID NO: 74253 - DNA, 8893 bp, Oryza sativa
ctatggcaacagaaagtttcagaagaaatgctatttcttgtcttcaagattcagatggaaaccaaatttttgatcacgaggggaaagctgatattttctagaatgtttttaaggaaagaatgggagtttctatgaaaccttctatggtctttgatctcaatgagctgattgaacataagggggacctttctactctgtgtgcactaattctaaccaaagagattgatggtgtcttgaggaaaatgcctggtgacaaaaccccaggtcctgatgggtttaatgggtgtttttacaaatcaagttggccaatcatagctcaggacttctataggctttgctcagatttttggggaaattcggtggatttgtcttctatcaatttttcctatatcactttggtcccaaagaaaccaagtcctcaaacccccagtgattatagaccaatctcattgatgaacttctctgttaaaatcctgtgcaaggtttttgctgacaggttacaatcgttgatgccaagtttggttcatcaaaatcaatatgggtttataaaaggtaaatcaattcaagactgcatagcttgggcctttgaatacattcatcagtgcaagcagtcaaaaagagagattgttttattaaaacttgattttgagaaagcctttgatacaattgaacatggtgccatccttcaagtgatgttagctatgggcttcccggatgaatggaatgtttggatgagtaacatcttttcttctgcttctacaaaagtgctcttaaatggagtcccaggaaagttttttaagtgtaaaagaggtgttcggcagggagatcctctctctcctctcctttttgcgttgggtgctgatttactacaagccataattaacaaagctcatctcagggggatactctctctgccaattccagtttcaggagataataactttcctattattcaatatgccgatgatacgcttattttcctagaagcttcggcccctcagctttttgctctcaaagctctgctaaactcatttgccatatcttctggtttgaaagtaaattattcaaagtcctgtatgattcctttaaatgttgaggatgacaaagctcacttgctagctgccacttttggttgtgccattggaactctccctttcacttatcttggtctgccgctgggaaccactagaccaaaggtgattgattttgccccattgacagatagaattgaaagaagattaacagtcagttcttcttttctctcctatggtgatagattgacgttggttaactcagtactctcctccttaccaacgtattacatgtgttcgctttctctgccattttcagtcattgagaatattgatagagccagaaggcattgcttatggaggggtaatgacctaattccaccaaaaagtctctggcagcttggggcaaggtgtgcaagccaaagaataaagggggcttgggagtcattgatcttagaattcaaaacagagctctcctcatgaaacatctgcacaaattttataataaggataatgtgccttgggtgaatttaatctggtcttcatattactcaaatataatcccccaagtggctaattcttgtggttctttttggtggaaagatgtctttcagtttgatgtcttgtttagaggtattgcaaagcccattttgagatctggcaagacagtcctgttttgggaggatttgtggcatgataatataagatctgtcaaatatcccaggcttttttcctttgctaagcataagggggattcagttgctcaggatcttcaaagaaatccacaggaccaattcattttacctctttctcagcaagcttttcaagaatataactccctcctagctgaagtgcaagatctcactctctctaatgaaccagattcttggttttacatttggggatctcatatttatacatctcagcgattttataagctctccttttggtccttatctcccccttgttcatttaattggatctggcaaagtaagctcaacatgaaaatcaaagtctttggatggctactgttgatggatagagtgaataccaagtatcttcttgacaggaaacattgtattcctttgaatgccactgcctattgtttgacatgtgggattaatgcaagagagacaagggatcatctcttctttcaatgtcagttcagcaagtcatgttggagaaagttgggctgggtttggaactcctcattagaataccatcaaatgctgaaggttcaaagaaattccttttctcagtatagttttatggaactatttctactggcagcctggaatatatggaaagaaagaaatggccttatttttcaaggtattcagccatcagttcacaattggaggaagggtttgaaggaggatttgagcctacatttaattaggttcagagaagttcatagacccacggttcaatcatggattgacaatctgtaatctttgctttcttcttttgtttctttgtgtgtattattttttccttctttaatataatttaaccgtgggggcttcccccctgtctttgagtaaaaaaaacaatggtctataataaaggcaataggtcattcccacccggtgacattaaaaaataaatgcaatagttgaatagaaattaaatgggaataacgtgatcaaagagtgattgggatctgtgtgacatgccttgctgcccttcaaactcatcagactcttctcctgcacagacagactctccgggaacatcggaatctaaacataaaagaacaaaatcaatcaaaaatagagacttgaaccaactaaatccgatctacggtgaattagttattaatttttgaagtttaaaccgaattaaattatttatagagattttaattgaattataacgcaataaaaaattattttaaaaagaaaaggagatttattgcgtcagcaggcttgggttcatggtgtaccgggtgcaccgaaacggtccaccacgtggcacgggcgaggcggggatgcggtcgacgtggcactgacgcggcgctggcgtggcgatgacatcacaacaacattaccaccggtggcggcggcggcggctcaggacctgacggttagcggcgaacgacaacgaggcggcgcaattggagggcaccggcgggtagagcgcgacgcggaaaactcaccagtggctcggatgacggcgaactgtcgaaacatgaattcggcaataataaaagggggtagcgcacgaggcctaaaagtggatggatgcggagacaaggatttagacaggtttaggccctctcaatgagaggtaatactctactcctgttttgggatttgaatccgccaagtacattgtagatctgacgatatggttgtgtgtcatgccccctagagggcctcctgcccaccttatataggatggggggcaggattacaagatagaaaccttaaccaatacggtatcggttccctaaatctactttacaatcttatcaaaccaggactttaggccgttccataatatacagggaaacgtaatacccaagtcatgatccgttacatattccatagatataagttatcccctataaccagtcggataactatgccgtgtgggtatggggtacccataatctctacagagcccctgagaccttcatagtcgaaaagataatcttctctcgaaccagattactccaaagccaagttcttcaatcatctttgccatggtctcccgagtacttttaccaaatatgaagactatggagggctgaaaaataaagtcaggtgcatcgactagatgcacctaataggtgtagccctcgactatgtggttagctgaacaaactaagcatatagtcaaggaataaataatccaaccaaccgagtggttttgataattgtaatcaaccaaatgacttgatatcaatatatagcatatgcggtgtgaatcccccaaataacatgatccaagtgatataccgactgctttgtaaaatatgatgagtgcaacctaaagttgactacatcattgaaaataaaacagctataaagaagcttatatgctgtgaataaaaaatttccaaagtattgggcacacaccatgcgcacactgctttaacagatgtgcttaagtccctaaaagacacatggtttcaccacacctggaaatatatggcatatgtggtatgaaatccgagtaaataaactcaaaaatgatttaccaaccgcttggaaaatgaccacaatatataatcagcctaagccataatattagtaaataaaaatgcacacttacgtggcaaaaagcaacgatattgtatccaatcaattgcttaaaaactcaaacatcaccttgacttatataaaaaagtcagcggggcagctatataaagctttactgtttgacaccttttaagatgcattgtaccaactcctaaaaagttgagtaattgcggtataaaaggattttaaggtattgggcactggatcacgcgcactttggcctaagcaaaaagtgcctaagtccctaaaagaacgtgacaggccacatctcataatatgggctgcagacatattaggcctaggccaaaaaatatgccttcgacaccctttaaaggatgacgcatagaacacgccaaataatatgatcccaagtgataaatatcctgggtgatgtagatcaagcgtaattgtccctcatggagaataccaaagtaaatgtgataattgaatcccgactggtgcaagcactcagctgatggccctcatgggaaataatgaatagtccagtcgttgagcataagaaatcgactcatgaccataaattcatgttgaatgtatccggaacaagtccaaattgaagatataatcctcgtgtttgagttcataagcccctgagcatatataacttgtccttctgccatagtcaaaattatccattggcaatagctgatgtagtcgacatgaaggcaagatgacgaacatggggatgatatcgccagtcagaggtgacgaaaatgttggtgatgataaaaacaatgacaccaatcaaaggtgatgaagtcgcatagccattggtggcgaagaaaccagtcgacagcagacaagtcagccagcagtgaagacgaaggcgcccaacaacggcgacaaagttgtgcagccacgacagcaaaataatcagtcgataacagacgaggcgcccggtgaagaagacgaagacgcccatcagtagaggcataataaaccagctatgaaagcgaagacaccatgaatggcggcggaggcaagccggtggtgaagacgtaaacgctcatcaatggcaatggcgaaatccaccaatcatgaagatgaagaaaatagtcgacgatggcaaatgcaaccgacggtaatgatgattagcatcaatagagatgatcgactatgatgacaaagttgtgcatcaacgacagtagagtagacatagccgaagaggtatggtaggatgttgatgaagacgatgatatcattgatccagtcaatagcggtgtagcagtcaatgataacgatgaggtctccatcgccagttgtgtagtagaccaaccgtgaagacgaaataacaagtcggcgatgcaagtcggtgatgacaaaagcaaccgacagcgaggacgtagtcaccccttagcaatggcggagacgtcagggccgatgaagtagaggtgttggtgatgatgtcaatgataataatccatcaaactcccagacatgtaaattacatctcaaacttgatacttgagaaatttggagtatattgtggcagcatggagaagccaaaattgccggtgaaataattggagtttctcaagtagaacgccaactcttaagtgaagacgaaactgatgactcccgaagtagattccatagaactcgttggctgattgattgctttgtcttgacataaagcttgtcgaattttgagtcttgtatttgtgtagcccccgactctttggttagttgagaaacaactgaacatagagtcgcgaactgtagcttcttgtcatcgagtagccatcacttgagtgaagatatgcattggggatgtccgagtagaaatattgaagattggaaaaccacttgtagtagtaaaataacacggcatcatatttggtcacgcatgctgagatgtcgaagctcttgtagacgttgtggttggtgaagtatgtcacgcccgaaatttctatccaaaattccaaacgcttacatgtgtgtaaattctcgtccaggaatcagccgaggcacataataacaaattgataatagagtgcaattattactctaattaataagggaatataaagtcattacagaggcaattattactccaaacaataaaaatctaagcagcggaaaataagataaacagcgcaggcgactccatcccacaagcagcttgacaagggctacgcctaatcctccacaccttcagcatcactgtagaactcctcctctgatgaatgattgcaaggtgagtatatgacatactcaacaagccacacaacaaatatgcaaatgcaagggataacaaaggatggcataatatagtctcatttgcataaatggcatttaataaatacttcagaatttaataaaacagtaaagtatttaattacacaatattaatccaacgctatacaacatacccgttgcataggcccaaccattcttaacaaccattcccagcggcacagttctatctccaaaccaggaatataccattccaaaccaggagctaaacaagttattaccaattacagtatcatttattatggtgagatgtatgaaactaatcacgaatgacattgttagacccgcccataacagcgggcacggctattcgaatagttttactctggccagaggtgtaccactgtacccacaagacacaacctcaacatcatgtcaaccatgcgtcgcgatacttaacaagtacccgaatagagattgtgacaatacccttcgcataacacaattcaaagcagtgcacccttcctggatcataatcacccccttataaacaaggcatggactccccagcgacccctgtgggcttatctccgccacttcacagtctggtgctctacaatgaaccatactatacaaaaagtaaagccgttgcccacgctggcttgtggttggcacggttaatgtttcacaaccgaaaatcgtgaactggtccttaattgtcatgagcacgaccatcaaaaccatgtgctcacaacccaccattatcaagttttagttggcaaattaattaattaaccaatcacgattaaccatcgtgagctatcattaagccatcattaaataatagtgaatcataagttatcccatttatatgagctaatgtctctaagcatggctaagcatcctaagcactttagctaaaaccatataatgttctagctaatccaattattaaccaaatgacaaagaataggtaatcaataacaaaaagactataacaaggcaataggttattcccacccggtgacattcaaaaataaatgcgatagttgaatagaaacaatagctttaaacgggatcaacatgctcaaagggttttttgggatctgtgtgacttgccttactggccttggaactcttcaaaatcttctcctgcaaaatcggactctccgggaacgtcggaatctaagcataaaagaacaaaatcaccaaaacagtacataaacaatcataaacagcacatgtggatatttttaacatgtagatctcaattttagaaaaatttagagacttgaaccaactaaatccaagctaagatgaattagttatgaatttttaaagattaaattggattaaatcatttatatagattttaattgaattatgacggaataaagaactatttttgaaaaggaaaaaggatttattgcgtcatcggctcgggttcacggtggaccgggtgcacagggacggtctacggaacgaacggccgagatctaatctaaacaaaacggacggccgagatcgattcgatccaccgcgggtctacggatgacgcggcgctgacgttagcgatgacgtcatcaccggcgacggctcggcacctcgggctcgccggcgaacgacggcgcggaggcgcaaacggagggcatctacgggtagagggcgacgcggtgaactcaccgaaggctcggacgacggcggacgtcaatggacggcaacggcggtgaggtcgaagcggcggcggcgttcgggtcgacaacgacggcgatgctccggcggtctttggcggaaacggaggacgggacgaggacggcgacgacttggcgatcccaacgacgaccttcccgagcgacgacgacgaacggagcggcggcggcgcacggctggactcccttcgggagcggcggtgcacgggctctagtggctagggcgctacgagcggtggcgagctaaagcgagggtggcgacgaagagaggaggtcccgggggtccttatataggggctagagggcggcgatggaggcccacggcaaccggcgacggcgatggaaggtttagggttagaggagagaaaacgaatccgaattgagctcgaatccaacaatttccaaacgaaattagatgaagtttctataggagaaaagatagaggagatcaaggggatcatttcccctctaccaatttgaccggatcgggaaaggggcgatgtaatttggaagggggcggcggcggctggcgcgctagggcgtggctgcggcgtgaggaggaagacgacggccctgacaggtgggcccacctgtcggtgggagagaggagggagagcgggcggcgcggctcggcgggctagatgggccaggcgctagcaggccgcggaga

SEQ ID NO: 74254 - DNA, 8054 bp, Oryza sativa
cctatctaaatcgagccgagccggagccgagccagcgggccccaccacgaccgcacgacgagcaatgcgatcgaggagataaggtcaagctcgctctcttcttctctctcgtctcgcctcttctctgtctcgctctcttctctcatctctctcctcccttcttgatctcctgcagccagcggaggcggaggcgacagcggcgaccgcgccctccccttcgccagatccgggggcggcaggaggggaggcgccagcggcgggcggggtcggcgccagcggggccggcggtgtcggcagcgggtggcgggatggccggatccggcggcgggcggggtggctcgaggaagggaggcggcggaggacccgccagcggggaagagccctcccctccgccagatctggcgggaggggaggcggcggcaggggcggtgatggggaggcagcgacagtgcgacaacgactcatgcgacgatgacttcatccggcggcatcttctaccctcccctcctgcttcttctccggtgatgaatgttgtgatttttttattgcataaatttgtgttgtgggatgattgttgtgggatgaatccatctttgaatgctgtgggatgaatcagtctttgaatgttgtgatttgttctgttcttgcggatgcgggttcttgcggatgtgggaggtcttgcgatgcgatgtgggaggagggactgctcgcctgcttggctcgatgcgtcggctcgatcgagctgtcacatcgagccggcttttttttgattcgtcgaacctaaaaggtgccggttctaagcaaccggcacctttttattttcaaatcagtgccgccttccttgtgccggttgggaaaaccggcaccgaagagggttccccaaccggcactgaaatcattttctgtagtagtgaagcgattttgtcccataaatattattgtcgttaaggttcatccatcccgcgccattaaatgcactgttcatcctatagcattcaacgagggatgctaacggaactctaacggtgaaggtatttttgggacaaagtcgtatgcacaatggtatttcatggaactcgtactcttcgatgacatttcttggaattgtgcacttgtgaatggtattttttggattatttcttatttttttagaagttgctgacttgctggtactaaggtgtgatagaaaattatcttggccatgaacatatatagaaattaacattgaacgaattatatagaggatcaatttttccaaaacataaaataaattttttctttcttaaacataaaaaatgaacttttgcacaacttatttctatttttgtttagattccaaatagtatcttcaaaacatagttgtgtgtttagctgtcagcatattatcggtgtgcgtcacgttgcgtccattttacttgcgtgaatcgtgttgggctaggttcgcatggactagccgactaattgcacctgaatgagtaatttgcaagctattataccaatttatacctatcccgtaaatttgtataccatgagcgcaatttatgttcaagagttagtaatcacttgtattaataaatcaataagtaaaccgtcaaaaaaattaaatcaataagtaaaagttttcatagacactttattcatgacaattttaagtaaatgtatgttcaacgtgcatacgggtgagtttggtgaaaccttaagaccgttatacccaaggtaatcaaagtacacgtggttttctgtaacttcgatttttttttcaaaaaaatacatatttagatgttaaaatcatgaaaaacactactccctcagtttcacaatgtaagtcattctagcattttcatatatgtctagattcattaccatcaatatgaatgtggaaaatgctagaatgacttacattgtgacggaggaagtagtatacaaaacaaggttatattgtacttgggggtattttgccaggctttgatagttgagaggtgttaaatgttgttttgatagttgagacttgagtggtactatttgttagagtttgtgtcgaatatgtgtacatagtcggttatagtttaggacttggagttgtactatgtataggactagagtatgagtcggactctatcctaggatctctcataaatagaggggcgtgcctgttgtaaccgcatgacgacatagcatagcgagagggagcggctgccggcggtaactggccgtgagtcgttgtaactctgatacgttgtatatgctagatcggggaggagcgctcgtaatcagtgccccggagatgtaggtatcggctgaactccgttatcaaatatcgtgcctcggtgtcgtcatcatgtttggatctcctgtggcgtttctgccgcgtttggtttccgatgtgaattcagagccggtttctaacaagtggtatcagagcctgcgggagatctatggtagaggtacgagggaggtgctccacgccgcgacgactacacggggtgtccagggacgaacatggacgcaaggtggagcacggcggcgatcaacggaatttgatcggtggaatcggacacttcaggcggtggtctgaaccgttcgatggctgcaatcaacagggagatgaccagacgtggtgctcgggttgatggcggcgcaagcgattggcggtccaatcggtgggtcggacacttcgggcgggtggctcgaactttctggtgagctactctcaacagggagacgtgtggccacacgctcggggttgattaaagctggaggcgatcggcgttctcgattgatggaatcgaacactctgggcggggtggcccgggcctttcgatgagttgcgttcgacagggagacggctagacgtagcgctcgggtcgttcggcggctggaaagacggcatgacgatttgtcggcttcggcttgcggctaaattgacggttgtcaattggaggtcggagcggatttgttggcgacgaagtccgagcggcaggaacacggcttggtgtggtcgtcgtgttggtgctggcgggattcgacgcgggccggctcctgtcaacggaggcggcgacggtatgcacaggagctgcacaaaagttggaccaatcaatagaagctgtttggatttgtgccatggatcacacatgcagtcacgcagagaagtcatcaagcatgaagacatcaattaattaattgcatggttgcatgcagggagtagttaattggatggatgtgcttgcaggctcggttcatggtggctgtggatgtgtgtatgcatgcagcagaggggtccatgggcatattgtgcgttggtccaaggcatcgagcagaggttgcatcggaatcggtcgtaggtagatagatgcatgagcagttttttccgcttgtggaggtcgacacgatcacggagttgttttcagctcggagatgtgatggatgtggagatcaatacggaggctaggtggctgggattgtcaccaaagccaagtcggttactcatatggacggtgctgttagggagtagatcgaggccataggatcgacagcgaaagtaatcgtgcatcaaggcttgggcgttacgattcaaaggcaaaaggttgtgtcggtgtaggagtgcagtaaggccacgtgcaaaagaagttccgggcaacggcgggtgaaatatgttgatggagacaacgggtctgtctgacagtacaggatatatccagaatctacggggtttgtataatggggatatatgaaatccgcgtcactaaaggagaagagcgaacgctatggtgataatttcttcgggtgattcaaggcaacggtgattttctcaaattgtccagttcagcctacggatgtggaaaagcgtggatgttggatttgttagctcggttcataagacgacaaggaagaaagggttctcttcgtgtctagtgagtttgatttatctatttggtgatgacgtcggttatctggccatggattagatcaagtcaaatttaagatggtagatgaagttgaacatggctttcaagaagtctataatgtgacggctaggaacgaattcaatttcacttggcaagacgattgtggtgataggagagaaggtggagcactgttgcaggtggagtcaagaggaagaagttacaaagatggcggagtctcttgttacggtaagcctggtggacgcttgtcggggcagctcggcgagagcggcgaaaaaggaaccaactcaagtccgggtacacggaggttcgaacaagtaacaaattcaggtcgtcgtggcatattcgctaaggtggagtttgttagagtttgtgtcgaatatgtgtacgtagtcagttatagtttaggatttggagttgtactaggtgtaggactagagtatgagtcagactctatcctaggatctctcataaatagaggggtgtgcctgttgtaatcgcatggcgacatagcatagcgagagggagcggctgccggcggtgactggccgtgagtcgttgtaattttgatacgctgtatattctagttcggggaggagcgctcgtaatcagtgccccggagatgtagccctcggctgaactccgttatcaattatcgtgcctcggtgtcgtcatcgtgtttggatctcctatggtgtttcttccgcgtttggtttccgatgtgatttcggggccggtttctaacacttagtaagacaaacctaatagttgaggggaagggtgtaatgtggatttatcccttgataatacaaatattacttcccgcttttatatacatagccatattaatttaatacgtcgtgccttgtgtgtgcgtcataatggacaaagcaaaaccgtcaattgaagtagctagcgcacatgtgatcttcctttgccatatcagaacaaatcgagagcaacaaaatggacaaaatttcgtgtcaagaaaagcaagaccgtcagcgcagggcacagccacaggaactccatttcgttttgtttcatgtgttgtttctatgcatcgacttattttgcacaccgtgtccacatggccgagcatgtgggctaggagctagtatcaatcacttcatgtttggcagatattttaagttatttgttagcatctaattttagtacttaatttcatctgaaataaaaggatattcagaaaaaaattatccttaattttatatgcaattgtgttttctggttttccaatttttttgtgcgtttttgtttactttttcacaagatgatatgataaattggtaatcgccgggcgaattctgctaatatattttcaccttgagtcatatttgcattcttgcatatatatatatatatatatatatatatatatatatatagttatttccttttcaccggattttaacatataaaaaaagggatgttaacatgttgggcatgttacctggaacctggaaaggcagcgaattcaagcaccgtgtttggagtccaaaaaagcatgagacaatatttagcaaacctagattaataaaatggccggcatgtataaccaatgcatatgcgccgcagctcatgtacttcttttcatgacagtgcatgtaaccgtacacagcagctagagtaattttcttttcctgaaagcaaatagctcgtggataaaggcctgattagttaccaaaaactttttctcaaaaacatcgcatcgaatctttggacacatgcatagagtattaaatataggtaaattaaaaaactagtaagtgctacagtaacccacatgtgctaatgacggattaattaggctcaaaattcatctcgcggtttccatgcgagttataaaattagtttttttatttgtgtccgaaaatctcttccgacatccggtcaaacgtctgacgtgacactcaaaaaaaattcttttcacgaactaaacaggcccaaagtaaacattctggcaacttttttatgtagattctgtcttattttgttttttaaaaaaatgaatatactgaatgaaaaaaaaaatgcatgcgtatatgcatggtttgatttttttaagtcctttagacggttctactatatagcggtagctgttctagatttcaagtttatttgtatccaatttttcttttcttttcttgagtaaattttgtcagggttatggataccacatacctaatagtagttgactaaatctcggcaggacccaccacataacatgttttatacggaaacaacatttgggtatagaaggagttccggataaggaaagataaatagagttctacatggaaacgacaaggattattcggattgtatccatattggtttccctagttctaattggaaaagggaacacctataggtataaatacaacggaacaatagatcaagacataagatcaatatacaagccaacatacgccaagacaagacaccggatattgacttcagagataagcatggctagtcccctacagtgtctacggatactgataggagagacatagcgctgtctttgatcttgccggatgtggattcgaagagaaaggctaccctgttgtcgactacgagtcagcacttcagaccgccaagtcgacaacacttagataggctaccccaaatattgtactagtgtgattatggtgaataagagcaacgaccggcttcggtcaacaggagtagggttattacctgacaattcaggggcccgaattgaacctgtataaaaatcctcgtccccatctcttttattacaatctcgcatatattctagtaccaacgattcccatactatgcaaatactggaatcgcgacatcaaacgtcgccaaatttcataaaactacatatgctttaatcaaaattatgataaaactctatatttaaggtagtgtatcaataaactacaaatttaaaaatattttttcacaaaactacaggtttaagctaagtatcacaaaactacatactttagggtttaaatttttagtactaatattagtttgtgtaataaaggtccatattttgtgattaaattggtgttgaaccactagttttgtaatactttaccttaaatatataattttctggtaagtttattgctaaatttgttatatcaggttaaatatatagttttatcatggtttggttaatatattataattatgtaaaatttactcaaatttaattgcacccagctttggtccaaggtagatcaccagtatagagacttgatagtagtgtcgccatcatcatccgtgtagacaggtctaaactacgcaaagattcgctggataagaacaaactagaacagactagtctatgaagtcataaagtagactagtctgaaagttacggttcttgtatatatcatggtgaaattatcaggacataaacgttcaagttgaaaggttcaatgtgcacctttttctttcatttctgcaacataatctgtctaatacttatatagttaatccccactaaatataattaatactatttctctcttctctcattaagccacattatctctattagttttagcctttggattcaatatatatggttcaaattgtctcctttcctctcccataaaaccatataattataattatttttgactcaaaattcatattagtttaataattatattgtatcttatttgtacatgttatacaacttaatttaacgcgataatgtggcatggtatttatttgtaaaaaaggtatataatggtaaaatagagaaataaacggtggattattgagatgtgagcagcttctgggtacaaatggattattcgcagtgtcacccctgtaaggagcactactaataaaaaattccaggtatttacgggcggaaaaaagtagcatcacaaaatagttgaggtcttcttggttttttacgggcggaaaaaatagcgtcacgataatagttgaggctgtctcaagtcatacaccgcctgtgaaaccaattttcaggtcattagtttacatgcaggcgacttgtggcggcgcctgcaaaactcgcccccccgggggcgggtcgacgagccgcatgcgaagatccattatcgcatgcggctgcttaagacagccgca

SEQ ID NO: 74255 - DNA, 9671 bp, Oryza sativa
attttgatcatttgtctatataactttgtttccaacagcttgaaattgattttgataatatgacaaatctaaacagcatttgtaaatattaaatgatttcaaatggaaaagccataaacagctaacttgtacagattatcaagatctacaacttttattttggtcacttcttcatccgacaaagtgatagtaccaatgtttacaaaattgacatatctgtgttgatatctataaaccagatgagagaaatgtgatttttgtgaatagtataactatcactttgtcggatgaagaagtgactaaaataaaagttgtagatcttgatgagaggatcaactttgttgttgaccatatttccatttgaaatcatgtagtatttacaaatgctgtttagatttgtcatattgtcaaaatcaatttcaagctattagaaacaaagttatatagacaaatgaccaaaataaaagttgtagatcctgatgagaggatcaactttgtttttgaccatatttccatttgaaatcatttagtatttacaaatgctatttagatttattatattgtcaaaatcaatttcaagctgttggaaacaaagttatatagacaaatgaccaaaataaaagttgtagatcttgataacctctacaattttgttgttgaccatatttcgatttgaaatcatttactatccaaaaatgtattatgactaacaaaatgaattattatacaccagctatatttttgtactcacaaatataaagacttgaatggaaaaatggaaaaatagtcatcggtgacgggccttagttaaagcccgatagagattaatctatctctatcgggcattatcttagggcccgtcacagatgagtcatccgtgacgggcctgaatgtcatctcaatcgggcattagtatggagcccgtcaccgatgagtcatctgtgacgggccctaccgtaaagcccgattgagatgactcatcactctactataactagggtttctcagatcggatcgaaaatttttctaagtcccgctacactttcctgcctacttagaaccctagcgccgccgtcgtcctccctcgccaagcctgccgccgtcgccaccgagcccgccgccaccgccgtcgtcctccctcgccgaacctgccgccgttgccaccgacgccgaggccaaggccgccgcctccctcgctgagcccgcgtccgccaccaccgagcctcctcggccctccattcggaccaccgccgcctcctcaccgacgacccccaccgagcccgccgccgccactaccgagcctctacaccgaccagaccggtgttggccttcctcatcgtcgccgcccgcgtcctcaccgacgcacgtcgccgacccccaccgagcccgacgccacccgaccggcgtctccaccgaccggcgccgccctccaccgagcccaccgccgccgccgcgaactcctcctttgccgagcccgccgccgccgccaccgagaccgctgcctccaccgagcccgacgccgcctccaccgaccggcgacgccgtccaccgagcccggctccgccgccaccgagccccaccggccatcctcaggtgagtactccatcgcgccgtcctctgctaactgtgaatgacatgtcattgaaatgtggatgtggatgatatgtgattgaactgtgagtgagacatgtcgatgttgggatgaaatgtggtgcatttatgaattttgtgatagatgattgtagtgattgatgaaatgtatttcatttaactttatttatatgcaatgtggttcatgttgggatgaaatgtggtttatttatgttgggatgaaatgtggtttttttatgttgggataaaatgtggtttatttatgtttgggatgaaatgtggtgcattaatgaaattattgtgaaatgtggttaattttattactgtgagatgtgcaatttcgtttatttatacgtggtgcattaatgaatttagtaaatagatgaaatgtggttcgttttattactgtgagatgcgcaattttgtttatttatatgtttcatttatttttataagtgacattcaattcattgtaatagattgtagcactcaattgtgtatttttgttattttgaaaaaaagtagacgatgtctcagcaaggcgaaccaatgtcgacgacaactagtgggtcctcaagggcacgtactcctaggacaggaaacaaaatccctaaggaacggttccgcataatagcggtggatgccgtagggttgtcgacatctccaaggaaaatatggagccgatttaggtctatctgcggggtcatagggaggcaaaaattcagtattctgcaagatgacatcaagctcgtgccggccgcagagaaggacattgcttggctaacgtttaaggagagcttcgattatcctgcggagcatgaggaccgtcttaggcgggctgctttcaaggttatgggcaatgcttggaagaacttcaagactaagctagtcggcgagttcgtctacaacccgacgaatccagatccaagagagaaattttcttggatcatggaacaggtctgggtggaattccatgcgaagaagtcgacccccgagtccagagctagaagcgaggcatatcacttgctccagaccaggaaccagcatccacaccggcttggcaccgccggatatgccggtaaggaaaaggaatggccgcgtgaggatgaagaagcggaggaatcgaacacgccactcgtgtttggtgatatcccacaccctcgggctaggaactgggccagggccaggtaccagaagaatgatgatggcacaatcttcatgccaaatgcagaagatcaacgagtgtacgaagctatagtaagtatctagtcaaactagatgtttgcattgtttcccatcgtgcagtttatttaaccccactaaattgtaatgcagaaggagttggttgccgagcaacaaccctcgcaagaggcctgctctcaaagacgcgaggacgacctcctcacgaaagtgttgggcaacaaggaacaccgtggacggacacgaggcgttgggtcttctgttccctggaagtatggatttccatactacgcgtggcagtacaagaagcggacttccaacaaggcggagaaagatgcatggcttgaagccaatatccgggcgtcgataagagctgagctgacatctgaattcgacgaaaagctcgagtcaatgaggaccaagattaggcaagagatccgagaagagcaacagaacccccaggccaccgctgctgcggcgcacgaagagttaggaagtcccacccaaaaacgcagcagttgcgcatcaactgagttggcggaaaatccaacatcggtcgacagcaccgtcgaccacataatggtaaaagtgaacttactcaatacatgaaagacttaacgaatccatattatatgtaatattctaaaaaaattgattaatctatcgcaggaaccaacgagctgcaccctcatagttagggtgatgccgaccttcacggttctagcagccgagggacttgcgtacaagccgaccccaaagacaagagtgcatggagcgcaactcagggccgactgtgcaaaagttcaagtcgactcggtgaagcccaaatacgagctgttccctctgaagtatccaccgaacgacgaggtcctctcactaggaaatgcccgtggtaccttcatccaatggcccaaggacctcattgagatcagggttacagcgaggccaaacactgcaccaggcggtcgtctaccaaagagacccacccctgctccttcagcccctcctgctcaagatcgtcatgcacaatcttacgatgtgcagttgcagtacgacacggattttggggaggaccgaacggaggccgacagcaaggcaattcatgaacccccaccgatgaagaagagcaggaaggcacactcttcccctcagagaattactctcgataaacccgaagcaaagaggagaggaaggggaggaaaggtgcaggcctcgcttctagctccaaggaagctagatctgggcaagggccaggaagagactaagggcaaagaggtcaagaagaaatatgtcgctccacaggagttccgactaggcatgccattggttggagatgacgtgcttgccgcaatgggcaccgcttgcaaggaccttcacttatactacatggagaaatctaacgccaggaagccgaataaagccaccgatatccttggagagcacgatggaaagccattccttggtccaacaaattatatcatggtcaacttcaaggatcttttcgacctctacaggctccgagcggtggacacaagcctcttaagtgctactccttgtaagtattgtcgcccaactcaatctggtaataacaatcggtttaactttcttacaagatcgtttatcctgtgtgtaggttaagttggcaatggtgtcagaagcatgcaccggaaattgccttccttgatccacaagtggtcattgtcacaaatctccagaatgaccgtcaaggaatggtcaactacatctatgacaccttatggtcccgccgagacaaggagtacattatgtgcacctataatcaatagtcatgacacattccttgagtacttaattaactttcactatattaatgccgcagtgcccattggatccttctggtcataacacctaagtggagtacatgtcactacctgaactccagaattgataagaacgcatatgatttgaccccaattcaactagcgatagatgaagcgtgggcccaatacgtgcaaagaggaggcctcaggaagataggacatgacaccctcatccacaaaaaagacttcccggtgaagcaacaaataggtgaccagtgcggattccatgtgtgccacaacatgcgccttctgtatagagaaaaggtgaagaccttggctgagtttgaggtcggtggtctcaattatgatagactaactacattttagtacttatatatgatcaatcaactaatctggaattatgacaatgtagggcacaataaccaagtctctgcctaccagctttgggaggttcacgaggagatagccagcttcatcctccatgaaatagttaaccccaaaggaatgtttaggcttaaactaaaatgatgaacaatgttgaacttctatgtttaggcaatgatgaacacttattatgcaattgtgatgatgtaactgtgatgcttatatttatgtatatatttcatatgtttatgttaaaacttgctaaataaatatttgatctaattaactcggttttgcaggtgaaatatgataaatatttgaatggatgtgaaatatgtgaatggatgtgaaatatgagatggctgtgaatgtgtggttgcgtgaaatatgttgatgtctgtgtatgtgaatgcatatgtatatgaatgggtgatgctggggagctggggatattagatatctgtgtttgtttctgtcatttttgcagcgggtatggctagcaaaggcctgaggctagccaaaaaacaaaatttattttttttgtggattatagtcatctgtgacgggccataactaaatgcccgattgagatgaggtcatctgtggcgggctctattttaggcccgattgaggtcagtagtcatctgtgacgagctctagtttaggcccgattgaggtcagtagtcatctgtgacgggctctattttaggcccgattgaggtcatcagtcatctgtgacgggctatagtttaggctcgattgagatgagtatcatctgtgacgggctctagtttaggcccgataaaggttagtagtcatctgtgacgggcgctagttgtggcccgatagagataggtcatctgtgacgggctatagtttgactggtcgtctgggtcaaagctatcggtgacgggctttacttagggtccgattaagatatattcattcgtgacggccgtttgcctgattgagataactcttcacatcagtgacttctagcctgtgacggacgctgtgcccgattgagatggggcttaccgcccgattgagatgagggtatcctttctagtgtctctgtagaaatatatatatggatctagttatttgagatatgtcagatctatgtgtgtggatgagatatgtcagatctatgtgtgtagatgatgctatatgggagtgcaatctgtgggagtgttcaaaaattattttgctttggtcgatttcattaacaaatgtcaaaggtttctcaaagtttttagaattttggatcaaactgtaacaagttttagaaataagcctaaggatgatgatgtttggttggatgtatcattttcgacatggtgcatcgaggaatgattcaaatacacagaaatgaacacggctgcgatagagctctagatttaagttactagggatcaaattttagctttcctaaatcaagttcatgcatttttagttttaggacagcaagattgaaagatattcctatgactgttatggttattgagtttgatattagagatggttcgaggtctctaaattcttgcatgattgaagctaacctatcatactaccccccttaaaatttaaaagttttagcaagcaggattgtggtatggaagatgaacaagctaggtggtttcaggtctgtcctaggtgtcaatctgctgaaaatagaagttaatgaccaacctagaaggcttgtaaattcaaataaaatttatattcaggttgcttacaaagttttctatgttctgggaaggaattgtgatttttggacaagtactttattttattcaaaaagaagaagacagatgatgcagttctggaacaggttattatctatggttgttgaatttttatctcttaatctacaggtgtaaaaatcccacgaaaaatcatgaaactttcctgacaagaatacaagttactgaccaaaggttttcattttatcatttatggtttaggagatataaaattgttaagtatgcaacctacagatttcagaacctgactatgcagactatatgaatttttacaccttgatgcagaggttcaaaaattctaccaaaattcatgatgcttcatatggtagtacactaactactgctaaaagatggcatgcttatcacttatggtttgggctacaaaatttcgtgaaagttgctggctataaatttcagaacacgtgcaactaatgcatttgaatttctatagcatgttttaagtttgataaattaaccattccatcataacatgaaaccaacaagattcagaggctataagatttttgggtggtccatctaagcattcaatctagtggtcataacacaacaattccatcctaccccaaatctacccattcaaggtcataacgaaattttgaaatgctgggatagaagagcataaaaaacccatcaaatttcaccatggtacagaagtaacatgtttatgtgatacaacctaacatgtctatcaaattttaatttatttaatcaacttcaaaacctacactctatatgccattccaaaacccgagatttttgcaaaaccgttctaatacataggagaattttgcaaatagattttaaaacttttcaaaacactttggtactgatctattgcgattaataagcgttttcaaactcatttttacagaaatataagctttcaaaaggtttcggtcctatggaacaagataaggagttttagaaatcaaaacatgagacatagggaaataatatccagagagggataagatataaggttaaatatgattttcgcaaataatttgtagctgagagcaaagccctcaaaataatttttttaagaatcaattctaaacgaccaacttaaaggggctcctatagtcggtatttgctctgataccatgctgtcgtaggctctccggaccttctattataattgggagataaagtgaataattcaagtcatcgagcaatcataatgaaacatccgacgcctcgagagaggaatattggagacattgctgggcctttagcctgccagtcaacttcagcctgagatgtgcccgtcaaaccactcgaaggcggcgaccatatgtgttacacattcaggagacttgacaaaaatggctaaagagctacaacatctcaaatattcctaactcatactcatgtgaatctagttcccaggaagtgcactagattcacactttcatcttaagtatgaatatacatagcaagatacatctaaagcaaataaaactcagattacaactaataaatagatacataggccgaccggccaaatataactatatcagagaacagcggaagcttgactacccaatcctcaagcacaccgactaggggtttaccccattaagttcacatcctagaagaagcagtcgaaacccgcatcactcaaattaaactaagcctattcctgcaaaacataaattagacaaaacatggcagagcactatcaaacctacatacatgaaagctctatgtcaaaggaaaggctatttgtagtctcaattttcagcataaagcaaattttagttcacaaaccatttgcaacgtaatttaagcaaaacattttagcaaattgtgaagcatattaatcatggcatgatatcaacataaatagatagacatcattcccttacaacacaacgggaagtaaggcaatcatatcacatatatcaatcttatcatcaactcaaatcatttagtttcagaaaaagtacgaattaccgccccccccaaactatcgcggccgtccaaattacccccctgaaccacaaaaccggacattcttcacccctaactatgcaaaccggacgaattactcccctcgacctaatccacggtggttttggtctacgtggcgtacgcgtggaagtccagtcagcaatttatttattgaaaaatactgggacccacctgtcatactcctattgcacttttccccctctctctctcctctctctcactcttcctctctctcttctctcactctctcacgcgcacgcgcacaacagcaggcggggggtggcgagcggcggcggggtgtggtggcagcggcgaggcgaggcggcggtggaggaggtgaggcggcggcggaggagacgaggcgaggttgtcccatgggttttttctggttgtctcatgctctcacgattggtcagtgtgtgtcgtgttcgatcgatctacatgtacagatgatcgatcaatcttcgaatcgatcgccgtgtttttgttgtgtttggtgatgagatgatggttaagtggtatggttagtgtgcgctaatggcggtggtttggtttgggggtggttgtgtgtgtgtggttgcagggtggagagcttcatagagcaacaggatgcgtgtaactctggacgggtgcgcggcgaggccgtgcccgtggtgacgacgctgccggtcatccgtcacgcagcgctgcggcatcatcatcatcatctgccgccgccgccgcctgagcagcagctcctcccggcgtccaccacggcaccgttggccgccgcgttctcgtccaactccacgaccaccacgaccaccgtctcctcctcccacgagcaacacgccaacacgcgattacgatgaagctgcagctctccatcggccccgccgtcgtcattgtcacggcg

SEQ ID NO: 74256 - DNA, 786 bp, Oryza sativa
agcaccaaccggggctaaagatcccggtgatctttagccccggttggtgctactaaccgagactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaagattttataaaatagttgagaaggaaaactctagtgaaagttaatattaaataataaaaaacaaactaaaataaaaattaaaagaagtaaaacacattaaaattagtttaaaactttacaaatagattttaagaattatttggtgtaatattttatgatttttgtatgaataaagatatcttataattattgaatgactgccattattgtaaaaataattatttgggtgcggttttttgattcatgtaaatggatcgccaatggatgtacgttgacgggcggtccaaagagtttatggacggcgtgcactattttttaagagtg

SEQ ID NO: 74257 - DNA, 3621 bp, Oryza sativa
aaacatgccaacaagcaaaaatgcagctaccaatgaacttaccgagatgccaaacactagattcaaatgtgcaactaatcaacccgatcaagatctacagcaaaatcttcaaaaaaaaagctactgtaaaagcctattctcactaatccccccatattgtttctcatagaagcacaaacccacatctagaaccctagcaaaccacctccatcagctctccgaatcccgcaaccaccaacaccaccatatgcccccattccgcgctgcaagcatccactgtggacaccaactagcagagaatcacgacattacagctggttcatcctaagcatcagcagcagcagcaacaacaacaacaacaaccgccaaatcgagaccccaactcactgcgcgaggtgggagggggagaggacgttggaggggcggaggcaggagcagatccaggcgaggaggggccgcgcctcctcgtactggaacggccactcgagcgcgtccgcgtccagcgggtcctccccgtcgaaccccagctccgtcagcgccgcgcacagcgccgcgccgctcatctcctcccgattccaaacccagcagcagctcgctcgctcgcctgcctctcgcccggcaacctccgccgcccgcgtctcccggcggccgcagccgcagccgcggcggcgcgtgggtgggtgggtgggtggggtggtggttgggggcggcgcggccggcggcgaagcggaggcgagtggtggtgtgctttttcgcgtcgcgttcgttcgaaacaaagagaatttcggggatccggcgtgaaattggaaaagaaaaaaagcggtgtggtcgagtagtctgcgtgggcgggaatgagggcccaatggttggattttgcggcccatgtataagggtatggaggcccaataaagcgaatgcgagtagatcactcgtttggccctatgctccgtttttttttactagtttacatgtccgtcaggttaatataactagatgaatttcccgccatgttgctgcggaaaattaagttatattattatatgtacaaataagatgtaatatgattatcaaaactaaaacaaattgatagtacaattttgagactaaaaataattgagattgcatggttttatgacagaataaagaagagacaatttgaatcatatatctatcatccaaaggctaaaaataattagggtgatgtggattaatgagagaagagagaaatttcattaactacatttagtgggaatgaactatataagtatataggattagtgatagacaggaaatccgtatattgatgggagaagtccatgtgataaggatggacagtgattacttttaggtatacggacgtgctgcgcacgttgagacttgagaggaggggatgaaaagaggacgaatttttaagatagtagagataccatgacattgtgtagcaatggaattataattggttcagttttttaatatatattttttatttttgcatgaaaataatattttctttggtttagtatttttagggagttgttttcttacacgaggaaactacgatggtggggggaggactactccaatataaaatagcagaaaaaaaatatttttgagttgttatttactttttttttcaagtagtactacttgcatattcatccgccttcctctcctcccaccacccagaaaatcggtcgcatatcaatcctcctcctatccgcgaggagctgaatttcaattcatacttttgatattgccgggccggtcaagataggccaacctgatttacttaagactgaggaatataaacaaatatataaagttttgacttcaacaataaactgtcgaagtaaatagaagttgtcacaagagcaacctcccaaaagaaaacagattacactaagggattgctctcctatatttctaaaaaccacaacttcctttcaaatcgccacttcctctttaattgaaccaaacaggaaacctgccgagcgctgctgattctaaaatacacacgcgtatttctttccttccaaaccatccaacaaacaagcagtataaggctgtcaatggcgtccttgtagctgttctgaaaattttgccacattgctaaccaccattctcctaggtctaagcatgactcagatggcagcaggaagccaaccccaatctagctcttgatcattctccacatcctggtcatgtagatgcaagacacaaataggtgctcacaatcttcatcacccacccagcaaagttggcaaacatgttagtgcgactaaccacgcttacttagattatccgccgtgaggcagcgtcctttttcggccaaccacataaataatttcacctttgatggcgcttttgtttgccaaatcagagtaccacatcgtgccaccatgtattcatactcttaatatatcctcattcctaagttatagaacgcgttcaggtacaatccattctaattattatatggatctattgtattgtattgtaagcgtatgagtatgttactaattttaaaactaattaactcgtgcatcctcttctcacaatagagatttttgaacgccaaactgcagcaatatggagttgccaaagttcaaatattacaggctcaaatgtggaaatatgtccttgctctatcaatacaaaaaaagacaaagcttttgcctttgctagtttgtttttaaaaaaaaaaacattgtggaaaacatgcgaaacgaatgtgatttcaactacaacccagcgtccatgctggtttttttttttttttttttttttttttttttttttttttttttgcggggagcgtccatgctgttgattggattgaatttcagcaacatactgttagaagctggaatttcgtgagagagccgtgtactcctacgcttgctataatctgttttttcttctatacgaaacagcactacgatgcagagagcttaccagatcgaatcccttgttaacacagatacaggttgcttccaagtctactgtaccgataaaacctaacttaatctttaagaacgaattaccagtccggactacggacagataatcagggcaccaaagaaagtcgcattcttcttggacactaattataaatattaaacatggagtattaataaaacccatccatagtcttggactaattctcgagacgaatctattgagcctaattaatccatgattagcctatgtgatgctacagtaaacagtctctaattatggattaattaggcttaaaaaatttgtctcgcaaattagctttcatttatgtaattagttttgtaagtagtcaatatttaatactttaaattagtgtctaaatacatggtctaaagttaagttcctggatccaaacaccaccttctgattagctcagtacggtcactctctgttgcagctttgcttcgagggtggacctgcaggaataccgctaaaaaaaaagctactccctccgttataaaatacaacaatttttagccctcggtatttatcccaaaatataacaactttttcaccaacattatcttcccaaccaatcataatcctccaccattcacttttctcacctacctccattgctcatcaaatcgcaaaccttcacca

SEQ ID NO: 74258 - DNA, 659 bp, Oryza sativa
cttcttcttgaggaacacaactcccgatggtaatgcgtctcccgaaaagcagcggtgaattcaagccaagtgataggtcagccagtagtcctgttcagacgaaagtgatcccaccatcaaaaggcagggccatgcaactgatgtgatgcaaatgaggccttctcctgatcagtgcactgaagcaaatccaccttcttgtatatggcatgcaaccaatcaccagcttcaacaggattagtggtactagagaaaataggcggcctcacacgaagaaattatgctaacttgttatgggaaggtgcacggttatttccttggttatgctggttgcgaagttgctgcatcatcatgttcattaactgagtctgttgagcaagaacttgagcaagagtgggattcccttcattgttattgttactggggccattcccattgctgagagtgttcaccatctggcatggacagggcacaagaagagacaccgggggaaactacttaggacagagaagtactttaacttttattgatcttaactgagtttcattattacaaactgaagactctcaccccactaaactcgccaacttcataacactcaaaaacaaacgaacacatgcacttacatcccaccactgatgtaaatcacatgcgagacacac

SEQ ID NO: 74259 - DNA, 37658 bp, Oryza sativa
  unsure (1)..(37658): unsure at all n locations
atattcctggtttggagatagaactgtgcagccgagatggttgttcagaatgggtgggcctatacaacagggtatgttgtatagcgttggattaatattgtttaattattacttaactgttttattaaattctgaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagatctacaatgaggctgctggtgtggaggattaggtgtagccttggtcaagctgcctgtggagtggagctgtctgtgccgtttattttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggtgtgacaggttgtgtatgatattagtactgatgacgaacccagttcgaccgaccattccttagagagagagagtgattgtgggggcgaagatgtaatttatctgtaaagccattgccttttcttttacttgtacaatgttgctgggtttaaattattcgatatatttttcttcgaaatcaataaagatgtgttttatttcttttcgctatttttgcattgtcacttcgcatgctttcgttgggtcggaacgtgtcggcccctttgcgtatattagcgaaataggtttttgactttttagctttcggctttcgttttcgatccgttttattctgcgttggaggaagcactcgtgctttcgttttgatcgagtgtaacggtgttcggttagttgtttcccgaaacaagctgttgtggtttcaacgttcggcgagtgatgcttcggccgattcgtttcgcccccttggcattttcgctgatcaggcgtttgccttggggtttttcaacaaattatcaatcacacaaataaaaagaaggcggaggacacaaaaattttatactagttcgggcctccatgatggataatagccctacatccagattttttgtcttttttcattttcctcttctttttttttgcattttcgtgccgaaatgcttacatagtgccgaaaggcttacataacgatatgtacatttttacaagttggtgattcgggtgccacccattctacacatagaaacacttgagagaggcagtgttccaggaatgctcgaactcttcgccttccagtgtcgctaggcgaaaggagcccatcctagacttgtgcttgatgaggtacggtccttcccacttcgattcgagcttgccgaccgccactgggttcgctttcctccttaggacgaggtggccgggtaacagctccatcggtcgaactttttttgttataagctgccaaagtgcctgcggcatatttgcgcatgtgttctagtgcttcgactttcaccccctccaggagttcgaccgacacctcgcacccttcttcgcccccagagaatatcacccttggtgaattagcccctagctctgtcggggtcattgcctcatcgccatagaggagcatgaacgggctgaacttggttggccttatgggggtcgtccgaagggcctagagaacagatagcatctcatccggccatttgcccttcgctgcccccttaagccttttctttagtgcttctaggatcttaccatttgcgcgttcggccgccccgtttgactgcgggtgcgcgaccgacgtgaacctgatttccaggttaagcccttcgcacaactctttgaacttgctagagttgaattgcttgccgttgtctgtgatgaacttttttggcactccgaaacggcaaacaaagtttttccacacaaacttctgcactgctgctgaagtgatcgctttgaggggttcggcctcaatccatcgggagaagtattggatggccacaattgcgaacttgtacccgtttcgcaccaccgggaacggcccaatgatgtccaacccccatctggcgaagggccagattggtgcgataggttgcagctcgtattggggcgcagtttggcttcggccatggcgctgacagctttcgcacttcttgacttgctcaacacagactttcagcacggtgggccagtatactccttgtcgaaacactttggaggcaactgttcttgtggcctggtgtgcgccacatagcccctggtgtatttccttggccatttcctcgccttcggcaaaagagatacagcgaagtaaaggttggagtacgccagagcgatatagttggcctgagactattttgtatttcgcggctctgagctgtaagcactttgcttctgcttcatcttccgggaaccagccgctcttgaagtattttacgaatggggttcgccagtctactggatcttcgcccagttctgcctggtcgattgccaagacatccaggccctctgcgggcacatttggtgcgtataggacttcgaaaaagatgcccggtgaatgtgggcccccataagcagcagatttcgccaaggcgtctgcttcctcattctggcctctaggtaaatgttggaccgttatgtcggcgaagcacttttccattgaccgaatagcctccaaatacctcttcattccttcttcctttgcctcaaaggacttatcgacatgacctgccaccaacttggagtcggttcggatgagcaagcgccgaacccccaatgctttcgccttttttaggcccaaaagaatagcatcgtattctgctgcgttgttggttgtgtcgaactgcagccttgcggcatagcaaatcggcaggccccctggcgaagtgagtaccgccgcaacgctcgcccccttgtgcgaccacgagccgtcggagtacatcacccagggttgttcaacgggctcgggctcagaggcgaatgccagtgtccattcggccacgaagtcagctagcacttgagactttacagcaatgtgagcaacaaaatgcaagtcgaaaggggatagctccgccgcccacttgctgagctagccagtaacttccttgcctcggagtacttcgcccaaagggtactgcgatggcaccgtgactttgtgggcctgaaagtagtgtttaagcttgcgcaaagccatcaccagggcgtaagcaagcgtttccatttcaatgtatcttttcttcgctccttgcaatgcttcggagacgaaatagaccggtttctggcctgactttgtttcttgaaagagggcagcactgactgccactggcgaagctgctaggtatagtagcagttcgcttcctggtgctgggctgattagggcgggcgggctttgcagatattgctttagctcctcgaacgctgattggcattcgggtgtccaggagaattttcccgcgccccggagggtcttgaagaagggtaaacctctttcggctgcctttgagaggaatcgacttagtgccacaattcggcctgcgagcttttgaacttcacgtacgctcgacggaggcttcatttgctaaatggcatcgattttctcggggttcgcctcgatgcctctttcagaaacatggaaaccgaacaacttgcccgcgcgaacacgaaaaacacacttctcagtattcagtttcatacccgccacgcgtaagttgtcgaaggtctcctgtaggtcggacgcgtggtcgaaagccttgcggctttttacgacgatatcatcgacataagcttccacatttcgccccaactacttgtaaaggaccttgtacaccagcctggcgaaggttgccccggtgttcctttggccaaaaggcatcctgaggtgacaaaaggtgccaaatggtatgatgaaggctgtcttggggatgtcggccgggttcatgttgatctggtgatagccggagtatgcatctaagaagctcatgagttctcagccagctgtcgaatccacgagttagtcgatccgtggcaaggggaaatcgtccatcggacatgccttgttcaggtctgtgaaatcgacacacatgcgccacaaatacgagtttctgttcatcaaagattgggtccagtaaatcaagatcatggccaagaggacagtgtaatcaggaagaatcaatggtgcccttctggtattttcacaaagaatcagaagagaagggttcaaagattgaggaacagggagcgccttcaggagattgaacaagaaattaatcatcggctgaagaaagcaaagccaaggcaggagtgacgtgttaagaatcaggttcctatagccgatgatgttgcggccgatgaggcaaagaggttggcaaaagggaagagtgttgtgacggcactggttaacatggtctttaccctgccagccgaattcgggatcgatcaaaccgatgtcgacgaggtggaagaggaatcgatcaaaccagagcaggcggtgttcgagaagcctgaaggaacagagaatcgacatcttaaaccattgtatataaacggttatgtcaatgggaagccgatgtctaaaatgatggttgatggtggggccgcgataaatttgatgccttatgctatgttcaggaagttgggtagaaatgccgaggatctcatcaagacaaatatggtgctcaaagactttggtggtaatccatcggaaaccaaaggtgttctgaatgtagagctgacagtcggcagtaagactattcctacaacgttttttgtcatcgatgggaagggttcttacagcttgttcttggaagggcttggattcatgccaattgttgcattccttcaactatgcatcaatgtttgattcagtggcaaggcgacaagatagagatcgtgccagccgacaggtcagttaatgttgccagtgccgatttagctctttgggagatggatggccttgattgtttatctagaaaagtctgggatggagattttctaaaagtgtccgattctgatatacaaccaattgaagatggagaacccaagctattattttgagggcgtcgtggagggttcaaatgtctacactaaggatactgtagatgatctcgatgacaagtaaggtcaaggtttcatgtcggccaatgatttggaagaaatagacataggttcaggcaatcggccaaggccgatatttattagtaagaactaatttccagagtttagaaccaagctgatagagctcttaaaagagtttagagattgcttcgcttgggagtattatgagattcctggactcagccgatcgattgttgaacatcggctacctatcaaactaagggttaggccacatcaacaacctccgaggagatgcaaggccgacatgcttgaaccggtcaaggctgagattaaaagattatatgatgctggttttattcgtccttgccgatatgctgagtgggtttctagtatagttcctgttatcaagaaaaagggcaaggtcagggtatgcattgatttccgaaatttgaataaggccaccccgaaagatgaatacccaatgccagtagccgatcaactagttgatgctgcttcgggacataagatttgagttttatggacggaaacgcaggatacaatcaaatctttatggccgaagaagacattcataagacagcttttaggtgtcctggtgcaatcggctcgtttgaatgggttgtcaagacctttggcttgaagagtgctggagctacatatcagagagctatgaattacatttaccatgatctaatcggttggttagttgaagtttacattgacgatgtggttgttaagtctaaggaaatagaggaccacatagccgatttgaggaaggtttttgagagaactagaaaatataacctgaagatgaacccgacaaaatgtgcttttggtgtatcagctggccagtttttgggatttcttgttcatgagagggggatcgaggtaactcaaaggagtgttaatgcgatcaagaagattcagcctccggagaataagacagaattacaagagatgatcggcaagataacttttgttagaaggtttatttctaatttgtctggaaggttaagaaccttttacaccattgttgagattgaaagccgatcagcagtttacttggggggcagagcagcaaaaggctttggataatattaaggaatatcttagctctcctcctgttttgattcctccacagaaaggaatatttttaggttatatttatcggccggtgagaagtcaatcggcccagtcttgattcaggagttggaagggaaggaacgagttgtattctatctcagtcgtcggctcttggatgctgaaactcggtattcccctatggagaagttgtgcttgtgtttgtatttttcgtgtacaaggttgaggcattatctactatccaacgagtgtactgttatatgcaaggccgacgttgtcaagtacatgctatcggctctaatattgaaagggagggttggaaagtatatattttccttaaccgagtttgatcttcggtatgagtcgccgaaggcgattaagggacaagctatagctgattttattgtggaacatcgtgatgattcaatcggctcggtcgaaatactgccatggactttattctttgatggatcggtgtgtactcatggttgtggtatcggcctagttataatttcccctaggggggcatgtttcgagtttgcttatactattaaaccgtatgcgactaataatcaagctgagtatgaggcagtgctcaaagggttggaattactcaaggaagttgaagccgatgccattgaaatcatgggggattctttgatagtaatcagtcaattggcaggagagtatgaatgcaagaatgatacattaatggtttataatgagaagtgccaagaactaatgaaggagtttcggctggttactctaaagcatgtctctcgataacaaaatattgaagctaatgatttggcccaaggggcaacggggtataagccgatgatcaaagatgttaaggttgaaattgcagcaatgacagccgatgattggaggtatgatgtgcatcagtatttgcataatccgtctcaatcggcttctaggaaattgagatataaggcattaaagtatacactgttggatgatgagctttattatcggacgattgatggagtgttacttaagtgcttgggtgccgattaggctaaagttgcaattggcgaagttcatgtaggaatttgtggtactcatcaatcagctcataagatgaagtggttacttcggcgtgcagggtatttttggccgacaatgctggaggattgttttagatattataaggggtgtcaagattgtcagaagtttggggcaattcagcgagcgccggcgtcggctatgaatcctattattaagccatggccattcagaggttggggaattgatatgatcggtatgataaacccaccattgagtaaaggacataaatttatattggtggcaactgattatttcaccaagtgggtggaggcgattgctttgaagaaagttgattctggggatgcgactcaattcgttcaagaatatataatctaccgatttggtattcctcgaactattacaactgatcaggggtcaatcttcgtgtctgacgagtttgttcagtttgccgatagcatgggtatcaaattattgaattcttcaccttattatgcacaagataatgggcaagccgaggcgtctaataaaagtttgatcaaattgattaagcggaaaatttctgattatcctcggcaatggcatactcggttggccgaagcattgtggtcttataggatggcttgtcatggatcgatctaagtccctccttacaaacttgtttatgggcatgaggctgttttgccgtgggaggttagaatcggctctcgaagaacggaattacaaaacgatttaacagctgatgagtattacaaccttatgaccgatgagagggaggatctggttcagtcacgattgtgagcccttgcaaaggttaccaaggataaggaacgtgttgctcggcattataataagaaagtggtaactaaagatttttcggaaggagaacttgtatggaaattgattttgccgattggtactcgtaaattcggcaagtggtcgccaaattgggaaggatcattccaaatttataaggttgtgtctaagggaccatatatgttgcaagggtttgatggtgaagtctatgggcgagcgctcaatggcatgtatttgaagaaatactacccaagtgtttgggttaacgcatgatcggctagtattgccgatgcatgacagccgatgtgtttacatcgcgttgagatggccgatattgttatatcgcccttagttgtttttcatggtgtaatcggttgtggtttgccggtgtacaacagccgatattgttatatcgcccttagttgtttttataattttatcaatgcttttgacattgtaaaattaggggggcacatatatatcaaaatgcaatgcaattttttttgaggcaaaatttttgagcgaatttcaaagtcatattaatcggcataaaggattgtcaagacagtaaagtactagagcatattagctgattacaaaaatttctaagtcctattacacaaaagttattgagacaagtatcgctgcatagccaaaatagccctttgcctaatttgttctttttcttcaatagcttgggcatgttgagcatcagttccagagatgactttcagggacttggttaggtcggcaacattcttgatagctgatttgagccttgatttttgttcttcaattgattttgggagatcggctagcttcttgtgttccatatctagctcggcattgcattcaagttgcgccaagagctcaatcttgcgagcttcgagccgatcaatattggatttgatcggaccttcagatagctgttcaagtttggttttttcttcatgcacaagctgtcgattagcttggattgtggcctcaatctctttgcgctcacggcgttcggctagtcttagcttggctttttctagcttgaactgatgttgctcaagataagcggctggaattaggacatcggccaaatcttcgggaatcagagcttgaacttcatgcagtcgtgtcctaattgacccacagtcaactaacaaactgtctaaagaagaggcttctagccgatgcgagatgtcttcaagtgtttttctcacatcatgagataggggagctagggctttgcttgaagtgtcttcttctgcctcatcaaggtaatctctgatgtcaaaagagaagagatcggctagaacctgcagagacaatttcgaaaagattaagagctgggtaaattatagccgatctaattgttgagacaaagggaaacttactgggatagcaggagcagctggttgttcttcctcctcgacgtgatgactccccacagccgatggagtctgatcacttgacgattgttgtacaggaggagaaggaagaggaggctgcgaaatagaccagtgttatatagagtcggttgagattgattaagtaaaagaattaaggacatcttactggtggagccgatttaacaattgttgctgctggttttttcttcacagcagttttcttcttctgcaaacacaaagtctatgagtaattagccgaagagggaagtaattttagaagaagtcaaagagagatacttactcttgtaaaatgaacaggggcagaaggagttggaggcgtttgcttgggtgaagccgatggtgttctttctgtgtcactcatttcggctacagcctggtcatcatcttcaccaatttcctcttcatctaaagctagttcaatagatggatccaaggcgtgcagatcatcagctggcttatcagtcggcatagttttcttgaatttgacctttttctttggagctaaggccaaggtactcacggccgatgatctggttttcctattttttgcctgcatcggctggttccctggttaggccgtgaaggagagttgaagtcttgggggcatgatagccgataacggggggagatagtccacctccattcagaattagacctggaacatattgaatgttcttgctattgttactttggtgaggaggggaggactctgttgtctgcaacacaggatcaagagattagtcaagtaatgaatcggctaactgattatgcgatttagtaatgataaagtttacatggggtatgacgtcagggaatagatctgtcatataaattgaagctgattgatgaaatagatgcagcttccattcaccccaccatctttcaaagtttttgcttctaaatcctgccaactcaatattatcaatgctgcccagagggggtcctggtaggttaagtagccgatccatcattagagtagatgtgatttgtcctcggcactgaatcttgtcgacaaagaataagccgattgggagttggcccaatccaagttgtctggccgagctcattgggtgataaaactcgtaggagacttggatgtttctcccttggtgaatgccgacagggaggatgcatgggctgattgcagctataagaacttctctggattttttgaatttttcatgattaatgtcttcaaatctaaagtctgatggaagttcaaggtttgctgagtcttcataaggaaaccagattcgtgcatctttcttaaaaccttcgtagaagctgcagaaccagtccttgagtagcttagccgatagcttcgctccagcatcggttggtgtggatgcatattctccatatgacatgcatctgcgatgggtgcgctcttctccgtcgtcttccgcaatcggctctggcagtgggaattcagcttctgtcacagagggccgattgacaaccttcatgactatcaggtttaaccaagtttgcagcagccaccatggtccacctgctccaactattgagctgacggctattttagccgatgcattgttcaacatttggtacagatagccgagaaggattttgcccacaggaaattctttctttgattcaaaggcttcggccacaaatttccagttggttgtagggccacaactggatccacaaaagaggaacttttccagccacatgaccaagaaagctacatgctctcgaggggtaacagacccttggcccatatatgccgccacatagccagaccagccacctatgcttttggtcttgaagtcaaattgattcttggcgttcatactcatagggttagccgatgaagttacatctaatccagtaatcatggtgatgtctattagacttggagtcatcggctcttggttgaataagaaagcattgatggtgttggacaagaagtaggtggcggcaaccatcagaggttcatccttagcagaattggctatggtgagagcgagcgcttggccgattccaatctcatcccagtgaactttcttactagccgatacgcattggtaccaggtggttcagctcttatcaggagtaggtttttcgagagatggccaagacttgaaggtattcttccagtgacccaggttagggttggctagtctaaaggggatccggttggtttcactgatgatgaaatcagtggggacgagattgccgattgggccaagaaaatagtggtttttgtgtgaaaggctgggaatcgcgactaggttggaaaggtgctgcaaatccaaaggaatcgggtagcagaaaacatgatgagaaaaggagaaatcgatttcatgcgaggtaaagggatctagctggtgaggacttacctcagtgtactcggccgatggcgcagtagaagggctggtggaagacgacatcgccatgggcggagatctggtcaggaacgaaatcgcctggggatcgccttatgcgtcggggagatcgtcggagagagagaacaaagttggtttcagcggtgaaaacggaggaggacggtgtgagacttctcgacggtaacggttagtatttaaagcacggcagtaacggtcgaaaaatggcaaagtgcgaaacttgctcggagtcgatttacagcaaatccgaaacattaccaaatattccggacttggggggcatgtgttaacaactaaaattggtaatatcggcatcgggaaagaagattagatcgaagcgaagtcgaaggcagagatcgagttcggaaacagagcaggaatcggctggagtccagatcagctacgattaggatcggctgagtctgagtcggactaggtaagccgatgcagccgattccgacaatacaacttgatgtatgatatcgggttgaattgaggcgcttcaaggtgattgctgcacatgatagagtcctgagaaggcaattgtatctattaattaggatgttttatgtaatttccttagagatacgcttgggcaaaagtctgccgcaaagacttatggtatcttagagtttgttagagatagtagtcgtgtctgttatggacatatcttgtaattcccgggtataaatagacccgagccctatgtaactttgaacacacacgttcaatacaatctcggcgcatcgccacctttttgctttagttttatttcgatgagttcttgctttcgggttgagctgcatcggtttcgatcttcaacaagaggtaaaacttgttatgatggattatgttctcgggattagtgcttccatctttatgatactctaatcttgtctatgtaattcatcaagttaccatatatcttacataatcttcgacaatatcgtcatctaaccaacaatcggctaacatctgtcaacagaagacagccgattaggttaaatagcgacgttgacctagattatataagatatctactattctatgaaacttccagcggcttgattgtctagatattgttcttcttttcatacttagtgctgcatcagttgagtttgatctattaagtcgtgcttagaatatcaatctctagcctgcctcctggttgccgattagaatagtatcggagtttcagccgatcttacctgatttaattatatttgctctatatgcttcaatgatacattaaatctgccctttatgtcaagatcttactgcatttaagtatattaggctcttgtttgatatattttacttgttttagtatcctgatatagagtagtatgggagtattagccgatacacgctagatctatctgatcggctatgctattaagatatataaggttgttatcaatatatatttcgatctaagtgattcatactgtctcggcatggcgactgatctatccctgtcacttgatttaagtatatatcggtataggaactatatattgttaatatctacagccgatcgaatagatttagctctttattgcctatttacaaccgccgatcgattcacctatgacatcggctcaaagataaatgatatgtcatcggcacctagccgatcggctatcatttatagatttaactgcggtttctttgcttctatttcttgttgattgcaggatcaaatcaactggcacgctcatacattcgaaggcgagctttggacctgcactggagttaagcatggtgggtaatttttcacctaataatctggaaaaagctcacctaaatgagcttatcagattataataagctgggctccagattataataagctacttcaataagttgtctgtttctttcagcttactcccaataatctgattataataatcccaagctgaaagaaacagggcctaagttgttgaaggagagcttgaagttgcgcttgcagagccgaagccccttctgccattgcttgtaacacttggccaggcggctgagagtgtgcttgggcagcgaccggctgagcttgcagctgcgcgtgaggggccggatatactaccgcaatcaaaggctgcccggcgaagcacactggcacttgcgtagcttgtggcggaaggtgctggatcggtgcttgtggatagacttgggttggacgtaacacatcgaatactggaggattgggtcgaagcggccttggcccgcctcgctgcctcgtacgcttgctgctgttcttgcatctgccgaagcatgtcctggaggcatgtcatgttctgtcgcatggcttccatgttggcttcggcctgtgtttcagggtcagggttgacttgtacagcggcgagcgcagtcgaggccgctgtcggctgcgacggggcggcttggggcaccagcagttggcttgtcgaaaggatctccgccctggactgaagtgcccttgccgccgcggctgcctttgccatgtcagccgtgttcggcacctgcccagaggcggtaggagccaaaggcggtagtgatggcgcaggtgcggaggcagacgacgctcctctatcttcggtgatgggcggcaaaggctctgctccctcttcggcggccatctcccccccggcttcgctttcctttcgccttgtaaccttctccttcacgaccctcttcggtggcattcgctcttagtggtttcgctcggaggtccccacgttcggcgccgactattgtcgaaacgacaactgcatacgtcgaaagacgtggttactcaacggtagttggaaaagaagtaaagtgtattaaattgagaatttttcttgtgatccccccgtattacatggccctatgagtctatttatagcctcattacgggttttactactagggctttggttatccaggggaatttacatggttgcccttatgaaagggacatttacatgggtatacagtgtaattaaggttcatgggctcctaatgggccgtcaggcgatcgtcggcccaataacccctaggcttgatgggccaagatggcttcttcggtcctcgcggggccgaacttgctaccgcgaaatcatctccctttggcatatactcttcgccctacatcctttcgcccaagaggcctcttgcttggcgaggtacccgcgcaattccctgccacccgcgtccttgttccatagtctttgccctgggggggctttcccctgactaacttaacgtctggggctggaatcctcactggtcgcatgggttcaacaaggtttggtcgaaggggcctcatgccataccgccaacagcgttcatgaaagcacatagctttgttattgttgcccggacattgtctggaaggataccccttgttacaactagtagcagttgtgtcatcaacacgtgacagtcatgagactttaggtttgtgaacttcttctccttcgtgcttattattcgttttatattcgtggagtatccagacggtacctttatgctctccaagtattcaaacatactttccttctctgccttgctaagaatgtagctggctgaactcaagtaatggcttcctttctcctttggttccgggtgaaggtcatcacgttgttccatatgcttcagatcattacatgcttccagtgtatctttcgactttccatatacacctaggaagcaaagaaggtttacgcaaaggttcttagtgaggtgcatcacgtcgattgcatggcggacgtccaagaattcccaataggataactctcaaaatatagagttctttttccacatcaacgcgtgaccatcttcgctctctatagggtggcttccaggcccctttccaaacactactttaagatctttaaccatagcaaacactgttttcccgctgcgatgtttaggctttgtacagtggtccgccttatgttccaagtgcttgcctttcttccgtaccgggtggtttgcagcaaggaatcgacgataaccaatgtacacaacctacctacagtgcttaagatacgtactttctgcttcatccatacagtgagtgcaagccttgtaccccttgttggactgcccgaaaaggttgctaagtgcaggccaatagttgatggttacgaatagcagcgcttgtaggttaaactcctcctatttgtccttgtcccacacggggacaccttcctttttccacaacagttttagatcttcgaccagtggtcttaggtacacatcgatgtcgttacaaggttgcttggggccttgaataataatcggcatcattatgtacttcctcttcatgcatagccaagaggggaggttgtagatatacatcgtaacaggccaagtgctatggccgctgctcatctctccaaaaggattcatgccatccatacttaaaccaaaccttatgtttcgtgcgtcctttccaaagtctttaaattttctgtcgatgtttcgccactgcaaaccatcggcgggatgtctcagcatcctgtcctgttgacgttcttcagcgtgccaacgcatcattctagcattcctcttgtttctgaacaaacgccttagccgtggtattatagggaaataccacatcaccttagcaggaattctcttctttgttggctgcccgtcaacttcacctagatcctctcgtctaatcttgtatcatagtgctttacaaacagggcatacaatcattcggacatgcgtgaatcttctgaacttccagtccctagagggcagactatcttcttagcctcgtacgttgtctcgggcaatttgttttcctccggaagaatgttcttgacaagtttcaataaatcgccaaatgccttgtcactaacactattttttgccttccattgtaagaactccagagtggtatccaactttttgtgccccttctcgtaacctgggtacaacgacgttctgtggtcctctaatatccgctccaatttatgggcctccttttcactttcacagtcctcgtttgcgtcctgcaacatctgaccaagatcatccgcagcgttgttatcgccagcaaccctgtccacctcacccgtttgatttccttcaaatccagcgtactgagcccagtcaggaatgttctcgtcctccgcttcatcttcttccttttcaaccccttgctcaccgtgggatgtccaataattatagcttggcatgaaccccgactcaaacaagtgcaaatgaatagtcctggatgcagaatactccttctggttcttacacttattgcatggacaacaaataaaacagttacgcttgttagcttcggccactctcaaaaaataatgcacgccatcgataaactctttggaccgccggtcagcgtacatccattgccgatccatctacatgaaatgaaaaaaaatcgtacataaataaattttggtacaataatgacagtcaaatagtaatgataaaataattaaaaactctttcgacaagcaattcttattaacaatttttgaagttctaaactaatattagtgttatacttctcttaattttcaatttagtttgttttctattttttaagattaattttcatcatattttaaactatgaaaataaaatttctatatattcttcttctccacacaaattttctctcttcaacttacaacaaagttttggagacaaaaaaaatgtgtgaaacatcgctccaaaagtaatataataacaaaaaaaacattggaggatgaagtgactaaccttttagacacctccgatttgtatataatcactaaaaaaattttacaagaaattttggcatgacctcccctctttctttgagaaattttgaagcttgctctcgggctggaggaggaagaaggcatatataaggggggatcttttgtcccggttggtgttaccaaccagggctaaagatcgccgtgatctttagtcccggttggtaaggggccctgacaacgtctgacatctctacaaccgttggtgatcacatatgtccgttgtagccgccaaccgtctttagtcccggttttaaatgaatccgggaccattgtagatttcggccgaccgaccaaagatggtttctccaccagtgaatcaacgcacctctctgtacgagcccacaataacacgcaagtttgctcggctcctgcatgcaatacctagagtgccacttgcatatacatatcgtctcatctcgccccaaacaaaccaaccaagctagccagctatctgcccgccacaatggacgcactgccattcctcctcctgctcctccagctctcatgtgccccgttcttccagctctcatgtgccccgtagtcaacggcagcgccctcctgccgctccacgatgccgccgtcgatctccaccccatcgtgctgctgccagggaacggctgtagccagctcgacgcggagctcaccgagcactacgagccatcgccatgggcgccggcgagctgcggcggcgctgcggccgcggggaaggggaagggacgacgacggtggttccggctatggaagaacagcactgcactgggcgaccccgcggtggcgctgtgctacgcggaccagctgcgggtggtgtacgaccgcgccgtcgccgactaccgcaacgtcgcccgcgtctggacccgcgtcgtgtcgttcggcaccacccgcggcttcggctcgacgatgatccctcggatccggaaaggtgagccgccggccatgtcgtacgtgtacaacattattattgtcatacactctgcacttttgactaattttgctacgtgatatacgtgggcgattacggtgtacgcactactagaaaactaatcttcgcaggcgggagggaggttcgcctgcatcataacgactgcgaaaatcatcgatcgattttcgcagtcggcgcaacggcccgccagagaaaatgcaaaaaaacgaacaaacaaaaatcgccgcacgcggctcaccgccgccgccctcccccggccggatctgagaggggaggggagccgccgccgtcgtcatcgtcgccgccgccgcgctccatgccattgtcgccccgcgtgtcgtcttcaccgccgtcccgcaccttcgtcaccgccgccggccccgccggcctcccccctccctcctccggccagatctgcgagggagggagggaggggagatgccgccggctgccgcgtgccgccccgcgccggcggtggaggaggagttggagaggtcgagttggcaaagggtggcgccctggaggtagaagcgagggtgggtggggcggaggacgaggtagacgatgagcgcgatgatgccgacgaggatggcaaggacgatgaggatgccccgcgccgtcgtcgccgccgtcgcccctaccggcctccctcctccctcctccggccagatctgggagggaggtgggaggggagctgctaccgtcaaccccgccggcctccccctccctcctccggccagatctaagagggaagggggaggggagccgctgccgccgcccagcccactctactgccgctccacgccgttgccgccgccgccggcctccccctccctcctctggccagatctaggagggaggggggaggggaactgctaccgccgcccggcccgcgccgccgccgcccggacttcagccgcgcctcctcgccgttgccgccctctgccgtcaccgcccgcggtcgccgctggggagagtataagtaaggggaggggagagtatgagaggagaggggaggagagaggctggtgaggaagggaggagaggtgtgaggacttagaaagaaattagggcccgcaaatctatttatattcaagtctattttcgcaggcggaccacttaagcggcgcctgcgaaaatgattttcgcaggtgccttccgcaagcgggcatcaaattttaccccgatttatatttttgtaggctgtcatttggctctaagggtcacgtccgtctgtgaaaataaggtcctcacgttaagaaaaatgctttttctagtagcgacgtactgtgatgcaaacgcatgtgatgcatgctgactatcgtaattagctgctccctctctttcagattacaagacgttttaactttggataaagttaaactactctaagtctgactaactctattgaaaaaaatagtaatatttacaacatcattaaatccataatcttctatctatctattattataaactaaaagtctattaaacttcctacaaacgctcctaaaccaccatgtggtatcctacaaacgctcataagccgccacatggcacgttcaatctcaccgtcgattttcacttaaattggtggactctatattttagatcattagattaaatatactatttaaaaaattaataccttcatgtgggtcggaaaaagaattccatatgtacgaaaggactccatacatacgaaacataagtatgattataaaattgattagagaaacataaatagtacgtacaactgaaaaaaaaaacgtataagcttacctactgctctcacaagaagaaaataacatcatgtacgtaattacgataagagcaataaaaaaaaacatacgtaacataaagaaaaataaacataagtaacatgccattgaagaaaaaaatcgatgttctataaaatataattttttatttacaagtaatatatactactataaatttacggaaatatacacagttaaaatacaatataaatataaaatatctaatcaatgctctttaaacattctatcgtgaaattattttaaaattttgttatccagttggccagaaaaaggaaagccacgtaaggacttatgataaaagcgataaagtaaaaaaaaatgttacacacgtacgtagtgccattgaaaaaaaacttatggcactatttaaaaataaaataaaatatattactataaatctacgtaaatatgcacaattaaactagatcttctatgatatataaatataaactatccgatcaatgttttttaatttgttatccagtcggattcctttaattaaaggaattaaactattggtgcctatgtttatatatacctcacaacacatatgaggccgacatataataattaatgttatctgcaatatataaatataaactatccgatcaatgttttttaatttgttatccagtcagattcctttaattaaatgaattaaactattggtgcctatgtttataaatacatcaaaacacataaggccgacatataataattaatgttatgataatattttaaataatttgcggcactctaaaaacgctctcaagctgccacataacgctctaaaaaaatagaaaaaatcttagaaattccgagaaaaaaactagccctcaattttcattttaaaacaataagtctaccttattttcaaataagatcataaataataaataattgcttgtagatattacttaaatataatataatataaactaataggttagaaattataaaacaattaatgttgatgaaaataatttatggagaaatagtggcagatgttctccgtttaatatttcactcatataagtatattaaacttagcatacgacgcatacccgcgcgaatgcgcgggttaccttcctagttgaataaattcttataatatattagttttggataaaaaatattacaacttttttctacaaatttaatcaaacttagagtagttttattttgacaaagtcaaaacattttataacctgaaacggagagggagtatttatataggtttgtcattcacgagatgccgcacagcggaagatatggtggtccaaacttaaagttaaagctattttttaagagaaaaaacatgtacgtacaggctagaaatagaatggagggggcttatcttcttttttattcctccagcggtctagcctccctactcttccttctcttcattttcttttcccctcccctctccccttctcttaatatggtacgtgcgcccatgctgaatccatccccgtgtacgtaccatcttaaatcctagatcttcatgtttataaatgggactacctatacgtttgtcgatttaaaattatacaatcgccttgcaattgtatagctatttgcatgtaactattatataattttcatatgtaagtttagaaactcacatgataacatactatttccatgaagcggtggtcacatgcccaaatcccctctcctatgcgtttttgtgattgtttccttccttgcttgcacgaatcgtgaaagaatatctaatggtttataattatacgaaagttgcatatatatatatatatatatatatatatatatatatatgttatgttgtatttacatacaagttataatgtaattacactataattattatatttgacaaatttatagaaaaatcactacaaaaatactctcttcggtacaaataatccaagcttatataagacataattaaatctataccctcctccagtacattatttcttacgtttggaaaacggtgcggtctccaaaatacacactactaaataaaccatttttccaaatgatagcatttttatccaggtgggtaggcctctcagagctaaataaaaatgacaaccgtgggcaagatcgtcgtccacctacgaaaatagattttcgcagacggatctcttaagaggtccgcctgcaaaaatatctttaggtggtcatatctttatttttgcaagcagacctcttaaacgatcaacctacgaaaatctattttcgcaggtggtaccttaagagttccgccagcaaaaagattaagcatcataaaaatgaccacctacctagtcaaaattgcctaagtccctctccttcaattcctccctgcgtcctctccttccctctcttcccgacggtcccctcccctcccacctctccttccctctgtccctgccggtggtagcaatggcagataccgcggtggtggcagcggctccatcccggtgcggcttccctcccctccctcccagatccggccaaaggggggggggagggtggtggtggtggcagctcccctgacctcctcctagatccgaccggagggtgggggagggcggcgattcgnncggcgtcaccccaccaccggcgtggcttccctcccgtcccctccctcctagatctgactgaagggggtagggggaagggcgatagcagcagcgactcccctccctcctcccgaatccggccggagcgaggggggagggtggtggcataccccaccccagcgcggctaaattctctcccctccctcccacacgacggtggtggcacagctccaagcggtggtagaggcggttcccctccctccctccctcccagatctggccggagggggagggggaagggcagtggtggtggcccatggcggcgccggcgcccctgcaacggcaagaggtgggatggctgcggcggctgcgcggacggagatgggtagggtggggggtgggggtggtggtgagtttttttttttcggccaaaatatattcgtaggcgggaggctacggtgcctgcaaatatggagatgccagcaatgacctgcctgtaaaaatcatctattttcacagacttatgcatacagacgggcctcccccgcctagaaaatgatttttggccacctggggaaataatttttctagtaatgacatcttcaattatatattattgtctattataatatatataaaagcttttaaatattttagttttattaaagaatgttttggactaatctacacatgtgtcttgaaatttaatgttctaaaagttataagctagtaatagtcaaagctacaattgtttaacttcgttcaaaacgtcaacaatattgaaccaatgtaagacaaacatgtgcatacctttttttttgttttatttagataagcatctgaaaagttactcaaagttcagttttgaaaattgacaaaatcttatgatatactccaaatgttaatgtttctgtctggaaagaaaacctttgtaaaatttcacttttcctagatttgtacatgtcgacattaatatgtcacaatctaagtggaattatcagttatatatggaataagtgacggagctaattaagagaggacagggtgaggcctggcctcgaccaacaaaaattactatgattagtgatcacaagatttgatcgaaatttatcaaaattttgtaaaaaatgtcatatggctggttggaatccaacagtaaattggaaataaaactacataattattacaacttgtaattaatgataagagactacaaaatacgagacaaaattatcaaaataaaaccaactcctgttgtagtagtgttacatcttgcctattacagtttatgtcgataaaattattaaaacatatatattattaatatgtaaaatacaccaaatgcatcaaaaattatcaaaaacactaattctttgccttccattatgctggaaataaaacgaaatatgatgtcaggacgtgcgatgccgatgcaaagacaacgaggaatatgatgatgcaaccagggaatttatggagtagtgtcttccggccttatttatgggcccaaatatcaaatcatatatgtatattgggccatcgtataatcataagtgctagttcattttctatttgctgcttgctagtatcattcctatagtagcagttgagctttgatggaacaatcaatgatgtcaccagggtctagtttaactcttcactagggtcatagcttgtaaaataagaggggtactagacatcggcaaaaaacatcaccccgatgattgcctgtaactccacccctcacaacagctagtagaaaaataggagagcaacatgcagcgttggaacaagagaatagcacgattaaaaaataaagctagtagcatgttgttgtatgtcaggttggtatgtttttggagccatcagtcggcgctgttattaaaactgttctaagtacttcctccatttcatatccatttcatattgatcgatcattatataatcaaaagtcaaaatgtttaaattgatcaccatatagacccttgtaccttatttgatatgcagcattattgtgtttatgcatgcatgtaggtttttaggagaactaaagcactcgatcgtttcttatgcatatggagagtcaaagtatgtatttttcttgattcttcctcactacatacttacattaattaaaatacatgatagtcaattcttttttggtcttggtagaaaaaaaacttatacaataatcaatatggaatgaagaaatagctagtagtaatggtaagtagtatgaaaaaaatatgagaaaatttagggttctcgagaaactacatgtgcattttttcaaacaagaagttttatgtataactgaattcatgtatgcttattttttttcatcaaatcctcagcctcaattttttttggattgaactgcaaatcctgtcaggagccattgtttcaagaagatggcagtgttagtgatatgccctaaaggcaatcatagagatgattgtatcatatactatgtttacatatttatccgacattgttccttaaaatagataactccttattggttaatgaatatgtgattctttcatgagactctttatgttgtttgttactatttctaaaggatccctgatcaaatattatatgtggaacaaatatgtttatatgatccgcacatgtattaattgataatcatatctcatggatcatggtttagagataccaaattaataatgtggacacatgttggtgaacatgttgttggatagacccaacatgagacactgcaagagccatatgtgttgtgtcatcagtgatcttattgagtgttggtgttgaatccttagacctgagattatcatggttctcaacatgtatagtagcttacttagggactgcaaaacgctactccgtaattgggtagttataaaagtagttttcgggtatgctatgaaacatgtagtgggatatgaataatcaaggtgggatttgcccctcctatagacagatatctctgtgcccctcgatgttgtagattacagaagtgcatggccatgccaaaggtgattgaggagtcaatcacaagttatataatctatcaacaagttcgagtgaatgattgagctattagaggatggcaagccttgagcttaatctatatcgtgaggcaaaggggttcatacaagtatacactagaggttcagccgatatgatctttatggatgcccggtgggtcaatacgttctgctaggggccgctgttaacgctggaccgaaaaggagtcttcgggttacagcccagtatatatgaacctacagggtcgcacgcttaatgggccagaataagggaattagatagagatacaatatgagcttaattcggattgggatccgaataggagtcctacgggccttggaggcccgagtgatggatcctatatattcgtgaggggtgtgaccggtggaggcattgcatcacgtgagaaaccttagccgtcacttccctccccgagcaaaaccctagccgcgcgtgggtgctagcacatctgcgcgtggcgttccgtccctgtacgtgtggataccggtagaggcgccgctggtttgcggtgctgaccagcgtgggagtacggcgagaagaacgcatgaggaggagaaagtcgagccggtgcgatcgactacttcctctacatcgatgcgcgctacttcgcgagagttccttcgacttctcagcatctttttccgctgcacagcgcgtcgagtggtaacgatctatgatctaatacttgcatggttcctggtttacgcggtagaaaattttgatttatgctatcgtagcctacgcgtatcccaacaggcagaggcactgggaagaatcagctacaaagaaggagagaacctcttcggcgccccctacgactcccggtacgtggcggcgccaccgggcatgcccgccatggcgttcgatgcctacaccgccgacctgaggtgtctcgtcgagcacgccagcaggaagaacggcggcaagccggtcatcccggtgacccacagcaaaggcagcctgatggccgcggagttcctcacgcggagcgcgacaccgtagtgcaggaggttcgtcaagcacctcgtcatggtctccaccggcgccggcggcatcgtcgtggcgatgcagagcctcgccgcctccgcctacgcagcgccggggtcgctggcgaggacggagcggagctacgggacggtgttcgcagcgctgccgtccccgaacgtgttcggcggcgcgccgctggtggtgacgcggcgcaggaactactcggcccacgacatctcggagttcctcccggtggtcaggttctccggcgaggaggtcaagctgtaccgcacgagggcgctgccggtgaactcggggttgagggcgccgcgcgtgacgatgaccgccgtctacggcgccagcgtgccgacgccggagcaactggtgtactgggacggcgacttcagcaaggcgccggaggtggtgtacggcgacggcgacggcgacggagcagtcaatctggagagcgtgttggcgtggaacacagtggtcggacatgatctggagcaaggtttcttcaaggccgtcaagatcatgaatgcgacatgtttacacccaaatttggtacctatggacgaaataggggaaaattgccaaagtttggaaagtatcgagtttctttcacaaggccggtcagaccgcaggtatatgggcagtctcaccggctagtagggccggtctgaccgcaggtatgtgggcgatcagaccggcagggtccgagtccgagtctgttttcgtcgggtctcgggtttccttgctcgggaaggcatgtttcgtgtttcctttagtttctatcccgagttggacatggagaagggcctgtagagggtaagaccaacccctatttaagggacaaggcctgttcattgtaaaacctccaaatacaatatacttgaatcattcttttactatgttttctattttaccctagttttagttcatctttgtcggtttgcgctgtaaaccgtccgccgccgctgcgagagtgcgacacctcttcgtaggtttgtcctggaaaccttccattttgcccacgagatggttagttatcctcatatcgatctaaatcggcctagaggctgattttgatctctaaatcggctccgctagccggtttagctgtttttctccaaaacccatcttaatttggccctttggctagatcgagatggtaggcgactccatatcaccgcaaagcgtttaggtgttgcgatcgtgtttgtcaacttgtcacgaaaagttaccaacacgatttttggcgactccgcaggggacaaatctattcggctttagaacagccgaatttgcgatctacccatctgtgtttcgtcgagacgagttccacgtctgtttcggctgtgcggccgaaatcaatccatacaattcatctactgctgttgcatatttctcattggatcaatttgattgacggcagtactgtttggtcatcaagcagaatcaatctactagttcggctgacgttatccgatttcatcgttgtctggtatttgagaccgatcgattcgatcggttagatagcagcacgctgccttttctgtcttgctgtgtacagctagagcaagaaaatcattcggattagatcgatcaaagctagtactgcacacatatatttacataaagacaaaaagccgattcatattgtttcggccgttactgtgaagcattgattttccagatttttgctgcacacaggggatcggccaatcaaggctactgatcttttgatttttggaatttttgctaggtacacacgtcagatatatctaggaaaattataagaccgtatattaatctattcggtcaaatatttcggctatgagctatgtggcccgatttaatcaaggaatttcttcatcaactatgacgagcgggaacgggttcaacaatattgctacacaatacattagaaccgatcaaggcgtcatgagaggaaacgtcccgctacctcaagttgtaatttcaccaaaggtaaccttcgattcgcccaacccgtcctttgctattcaaaacattaataatcattatgtagatgcatatgctacttctagttttgctcctatacaatatgcttataatgctacgggggggtcaatgggtgattatgcagccgattacacagaaatcggctatatgcaaaaccgagctgacagtatgaccggtcgtgacaccggtctaaccgcatcctttgccagtcagaccgcgcccaccatggccggtcagaccgtgtactacgtcggtcagaccgtgcctaccatagccggtcagaccgtgccctatcctggccagatcggacctcctgtggccggtctgaccgcaccgctgaccaccggtcagaccgggccatgggccggttagaccggttcccagggagtttctccaggttttcataccacgactagcagtactgattttaattcacctgttaatactgttagtcatgctattccacatatccctaatgcctacaatgatattaataggggatatcctcccgatactaggtatggccaatataataatattgtgccaccacaaccaccttttaggccaccaagtccaccaccaaatccaccaaagcctgaaactatggaggattggtttagaaatactatcagggagaattttgcaaagctaaggaatcgtgctagggagtaccaaaagtcgtatcctgatttttatgatattatcccatatccttgtggttataaaattcctgaatttaccaagtttagtggtgaggatagtaggaccacatgggagcatgtagatcaattttagcgcatcggtgaggctattaagaatacatgtaaattgaacttgttttctttatctttgtctggtactgcttttgcatggtttacttctttaccagcaaattctattttttcctgggctcaattagaacaaaaatttcatgattatttccacactagtgagactgagcttagattgtctgatttaacatcggttaggcacaaatacaatgaatctgtcgttgattatattgaaaggtttagagatattaaaagccgatgttttagtttgaaaataactgacaaagatttggccaacattgcatatgatggattgcttgattctattaaagagaggttgaatggccaaatatttcttaatgttgatcatgtgttgcatgaagctctggctcaggaaagccaagtggatgataatagcttaaatgctagtttagatgatagtgcaatatcatgtgtagccaaatcaagcgacggttcggattgtgttaataatttgtgcaatgatgccataacaattatagccaaaccaaatgttggttcggattgtcttgttagcgtggataataatgcaataaccattatagccgaatcaagcgatgattcggattgtgttactagtttagacaaagatggaatagtcgaaccaagtaatggctagcttagagaataatgccattgaagatatagccaaactaaatgacggttcggattgtatcacaagcgaaagtgaaatagcattatcacctaagaccgaatcacaaatcggtcatgtggatgttgggaaagatgatgacaatgtcttgcgggatagtagtgaaatagaatcgaaagtagctatgcatacataccaaaggccgtatcctgaacacgtagattcagtcccatacccgcaaggatttgaggtgcccaacttcacaaaattcacaggtgaggatgctagaacaacaatggagcatatcggccaatttgttgatcaatgtggtaaggtcggtagtaatgatttgcttaagttaaagttgtttcctctttctttgtcaaactttgcatctacatggtatagtttacttgctcctaattcaatttctacatggtcacaaatggagcatgagtttcatggttatttcaaatatgcaagcttgatggagcaaagaccgattgatacttcatcggtcacttgtgaaactatttcggttacatctatgcctaagaccggaattgttagtgatcctctccctgttagttctattgatgttggcaaaaagaaagggaaaagtgttattattggggatcctcggcccaagaataggatcaaaaatgcgaaggccgaagatcataaagttgcaaaggatgagtcatctagtttccaaaagaccaaaaaaccgaagctcacttttgacatgcttatggctaagtacaagaaaggattagccggtcaacgatttcataatcaaactagtgattcaaaaagaccaagatcatctcgtaggaagagatttggtcaaacaccaaagcaatcggagccatcaactaaaccaactccatacaaacctccgattgtgatgccatggtatccatatccaatgtcaccgtttggttatccttttatgtattacatgccgtggatgcatcaaccgcctatgctgtatcatcaaggatggaagcaatcacctaggacagtaccaagtcattctaactcaagacaagaacgtttcccacaaaggaatcggtccggtggatcaaaagtgaaaaaggtgaagaaggtgtgggtgagaaaagaagccaaagcttcggaagtcgtcactattaaggaggaatctcaagatgttcaagtacctactggagatgcggcgaaaaatatacaagcggagaagactgaagccgacgccgttgctgtcgacatcggcagtctgaccgagacagttggccggtctaactgccagactacggccgttctgaccgaccctcctgatcagtctgaccgacggcttgtgaccggtctaaccgggcccagaggccggtctgatcagggggcattggagaagagtgggaaaattgagagcaacattggagcttccatttcgaccaaaaatatgaagaatcattgcttagctcctggaaaacaaccacagccgaagtggataccttctggcttatctcgctctcaaaagaggaggctacagcgtcttcgggccataggtcaaaaagaaaaggaggccgaagatgtggagaacaagatatgcaataatttaaagcctcgaatagcacctaggcaagtgtggagacctaaagaagtaaaagttaagagaccggtgatttcccatagtagtagtgataaattcaatttgatgagagaagaatcatcggtcattagagataagtctcctccacatgatgctatgggtgttagtgcggtatccatcttgccttcgaaatcgtgcagtcaagaaagccgattttgcttggggggcaagacattaatatgctcatgaaggaatcaagagagatgaacagcgatggatacgacatcacatctttgagccgccgtttgtcagatgctaaggcaaggtatgagtttattgtgttcatcatcatatgatatgcctatgccatgttagaacattgcttactatctagcacatgtgtgtttttgcttatcgaattgatattatacatacatgttgcaaatgccagttctaagtagtggaattggtaggttggcatataatttgtttgtagtatgatttggctcatgagtctttgatatttatttaaagccaaattgtatgtgtttttatggatcaccatataagatatagattttataattattgcaccatgaaagttttgcttattagtaattcggctaatgtcaatgatcaatgtgatgatttattctagagttgttttctttagaaacattggcattgttaatattttgcattcatgctcaagccgattacttacatttgtagtttattggaattcatgtgtgtgaggcatatgactttggtgattcattattgatcatacttcaattggctaagtgttttgatgccatgatgattattgtttcaaaagccatttgaattagtattcatctagacatgttagttggatgctataatttttcatatgtctagagagaagaaattttggtccaataatttgatacaccaagcatctggctattatgtgaagagaaattatatactaaaggccgatgcttgatttcaaaagtttggacgaaattggcaaaatcatagaccaggggcggtctgaccggcattgcacggccggtctgaccggtggtaccggcggtctgaccggctctacatggccggtctgaccaggtagacagggcagtctgaccggcattgcgtggccggtctgaccgatcccagacaggaggctggggggcacgttacaattgattaaaaggccgacttaattgtgaattcggacatttgtgcccatgagttagaggtagcttggagaattcatttgattagatatttgaatgatcctacacttaaggttgatcgaaagattcggcggcaagcgctcaaatattatatcgccgaaaaacagatggagtattacttagataatgatcaatctaaagttgctaggagagtagtacatgaagggatttgtaaaattcatcaatcggcccgtaagataaattggttgcttaggagagtggggtttcattggccgaaaataattgatgattgtttcaaatgttatagagggagtgaagcttgttaacggatcggcaatgttcaattagcgcctaccgctgtgttgaatcctatcattaaactatggccattccgaggttgggctttggatttcattggtcaaatttattcttcgtcatcaaaagggcattggttcgtgctagttgcaatggattacttcactaagtgggccaaagccgtgccgctcaagaatattacttgtatggaggtaattgactttattttgaagcacattgttcatagattcagtattcctcaaatgttaaaggagcttcttttatgtccaaagaagtgagaagttttgccgaatcttatgatattaagttgttgagttcttctctttactacactcaggctaatggataagccgagtagagtaataaaacattgttgaaattgccgttttgctagttgaggtaaatcttggctctttttggtatttcaagcaagacgacttgtcggttgaagattacaagaccttgatgggaaacaattttgaagacgtcattgacaagcgtttgaagactttgaaggagatgaagacacttcaagatggtgttttcggagagcgattaatgggaaatacatgaagaaatacttcccgagcatttggcaagatgcttaggaagtcctatggccggtaattggattatcgccctgagataacatgttcacttttagattcacgtatgttcaccaaaaaggcagggggcatgtgtttacacccaaatttggcacctatggacgaaatagggaaaaattgccaaagtttggaaagtatcgggtttccttcacagggccggtcagaccgcaggtatatgggcggtctgaccggctagtagggccggtctgaccgcaggtatgtgggcagtcagaccggcagggtccgagtcctagtctgttttcgttgggtctcgggttttcttgttcgggaaggcatatttcgtggttcctttggtttctatcccgagttgggcatggagaagggcctgtagagggcaagaacaacccctatttaagggacaaggccagttcattggaaaaccccctaatacaatctacttgaatcgttcttttactatgttttctattttaccctagttttaatccatctttatcggtttgcaccggaaaccgtctgcccccactgcgagagtgcgacatctctttgtaggtttgtcctggaaatcttccattttacccacgagacaggtagttatcctcatatcgatctaaatcggtctagaggctgattttaatctctaaatcggctccgctagccggtttagctgtttttctctcaaacccatcttaatttggccctttggctagatcgaggtagttgacgactccatatcactgcaagacgtttaggtgttgcgatcgtgtttgtcaacttgtcaaaaaaaaattgccaacatgacacacggcggaatcattaccgacgagttcgccctgaagcgtgtgattagcgagatccttgaagcgaatcgtgccacctatgacaaataattacgaacgagctgagtttcgagttaaggatcagaacattgatgttaggtatgtgtcaataatattccttgcatgtgtcaaataattatgcgcgtctgacattctgagtcacgcagtgatgcacattgttgcgtaacaataattaatactccatctctccatttcatattataatctgctttaattttttaagtttgctatgtttataaaaaatagtaataattttaacaccaaacaaacataatatcaaatatatattcaatgttaggtttaatgaaaaataatttggtattatacgagtttatttttctctataaatttggaaaacatataggattttgacttagaaaaaagtcaaaacttattaaaatacgaaataggagtagtaaccaacaaatcatctcatggaccttgttgtcaataactccttatttatgtggaataagttcaatttaaatccctcatcttgaagtgctagtcgaattagaatgtgttggtcaacttgcaatacccaattactcaaggtcccactgcaattttgtgcctggttagagcaaacgtgatgagctgaccgtggtcaatatggttaaatcagcatggggcccacataggcccaaatgtcagcgggtatgtcttattcttcctcttctattcccatctccgtagtctccctatcctccccatttctcttcaagcatgtaggtggcggccgtagtgtaagtgatggagcactatgtgatgacaatggttactcggcttcggagaacatgggacgacggcaaggcgatgcctctagcacggggagccatggtgaagcagccactagggacttgcagcggcaagtggagcaacacaggactggtgaccactgtagagtgcatggtgagagcgttagtattgcagcgaacgggtgggggaggtggtccatttcgtccaacccgtgctgacgtcgcctcgcaccgctggtcccatcatcccgcgggatgctggtgaagtgggggatttgaggccggtgcgtgtggaaggcatgccttcctcagttcttactgagttccggcctacattacacgtctgtcctaccgacattatgaccactggaggtgttaaattaagttgttttttttgggtttcctccctattctctcgattcaatctttataagtcggttagaggataggataagaaaagtcccatcctatatgtactcgtgctctatccatccaatggaatcattgtgttgaggccatgtcagatttcaccgttgtacaggagtatttaattaactaggtgattccctgcacttcgctgcaggaatttatattttttccattacaatcaaggtagaggtaaaaagaaaacaaatgaaatctcagggcttatctgtattaatcatgaatcaaacaaatgaaacccacactttaatgtgaaaacatattgacaagtttgtgttaaatattataaaaatgatagataaatttgtaaaaatattgtgaaaatgatgtgaggggtaatgattggatatgtttgcatgttgatttgtataattaaatagattgtagatgatgttgcctgtttgcatgaggtgaatatgtaattattgctagtgggtgatgatgtggcatggtcgcatgttaagctttagcgttagtgggttttaactttatagaaagtatagattggcagcttatgcgcacttgtttttttcacctaatggcagtgtttagttccattcaaactttcaaaaattccgttacatcaaatgtttggacatatgcatgtagtattaaatgtggacaaaataaccaattgtatagtttgcatgtaaattatgagatgaatcttttgagcctaattacgccatgatttgataatatgatgctacagtaaacatttgctaatgacggattaattaggcttactaaattcgtctcacaatttacacacagaatctgtaatttgtcttgttattagtttccatttaatacttcaaatgtgtatccgtatacttaaaatttttttttggcaggccaacaattcggagaagcttgtctactgggacacttgagtaaggaaattgagagatggggcggtgaatgtgaccactgaccagcgtgttggcgctggatatgcacggagatgatccggaggaagattcttcaaagccgtcacgatcatcagtacgacacactcgagaataattatggcgagttcaccctcaccctctattgcattgtgtgataagctagaatttggaagcggagctatggacgaaagaaatttgttttgctacatgctagaaggtgccaagactgaacagtactccgtagtgcggagtacagtacgaggaaaaacactagctagtagtgagaatagtcagaccgatagtggacaggacatgataccgagagataaagacgtaaaagaggaatatgagaaagacatgtaaaattgttatggatttttatgtatctgttttagtatgaaaagatgtcattattaccgaaacatttattccattttaagagaggcatatcataaatgggagtgttgaatttacatcctgtattagaactacaaccct

SEQ ID NO: 74260 - DNA, 7910 bp, Oryza sativa
gagtcccccacagcacccacgctggatccacccctggttgccatcataataactagtaagagtagcaaaactatgctatgcggttgcagctctgtggctgcgttcggcagaaaaaagagagagagtaactattgtcgacgtttgatggcgcgattccggtatttgcaaagtatggggatcgttggtactagggtatatgcgagactgaggtaaaagagatggagacgaggatttttatacaggttcgggcccttgaattgtcaggtaataaccctacatcctgttggccaaagccggtattgctcttattcaccataatcacaccaatacaatatttggggtagcctatctaactgttgtcgacatggcggtctgaaggtttgactcgtagtcgacaacagggcagtcttcctcctcgagttcgtgtccggcgagatcagagacaacgctagatccctacgaccagcctctgtaggtaccggatagggtcgatccaggcgtatctctgatgtcgatatccgatggcttgtcttggcgtttgttggcttgtattggcttgtggctttgtggcgtctatgttgtctgtgtcccctctcctcctagggggccttgtatttatacccataggtgtcctcttgtccaagtagaattagggaaactaatatggatacattccgagtagtccttgtcgtttccatgtagaactctagtcatccttccttatgcgaaacttctcctatatccgaaggttgtatccgtataagacatggtatgtggtgggtcctgtcgagatttagtcaactactattaggtatgtggtatccataaccctgacagtagcccccgacttcgatgcaaatgaacgaattcatattctcaaccgcgcgcagaccttggagtaactgttatcgtgctcacgtgaccgttctcggtgagttcagagataacgttagaattcctttatcagcctcgtgcgggcacctaaagggtttgtctgagtcaatctccgacgtcaaccaagaaagtacatagcatacgactaagtctcccgtcttgctgtaatcgagaatttggattgaagtcaagaaattttatctcgacgggtacaccatttcttcattttgtattccttgtcgagatccaccaaccgttcttgagcgatcgagaaggtgtagaatctgcgacgaagccttgtcaacatttgtcatactcgtcttagtcgatcttggtgtagaaccatagagacatggagccttcgtcaatgtcgaatagaattttcctgaaatcaatactcaggaaagaatattagatagaaatagcccccgagcgaatgctcaaagggtgaccaatgttataatatgtatggaaaactagaaatgagttaaatttacagaccaatgttttgtatatgagcgtcttctctcttaccgacttcgataagtcagtttgttgagtcatacactctccctaacccccagccttgtcttttttatacacgtgttacccaaaaatttatagaaaagctactcaaaaaatcatcttcatcatttttaaagtttgaaatagttaatactgaattaatcgtgcgctaataagtaatgactcatctagttttgcgtatcttgttatttttcgtcatctcaaacacgcctaggggcttattcggttcataagattttcaaattataggaatagaaaaaaaaaacagaatgacactactctaatccatatgaatttttctaagagatctcacttcatgctaagaatcctaccattattcttgtgaatttggaaggatctatgaatgatgcatatagaaaaaattgtaaggtttcaattcatacaataatgattatttggatattatttaaatcgaatgagcctccaagggagtaaattggaattgacgtatttggttcgatgctagcgtggtgcacgtgagatgaataggtagatattatcaatttttttttgttttggtggtatcgagtaaagttgaattgatgtacttggttcgatgctaacgtggtgaatgtgaaatggataggtaaatatcatccaaaaaaaaaaatcttggagggtagagtttctaaaggggtgctctaaagtaatttttctggttaggtagaaattcaattggcacggatttttttccttaaagaaatgtccttttcaattcttccaccactaaatctatgggtacactctcaacaaaatttagtgatattagtgatttaaatcctatctgagaaatttcttagtaattgcaaatctatactaatacagaaaaaaatcttagtaattacaaatctatactaatacagaaggtagcattagtaccaccaccactactcatgtacctagcggtaaccccaattacctaccgggacaaatactcaatccatcccaaaatatatattgcctataatacaaacttatagctagtaatacaaacttaaaaatatatattgcctataatacaaacttatagctagtaattactctagtactccctccgtcccataatataagagattttgagtttttacttatagtgtttgaccactcgtcttattaaaaaaaattatgcaaatataaaaaacgaaaagttatgcttaaagtactttggataataaagtaagtaaaaaaaataaataataattctaaaattttttgaataagacgagtggttaaacagtgtaagcaaaaactcaaaatcccttatattatgagacggagggagtattaaactgcttcaataaattaaaaaatgaagtagagtttagaatatgagaaacttttttttatatttttatcatcctcttagaatctttagttctcgacgtagtattaatttcgtccatttaaacatgtgttgagcgtttgtgtatttagtggtctgtgtgagtattttctatgaaagaaaaagatccataaagatatgaattcacataatatccctgttgtcttcgcttttctttttctagatttttgcgacggatatttgtgtcattttcgtgaaaatacgattctcaagaacatttcttccagtggtttgtttagaccacttgatattacgttaaatcaagtaaacaatctgtcgtgtaaaaaaaataataaaaaactgtttcaagccgggccaatatctgctcaaacctgaattcacattatatctgaatatctgctaaaatctgaattcattttatctatggctgtcagtttgtttgacgtgtcccaccttcgatcctactcactcagtccttaaaaaaataaatccattcttagcatcccaaggcaaaattagtgaaaagtaagaatgacaaaaatatcctcaatcattaaaaaaagtagtaagagtgatagataggtactccctccgtttcaggttgtaagactttctagctttgcccatattcatatagatgttaatgaatttatgtacacatatatggctagattcattactatatatatgaatatggataatgttataaaatcttataatatgaaacggatgaagtaaaatgtattgaagtgataaaacatcttagggtgtgtttggttcacggacatgcatggatgggatatggccatccatattttgttggatatggcaatccaattttttgtttgatttgtatggataaggcaatccaatttcttgtttggttgcagggatatagcatggatggaaaaagccataagttagtgggacccatttgtcatatatatttttttatcaaaatataatcatccgagatcttgtttttaatatttaattataacaaatataatggtgtaatcaaatcataaattagatagacggtttaggagaaaaaaatcatttggagcttgcttaacagaaaatcaaactaaccacacctaatcagaataagacacatcacccagaccaaaactgaatggcttcatccagccaaatcggccggatgcactcatccagcatatcgagagaatattccctattccgggccgccccatccaccttgccctccaaccaaacaccacagaaaatccggcggccatctcccatccagactcatccacccaaccaaacacacccttattttatatgctaagggtagataggatgatagaggttgtattttttttggataaaatttaaattttagaagttaagtttttttttttacaaagcgagtagaattgaaaaatgaaaaaaagaattgccaagtcgcacgtccccatcgccgatgatgccccaagattcctccttttcttcccgcgaaaaaaaaattcctcttttgcttccgccggcgagcgaccaaaaacacacacacagccgtaccacccacccaccaatcatttcgccatcgcaggtgaggtgagcccaccactccagtactccacgagagaccacgaggggaataacttattaagtaggcaaaatttggtataggacacccgaaaatcgtgtaattggcggtgagacatcgtaaaatcttggttttgccaacggacactacgaaatttgtgaaattggctgtgaaacaccggaggcaatattttatagtttccgagacaaagaggtcaaataattttttaaaagatcaatctacccctgcgcccagctgtccatctccctccccaacccgatttcccagtctcaaaccctaaccctaggcgatggtggggctggcgacggtggcggtgccagcgacggtgttgaggacggcgacgacggcggccactggagctgtgatgatgacgcagtaaatcgatccttgtggcaaacccgacgagtcctggcggcaagtgcgcggcgcggcggtttcaagccgatagcggtggacggcggagcttagtttctaaatggaggacacgttctctgcacagctgtcagttaattaactaattaagttgtcctttggtgacaaatatttcctggtgccatagaccaattagcttctgagtggattataaaaggagttgcatcatcgccgtgcaggattgaggtggaagaagcagccaaaaacagtaatggcgcaggcggagaagacgagcgagagattttctttgtatgcggaatctcctgctagcttgatgtcaggaacgcgccaggaacgggcctattcgcgtctgtgcgcggcgcgacgcggcgcgcacacgccatgccggcatgccgtggcataccagttgcgcaggggtggattggtcttttagaaaattatctgacctcttttatctcggaaattataaaatattgcctccggtgtctcacagccaatttcacaacattcataatgtccgtgggcaaagccaatattttgcagtgtctcacagccaattacacgattttcgggtgtcctgtagcaattttgcctattaagtactgtattaatttttaaaaatatgctacttaaaattttatttttaaaatctagattcgtagttaggattgtattttttatagaatgaaagggacactttctttgatctagtattagaatatatctcataaaaccaaactctattatattgtctccgtcataaaataagtttatttttcactcatcctactcatccatacttgatcaaattccgatacaattatttccaactttcacagactttgatatgatataactttaaaagcaaacttattttgggacgaactaaaaatgagcttatcatgggatggagcgagtagtttaaaaatatttatttttaaaatttaaaattaaaaaaatactatatccgttttatattataaaactttctagcattgcccacattcttttatatatatatatatatatatatatatatagatttattgacatctatatgaatatagacattgataaaagtcttataacctgaaacggtgtaagtagtaatcaaataaaatttcgaggggaatagtagctcattataacaagctactactactactactggtacccccattggtagcacgcaagccactttctccgagatcgccgcgatgacgacgacgacgacgacgagcgccatcggctccctcctcgtgctcctgcttgtggtggtggtgggaggggtgtgctccgcctccgtgggcggcggcggcggcggaggggaggcgtggcgggcggagcaggagcgggaccgggtggcgcgggtgcccgggcaggacttcgacgtcgggttcgcgcagtacgccgggtacgtcgccgtcagcgaggagcgcggcgcctcgctcttctactggttcttcgaggccgccgacgacccggcgtccaagcccctcgtgctctggctcaacggaggtgagcgcccgccgccgccaccgccccgcctctccgatttggtctcttgttgacttgtactgctgctgctgctgctgctgttttctcatccgagtccgagacgcacgacgaatagctgttgcgttcgtggttgggggaaagtcgctaccttccgttgattccttatctgatgagcagctttcttctgcaggattcggatgcacaatttggggttttggggggtggggattatgctaagactagtacatggagattagtcgatttgatatctcgagggttttagttattactgatgtggtagaaatgcacaagtaactgtaattcgttcgaggggggaagtatccgcagacggaggaggattgagatcctcagacatagtggctgacatgtgggcccgagagtgatgggtccacatgtcagtcacggtgaacagtaacgtcagtggatcttcttccgatgaggaggggctgttgtctctacacaatttccggatcaaactcattttcatttcttactaaaaaaacttatttttattttggagatacgaaagggcaaatattttttgtatggtactcgggttcttaaaattggtatagtttttcttattattgattcatatcatatttcacatttgggcaccacaattagcacttatctagaactcttatagtttaattttgtgatttttcccttttgttttcacatgtactaggctttactgaactaacctccaagcttccagcaatacctatcaaaattttccactacacagcattcatatacatcctctaaagccagcttattataattttttatagttaaaatatgagagaatttattctatgccactgagtttaccttaatttcaacgatttgccattgactttgtctccctctataatatgccactgactttatcatttttttcctacaacatgccattggggtggatacttttcaataaatgcctaaaatacccttcaggtcatacaagagaagacaattatttgacccactagaagttctaaaaacatgaaagtttttgtgtacttagccttcttacaaaatattaaagtttgtgtgtatattttaagattttctttcatgttttttttctaaaaaactattttatatagcatatgaaagaggaatcacatacacgaaagatagttgcataaaaaaaattatataacatgtgaatgatgatgtacaaaaagaacattaacacaaagtattctattagcatataaaacataaattatatatttttaaagataatacatgcaaaatgaaaatcttgatatatacacacagttctatattatgcaaggagtttacgcaaatttttttatatttttgtaggtcaatcaattgtaacctcttgtaagtcttgaaaggcattttaggcagttttgaaaaatatacactccaatggtgtattgtataaaaaattgaaaaagtcagtggcatattgtagatggagtcgatggcaaatcgttgaactagagtaaactcagtggcataaaatggtttctctcttaaaatatttcaagatgaccaggccaacttttctattcttacatgaggcaagatgttgtcggtgaatctgatttttttttcttg

SEQ ID NO: 74261 - DNA, 4959 bp, Oryza sativa
taaccttaaaatcttaatcattcagcttcaaattgagtgcaatttgcattattcttacttgtattcttcgttgattcacatgtagggattagccttctcggcgaggtcaatcgggtttcggcacgattgataaccaaaagagacatggtgattgcagggttcgaattgcaagtttctgccaaatcgatagttattaatacatataggaagatttggacctagttcttcatcagagatcaaaacaaaactcaagaatatataaggatcaagctagcgaatatcggagacgttaatgaaattttagagggcacgtagggaattttctgaaaaataaacatcttcctccacttgatcctcattgatacatatacatcatgaaaatgatgttaaaaaatttacaacatttgcatgggggaagaaaagataaaccccaaaaaaaaaaggtgtaaatctttcactaacaaacatacgatgggttttcaattgattggcaataacctcattttattaacctgtacaactgaatttctcagggtatgtcaaaatcatctctgcttttttaagcaaatgaaaagatgaaatttgtcctctgcatcgtacgcacaagactgcaatgcacacgtctcgcgtatgaccattttgtgttgtgtttcaaagaaaatatataaagggatttgaaagaagataccagtcacactcgcaagggtgacatatatgatatatccgctatttgtgaatcagaataattaggccctgctttgattcaggttatttaaaaaaatattatcatggattttctactataaattaattattttaataattaaattcaataaatagcttgaaacaagttttctttaaattcaataaatagcttgaaacaagttttcttaatgatattgtggaaggatgtgtttcaagaaaatatatttttctaaacatatagtaaataatccgtttcaataattcggtgattaataatccatttcaaatagtgaaaatatatagtgcaaaccacgtatgtaatgtaaacctggaaactatagttggatctaacaatggacgcctgagatttatccatatcactttgagtataaattttatttgcagattcaatcatgaatagaaattttgttaggaataaaaagtttactcttaatggcgtggataaatcttaggcgttcatttttagatccaacgatagcttttaggttccattatatatgtggtttgcactctatatttttccaaagaaaaaagctaaggagagagaagacaaagcatagccagtaacttgggcagtttacagaattactacacatttgaacacatgtggacgacaggcatatatatagggagtcaaactagatttttattttattttttgagaaatttgccatgtgcaagttgacatgataattactatttgagacaagctaaggcccctgctggaatatctggggaactacaaccaactgtgttctggaagcaaaggtacatgccagccctaatatattaattaatgctaatccctggttaactttgttgtttttttgaaagatctggttaactgtaggttattaagccccagttgacaatttggtcctaaatggcaattctagctccagcaaccttgacagcacagcatgcacatgcatatatatttacatataaaatatatgttgttgtcactgaattaatggttgaaatgatcagacattcatacctttgccaagctaaggaagagaaaattaagaaataagaaacgcgtgatagaacgtacagtacgagtcactgtcttcagatgagatgacaccagtgggccgctaaaaatggtgaagatgctgataaaagccattgctttaattaggaccttgacctgccaaaaaaaagagagagaaagaaatcagtagtattttctttgatcactggtgatattttatttttgatattgtaaatccatttcaattttgtcatgtgtataaactatatatgcagaaagcactgaacaggtaaattcgtgagtgaattaatagatagtatatattaagatggatgaattaattatttagtttttcgtatatatatagagcataacctacaagatgtgtaagcctgcttgatgcaaactttaggttaaaacacaatgacatgtttttttttcatctcggtctaataagcatcaatatatatataatttagagcacatatatatcgtcttcttcatgtgaccatctgaaattggcagtgtgtctcacctctgttcagttttctgtacggctattttggattgctaccaaaacgtgccctactgattctttagcaacttaaataatagtgtatatggaccattttggtttgatgtcttactaaaattttgatagtgctaaaacttgaacaaagtttggtaggataggatacgttagatgtttatttgaatataagccaaagagcatacctataagaaacacctgtataagagacaagtttcagggaaattctataatgttggtaaggtaatatttggagagatatctatactgtgctctctaatagactattattctactactagcattattcatgatatctaccgatgatttactatatgtagaaaaaaaactattctacaattaattttggtttccttgtataagtagatatgattcattggattaaaagaaataaatggtctagatttgttttgctgtcaataaagagcactgcaaaacacctctaattggagatattttggtttgctaccctaccaaaaaaaaaattgatttcgaatgaagccaaatcattagtaatgacatgcatgctccattggcaacaatctaggattgtctttcattacatcaagtttactgatagcaaaccaaacatacacctctacctttgaagaattggcagtatcaaattttacctagattttaacattattgaagaattagtagtgcctagagaaccaacacgaccctacattgctagctgcaggtacaacatcaaacagtagggcaaaaaacagagcaacggacatcacaaacctccaggtgggccaatgcaaaacacacacagagagagagagagagattgactgatgtgtttatagaggggagcacacctgctatctacttggattttttccccataacttaatagatgtgaacttttaaattcagacaaatgttgcttcttcttcttctaatcatttttaaattttgaccaggctggttctttactcaaggcatagattttaccatattattaccatgttacagatgtggaagatgcagtgtttaccagtggccagtgcttggataatttaatataggtgcatgcatggaactgtcaaaattttggtacaggtaaatgcatggtgtttgggtaaaatggatcttactgaaattcatacttttacataagggccgtattgaaggcaatgaaccagatttgcctattcttgcagaaatattagctcatatttggaactggacagagcatatattgcatgcatgtagtactgtacatgtataaccagttgcattttgctgatatctacagctagccaaattcctccccccacaaaaaaaagggtcgctgtgcctctacactcctgcactacagttgacagaggcaggtcaggatgaaagagaaagaaagggatttttggagagagaaagcacagcctaaattctttcttagggcatatgggatgaaaaaaggtgagaggagatgtagcatcctaagcacacgagctcaatcccacagcttttactactccgacattttcctccacaatatacaatatatatcatctaatatattatatatatgtatgttgtattttcttcgtagtgtagatgcaaaaggcattaagtgtttgcttttgactcatttttggtccttttatgtatgtcgttttcgcgtggctgccctcaaccaactttggcctctcatcttatccggaaatcagaaccctaaccgaataaatcccctttatatgtatttacacttaccaccttttttttccgaaataattctctcgctttctccgcgtatgtgtacagatactagctatacctactagttctactactaccctcctcccccttcttcttctctctcatcaatcaccaaggccctttaagaccagtacctaaccccagacaacacatgaaaccggttccattccttccaattcatccatccctccctaatgtctcccttcttctcttgagatagagagagaaactagagagagaaagtgtagagagagagtatacaaaggttagtagtagtaccctagtacaagtactcaaaagattgtggatgtggttgtagaagcttgtacacacaaaagagaggaatttgagggagagagagtgagagagaagcctagctagctagcaagcacacaccacacacatctccaaattaagcacaagaggaaacaacacacaagccacctcgatctctctccttcctctcgatcccaagaagcccaaggaagcttcctatacgtttagtggttagcgcgctcgctcgccgccgcgccgcggcgaaggagggacgacgacggacatggcgtcggcgacgtcgacgacgcccgacctgtcgctgcacatcagcctgccgagcggtggcgcggcggtggggacgacggcgccgccggggctggggaacggcggtgcggttggtggtgccggcggcggcaaggcggcgggtggtggtgacccgtggcggaggctggatggctccacagcgtcgacggagctgtcgctgtcgacgccgcagcagcagcaggagggcagtacatcggcggccgatgtgctgccgtggcggctgcggcagccgacggcggcggcggcgtccgtgccggtgacactgccgacgataccgatggatggttcggcggcggcggcgcgcgcgccgatccgtggggtgcctgtgtatagc

SEQ ID NO: 74262 - DNA, 19045 bp, Oryza sativa
agaaagctcgattgcccattttaccacccgtcctgtaccctctcgattatgcaagatttgaccgaggggtaagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacccttcggtggggctgatcctctctactaggggccgtacccccggggggttcttcgttcaagtgggctttgggggcgcacttgttttctgtgccgatgacctcggggtcggaggatgaaaggggcggccttccctcagtggcctcgggcccgtcctgggggtcgggggctcctggcatcgtcggacaagcgggcaaagggccaactccggtcgtcaggggcctctggccttcgttgggctcgggggcctcttctccctgctctttcccgggtcgagtcagcacagggttagcctcggggtcaaagggcgttaagtgcggccttcccgcagtggccttggggccctcctgagggtcgggggcacctagcaccgtctgacaagcgggcagagggccggctccggtcgtcaggggccgtaggccaccgtccgaatcgggggcctctcctccccgctcgctcccgggccaagttagcacagagtgggggtgcacgaaatgaggattgtcttcatcgcgctccacaaccaatgctgcactaactacttggggggtcgccgctaagtaaagtagcaggggctcatttggctccggggcgactagaactgggggagagctgagatatgcctttaactgagtgagggcatgttcagcttcctccgtccaagtaaacggccccgagcgcttgagagcttaaacaagggtagcgccttctctcccagccttgatatgaaacgacttagggcggccatgcaaccggtgacgcattgcacatccctaagtttgctgggggggcgcatccgctcaatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctaaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctcgagaagcctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccggggcccggcatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggttgagacggctggagcaccatccccggggccttgatagcatcaaaggccgcgggggaaaggatgttgagagccgctcctccatctatgaggacacgccccaacttcacattgcagatggtgggagaaaccaccatcgcaatctgccctccccgggcaacgcacggtgggtggtcggtctggtcaaaggtgagggccacctccgaccaccgcgcccgacgcgtcgcctcatgagtaggggccgcggcgagaagctctcgcctcatggccttgaaactccggcgagaaacgtgagcacacgctcccccgtcgacagtggcaatggtggccccaggttcttggaaacctaggtcatcatcaccgtcatcgatgtcagcggcgggggccttctgtttggcctcacttcgccgtttaccggagggaactgccgcggacttgccctcacggcgttcctgcctcctgtcctcctcccacttcctcgttcgctcagccaagtttttgactgcgcgacagtccgcgagatcgtggagggaggtgttgtggacggagcaccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagttctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagtacgccgatcactacgtcggcgctcaatgtcgaggcgggcatccggctcttcatgctgatcctcccgagtcggaggcgccgacgaaggagtggtagccgaatggcgtgcagcagccgccgctcgccgcgccctccgccttgatgacacagaaccggtagtggcggcgccggaggtcttggtggtggcggaccgtccgccagcacccaggcgttgctgtgccgtcatgaccaagttggccacgtcgtccagccatcgctgggctggagactccgggtcagggacgacaggcgggtgacgtaggagcgcgccaacagcctgaagcgcgccttgaggcgtgctgccgtcgccgtagacgaggaggcgacgctccccatctcgccgttctcctgcaccacccgcgactggcgatgctgcggatttttcgactctctcgagcgcctccccccgcttgggactttggcgtggaggaggtgggggagtacgagctcgacggcgcgggtttggctccccgtcgtcgccgctcacactcggagagaggtcgtgcgcctttgcttgctcggccattaggcagaacaagggaaacttggcgcacacggaagagtatgagagctcagaaaacacacactgagccccctacctggcgcgccagatgacggagctcgtggcccctcaccgggagactgcgcaagcccccctttgccggttcgaccaggggcttagggtgcaatcccaagctctctctctctctctgtatgtggaaagatcacccgcccgcaagacacacgagacacggcgatgtatacaggttcgggccgctgcgaagcgtaataccctactcctgtgtttttgtggatttgtgtatggacaagttacaaaagattaacttcctttcccctcagccttccaaaaaggaaaaagtcccctctctaaatgggcaaggtcctccttttatatctcaaggggataccacatgcacctttctctttaatgggcggagatcggtacggtttccatccgggagcccttctgatgggacagcccacacctacccccacctcccccgaagacagagatgacgcgggaccgtggctgtctgtcgatgacgcgaccagtgccagactggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccctcgggggaaatcaggaggagggcggacacctcaccctcgggcccgacgtccccgaaggtgctaggccacgtgggcgattgcgtctgcctcaagcctctggtcatgatactcccggtcccatatcaccgacaccgtgggaagatcatgtagagacagcttgactaataatttatatattacttgtgataatcatattctaagcaggggttaagataatccaagggtagagtgacacacaagcattaactactcattctcataatatatcatctaagttaagtggatagaaaagagaaagaaaatcttttcctatacttgtaatatacatagtatacatacattctagctagctgatatacgagctaatactctctatcggatgccttcctggtacttcgagaagccaccactggctgcagagttcctacgacaacccgctatgaccatacaaccggggctaaatacggaggaataccctccccaggaaattaacttaggattatataccagcgaggaggaatacccggactgagctgtcacaatcagcggcccacctctcattcgcaatatataaccccaaataatgatatcccgtaatctagacaccacgtctaaactaccagatactactctaatatcatcgtcgtgacatagagtaattgcataagcaaacattataccgcaccaaagcatctcccagataagctagccgtatattcagtataacataaacataatgtaaagtaggcattcatatactcagaaagtattccaataccataaatgtataaagaagagtattctaataaaagtacaaagcttacaaaagagaagagagaagctattagagccatacccgaactcttccgaaggcttccggactcctgatttttactctattcctattccaccagctagatactactaaactaaacttgagagaaatgaaaaagctattgcttgaggtgtgtgttgaagtgaagagagtgagctccttatatagaggtagttatgacggttgtggaaggggaaatgtccgaagtaccccgcaaccgccatcaggagaagatctggagcgtctctgccaaaccccacatccaacggtggagaaatgggttcggccgaacctggggccggcccaaccagcccacaatttggctggtggcctcctggacttctcttctccgcagacttgtgaattttggcccaattcatcgtgtcaactcgtcaactctgagttcttggcccattcatacataagtctggtgctcgacatcgtccgattgatttatcgtttgcgttgacatcaattctccttcattttagtgtcattctctgcaaaaggttagtatacctaatactagtggaatattattattctaacatgtttatgcattgcaagcatggctagttcacctctattttggtaatattgactgtcgaaactgatcaataacgaccatcaacaatacttcactcgaacaacctcatattttcgcttatgcttatacttatcagccaaaattttgaattttcaactttaaatttggagctgatttcggggtttttcattgtagtttatttttcagcctgtgcttttagatcgttaagaataagtatataaaagttttttttctcgaatacgcaggagagtacataaaagttttattcacaatttttttttgcaaatacattattcgctttttcctccaatatgcgacacgacgtggctaaaaatttgtcacaaaacaagcgtgacaaaaaaatgaggtaccttgttaacgtatgattaatgaagtatgagctacaaaagacttaaaatattaattaatatgattttctaaagcaactttctaaatgtatttttaaaaataagttcaggaagcgtgcgtatggaaaacgaaagggtggaagtgggaaaagaggagaaatgaatgcagcctaagtttacctttctcgccaaaaaaatatctacattatttactgatgttaaagaagatataattgctaatagggatgatttagatattatatagtataaatctaagaaatagcataaatgtttatcaaagcaacatagtataaatctaacaaatagcataaatgtttatcaaagcaacaccattcaagaaattttatggagaactcgtactttagatgtcatttatatgtcttgtcaagcgtagcctacgatgcatggccgtgcttcacatgggctacctttgtagttaaagaaaaatgcttgtatttgatatggtccgagtagtacttcataagtctcagaatgaataaatttttcatttcccccctccatttatcctcggataagttcattttttcagccattattactttggagattataaaaatagatgataaatatattaagaatagataaactactgaataataaaaatagttacattagggatttgataaagggatagtattttagtttttttatttatatatactacatccgtcccaaaatataacaacctatgattgaatgggatatatcctagtccaataaatctggacaacactttgtattcaacgtgcaatcctaaatagtcatattttgtgacggagggagtactagtagataagtaaaataataaatttattttgtgaaagatggagtatagttcttacacccaaaaatgaatttcgtttgtttgacaaacggaccaacgatcagaccacgctgtgactgtgagccggacaacactttgtattcaacgtgcaattgtgactgagggagtactagtagatagataagtaaaataataaatttatggctgaatagctaatttaatccctcaagttttaccgaaggctcaatttggtccttcacattttattttgtccacatagctcctctaaatatttgttttggcttgaaatcaccttaggcccacttaatatgccatatggctatttctagttaatatttctattagaaaatgtcccttttacacttaatttgtatatacaactatatactagaaaatagaaaaccaaagatgaataaacaacattgcagatgtgtttcccattatttcaacatgtgcacataaaacttaagcaattgctactgtatatactttctagtacataatttattttcgttttacataatttactatggtgacctataagaaaatcaagcatgcaatttttctcttatatatgtgaatgataggggtataagtgtcatttatcaaaagagttgttggttcaatgctacatttgaactaaaatgaaaacttaaaggactaatacggatagattgaaacatcaaggactaaactgagtcccagatgaaatttgaaggagcaccttttgtgaaagatggagtataagctcctacgccaaaaaaaagaatttcggttgggcgacaaacggaccaacgatcagaccacgatgtgactgtgagcctggacaacgcagcagcaagccccgtaccgcgcgtacgccggggcaacgtggcacacgctcctaccctagcgatcggagacgagccgaccgcgttgtggcgcgcgcccccattgccattgcaattgctcgtctcgtctgtcgtctcatggctctgctcgagtgctcgactcgcccacacgacactgccaccgcgcgccattaactcccgcacccgcattcatgcccgcgccgcgttccaaccaccgcaccgccttaaatgcccctccatcccccattcccatccctcctcacctccacctccacctagctctagagccttccctctcctcctcctccacatccaccggagagagtgtgtttattggttcttggaggagagatgtccaagatggcggaggagaaggtgctggcggcgccggccaccgtcgacggcgggatgcagtcctccggggacctgcaggcttcgtcggcggcggcggcgcgtgtgcggcccgtcgagacgctcctccgcgccgcgccgctggggctctgcgtcgccgccatggccatcatgctccgcaactcggtcaccaacgagtacggcaccgtctcctactccgacctcggcggcttcaagtacgcttctggaactctcctgcggcggcggcggatcgacatggctcactctcctctgatctgatttctttttgttgtttttctttttcccaaggtacctggtgtacgcgaacgggctctgcgccgcctactcgctggcgtcggcgttctacatcgccgtgccgaggccggcgacgttgtcccgctcctgggtcgttttcctcctcgaccaggttgctttcccctcactgctgcttcttcctccatttcttgccttcccaacaaggattcactccaatttgcagccctttcgattcattttgctcgagcaatcatgctcctgtagtagaatgaaaaaaaaaaaaagctcgatgcgtcggaaataaaaagcagaaatctcggggtatttagagggggaaagttgaagttcgataaaattttgtttaaatttgagtaaaattgacttaatttatttatttttgaatatatcggacgaaagaatatcctatcagaggatggaaattcctgaaatttcagatgttcttgaaatttcgttcccgaatttccgttatgtctgtgtcgagctcactgaggtatttgtaggacggtgttttcggtgtgaacctttccttggatccgtatgtatctgttagcttaccaaaccgagaaatcaacaaatcctgtaaaaaaagatctgatcctttttagttcatatataacccaactgacgaactgaaccgaccgataacatctgcaaaaaagattctgagggatcatatcatacctatccatacgatgaactaactaaggctgacttcttttcttctctttcctaactcacctctctcgtcttgcttatgcatggtttttaaaatactaaacggtatattttaaaaaaaagtttctatatgaaagttactttaaaaaatcatttaatatatttatgttatttttaagctaatacttaattaattatacattgatacaccaccatgtttttgggaccgtctcgaacataatatttttctcaatttcaaacttcaactttcttattattttccgttagcttgttttttaaactgttaaataatactttttgacaaaatgtttctacgtaaaagttgtttaaaagattcaaataaatccattttaaattttataataattaatacttaattagtgggacaatagccattttgctccatgaagtttcgctctgagatcattttagtccatgacctttcaaattgtccaagcgagcctttaaactttttaaactttatcatgtggacatatatatatatatatatatatatatatatatatatagtcctttggcccatcggaaatttgccatgtaggcatgccatgtcatctttcaatgtcatctttcaatgccacgtcatctttcaatgtaaatatatgatgaaatgcccaatttgcccatacacatgaccaaattgttcctggagcaaaacttctattctcccttaattaattatatgcgaatgaactttctcgttttatgtgcgccaaaaaaattatcaaatcaactgagagaacatgctaagctgagatgagatcacatatatgcaggtgttcacgtacctgatcctggcagcgggggcggcgtcggcggagctactgtacctggcgtacaacggcgacaaggaggtgacgtggagcgaggcgtgcggcgtcttcggtggattctgccggcaggcgaggacgtcggtggccatcaccttcgcctccgttgcctggtacatcctcctctccctcatctcctcctaccgcctcttcagcgcctacgacccaccccagccttccctcggcaacaagggcgtcgagatcgccgccttcccccgctgatcgccgccgccgccggagacgaagaagaagacgaccacccagacgaccaccaccaccacgacatccccagctactaagcttgagctgctgcgtgcttgggtactactactagctaggcgagagcatgattaagtaataataataagtacttttatctctccagctaaatatatagtgatgagtgctttttaatttcttcttgtgctctgttatatatatatgtgattatctctgacctgatcatgatcatcgtcgtcatatactcatatatctctactcgaactcgtggtatgtatggttgttgattcgatcagctgtggtgaactgattgacccgttacaaagattgcaaactggatatgtatctgcggttagagaatgggtggtataatttgagatcttgaatgggtgttgcttaagggctccttattttccccctttggaatgaatgatttattgagaacattggagtaagaaaaaaaaaagaacttggaaattagatgtcacggtttgttgtatcgtaatattacgagtctatcggaaatttatagaaaacggcgtttggtaataccattggaaaaacatgtatatcatgtggaatttacacgagacaatgtatatttgagtttatgcaaaattcaaatataatagcctagtactccctccgttttttaatagatgacaccgttgattttttctcacatgtttgactattcgttttattcaaaaaatttatgcaaatgtataagatataaatcacacttaaagtactatgagtgataaaacgactcataataaaataaattataattacgtaaattttttaaataagataaatagtcaaatatgtgagaaaaagtcaacggttttaactttatttttttattttttaaaaattttatggtgtagtaggaagagagtaggggtttagggtttagggtttagtagtagcttccaaaggattttgttggactccttactctgttcaaagcaatcgtgtacaaataatcttacatcggattttagtactataaaattcatactctctccgtccttaaaaaaaaaaaaagataaactctgggtttccgtgtccaacgtttaattatccgtcttatatgaaatttttctataattagtattttcattattgttagatgataaaacatgattaacactttatgcgtgacttatctttttaatttttttcataattttttcaaataagacggacggtcaaacgttggacacggaaacttagggtttgtattttttttttttttgggacggagggagtacgttctatttagtacatgaggcactgttctgtggaggggggttaggaatggtggatagtaatatgattatttaaaagcagctttttataaagtttctttttttttagaaacgtaacatttaaacatttgttcagaaagcatgcctatgcctatgaaggctgtgtttagtttatactaaaattgaaagtttggtttaaattagaacgatatgacgaaaaagttggaaatttgtgtgtgtaggaaagttttgatgtgatggaaaagttgaaaatttgaagaaaactttggagcaaaacacggcggaaaatgaaaagcgagagagaagttgggaaaataggagaaaaaacttccgtatggaaagcttttgtaaagactgtattctttatatagttcattaaacgtgcatgtgaaaaaacttccgtacggaaaacttttgtaaaaactgtattgtttatatagttcattaaacgtgcacgtgaaaaaggagaaaaaataaagttatttgtagtagaaaagaacacacaacaaagtaatttacagaacagttcaccagaggttggtgactgcagttatttaggaatcactaggccctcttaccttgaaagcattttaatctgaaattagaaaacaaaaacttgaaataattaaaaaccattttcaaaatttccttatgctggtatttattggattttattttttcttttcctattgtaccattgccaaaaactaattaaataatttcaaaggtaatttaaaaaggaatcaacttcaaattctaaatttgaaataagaaaatgaataattttgatattgggaatatatataccatctttgactctttatgtaattatttatatatattaataattagcaagtcctaattgtcgtgtatacttttttttaaagataatatcagccgatataatttaacaattatattgacattccattaaaattataatattataatatacctgtaaatagcccggataacataagattggctcgatccattattcattgaataagtaataccaaaatgtagaatgaaccaatatctacatatatcatacattgttgttttttctccaatcaatataggggttgctcagattgtatccaaaataaaccttatcaaaatttgggtctagatcccctggagttggagccaactccaccggtagatttggctcaatcttaaccgttcttctgacttctacggctgggatcatggcacctactcttcttctaatcaactatcttaatcatatagatttagaggaaaatatttagtttttttgaagtacttcccaccataaccatgattattctccgaccaatagtatcaataaaacaacgctggccatcacaaaaccatataaataaacattagcattatgttcttcaccatggttggaggtggagatggtgggtggaatacccttgaatcttcagtttgactgtttgaggcaatgaagaacaatatgccaattttatcaccatagctgaactaaagtttgatgacaaagacgaagctatcgcggctctggaggggaaacgatggtctgctgctttggtactagtaatttaattaggaaaggaaagaaacacagttacagagattagagaaaatctcagccgtataagtcaaaaggacggttgagattcggccaaatccaccggtggagttggccccaactccaggggatctggacccatcaaaatttggtatattgtcaaaattttagtaggatttcttatgtattatcaaaatttggcaagaaagtaaatggatgcacatatttgacaacttaaaaaaaacatggtttgaaatggtattaatctgaaccagcccgaaacttcggagtactctctactagtactagccatttcaagaaaaaaaaaaaccctgccgcttgtttaagagaaatttaaaattttgtcgttaacaagttcttttttttttttttgctattgactagttagcgtgcacgtgcaaggcacgtcaacaatattgaatagtaaatactttacatatatggaacagaaaaaacttaacctttactgtaacaatagagagaaacaaatcgattattctttttctaaaaaacaaacaatcaaataatatatcaccgataattgtttacggcccattgccatccccgccacttaacgccttgcatgttggccccaagccacactcttttttaggcagagagaattcagttatttttttagtatttataattatccaaaatggtgctactgtttgttaatggtggtgcaaacaattgctttgctggtccagtttaaaatcggatgattaacggaagcatagtgacagggataaatctccgagaaaaatggcataaatcaacaatactcaaagagtctcgcattgatgctatgtaagagaaaatttgattatgaaatacaagttacaaattatcatggtcatgtaactgtttgctagtgtttatgcaaatggtcatttctttcattacggtttgattagataattactaacagcatcattaggttgataaattggatggttgctaataacatcatcaggttgctgtgacaatatgatctttctgcaagaaaaggttgcagttatagtgatgaagttgtgagccaaaaggcagaataaaggcacagtgacatctgtcacgctgatggtactgaagtacgcaaatctgtttacaaattgtagcatttttttgtcatttttcagttgaggtagatgtgagaggcgacgtcttggatgagctagttgaagccctaaagcagcctggtttgagcacctgcaaacaaaaccacacctccagctgtcaatcaatcagcttccaaatttgccaaaattactataagaaaatcttgcaatggtcaagcacgtttaatacacgtctaataaaaccattttctatatacagacttagaacatattgtttttctcaattttatcaaaattatctaattgaatgttgtgatttgtcagatacacattaaaacaaaaccctgctgaaattatctgaacttcgcataccacctgctgaatcactgtaaaacaaaaacatttttttctctgaaccttgatgttcatcgccaaagttgggttaggcagtatccaacacatgggcctaaattgtccctttaggcaatatacatacatatgaggtagtgtaagagatacattacagaagaaatttggagagcagcaacatttacagtgctctcctgtctaaacaaatcgttccttgcttcaattatctttggacatgtggtctatatatactctgtacatttcaataatcttgagacatgttgtctatactcagtccattacaatgctctccagtccaaacaggtgaaatggattgaagccataactcctactacgagtatatgaaataagagtattaacaatgtatatatttcttaccaacaatattgtagatatgcagtgatccttgtggcagtgcaattcaaatatggtatctaaaatatgggtaattatcataacaggataaacaagctacaaaggatttatgccacatgtaaatttacttaattaacttgcaatgtcaactggctgaaataataatttttcgagatgattacagcactttaaaagcaatagcttcaaaggctaacaacaaaaacactatagctgataaaaaaggtacggtaaattatatttcttgccttcaatagtagaaaagaaatagaactgcattgacaaatgaaagatgtccagaaatctcaaaacttttttacatatctagctatcaaagtcacatatatgcccattccagtcaaatatatgattaaattaagaaatgcacaaattggaatacccagaaactgcatcacattagtttgagctaccatgtaataataatctactgccacatgggaatatgatattgaaaattagcctaagaacaaaagtacagtggagcccaagaactaattgcctataggataagccccaaccacaggatggcatccatggtctagctttgtggtctgccaaaacatttacgtgttttcctctaacagagctcaccttcacctgcaacaatcaggcctcaggaccagaggggaagtcacagttccatagcatctgagtttacaacagaggggatgattgaatcgaattacatccagctagggtaatattcaaaaatagaaatagaacgacaaaagaagttaaagaataatgcacgtgcaaggcaaagaaccataaattaacatgacatgtttcataattgtaatcattccatagttcataatagatgcgcaagaagttcagttaagaaatttttttaccaaatcaaattaatgttgcaccaaacaaaaaactatccaatataattatgagccaaatggcatgcggatttttttagatgcaaaagtttagttttttcttctgagatgaaactgtatacaaaatactgcatacctcatgagtacatggtgtttgaatatgtgacaatgaagtggaccattgctacaggcctaaggaagaaccagctccaacaggggaagaacataagcactccagagccatttcttcaattcaggggttcctatcaatgaaaactgaaaaacaaatcctttgtacataaacaattgcatgtttgtactgcaggaaaaacgtttacatattcagttatcatgaattatgtgtatagaactaaacttgacatgttcaaggaaaatattatcactgcataaatctgaatttgtgatgtgtatgaaagcatgatatccagtaatatcaatagaatactctacatgcaataccattgcttataatgatgtccaaagtatcaagtgatggtgcatagaagtataggactataggggcttgtagcagcagaaatattagaatggcctcatcctgaaactaaagtatgcagtatttttagtccataacggtctccacatgtctttagtagtaacaatgacaaagatatacagggactgtcacacagtcagtcacatatgtgggctgggccaagcggtgggaggagaaaaacaaaatttgcatcaacaagaagcacgtgaggtaactaacaatgtctattggtaaaaattgtacaaatctacgaaacaaaacgtctagaacaatccatgcatacaaacttttataaaaatatttctaaaagtaatgaccttctcaatctcagatgattcacattgctagcgttcacctttagaatgaatatcctactctgctcttttcagcttggaatttcctcctggaatcaaataataataccaggttgaattttatattgacaatgtactattatttgcatatttcagaaaaaagctagtgagcaaggcatcatacactgttaactgttcaatgtgcaagatgtctaaaatgacaggggaagtatgcagtacgacaataatcaaatctctataacttcgccactttctttactatagtccctcttggtggtgtttggatccagggacttaactttagtctctgtatttagacactaatttagagtattaaatatagactacttacaaaactaattacataaatgaaagctaatttgcgagataaattttttaagcataattaatccataattagagaatgtttactgtagcatcacatagactaatcatggattgattaggctcaatagattcgtctcgcgaattagttcaagattatggatgagttttattaatagtctacatttaatatttataattagtatccaaacatccgatgtgatagggacttaaaagttttagtcccatctaaacagggtcttagacttttttctcgagaatacacaaaagtttttcatgcctttgtatctagaattgggaggtagctcctcctagatttaaaaaatcatccaatattatataagttaagttgtctaaagaagattatatttcacatgttattaagtacccacggatgatttgcttctttcagcaaattaggtactggtgccgtcttctccttcatctatctctcagttgtatcattttccacgtacaaaacatgctttgagtcagtgctaccactgataaggaaattgatattggcattcatactaatactaactaaagaggaggaagggcaacaaaggatgggcttgcaaataaatttaaggtacttgaattgcacctcagtggaggcggtggagagcctagcctaggatatgagcattttgtttgttacctctctgaccaaggagctcacttttttttccccggaaaacaaggagctgactttggttacagaaaaatcagaagcatgtactggaaagcaataatccctctagatgaaattgaactgggttggatagcaatagtatacaagttcactaattcacctgttgttgataacctattactatattccattcttaccccttctcttatagctcattctcataatttgtaactccaccgcagtccctaccaaacaataaatcacaatttatccatccaaaacaacatttgctaagagagttagggcctgtttggtacaactccaactcctaaatataactccaggagttgagtctggagtggagttgtggagctggctaaacccagctggg

SEQ ID NO: 74263 - DNA, 641 bp, Oryza sativa
cctcctcccccaccagcagctctggaccagacgacgtcgtcgctgcctgtcgccgtccgcgtaccaccggatgctctccagcacggggcgcctccacggcgtgctcgccgacaccctccgcggctacgccggcgccgctgcggtggcgggctccatcggctacggctccgcggccgccgccgccgccgccatgggcggctacggcggcgccggcgccggcggcgggttcgcctcctcccgcttcatgccgcgcctcctcccggcgtcccgccgcagcatgcgcgccccgcggatgcggtggacgagctccctccacgcccgcttcgtccacgccgtcgagcttctcggcggccacgagcgtgaggccccatctaaacatggatcatttcatgcgaaaatcagctcaaaaaatctcatctcgcgctctaatttgatgcaggagcgacgcccaaatcggtgctagagctgatggacgtcaaggatctgaccctagctcatgtgaagagccatctgcaggtgatgatgatgatgatgagatcgatgccctacctatcaacaacaccaacaacttctcctcctccttggaaatttccatatcatatcaccacatcgccatggccatgatcgagctaagctactac

SEQ ID NO: 74264 - DNA, 29354 bp, Oryza sativa
gccaccacgctgacaccgcaccaccacgccactgccgcgccacgctgcagccgcgcctccacgccgccgctccgctgccgcccctgccgccccatcagtgaacgaaaagcgaacgaacgtacgtgaacgaaacgtgaacttaacgagaacgtgaacatgaacgaaacgtgaacttaacgagaacgcgaacattaacgaacgtgaacgaaatgcgaacgcgaacgaacgtgaacgaaacgtgaatgaatcatgaacaaacgtgaatgaaacgtgaacgaaacgttaacgaacgtgaatgaaacgtgaacgaacgtgaatgaaacgcgaacgaacgtgaacgaaacgtgaatgaaacgtgaacgaacatgaatgaaatgtgaacgaaacgtgaacgaacgtgaatgaacgcgaacgaatgagaacgaaacgtgaatgaaatgtgaacgaaacgtgaacggtcgccttataggacactacgtgaaatacaatatatgttactttgcatttagactaatacatttttttgtatgttgcaaaaaagatgtcgtcgtcgtcgtccctcaagccagagtggtagctagcccgcaaaggaaatcgcgcaggcaagtgatgtaaagatatgattgttagatttttaatataattaagattattagattattagacttactaaatgtgagtgttagagattattattagagttttagacttagcatatgtgagtgttagagattgttagagatttaatataagattattattagacttagcatatatgattatttgagttctaatatatgacacttagacttaacatatatgattgttagagttttaatataagattattatatttttaatataggactaataatataaggctattagatttaatatacgacacctagacttaacatatatgattatctagggttctaatgtacgacacttagacgtagcatatatgattatttgagttctaatatacgacacttagacttagcatatatgattgttagacttttaatataagattattagatttttaatataggactaataatataagactattagattattagagttttaatacaagattattacagttttaatataagattattagatttgtaattagacttagcatatatgattatctagggttctaatatacgacacttagacatagcatatatgattgttagagttttaatacaagattagtacaattttaatgattatctagggttctaatatatgacacttagacttagctgcaccgtctccacctcaggctcctgcaccaacttctccttaggctcctgcaccgactcctcctcaagctcctcgtccggcaccttccaagtcaagggccccccaagctccaccgcctgcccccacaagggcaacgaagaaggcgaaagttgacgccgccaaaaacaaggacctagggtacgactgcacgcaagaggagcttgacgcttatgtggcatcagatgtcaggagacaattgaagccttggagtccagaaaaggagattcttatagacccgagtgccagaaacttcttcaggggtatgtctgcacctgccaaggagaccataaagctatcggactatgagcgaaaacttaagaaagcatcttctggaaagtccaaaccagtccctcagcttggagagcaaccaaaccaggtgatcgagccgttggtgaccggtgaagaatttggaatacaagattttattaatgacaccgggctaactacggatcaattgctacgaggcgcaccattcggaaaggcggaagtgaaatacaagtacgaactcggtaaaccgcttgtcaagcctgagcagctgcagtccctaccgacacagatgtacaaattccatcgactgtacatggagatgagcgccaccggtagagagatgatcgaagtgaggatcagggacacggacttcttgcaaggagaagatattctctggatcaattacaagggtatctacgaactataccagctggacgccctcgacgtctctattatgagttgttggactttgtaagtatcgtccagttagatttcttattacgtttccttcaattaattaggtccttatatataagtacaccatatataatatatacttccttttatcgttgtagaatggagattaaaagggcccgacggcggggggttttcgatactggattcatcgaccctcagaaagtaaacgtcgcaatgctcgacgagtatccgcaagccacagaggacaatctcgtccatctcctgaaggcgcagcattacaagatgttcatactattgccgtacaacgcagagttagtttttactgtcttcctaccaaatttcattcccgtacgaacatgctaagtatttcatatgtaaagcatgcgatgcacattgcagattccactgggtacttttactcttcgacttggaggcctgtgtagtcaatgtatatgactcaatggataaaaaagagtctacgtttgaccaggtttttgaacttatagataggtactgtcataagttccaatgttaattacgaatcttgttataattaattgctactacgaatcatagctttaaactccatgtagggcttggtatcggttccgtcatttggtccacggcaattggagagaaagacttaggcggaagtttaaatttcctgtgagtacacatgctctacatttatattgaatctccaattcaaatacaagtgtatattaattagatctcttgccgtttgtcatgtatatatagtgcgcaaagcaagcccagggaactaacttgtgtggctactacgtgtgcgagaattgccactgccttgcagaccaaatcatcaacacaagagagctcgatgtacgtacaaataaattgaaaatttcattgcgtatgtatcgatttgttgtttactaattaatttcatacattcataggttattcgcatgagggataacctcacacaaaaggaatttatcgcagcggttcaagaacaactcatgggattcatcaacaaacaaatccttgatcccgagggtgaattctactacgacggaaatacaattcataggtcgttagcttctaagataacgactaatactacgtcgaagtcgtagctagctaggacatcataatgaattgtaattaatacatgtctattttcctatatgcatgtacacatttactttagtgtaaatatatattttggtcatatatatatgcacataaaatgttaagtgctttaatatatatagacatatgcatttgcataacatatatgtataaatacatatatattatgcatgtatatatattgaaacatatataaatataatatataaatatataatatatatatatatatatatattatgcatatatatgtattgaaacatatatatgcatggtttatatgtatgcatttatatataaaccatgcagcaacagggccttgcaaataaaaaaaagggaaaattggaaccatgccattataatattgcaaaatttgagatatgccatcctaacccacatgtcattgactcatgtgggtcctacatgtcattgagataccgatagcatatctcaaactttgcaaaataataatggcatgatttcaatttacccaaaaaaaaaagggcagctcgatctttagtcccggttatttcacccgggactaaagatagcgatctttagtcctagattggtagtcccggtttgaaaaccgggactatagggggttaccaaccgggactaataagggtttctccaccagtgattatatggtgcgccgtccccacgcatgcatcatatctccgttttttagttggttggtgagagggttgtttggttggttgacttgcattgccaagtcatattttaatcatgtcacagtttattagttatcatttatgaaaaatagttgcttaggtatgtgttaatttgtttcgctgctacaactttgtcatgcccccttttcttaatttttggattcactagaaaaatacccctacattgcaacgggtgaatgctattttaagcttattattgttatatggtttaggtatggtagaattcaccgtgggaattcatttggatttttttttagaaaatcacgagctgcaattaggagtccgacttttatctcaagttagcatgcgagttttttaaaaaaagagatttcttatacaatattttcaaaagcaaacgagtttaaaatccaactcaaatacggatatatatttccaatagcgaacaaatttaaaaaccgacttaaacaaggatgacgtaccaaaatatcggaaaaacatcttcaatttttataatagtatagataagttacactcttaaatttagagctaaccgtgctacacttttgaccaactatttcttagtcacacttataccacccatgccacaactagtcaccttatagtggaaggatagtggatgagatactgttacctaattaccaaattgttcagagttgcttgtgcaaaaattgtaatatctccccaataaaaaagaagaaacatcgctacatgcagttctgagtgggccgtctgttatactacatgccaaatagtgatattgggatatgagaaagtgagggcactgtggtcttttggttttctctatttgtaggtatgtgtcaggtaggtgaaaactaaatttatttttgtatgaagaaacagtatgtattatcattacatttgtatgtaaagataatttcatgcaatggtaataatttactccttatgtcccacattaaaaatgtcaggttatttagtatggattaagagagtccaattgattaccctaataagtcaaaaccaaatctaaaatttgaattttcaaacttaattttgacgttaattataagatattttgaacgtagtttattttttgccattggcatttaagtgactacgaacacgtatataaatttttatctataatttttttattcccaaataaaccgttttggtttattagggaatatgggcaaacgatgagcacagtgctgttcttccacagccggaaccaccgtcccttcccctttcccgtggcaccggtgcccatggcgatggcttgtagtgcttagtgagctcagcgtcgaacttgctacatccgtttcccggcaacagcacgatggggtggatatcgacgacggcgtggtggagcagacgacggcgtggtggagcggtgggagggcgctgccgtcgatgaggaagaaggggacaacagaggaggagcagcaggaggaaaggtagtatgtccattgtggcagatagctcgctagcttggttgtttggagttttagataaccacgcgagatgagacgataagtaggagtatataagtaagtggcactctagctattgcttgaaagagccgagcaaattaacttgcgttattatggtaagctcagttgccacgtttccgaaaacggaaatttgtctggacgaaagtgattttcatttaaggatccaacgacccgaatttatacatttgggctcgtacagataaggcgttgattatgtggtgctgtccctgtccccacgcaatcgcttatattctgcgggcagagtacaatcaagcgcctgatgtttgaagaaaaattggacgcttcacctatgcactttgtgttgcatacatcatatcttcttttatttattggttggttagaggatggttggttttggttgcgtcgcattgtaaagtcatactttagtcttgtcacagttttttagacatccagtatctgaaaaaatagtttcttgggcatatggtagaccctatttagattacaccctgtcacatcaaacgtttgaacacctgcatgaagtattaaatatagtcttaaaaaataactaattacacagattgggactaatttgtaagacgaatcttttgaacctaattgtttcatgatttgataatgtggtgctacagcaaacatttgctaattaccgactaattaggcttaataaattcgtctcacggtttactgacatattctgtaattagtttttttattagtgcccgaacaccccatgcgacaccctatataatattcgatgtgacacgctaaaactttacacccctggaatatttaaacacccccgtaatttgtttagttgctgcatctttgtcataccaaactttctatctagggatctacgctttcacatttagagctaaccatgtcacacttgtgaccaattatttcttagccatacttatacctcccatatcaccacttgtctaagcttgcattaacaaaatatcctaactgcaggctatattctaggctacatcccattcttatatacttatcttagcatttttttccccaaatgatttttccttctaaattatttatctaatctgcgatttggttacaccatcatatttcttttaatttagccgttacaacaagatcttaggaaactaaatttgatcttggacaaatatattttgatgagaaaaatcatgtgttattttatcgtatattgaaaattttttcatcactcgatcaaatttagttcaatttacaaaaggtttcatagagatgcaacattcaaaatatatatgatggtgaggctagcaattagttagccacaaagtttaccacacctcactttgccacaaatgtgtcatgccacataaagtgaggctagcaattagttagccacaagtgtggctaagtttggcaagaatttgagtctatgacgtgtaggtccaatgactagcaaagtgaggcattacacaattgtgacaatcaaccaaacactatactaagaaattatggcatgcctaagatttggcatggcaacctttgggagccaatcaaatagccccgtactccctcctctctagtggataatccaatatagctaaccgatgagctagtttgaaaaacaaaaatcaaaatttttttcccgcatgcatgggcaacgaaggcacatgaaattagctgatgtgcatccgtatctagtcaataattcatccatgcatttcggtatgtaagtacgagaaccaaggttgaaggagtatataccttttctttttcaggatccagtatatactgtttttttttatgatctaacatgtactagaatttttttgctggagtacatacctttttattgtaatatccagtatgtttgtacttgatttcttttaggtacagtatgtacctttttaaagttaagtatatacttttttaagttagtaatggtatatacctttttgaattagtagagcagtatatacctttttaagttagaagtagtatgtaacttttaaaaaatgtagtagcggtatgtaccattttaaattagtagagcagtatatacctttttttatgttagtaacagtatgtactgttttttaaggtgaatatcagtatatactactgtaatttcaatgagtactgatgtacttaatgattttttcctggaactgactatatactaaatttaatttcttgggacgagtatatcccgatttcttttctgaacaagtttgtactactcttctttgaacgagtgtactgatctatatactgatttctttcacaaattatattctccgatttcaggagtgaacatgaaattttaaagaatatatagaaagttatttcctcaatttagattaaattgaagcatagtccgatcccaagagaatttgcaataatccaggcagtatatggattcatacatttagccattctgaaaaagaagaaaaaatgaatgtacagtatacccaattttcgacctgcacaaactgctttggacagaattttcatactgccatatccacattttctacatctacatcagctaatccatgcaaccatgcgaatatactgcccggtgttggccaccatccatggtgtatttgtcatgcatctgtatggagcaaagcaaagaactagttaattaggagcttcatcattcttcagaagactaaataatacgctgggttatcaaataattttttttaaaatactagcaggcctactcatggaaagagggtgaatggggattacattcaagtacagatctaataagaaagggaatcctcgatctgcaggaagagaaaaatggaaagataataccttggcaggatgaataaggagtagaacagagtggttacggcctcatttccctgcacggcgcatggatttatgtgtcaaccgggcttggcgaagaaaccccgattgcatgatcggatgatcctgcacctccggccaaccgtcgttcttcgtccacaccggtggtgaggagtagtagcgtcgcgccgaggtgcagccaggccaccgctgcctccgtgtggacagcgtcaccgcacagcgcctacataggacgagacgacgaatcgatgactgatatcgtcgccgctagggcactgcctaggaacgccatgattgccatgttgctgcaaatggatctcaccgcatcccaacaaatcaccgatggatgccgccggcaccgtgcatggttgctcatcaatcgccaatggatcatgccgtccgctttgactctccggtagctagcggtcgatccgaatattgcggagagagcgagctattgccgtcgctggttaagtggttaggatggcagccggggatttatattatttgctcaggaccgattagtgtgggatagttaagcattaggtgattttttttttataaaaacgaaacgggtctgttgagtggatccggtaacaaggttgatcgtgtgcctcattactgatgaacggtggcaggtgtacgtactcccaggtgtatagaaccattttcatatatatatatatatatatatacatatatatatatacatacacatatatatatacatacatacatacatacatacatacatacatatatatatatatatatatatatatatatatatatatatatatgtatatgtatatgtatatgtatatgtatatatgtatgtatgtatgtatgtatgtatgtatgaatgttccacgtgaaatcaggaccccgcaatccatcccaaaatatccttgtttgggtaatcaagggttttgctggcgaaaacttgtgcgaattgcgattacggggtaaggcgacacctcatctatcttttagatcacaaaacggtggttcaaatgtcttgagcaagacgaatagattagacaatcaagccaatgtgcttgaaatgatgattgatgttgatccaagtggtccaagtatgtctatttgcaaagatacgatatgaaagcattgcaatatctactagcattaactactacaattataacatttaataggaaaaaaatttgcccaaatgcacaaataaaaatcaataatttttcaggacgagatgggaccgggaaattaataattaagatagtttcttcatggccgaataacatatatatgtctgaattctgatcctgagatcattgcctaccatgctatccgcctaccatgctatccgttatattttttctcagaatttttttctgcaaggaaatggtgattttataataatcagtaacaagtgctttaatgcccagagggtcatcaaacggccaaacagcacggttgttcaatctcgatcctagcacggttattcacaagagtcaccttgttaaaccctcttccaattatctagagcttcaaaatgatatagatggttaaatggcagattcataatatgttgaacgtagaaatcggagtgcctctagagcctaaggtggactcgaacttgatatgagttggacctccatcttgatttgaacgtctatgacgatcttattcatctcctagcttcttttcatgtgctccatggtctctccatagttcataatcgtgattaaatcattaggtagcaatctatcctcgcaagcacataaagaagtacttaggaacgagctcatcagtaaatttaattgtcgggcgcgagctctagtgactggaccttgcaaaacaatttgaggggtagcgtgtgtatccaaaacgatagggcatgtagcctagtggttccagtgacccaaataataccccaaggtcctgagttcaaatctccgtatgagcgaattttagactgggttatttatggggctaagttaccaatttcaatggccaattagtaacctcgactacctatcgaacagtgggtgcacgcagaaaatgaggcggacttgtgtgtccaattgggggacattgagaatttgagattgtatttgtacatgagcctgagcctatggtgcacgtacagtgtattgttgatccatccgctttgaatttggaggccctagctgagcaatagagaatttcaagcccaattatgcgtactagccatcgagtcgtgggttgcacgggatattaatattgatagcacacgctacatgtgatttagaaccaacaccatgttaagttttattttagttacgtggataaaatatgtttggtcataatttcaaaagaactatttatatatagtacatcctaattcttattaatttcaatttattaatctaatagttttaaaatgtacaaatattaagtaacgatatgtactcatgtccatgtctcaattctgtattttatcttaattaatacacatatatagaattaataggtaccgtattgtagttagtttaaagtcttcttttcatgatataatattttttaaatatataattactaaatattaagttatattcattttgaggtctgaattttagcttttttggacgatactccgtatggagtttaagttattacttattcataatttaataactttgaagttcacaatcaataactatcgagttatatttttttcagaacatcaatgttagctttggcgatttgtaatccaaaaaatcagaataaataagtaccaaactgtactcagtttggagtatcaattatagctcatgatttaatggtgcgaaaatttgtaattaataaatactgagctgtataaggtatcaaatccaacaatagtttttccatgtattaataattccaaaaaaaggaatacattgtaatatccattttagccttttcataatttgctatttctaaaattgattattaataaatgccgagtgctacttgttgatgaaaagaaaaacacacaatagcctgggagatctgcttaactccagtgcagttataagatgttgatgagatgcgggcgtgccagttagtttgatcttgcaacagacaagatatgtaaacaacagaaaaaacagccgatcggctgacaagccgatggagtaattccagccgatagccgatattagccgattccacccgatgtcgatagggttttgagcaatcggctatatatccattgtagataaatatatatagacaatcggctgatgataataaaatataacaatattataatccaatagaaatcactcggctaataataatatgataggataagtatcgatccgatagttaaaagcatacattggctaaaagttcgatgtcataaaatccaatcgatttagataaacagtgaaaccttgttgcaattggcaaaatctaacttgtaagtaatctttgtaagccgatgcaacgtctagaaaacttatcggctagcatcccgataaaacactagcatgaacctattggcttaacaagatttatattatcaacaataatttagtaggtcggacctaatcgatgcagcacgagattataaatgatagtctaatgctcgatgagccgatagatctgtctaatgtgatggatataagaaatctatttataacagcattgtgattgtagagatatatcggttaagacggaagatcagacctaaccaagacagtccgaattaaaccgatacgtctctaaatacaatgtaattagagatagaattgagatatcaggtaggcaaatatatcaaacaaaccagagcgatccaagagatcggagtgatgcagccttgaacaacaccaatatagccgatagtatcactagggccgacgaaacgcaggacttaccccttcgtcggatatggaactgaaccgatgcagccccacatcaggtaccaaattcctctggttgataagtaaaacctcagaaaagagggtggcagtgcgccgagagtagtattgatcgagagataaattacattgaccccgggtgtacatatttctacacatgggtggaactgcttatacatttgtcgggtgatttttaacaagaaatcatccagattttttctacacttagatttatatccaacagactacaaaataaaataactaatacaaatttacttattcaacatctttatcaaaattacagtacacttatatgtcatatcaattttagttatataggactgtaattttatattttaaatactcacatgtcctatcaactgaatttacaaatgtaattttagttatataggagtgtaattttatattttatagaaaataacgaatgcatatttaattacacaacatttttatcaaaattacagtacacttacatgtcatatcaactaaatttacaaatgtaattttatttatataggactgtaactttatacaattacagtataattacattgtaacttacatataactgcataactgcagtataattatagtgtaacttgtatgtaatttcaatgtaactttgtatgtaacttttaaaacactgctagtcatacgaaataaacatcacgggagatctctcacccgtattaaagtagtattatcgttcaatcactttcgttctatacagtggcaaagctaaaaaaagatgcgtacaatacctcgcttggttataagtgccttgccctaatcaggtgctaatcggtaggtttaaaaaacgtcaaattttaagtaaaaaatttgacgacagatttatagcaaaactgcccatgggtagatactagtccttgtaggacaagaaagaaactttcctaaagataaaaggaaaacataaagtccttatcggacactaaacacactttccttaagataaaaagaaactaaaacctgcccaattaatagataaactgtcatttcgcatcctccttgaactcagactcttctagataagtttcctttaattgatctttacccgaatccatcaagaatacaactgttggcgattgatagtttccatggtcgattctaggactttaaaaccgatactgactctaaacctatgattactctgggcttaacaaattttgccattaacactactatatttaaaatctcagttaatttagtaattttgaaactaatacatatcaaatcgtacttggtttggagtttcaattatagatttgagtgatttgataattgaaatttaagaattaatcactactatttgtccccatcccaatttagttttgtatttaatttactaattctgaaagttagaggttatatgtttctgagtttatatactttgatgtcttgcattagaataaagtaaaaaaaactattgactccatatgttttccttttggagtgttttacttgatacaaatttgatttgggcccgtgtgattcttttctaatttttggatgagatcatagaatcggagtatgtttcttcgtaggtgcaaggaaattatacggaatacctatgtgaatccagcagttgcaacacaatcatggatcttcttagttagatgcaaatgaacctttcttgtggattattgtgtcatcacccgaattagttagctaatttactcctggtagtgtggtttcaatgtggaacaattaatcaaattataaaccaatctgtttgataaataaaataaattaataatcttgattgtgaaaaaaatatacctgacctgcaaatttaggatctccaggttccatgcattggccaataggaattcatgaaggcatctcctgctgttttttccagagtcatgtacacatgcaaccatttgatgatgccgtgagaaatcaagattgattgacaaaacaaaaaaatatatacactcaaataccaaatagctgatcgggatggagtatgaagggcaaacctggagcatctcctgtggttttgcgcgcggtgttcaatccctattggtttctcgtattgcagatagaaaaaggtagtcgattatcgttgttttaattagatgtatctcccaaatatttgaggggcttttacatggcccacaatattagctaagcgttgttttctttcatctacggttgctatagtatgatctattaaattaacggacaaatgtttctagttaccatgagagctcgaagatagtggccaattagtatagatactagccgtcaacccgtgcgttgcacgggttactgttgttggtatcataaataccgcttagattatgtattaaatgtattttctaaaattagtgtggcttaaattttgtaaaaaaataacattgcggcttatattgcattataagaacaataacattgcctacaattcacttagggcccctttgatttggaagaaaaacaaaggaatttcggagagttttaattctgtgggaaattttctatgaaagcctttgaaacaaaggattgaatcctatcatatcctttggaatacctatggattgattaatccggtagagattttagagaaaacttagtaagagctctaacctctttagaaactttcctttgaatctgtctctatcatccgattcctgcgtttttcctgcagtccaatcaaatggtcattcctctgtttttcctatattttgcaatcaactattttgcaattgcattcttatcacaatcctgtgttctttttatattcctctatttttccattcatgcgattcaaagggacccttagaattaatattgattaatcatattaatcataaactaccaatagattaaattgtccatgattttttggatagcatatttatttaacatagaatttttatgcaatcgacggtcgagttaaatctttttgagctatccgatggctaatataatcggctagtataaaaaaaatgtttggcatcttaattggaatttcatatgaagatgtgaacaatttcatatttattaattttaaaattggaattattaaatctcaaatggtgtttttattaaatttaaattgaaatatttatttgcatatttatttgtctataaaaatataagtgatgctaagacataaataaatatcaacattatttgtgaaaggaatgtataactcttcatcaatctgtgtcatgttgagggctaataattttgttgacgttgggatttatggcatcccagagttctattacactgactttgactttccgtgtttcctttccacggttgatgcatatcacatgccactgcagttataaaaaaaaagactgttaagttatatttatcaatgtaaccatgtattaaattgaccaaaatctctactattataaaaattaaagatatttttgccagtattctggtacatcatccagttggttttaagatcgttcgtttttagaaatacagttccatgtttgagttagattttaagcttgtttgcttttgaaaatacaaaaaagagtataataagaaatctcttttaaaaaaaaactatgcatgctaacttgagataaagtcagactcctaatgcagctcatgattttttaaaaaaaatccaagcgaattcccacgtagaattttaccctaactaaaccgtataacaataataagattaaaataacattgacccattgcaatgcacgggcatttttctagtctaaacaaattaaaagaacatcaacaataagctatacgacatgacacatggaaaactacatattagttcatagagtgcatttggaaaacatagatcagtctatgttatctacacaaaatcatcattagacaactctttttttacactgggggttttgccgttgcctgttgggaacagagacctcatccaacaggcaaaaataagcacattcaatatgcaaaaaatcagctagtatttctactgtgtacgtgtagaccggacatatagacataacatttgaaaattaaattaaatatttagttcataggttgtcatcagaaaaaatatagatcatgaatcaaaatcagaaacagaacctgctaggtcgacagaatattaaatagcacattctatgggcaaaggatcaacagacaattcattaattatttcaacaaaatcataaatcgatttgtgtttaatttgattacaaaattcacaccagacttgtggggttgcacttgttgagattatgggcatataatgatttaatttattccataaataaatcatgacattacagatgaaaactagcatgaacgcatcattagatctacacatgtaaactacgcagaataacatgaacagatcaaatatgcgcaacatattgaatacgtaccgaggtgacgaaaagaccggctgcttggtcgaaacttttcgcaggtgtctacgaaggcacgaaacacgcgagcgaagaggaaggcgagccgtcgcgaacgaacagggagcagccgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatcctgcgtgaagacggcgggtcggtttatatagagaagggtcgcttgatcagggcggatttttcggaacgtttccaaaacaaaaacgaatccgaatttgcagcaaaacaaaactgcaaaaggaggctgcatctgcacaagggtgaggagccaatttttcggaccattcgacgcgtacgtcgtgcacgcgcgccgcctgccctgccctgccctgccaggcgcgaggcgaggcgagcgagcgcgcgcgtgtgtttcccctcttctctccaccacacatgcttcaagtggctaggaggacatcttcccttttaaggaggtccccctctcctagaataagcaaggtcgtactaaactccacatgcatgccatcccatgaggtgggctttttgtgattttccaaagaattaatcttcgagtgggctaaggcccattcattaattccaacagcactcgttgggatgggcctttacatgcacaccttgtggtagcggagcatgcaattggcgaggatagtccggtaccacttaccttgctctgcatctgatctagtgggaggaaaccaaatcgagctgcagcttgagtgcagcttgagatcagagtaagaaagctacatgcctctattacagatgccatgatagagaggtggaagcgaacctttcttgtgaatcatgttgatacgtatctgagttcggatgagtcctgatcggcgtcatctccgatggaaacttaatcttgatagcgaaaaaataaaacagttccagctggtcatgtatgcagcagatcccttcgatggcagattccatctcgttctcgcttgctcccatgtgttccaatgatcccatctgatcaattaattcgcatagagataaaccatcgatggtgtgcttggagatagaccgatggttgtttaatttcccctgagtgctgcagtcagtagacattgaaaagggcccacatagttaaagaggcttttcagtttggcccaggacccacgatgtggaatccttttatcacgttgaaattgttttaatctacgcttctaattatacaactaatctaatagatggccagatctttctaataaatgtgagagctcctaaacagtgcccaattagtataggtatagatagatggtgtccaattagtatatagatggatagattgtcgttgttgttgtggagtcggcgctgctgggtcgcttgggtggctagctcggcaacgataacacctcttctacaatgtgggagctgttgtgtcgcttttgtgtttagtttggcgtcgacgtccatcgttgttagttgtgtagcgatgggttttagccggtttttctgtaattaaccatacggatgtatggttttcgtgcccgatttttcttataaactgggtcaattcttttcttctaattataatagtggaacaaagttccgccttaggtttaaaaaaaagatagatagatagatggatggatggatggatggatgtaaagaaggttttgtgatatgtactcaataaataaactttctactatggacaagtattggaaggtcaactttgctgtgttcgcatatgctggttcccaacccaaatagtacgcacggaaaacggagcaatccattagcacgtgattaattaattatttactattttttttttcaaaaatggattaatatgattttttaagcaactttcatatataaactttttttaaaaaacacacaatttaacagtttgaaaagagtggcacggaaaacgaaggggtgttaggaacttggagttccaaacgttaaataggatagaaaaatgtcggtatcgaaaagcatttgggctgatatttctctcgtttgtaatcaagctgcagtgtgttcctctcttattcccgatgttgggcttaattacagtccaactcttattccgtctgtgaacaaataaagcccacatgcccaatgtgagcaaggctggcctctttttctttcttctcctcagccttcagctcaatttgctgtatctggtagaactggctgagtcctccaaacttgaccaataaaggtaaatgaagccagtgatacacgaatgaaatttattacataaacttctaaaacgtttatttagttgtataaacgtgcgtagcgcatacgaataaagaccaaaatagcacaacatggcagattttgctgactttgatatttattaggatgccacgtatataaatacttgttcagcaatccatagtgtacgtctattgtacatataaatataaatatgtctataaaaggaaatataagggacacaaatacagaaaagataaaatagaaatcctacatatagttatttttcaatagaacatgcgtaatgccccttgtcagtatgcgtgtggcgtcctaatcaatgttcacctcagcaagattagccatgcatggtgaactattttgagcttgattcatacgcacaatgtacgtaagttcatgtagcagaacgagtgttttacaagtttttcttagattacacctacttataaggtggtgtaccaccaatataacttactcacactacttaaaaaggcaaataggtgtcgccactataggtgccagcacaccaaaaaccggcacctataatgccttcccctcccatgagtccatccccacgcaccacatattcaaaaaccggcacctttatctctaaataggtgccggtttttaaataaaactgcacctaaaacctgtgtccgagaaaggtgccggttctagacccaaaaccggcacctttaattttctccctcccacactagctgtcacaccctgaaaattcaaaatatataaattgttgtttaaatggaattaataaattgttgaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaagtcttcttttggctttgggccgaaagtcggcccaaaaccgctctcctctctcctcggcccaagtcggcccagtccgccgccgagcgcgcgcgcatccgaccgctgacaggtggggcccacctgtcagggtcgtcgtctacctccggccgccgccgcccgaaaccctagtttcgcgccgccgccgttcctttccaaattcggtcgatcctttccttctccggccgaattgatagaggggaaacaatctccgggatctcctctaccttttctcttttggaatcatcggctaattctttttggaaatcattggattcgagttcgaatcggattcgtctctttcctccgaaccctaaaccttccttctcgtcgccagcagccgtgggccttcgccgtcgcctccgagcccctttaaaaggttccccggtgtctcctctacccgccgcctctctcgccttcgcctctcgtcgccggaagagttctagcgccgtgcaacatagcgtcgccgtcgccgccgtcgctccagccgtgcgccgccgccgtctcggtcgtcgtcatcgcttgggaaggccaccgtcgtgatcgccaagtcgccgccgttctcgtccgctccttcgccgccgccgaagaccgccggagcaccgtcgccgccgtcaacccgaagtttgccgccgcttcctcctcgtcgccgtcgccgtccgttgatcttccgccgctcttttggtcaccggtgagttcgccgcgtcgcgctctacccgttggtgccttccgttcgcgccgccgtgagcctgagccaccgagccgccgccgccggtggtgatgtcatcgctgacgtcatcgtcatcctctcccgtgagccggtcgtggaccgatcgatctcggccgtccgttttggatcaagtcgatctcggccgtccgttcgcgtgaaccgccgccgtgcgcccggtccaccaaaaccctagcccgctgacgcaataaatccctttttccttttccaaaataattcattattgcgtcataattcaattaaaatcaatttaagtgttttaatccgatttaatcttcaaaaattcataactaattcatcttagctccgatttagttggttcaagtctctaaatttttctaaaattgagatctacatattaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttctactcaactattgcatttattttcgaatgtcattgggtggaattaacctattgtttgttatagccctttttgatcttgattactttattccttgataccttgggttattataatttgactagttgagctttatttatattggttcaactagatattaggtataatagcttagccctgcttagaaacattagctcactattgggataacttatgactcactattacttaatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttgtttataatggggtgattatgatccaggaaggtgcgctacggtggattgtgttatgcaaggggtattgtcacaactcctttccgaggtaccgtggtggtattgaggcacatggtgacatgatgtggggttgtgtcttgtgggtacagtggtacacctcttatcagagtaaaactgttcgaatagccgtgcccgcggttatgggcgggtctaacaatgtctttcatgattagtctcacccttctcaccacagtaaatgatgctataactggtaataatttgattagctcctggtttggaatggtatattcctggtttggagatagaactgtgcagccgggatggttgttcagaatggttgggcctatacaacagggtatgttgtatagcgttagattaatattgtttaattattacttaactgttttattaaattctgaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagatctacaatgaggctaatggtgtggaggattaggtgtagccttggtcaagctgcctgtggagtggagccgtctgcgccgtttatcttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacactagccgttggcaggccccacacataggtgcctgttttgagacaaaggtgtcggttctcaacccaaaaccggcacctttgtttcattagtgtttttcatgtccgacggtgggccctacacaaaggtgccggttcttggtattacaagtcaaaggtgccggttctcgatccaaaaccggcacctttaatattctccctcctgcactagccgttggtgggccccacacataggtgtcggttttttgtatgacaagacaaaggtgccggtttttggtctagaaccggcacctttcttctaatagcacttttcatgccctacacaaaggtgccggttgggaatagaaaggtgccggttttaggtctagaaccggcacctttgttccaatagtgcttttcataccccacacaaaggtgccggttttttgtctataatcggcacctttcttccaatagggcttttcatgccctacataaaggtgccggtttgggaagacaaagatgccggttttgggtctagaaccggcacctttgttccgacagcagtacttatactccatcccttgctactcgagctgattgagcaagaagagagtggcgcctctccttcttgcccaatcagctcgaggaggggaggaggttttgctctattttttttggtatttggttaaagattgaagcctaaaggtaaatattcattatttctccctccgtttaactcttcgttgttgatttgaattgtcgtgtgcgtatgcatgtaaaatacgatatgggtgttatttttagggataattctttttatcttttttgtgtctattgttggatgaaatgctaaatttgtgttaatgttttcttccacctacgtcatggccgttactcaaattaatggttgtcaaactatgttaaggccacgaaaatatccattgatagcttgatttatctcaaatttatgttaggggtgcccatcgattcacacccgctcattgaattgaattgccatgtggtaatacatgtaaaatgcactagtcattaatttgtatggatccataagtcattcgtagatctattctcgggtgctatgctaaatttgaattaatggttttttcaatctatgccatcatcgttaatgtttcacattagccaaatattttttcgcattgtcgaaaaatagaattttttttatcttttcgttagccatgactatctagttaaggtgacgtgggtgtgtgcaaaaacctcaattttatcgtagggtaaaatggtcattcctcgttgtttttactctaatgtgcttgtaaattatgaaatcttcattgtttttttccttcacggtatgtaataaacaataataatcataggtacgcattggatataatggatctagaatggataactacagcggatcgtgactctgtggagtatttcaggggagtaacggctctcgttgccgcggccaccagcacaaactcagtcgatgcactagaatatatttggtgtccatgccataattgcaagaaagacagacaacttccagctcagcgggtccattcacatctccttacaaagggttttatggacaacttccttggcgaggaggagcaaggggagggaagtgccggcaactgtcacgggcatgatgcagatgtcggctacaaggaggaggaccaaacatgtgtcgatcacggtgaaccaaatctagatcagatgctgcgcgacggggagagatttgacactgatgataaggaatatcacaagttcacaaccatggtgaaggactccaaaactccaatttacaatggatgtaaggcggagcacagcaagctccaagtggtcctatcgctgcttcacctgaaggcgagcaacggatggtccgataagagcttcactgagttgctagagctcttgaaagaaattcttcctacggacaatgtcttgccagaatcgacgtaccaagccaaaaaagttatatgcccccttggtcttgacatacagaaaattcacgcttgtctaaatgattgcattttgtatcgtggtgaatttgcatatttggagcaatgcccggtatgcaaggcttcccgctataagtgtggagacggggatgatgagggtggaaataagaaaagagtgcaggtgaaggtcgtttggtattttccaatcatcccccgtttggaacgtatgtatgcaaacaaaaagcatgccaagctgatgcgttggcaccacgaagagcgtaaaaaagatggaatgatacgacacccagctgatgggtctcagtggagaaagatagataggaagtaccaaaaagagttttctcacgacatcggaaatgtgaggattgcactaagcactgatggcatgaacccgtttggtaacatgagcagtcgtcatagcacatggccagtagctgttattatctacaatctcccttcctagatctatttgaagggtaagtacatcatgatgccacttctgattcaagggcctacacaacctggcaacgatatcgatgtgtacttcaagccgctggtagaggatcttcatacactatggacggaaggcatgcggatgtgggatgcgtacaagcgagaacacttcatatgtcgggctattttgttagggaaaataacagactacccagcacttggaaacacgtcgggccaaacggtgaagggcatgaaagcatgtgtaaggtgcatggcccaaacaggaggcaagtggctgaatcactgtcggaagaccatgtacatgcgccatcggaggttcctcaggcaggatcacccataccaccgaaataaaaatgcttttgatgggacggtagaaatggatggatgtccaattttcagaaccggaagtgagatcttggcggaggtaaaggatctcagagttgtattcggtaaagggagcggaagcacatgtgcatccacatcgagcggtgagacccctctattcaaaaagaagtctgtctcttgggatttgccctattgggaagacctggatattcgtcatgcaattgatgtgatgcacgtggagaagaatgtgtgcgaaggcgtgctcggggtatcgttgaacacacctggcaagatgaaagatgtcacatcctgatttttgtttcaggatttataaattatttaataaattattattagaagttatattaaatgatctttaatttacaagtgaagttaaatgtgggaaataaaatttcctaaatataaagcatggatggatttaatttttattaaattctccatgattaagtcaactctctgaaaatattctcggatctttcggagctcaattcctaaatgatacaaagaacagttcagtaattatttgatcattaatgatctaattataattgttaagtgcttttcttgtttaaactccttaaattataaattgttgtttaaaaggaattattagaaatgattttaaaagcttaaaagagaagatctaattttaatttgttaaatctcaatataaaattgggctagataaaattttgttaaatactttgcttaattctataattcctagatttttctgggatttatttgagctaaggaagtatttttaaatggaattgcatttcataaataatttaaattgaaaaagggttttaaaagtctcttttggccttgggccgaaagtcggcccaaaacctttttcctttctctctctcccccggcccaagtcggcccagtccgagccgcggttttcctttttttttcccgctgacaggtgggccccacctgtcagggtcgtcgtcttcgttgcgccgccgccgcccgaaaccctagcgcgagccgccgccgtctcctttccaaattcgccgcgtctttccttctccggtgaaatcaatagaggggaaacaatctccaggatctcctccaccttttctcttttggaatcgtcggttaaaatcgtggggaaattcgtggattcgagttcgattcggatcggcctctttcctccgaaccccgacctttccttctcgtcgccggcagccgtgggccttcgccgccgcctcctagcccctttaaaaggacccccgatctcttctctacccgccggcaccctcgccttcacctctcgtcgtccgtagcgccctagctccgtgtgccctagcgccgccgtcgccgccgtcgctccagccgtgcgccgccgccgttccggtcgtagtcgtcactcgggaaggccaccatcgggatcgccaagtagtcgccgtccccgtccgccccttcgccgccgccgaagatcgccggagcaccgtcgccgccgtcgacccgatctccgccgccgcttcttcctcgtcgccggcgccgtccgttgcttttccgccgttgttttggtcaccggtgagttcgccgcgtcgccctctacccgttggtgccctccgttcgcgtcgccgcgctgtcattcgccggcgagcatgcgcgtccgagccgcccgagtcgccgccggtgctgacgtcatcgctgccgtcatcgctgacgtcatcgttgccgttccccgtgagccggtcgtggaccgttcgatctcggcagtccgttttggatagggttgatctcggccgtccgttcccttgaaccgccgccgtgcccctggtccaccgcaaaccctagccgctgacgcaataatcctccttttccttttcaaaaataattcattattgcgtcataattcaattaaaatccatataagtgttttaatccgatttaatctttaaaaattcataactaattcatcttagctcagtttaatgtggttcaagatgcaaaagttgtataaaataaagatctacatattaaaattatccataaattgaattaaatttatttaattctttttaaatgggctttaaatagatttaatcttgtaaaattcataataaatttatttgaagtcagaatgaggccgttcaagtctcataattcatctaacattatgatctacatgtttatttacgttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttgtttcaactgtgcatttatttttgaatgtcactgggtggtgtgaatctattcctttgttatggcctgtttgcattgattactttattccttgataccttgggttattataacttgactagttgagctttatatattggttcagctagatattagatatgattgcttagccatgcttagaaacattagtacactattgggataacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagtgtgggcaacggctttacctttcgtatagcatggttcattgcagagcaccagactgagaagtggtagagataagcccacgggggtcgctggggagtccatgcctctggtttttgagggggtgattatgatccaggaaaggtgcactgtggtgggttgtgttatgcgaggggtaatgtcacagctcctttccgaggtaccgtgggggtactgaggcacatggtgacatgttgtggggctgtgtcttgtgggtacagtggtacacctttggccagagtaaaactatttcgaatagccgtgccccgcggatatgggcgggttgagcaatgtttttcgtaattagtctcacacctctcacaataattttggatgttatacctggtaataatttgcttagctcctggattggagattagatctgtacagccgggtatggttgttcaggatggttgggcctgtgcagcatgggtgtgctgttcagtgttgattaaaatctctaattaattactccactgttttacttctcttaaatgttttgctaaatgctgcttttgcaaatgagccaatattatgccatcctttggtatccttgtgcacttgcatatttgctgtgtggcttgctgagtatgtcatatgctcaccttgcaataatcaatcaacctcagttgaagaagaaggatccagaaggagaagacgtttggcttataccccagttgagctgcctgtgggagtggagccagagcttcgctagattttattttccgctgcagttttcttcatggtgaggactaagtgcctcttaagtaagtatatatcggtttagttattatgatggatttgtatattaaattgtcagtttgtgtacctcggctgattcctggatgaggattttatgcacaaataagttcggaaattactagtgaatttccgggcgtgacaaaagacactttgcaagtacggaaagatctcgaagacatgggcatcaggaaagagctgcatcctcatgacagaggaaatggccgctactacctacctccggcatgctacactcttagtgctgcagaaaaaacgagtatgttggaatgcctgcggggtgtcaaagtcccatccggttactgtgcgaacattaagagactagttagcatgaaagaaaaaaggttggttggaatgaagtcacatgactgccatgttcttatgacgcagctgctaccagtcgcaatcaggggtatccttctagaaaaggttcgagacccaatcatcaagttgtgccagttcttcaaagcgataaaccaaaaggttatcgatccggcttcattgg

SEQ ID NO: 74265 - DNA, 2050 bp, Oryza sativa
agagtttgtggaaattcagaaggttttgactgttggttccaacggtctgtcccctaagcaatcgaatgcaaaggttgtagacataatattggcaccaacagagggattatacagagcacggactaaattacctccaatgagacaagtaatggttgaggcagggcatcggatctgaatcgattcagatgagagctctccttcccttaaccattcgttactcatgatgatggtcaacttcttcaccgtctctttaagcatagctttatcgagaggatcattagagttgaccttggtcggtggtctcttctcacaggaataattcgaggtgttcccataatcttcgaaaagatcttcctcaaattggaatggaatttccagagaatgaatttcttcttcctccgactccacatgcagagattcctcatggataatcttgacctctgggacagcttcacttcggccgaagaaatcgttcactaagattagatctaagagttctcttccttcggcggttgtcttgtgtgcgaacgatcctctagtggaaatatcgagattttcggcagactccttgtctaacccataccgaaaattttgcaacaacacataatcaatgttgcaacaacacataatcaggtaaagacaagtcccggaaaactcatgattttgcggaacgaacgcacccaatccactttaatatgttgaaaactcatgttttagtgctatttgaactttttcgttccgacgaaaacatcgcacccacgtgtgccaatattgacattatatgacaaaatgtcgctgagcgggtcacagagatatttttcaaaaagaatgcgcccaatccattctaatatgtcaaaaactcatgtttttatgctttttgaactttttcattctgttaacagtgaaatttgataagccccgaagtcatcatcggcttagagttagtattggtttcagagtcctggaatcggccgatgggcattatcagtcgccatttgtcagattcttgatgggttcagttaaggaaattaatctattcaaagaagcttatctagaagagaccaagtttaagaaggatgcggcatggctagttatctattaattagcaatagtctcttagtttccttttatctttaggaaagtttgtttagtgtccaataaggactttatgtttccgttttatctataggaaagttctttcgtatcctacaaggactagtatctacccatgggtataaatatgtacacccggggtcattgtaaactatctccacgatcaatacaaattcgacgcatcgtcaccctttttaattttctactttttcgacgagtttatacttgtcatggctgtttgcattggcggggcttagggcttccacactctgatcttgtcaatgtaaacacctatctatgatatatcttagttaatctactttggtagttcaatttacttgtatcggctgagattcattttagggtttttgtcggtatctactacattgctttaccagattagattagctatggtatccaccatcctgaaaatcagttaaaggcttcattgtctacatattatgtttcttttcatactttacgctgcatcagccctagtcatgcttagaaccataacctctagcctactttttgattgccaataagggtttcatcggggtttcggccgatgagttatctagacgttacatcggcttataaggattatatacaagttggatttagcctatcacaacaaaggtttcactgtttatcaaatattgtggatttaatgacatcggacctccagccgatgtatgctttaaccttcagataagtgctaactctatcatatagttagccgattggtttctacttgattatattgttgttttgttacattaccatcaaccaacgttatttacatcaagtatcagaatctacattggacatatagctgataggtcaaaaccctatcgacatcggctggaactactccatcggtttgtcaaccgatcggctctttgatctgctatttgtatatcttgtccgtagcagg

SEQ ID NO: 74266 - DNA, 11805 bp, Oryza sativa
aactctagtacattttttgagagagctctacccaactccactcctagttttggtggagctgaaactgtttggctgagctccagctccaggagaggtggagttgaagctggagttgtgccaaacaggccctaactattttctaggacatggttggctgcagcttcagttcattctctggcaacatcctgttggttgcaggctgccgctggtactctttgatccccgcaagctggcactgctaattaacccccaacggccactgtcattgctaacaacatggcctctaggcgctagtctaaaattcgttgggtgggtgagctagactgggttcccctattaaaataaaatccccaactggcataatctgtataaaatcccaaatacacagtcagaataatacgcaggcagcagcagctgaaccaagcggcaagcgcacatgagccgaaccagcaataggagccgaggagaacccctcccacgtaccttgagcagcaccatggaagcccggtagtcgcagctctgctcctgtcgtcacgccagatcgcaggtggagttcatggcagcgatggatccacggctccgatggtggcggttgcaggcggagtagggaaccggtggcggcgaggaattgaggaggcagcggggaaggcgcgacggtggtgaagcgcgaacgcgcgcgaggggaacccgcagagggggaaagcgcggcggtagtgaggcacggatgcggggggaagggcgccggtgggatgcgtagacacggggtggggaacgcccaacggcggtggggaggcacggtcaggggtggaggcggggaggagtgcgcccggcggtttggggataggacggggaagagcgctaatccaatcgctattttgctgtaaccgctgtttactcgaggtatgagattggtgggagatcgctaattgcagaggtgatccaacttttgatataagccattggatgaatagatctaagggtaaaaaaaaagtaggtatttgatgaactcgtactttttatagtagtatagatgagtcataacccacaccgcttggtttttgcaccaatcagtgatgcaattacgaaatgacagtaatgcttcgttcggttgatcatattaaagaaaagattagggagatttagaggagaataatttcacatctattaatgagtggaattaatcccctgtaacctcgatctaataggaaataaccgaacaaagagaaataaaagagacatgtaggctaatatttttatttaacctttcacataattttttttctattaatccaaaaatgaatgttatttaatcagcactatgtctagtaaccaatatacacaatttgagagaatctaagattgacttgggaacatttctggattgatgccaaaatatgccataccaattatttggcaacttaaatagtatgcgattggtttggattagagccagagcattgctaatgcccatactttatttggcaatattctagaacttccttcactgatatcaaacacatgaatagcaaaccaaatatatatactactagaaaatttatgctcctgttggcgcgcctactgattaacccgtacatgcgaaatatgtagcgatatagcctcttaatagtattttaatttccgttatttttaatccaaacggatagtatgtcatgatcaagctttaagataaggtgtggcttggttagcagttggagtagcacacagtggtaaagctcgagaagctttaccattgcacgtcatcgttgataggaccgatcatttttcaaatgatttcatgatgtgccaatagtaccttgctatgtatttaatttattttgcattaacatttgattttgatgctactccatttttattttttaagatagttttttttacttgatttagttctctatacttttgtagtgctaatattttacggatatataaaagtggcatttgtttactttgatgtcaaattctgtagcatgagatgaggacattggtatatacttgaaatgttccttagggtagtaacctcttgttacatagttgcataatagatttattggtaattttttaattgcttggaattgtgtcatcctttatacaatttttttggaattttaattttgtgtactaaaagtcacatttagatctatcatatgacacgtataagttaatagtacattggctcataataatgaagagaggaaaaaaaatcctctcaaaaaacaagagaaaaaaaaaagaaaagacaaacaaccaaagaggcctagtcctacccctctcccactggctggcacagctgagctgcagcccagccactggcgggacggcccaactcgagcgaaaaagctaattggcgactggacatgtgtcgcgcgcgggggtggggcggcggacggcgcccgcgagagaggttttttatttcggtctctgttttgtttttttttctgtttcttccttttttttgggttctatttctgttttggttttttcggttttttttctctttctttttctgctttttttaagatgtacgtatgcaaagtttatattcgtatatataccaaattttgtatttgtacgcatataaagtttgtattcgtgttattttctctcggtatatatataggtggtttgtatacacgtatgcaaaaattgtatacatgtatactttttatatgtcaatttttggtacacataaaaattatatatacgtatgtatatactttatatacgtatgtataaattttgtattgtatatgtcgacgtttgatgttgcaattccggtatttgtataggatggagatcgttggtactaggatatatacgagagtgaggtaaaagagacggagacatgatttttatacaggttaggaccccttaattggcaggtaataaccctacatcctgttgaccgaagccggtcgttgctcttattcatcataatcacaccagtacaatatttggggtagcctatctaactgttgtcgacatgacggtctgaacgtctgactcgtagtcgacaacagggtagccttcctcctcgagttcgtgcccggcaagatcagagacaacgctatgtctctcctgacagtatccggagacatcgtaggggactagccgtgcttatccctgatgtcgatatccggcggcttatcttggcgtatgttggcttgtatgttgtggcctctattgttccatgtatgttgattgtctcttctatggtgggtgtgtgttgatcgtctcccctctcctcctagggggccttgtatttatacccataagtgtcctcttgtccaagtagaactagggaaaccaatatggatacaatccaagtagtccttgtcgtttccatgtagaactctggttgtctttccttatccggaactcctcctatatccgcgggttgtttccgtataagacatggtatgtggtgggtcctgccgagatttagtcaactactattaggtatgtggtatccataaccctgacagtagtccccgacttcaatgcaaatgaacgagttcatattctcaaccgcaaaccttagaggaactgttatcgagctcacgtgaccgttctcggtgagttcagagataacgttaaacttcctttatcagcctcgtgtgggcacctaaagggtttgtctgagtcaatcatcaaagtcaaccaagaaagtacagagcatatgactaagttacccgtcttgctgtaatcgagaatttggattgaagtcaagaaattttatctcgacaggtacaccatctcttcattccgtattccttgtcgagatccaccaaccgttcttgagtaatcgagtaggcgtagagtctgcgacggagccttgtcaacatttgtcgtactcgcctttgtcgatcttggtgtagaaccatagagacatggagtcttcaacgatgtcgaatagagttttcctgaaatcaatacttagaaaagaatattagatagaaatagcccccgagtgaacgctcaaagggtgacatgttataatatgtatggaaaactaaaaatgaattaaatttacataccaatgttttgtatatgagcgtctactcttttaccaacttcgatcagtcaatttgtttgagttatacactctccctagcccccagccttgtcgtcggagaatcgttctcgggaaataaggctcttagacctttgacctgcatcggttgaataagcacttatcctagcccccagccgtgaagttggaaaacccaatttccgattacacggcttggttaatacgcacggtgagaactcttacacgaccagatcttacatggtcttttgtctctacaggatccgacaaggccttatccgctctgggcgtccctagccgaagttcccttaggttcctcggaggccttgtcaagacggtgtaaaaggacattaggataggtttcaatgctaggtgtttttgtggtaagggatctctgggtaaaacgcttggcgatattgtgtacctgaggtcaacttttgttgaagtagaggtaatgggagaatcgctacacctctagtcaagaaccaggtagtagtcgtaactcaacgactagaagtaaatgtacgagagatcactacgattgaatggttaagaaccagtgagtaggtgtctctcgatcatttgaagtcgtggtgcgaggaccgctgcgttattgctgtagtcgtacctcgaccatctgaggttgcggtgcgagggattgctacgtactggtttgaggaccagcgaacgtgtagaatcatctctcgaacaccaatggaggttgcggtgcgagagattgctacgtactggtttggggaccagcgaacaagtagaattatttctcgaacaccaatggaagttgcggtgcgagagattgctacgtactggttcgaggaccagtgaacgtgtagaattatctttcgaacaccaatggaggtgctagagttggtttattacatgtgcgtctcatgtggccagcatgactcacgcacccaacttatagcatatccggatgtccattcgcaatcatgtcgggtgatcaagccgacggtgttcgcgaggaattatccgttaacaatcttttctcgagtagtccagccatggccgatgctatgaggtaggtcgtcggtcttcgttggtaggttgggcgcgacgactctgcatttgtcgagatcgttctcgataatgcggtgtactcgacgacaacctactcgggtgctcaattgttcctgaagaatattttctagaaggcaagacatatagcagagaatatcgagtatgtactcaacaaactgcatggatcttctagcattatcaggatataacgagcagatataaatatcaggcattatgtagaccataaacaagcatgatttatacagaagaaaatagagcgagcccccagcgttagaccgtagtcaatttaacatcggggacacccgcgcaacaaatattgtataaaaaacatgctctaggtaaacataataaattattgatctgacaacatctgaaaataggtacggtaaattgtgtataaaatattgcgtacctttatagatacatgccggatgtatctacgggattagtagattaatttaaaaaatcaatctactatataccttgatttgcatgcccgacatactatcaatagaagatataagtatgcatgcagtagacctggacgtcaatatcttgctgtcttggaagagcaatgccacctgtcgcatgcatacatgtgtctaggcatgtgtacgtggcatggttaggcaagcacgcttggttgaccaattccggctagcacacggcaagttggcgacgcagtggcgcctattctcggagaatttcgcgcggcatgcatcgaggtatattggttggtgggaatcggcgtcgtgtccggcctgtgcgcagccagccaataactcacaccaattgatgtcgtgcacgaggaggaattgatattggatcggttttggaagctgccgatactgaagattctccacggtggcgatgacttgatgaagcttggtcgatctcgccggatcgaatattcgacgacgatggttccgatcttgttggacgacatactccggtcgggttagatctccccataaccgaagttgtcaagtagcttgttgttggagaatccatctcttaaacccatctcgtcgaaaccctgaagcaccaaatccccctacctagcgcgccattgttgacgtttgatgtcgcgattctggtatttgcatagtatggggatcgttggtactaggatatatgcgagactgaggtaaaagagacggagacaggatttttatacaggttcggacccctgaattgtcaggtaataaccctacatcctgttggccaaagccagtcgttgctcttattcatcataatcataccagtacaatatttggggtagcctatctaactgttgtcgacatggcggtctgaaggtctgactcgtagtcgacaatagggtagccttcctcctcgagttcgtgcccggcgagatcagagacaacgctatgtctctcctgacagtatccggagacaccgtaagggactagccgtgcttatccctgatgtcgatatctggcggcttgtcttggcgtatgttgacttgtatgttgtggcctctgttgttccgtgtatgttgattgtctcttctatggtgggtgtgtgttgattgtctgtctcccctctcctcctagggggccttgtatttatacccataagtgtccccttgtccaagtagaactagggaaaccaatatggatacaatccgagtagtccttgtcgtttccatatagaaatctggttgtatttccttatccggaactcctcctacatccgtaggttgtttccgtataggacatggtatgtggtaggtcctgccgagatttagtcaactactattagatatgtggtatccataaccctgaaacgtagtagtattgtcgtagtagtattgctgttgctactactacagtagtagcggcgcgcaacagtggtagtagcagtagtaggagtaggagtagtggtagagcagtagttgcaggaggagtggactggtcacgcgcccacgctcccgtgcaaatcactcattaggggcaccccaactcgagttgtgctactactacgaagccacgaaggggagtggagggcctaggactacacccgtcatctaatgtatagtgcgccgtgctgcgtaaatttgcatgaaaacccgtcggctctagaatatcagattactctacctaccaaagaattatttcctccctcctataatataagacgcgcccgtatttcaagattcaacgtgtaaaacatttgacccatacatagtataatatggaatgaattttatttattaaaaattatatcattggattgatatttaaatttacttgtatatggctataattttgttgctacaaaccttataatatataagatattatgaactaaagattagttttgtagaccattttaactttaaccgcgccttatagagggaacagcattagtagtgcgaaaattcgcgtagattttgacacctggtttggtttgtgacctaaattggccttaccaatttttgtcgatgccaaattttggctaggcaaagttgtgtttggattgaagccaaaatagcccaagttaattattgaaatggcctattttcttaggcatgtcaaaatttggtttcaaaccaaatagacactacacactgttaaaacgaatttgctatatatttgtcgacaaattttcctccaaaaatttgtcagatgtaattacagtacaatcgtagtgtaattacactgtaacttgcatgcaattacactgtaactataatgaaatttgtatgtaactttcaagaatctctcggtaacatgttatttcagtaaaatagaggttgtgggaacttctttcacatatgtgtgtgctgtgatttttttctttctcaccagaacaaatcttgcaatagatctaacgattcaaaattacgtgaaacttacatacaagttacactgtagttacatgcaagttacagtgtaattacatacaagtttcagtgtaattacactacgattgtactataattacatctgtcaaatttttagtagaaaatttatcaacaaatgtataggtggtcccctattaaaattgccaaatactggtaaggccaatttaggcctcaaaccaaaaccggcccatagtgtctcagaagcatatggaacggagccacgtaggagctggctactgggcccgtgggctgtggctggcccggcccgctccgttccagtgagccggggcccggagggaagaagagagcaaccagagcagcgcgtgtcgagcggcggcgactcggttagcggatggccgccttgccgcaggctgctgccggcgtcccggcgagccgtcgtgtcggcgaccggaggtgggacacgcgctgcggcgccggggaggccccgcatgggtgcgcggaggcgtggggggcagcgcctggtgccgcacctggagcaggcggcagccgacggggtggcgtgggggcggcgcggcggaggcgcactgcccaccacagaaagacggcagccgagccggcagagccactcctgcaccatcaatcgaacatgcagggtacgtggattttttttcctccaatttttttcccatattcatttgtactgtcaaattgcttggtgaggagttcatttcagctttcagattcgctctgcgacagtgtaacatgtttagggttcctttggagtaattcctatataagtcatttggtttataggattgctttaaaggaaatttactacataggataggaaagtttcctccacttcttggaggaattttagcatcaggtctaacctctagtttcaaattcctttgagattttcaattcattttatctccaacaaatcaatatataatcttaaatctcctatggttttcctatgatacatccaaacacatgttttaaacgattcctgtagtattacttcctgtatgattcaccatcgtgtgacatctcaatccttgtgttttttatattcctgtattctcctgtgacttttgttgagaatgccttggaaggctgaaacgataggtggtactacgtgttgtttaaactgtgctgataggtagaccacaaattagaacttaagaattgatgtttgccagcagcctagcaccctagtcggaacttggaagggaccagaataatgaaatgatttgttggtcattaatagacagtttcttttgattgacagcggaaattactcgatattgttcttcaaattattagtggtatgaaccttttgagtgattgacaggaaacaaatccaccactatctgttaaagatgagagccaaaagtctgcagttggcctgacgatattgttctgttcatagtcagtcgcgtcttcttgtattggttttgttttaccctgattgcgtgaagtgaaactattattcaggttcgctcaagtcaataagattttcacatttctctttttaaaaagggataagattcagacaatcatttctgcaagtgcatattgttctgctgctccttttgcagattataattgtcgacgctatttgtgatcccgtgcatgcactttggcactcgtccatgcctcattttttccccttccgcagccactgcagatggttggtgatcataggttattcaacactcaagtcctgaacttcccttttccttaattgacaataccagggttggtgccgatattggcttttacctaatttaagtatctccgccatgtgtggcagggatttctcttggttaggattaacctaattaaccatccggcatgatccatgcatggcacagcttgtgggtctcctatttttggggttgatcttcctccttcctccccttggtattagaggacatcatctccctgtcccctctttgccctgccatttccttctccttcctcctgcagcagctgtcgtaagtcgtggcacgacagctgctgcgatatctatcgcaccaggaaggatccttccgaggaggaaaggcaaacggcgggacgcttgagccaacacacaccattgacaaaaacattaattagatcgtgatagaggaatataacaatcacagaagccatggcaagcagcggcaaggagcaccggcgaggtgttccacgcccaccgccgttgtcgctctacatcgagagggagcaaggtgaggtcatcatggctggtcaggcgctggcgacgacgaggatgctccagcaggtcgccaccagcagcagtggcaagaagaggatactgtccaagcagctgtccatgaaggagacaacccgggaggtcaagtgggagaagcggcgcaggcagatacaccggcagaggagcagcatggcccttcaggatgttgaggaagaagcgagtgccaacatgttcgccgccaccactgacagcgaaatgggctccagcaccgagcgggtgcccaagaggctgaccgatggagacctcgatgagctgaggggatccatggagcttggctttggattcgacgaggagaatggtgggcagaacctctgtgacacgctccctgccctcgacctctacttcgccgtcaaccggcagctctcggagcccaagatgcgtttgtccactagctccttgccatcaccgacatcagcgacgtcgtcctcctctaccctcggtggcacatcgaacccgggtagccccgtcgcaccttcttctttcatggactcgtggaagatttgcagtccaggtaaagaaaaaaaagaacaatatttatcccctttctcttggaatattgattctatttgtgttaatttatgtcactgtttttgtctgctaagatgatgtgaaattgtgatgcatgcaacttaacaggtgacaaccctcagcttgtgaagacaaggcttaggcactgggctcaagtagtggcctgttcagtgaaacactccagctgatcagtgctgtaacaaccatattctcctcccaaaagccattaacaatacaatgtttatatatatatatatatatatatatatatatatatatatatatatatatatatatgcatatccctgcatgcattggttagatggcgaaggatgagaaaattaaacttcgatggtataaactgaacgtaaccttttttccctctgatgatgacgcccatggttgtgtttgtatatatacagattttagtatacaaatatgtatgtgttggcaaacattaatgttctacatattgcatatatgtgtcctggttttgcaagaatatttttcatgccaattaatctctggccgatctctaattgatacaaatacagccttcactaacataacatgttggttgatttcagtaaaaccatatggaacagaactacagttacagaaacagaaaccagagactatcttagttgtaccagagtcacaaatgattctatgaggacttcatagaggtagagtgtgcgtgtgtattcataggaatgagtgtgagcgcattgtgagcgcctgtgtttgtattttacttataaaaaaaattgctccaaaatgcatatacattttatgttaatatacttggtgagctttgccacaagagcacttaagcatcactttttttcctgggttccttggtgaatttcagacctagttaaaaaaaaatctctctctctgatcccacataaaaacatgtgttaagattcgacctatatagggtgagtcctcgtgttggaagcaagggcctcaaagtaacggttaagaattgatccataggtggtg

SEQ ID NO: 74267 - DNA, 5875 bp, Oryza sativa
ctaaaaaacaccatgaatgttcaaaagcttgatagtttctggtttgttttgtgcacaatacgtctggtcctagacaactcatagttttattgtgggtatgtggtttagtggcacatatgtcctaaactcctaatggtctagtcacctaactttaagttgaaattatctggcattagagttgcagggagccaggaaatcactggcagagcccttgctcccaggagaaaaatctcacaagtcatatggctcattagctgtttcaggctacaacattctttgtgtttatcatttgtttgttactagatcaattattaatgttgtttggggaatctatcctccagttgtagcttctgaatctgtttgtgttcaatcaggttggtggctggactcaagggtacaagggactcaacttcgtgactgtgaggggcgcaggtcatgaggttcctctgcataggcccaaacaggctctaattctcatcaaatcattcttggctgggagcccaatgcccagtgttcaagatttttacagtgatgtgtaacatattttggctacaattatatattaccaagatcacaaaaggtaactcagacggggttgctagtatcacatggaactcgtaccatatattggtaacaattcttccctaaataaaatagggaacaaaatcatgaaatagttttcgtgccacgaatcgacactgtctgttgatattgatatgaacctaagacaaaagtattaatcaagggtgaacgttcacattgttgtcgtacaggatgtgtataacattgttgtgtataacaaaactattaatcaagggtgaatgttcacattgttgtcgacaggatgtgtgtacagcatacatttttatttccttttccgtaagatgtggctgaatgctaatgttatgtccagttttatttttcatcttcctttaatccgtatgaacaaatctttatgctcctgctacctgtctatacttgttcaatatagttctctatgagtacaaatgattgctatagtgttattctgtcatatgtcatctgtattcatagttacaaatcatactagttattgccatctttaaaatctgtgtccttactaatactttgcagatgaacacctctatatttttgcagccatttccagaaaacctgtaggagatagtccatcacacaaggtttgcataccttatccttctatatgtgcttgttcatgtcatttttttttcaggttttagtgttaccacttaatgaaacatgcatcatcctccactaaaaaagaaagccaagccacattcttgcccttttatctttcaggaagcctccttttttgttcttttacttgtcgtctgctattagttgcgccttttggaaaggctttttcgattggtgatgtctttccaaccaagattttcactttgaaggatggagttattgtagcacgaagcattagttttgtgcactatgtttgatatccaccctgatgaacctatgttaagccatgaaattttattttagcttgatcagcagtatactttagaatggctaggttgtacatttgatacttttcccttttcatgtctgatagtgttatgataatatgaatatgtgcaagctgaaatgtactgtcaataacatgaccgaagcatgcaaccagcaacctaagtaattttgttttctatagaagttttataattaaactttgataggatcataggacacatgcttgaaccacatttagctatgtcgattgtccattaaggccataatcactatgccgtaattaacttatgcttgcctttttctgctgtcttagatatttccaatgcctgttgctatcaagtatttggcatgcatgtttgacctttagatctccatgaccaattcaccttccactcaaataacctttttacttctggcttatgtaaaaatgtaaataacatttcaagttgtccagtcaatgcccaatccttaactttcatcaagtgtgggtgcgtgggcacacctatgttgtttagtactactcgatctgttttgacatcctgtaaaactttaggctttgaaaaattcagtgtggacacacaacacatcgcctagtcaatgccctcgcatgaactttcatcggtgtggatgtggggcacaacctacagtacatactacctccgtttttaatacacgacaccccgttagctttctgacaaacgtttgaccattcgtcttattcaaaacttttatgcaaatatatataaaaaattatgcttaaagaacatttaatgataaatcaagtcacaataaaataataaacgataaatgataattacataattttttttgaatatgatgaataatcaaacgtatcttaaaaaaccaacaatgtcatacattaaaaacagagaatgtcataaaatactcttacatgttttgacattccaaaaaaacttaactttgggtgtgtttagttccttaaaaaaattagaagtttgaaaaaagttggaagtttgaaaaaaatgttgtgtataggaaagtttttttttatgtgatggaaagttagaaatagggaaaaactaaacacggcctttgtgcggattttatttaatatagacacaaccatattacacaagggtgttagttgggcaagtagagttctgtttggcttaactccaacattgacaactactcgattggcgagacggttgacacgtgtgccgaaacctcttctcacacgtgacgtgacacagctagctttgtcaccctttgccgatttgtcgcaagtagcctttctttggagagatcacgtcacaccacttactaccatcacagctgctgcttctcccactgtatgtgacctgtaactctttcggcttctatgatatgatattgttaagtaatcaatcaagcaatcaagcaccttctccgcttgtccctctcgttactcgcatgtcactatcaccgagcacaagaacatcaatcgacaagcctccccaaccccaccatcacacccgttgcgatccttcgcaacgggtcgccacatcacaccgcacacgcgcacacacgcagcaatacagtaggagaggtggggattctccgtgtacgaacagagtacaacttgggtagcgtttaggaattgttgttttataattgttgggtcactaattaaacgcatgcgtgttatataggggcttaaatctccctggcctgctgcctaaacgatgtgatcacgaggactccactggtcaatgatcacgcgtgcgtgcagagttttacttagtagaacagcgtgtgcctttggtgatatatatatatccttaggtcgacatctggtttgcgaaatactgtatgatgtttccgattgcaaaagtagaaatgatatctcactaattagagagagatcaggacactatccttatctctctagatgctcctttttcttacatgccatctaaatagttatgtcttttaaaaaaagatagattaatatatattgtatcatttcaccaatgcaaattcaaatttaacttctataagtttaaaaaacaaatatgaccaccactatagtttaatttgttaagtcgttctttttgttgcaactcgaagagaagtcaagtagtgatgtttgaatgttagatgacgctacagatgctagaaaatgggggcaatgtgtggtgtctcatttgagaagatgcttttactttgttgaatagtgtgtgcttactgttaggtcgattgctggtttgtgaaactactgtacgatgtttcacattgcaaaggtaaaaataaatatatctagggggattaaccattggtctcgtagttagatagtgtcagagaataagggtgacggtggtggtggctgatttcatagaaggtgctgttgaagtgagatggcatagaggttgtgcattggtggtggtggttgtttttttttttttttgggcgggggaggaggggatataaggcccgtttagttggcaaaaaaaaattgttttggggtgtcatatcgaatatacggacacacatttgaagtattaaacgttgtctaataacaaaataaattatagattctgtctgaaaactacgagatgaatttattaggcctaattaatctgttattagcaaatgtttattgtagcaccacattgtcaaatcatgacgcaattagacttgaaatatttgtctcgcaatttacatgcaatctgtgtaattggttttttttgtctacatttaatactccattccatctatgtgtccaaacatttgatgtgatagggtggaaatttttgttttgagaactacacagagcctgaataggagaatgtaatccgacaactacatggatctcaaaataattacaatcatctcaagataactaagagttaacccaaaaaagaataattagcacataaaaaatcttttatttgagaaatcatgtcagtccaaaggtaggaacacatgtaccaaagaaattaacaataacagtttgatataaataagttcacggaattcctatatttcttttaacagattgtcttaagaaaatctgtcagattttggatcctgattggatctaagatttgtgcatgaggtggaaaaaaaaaagcacacatgactacgggagtcaaatcctattccctagaccgaggtcccgtcacgctaccaccgtaaggcatattttttattagttacacaccatttatatgcaagtaatattgtaacttacaatacattacacaataattatacatttgctgtatttgacatattttaaggggattttctgtcaaatgttatatagacagttccgtacgtttacatgtttttcatttccctcaaacaagcaacataaaaaaaaaaaactccagcgaagtaagctcaatacaatttggaccataattccatgataaacaaaactagcccaggtttgacacctaaatggcagctgcatatgagatcaatcaccaacccatgtacatgtacacatgtccaacactacaaccccttatccagattgcaaagtcaaacatttggcgccaaattgaaaatccctttctacagcagttaggcctcccgcctttttttcttgcttcctcctctccagcttctacctcccctctccttcttcttcctctataaaaaccatggcattgtagcacacgttgctatcaaatgatcacctcacccacctccacgccaccgccctttcggcctcaatggccaacttgctcctcatcccaatcatcatctgctacctcgtgccgatcgctgtcgccgtcgacgcaccaccaccagtaatggcggccgccgctgtcgccgacgactggtctgcgctgctcgctttcttgtccaatgtgtcggccgattccggtggtgtcgctctcgccgactggggacgctcgccggagttctgcaactggacgggcgtggtgtgcggcggcggcgagcggcggcgggtcacgcagctggtgctcgccgggcgtgggctccgcggcgtggtgtcgccggcgctggggcggctggagttcgtcacggttcttgatctctcgaacaatggtttctccggcgagataccggcggagctcgcgtcgctgtcgaggctgacgcagctgagcctgacgggcaaccgcctcgagggcgccatccccgccggcatcgggctgctccggcggctctacttcctcgacctcagcggcaaccgcctctccggcggcatcccggcgacgctgttctgcaactgcaccgcgctgcagtacgtcgacctcgccaacaactccctcgccggcgacatcccgtactccggcgagtgccgcctccccagcctccgctacctcctcctctggtcgaacgacctctccggcctgatcccgccggcgctgtcgaa

SEQ ID NO: 74268 - DNA, 2910 bp, Oryza sativa
tggcattaattgacaaaagtttggcgcgcgagtcacgaagtgattttttttccaggaacgcacccaatacactgcaatatgtccaaaaatcatgatttggtgttttttttgaacttttttttgaagtgaaaaacatcgcacccacgtgttccaatgtatgccaatatggtcattaattgacaaaagttcgccgcgcgaatcagggagtaattttttgccatgaacgcacccaatatactccaatatgtccaaaaatcatgttttggtgctttctaaactttttcataccggtgaaaaacatctcacccatgcgagtcacggagtgattttttgacacggacatacccaatacactccagtatatccaaatagcatgtcttgatgctttttgaacctttttaattaatctccaatatgtccaaatatgatgttttagttgtttttgaactttttcattccggtcaaaaacatagcacccacgtgtgctaatattggcattaattaacaaaagttcgccgcccaagtcacgaagtgaattcttgcaacgaacgcacccaatacactccaatatgtcaaacaatcttgttttcgtgctttttgaactttttcattccggttaaaaacattgcacccacgtgtgccaatattgacattaattgacaaaagttcgccgcgcgaatcacgaagtgatttttttgccacgaacgcacccaataatctccaatatgtccaaaaatcatgttttggtgctttttgaactttttcattccagtcaaaaacatcgcacccacgtgtgccattattggcattaattgacaaaagttcgccgcgcgagtcacgaagtgatttttttccacgaacgcacccaatacactgcaatatgtccaaaaatcatgttttggtgttttttgaacttttgcattttggtgaaaaacatcgcacccacgtgtgccaatatatgccaatattggcattaattgacaacagttcgccgcgcgaatcacgacatgatttttttcaacaaacgcacccaatacactccaatatgtccaaaactactgttttggtcctttttgaacttttttgttccggtgagaaacattgcacccacgtacgccaatattggcattaaatgacaaaagttcgtcgtgcgaatcacggagagatttttttttaatgatcgcacctaatccactccaatatgtccaaaactaatgttttggtactttttgttccgttaaaaacatccctcccacgtgtgcaaataacggccaacattagaattaaatgacaaaagttcgccagtatgtcacggagagattttttcgtaacgaacgcagccaatatatttactccaagatgtcaaaaagtgttgttccggtgaaaaacatcgcatccacgtgtgggaatatcggtctatattcgcattaattgacaaaagttcgccgcgcgagtcacagagtgatttttagccacggactcatccaataaactccaatatgtccaaatagcatgtttaggtgctttttgaactttttcattccggtgtaaaacaacgcacccacgtgtgccaatatcggcatttatagacaagttcgtcgagcgagttacgaagtgatattttgccacggatgcacaaaatacactctaatatgtccaaatagcatgttttggtgcttcttgaactttttcactccgatgaaaaaaatcgcacccacgtgtgccaatataggcattaattgacaaaagttcgttgtgcgagtcacggagtgatttttcgtcacggacgaatccaatacacaccaatatgtccaaaaatcatgttttggtgccttttgaactttttcattacagtgaaaacatcgcacccacgtatgccaatatcgacattaattgacaaaagttcgctgcgagtcacggagtgagtttcagccacggacggatccaatacactcgaatatgtgcaaatagcatgttttggtacctttttaactttttcattcgcgtgtaacagcgcacccatgtgtgccaatatcgacattaactgacaaaagtttgctgcacgagtcactgagttatttttggccacagacgcacacaatacactttaatatgtccaaaaatcttattttgctgctttttgaacttttttattccggtgaaaaacatggcacccacgtgtgccaatatatgccaatattggtattaactgacaagttcgccgcgcgaatcacgaagttatttttttccacgaacgcacccaatacactccaatatgtccaaaaatcatgatttgttgttttttttgaactttttctttgaagtgaaaaacatcgcacccacgtgttccaatgtatgccaatatggtcattaattgacaaaagttcgccgcgcgaatcagggattaattttttgccatgaacgcacccaatacactccaatatgtccaaaaatcatgttttggtgctttccgaactttttcataccggtgaaaaacatctcacccatgcgagtcacggagtgattttttgacacggacgtacccaatacactccagtatatccaaatagcatgtcttgatgctttttgaattttgaacctttttcattaatctccaatatgtccaaatatgatgttttagttgtttttgaactttttcattctggtcaaaaacatagcacccacgtgtgccaacaatattggcattaattaacaaaagttcgccgcccaagtcacgaagtgaattcttgcaacgaacgcacccaatacactacaatatgtcaaacaatcttgttttcgtgctttttgaactttttcattccggttaaaaacattgcacccacgtgtgccaatattgacattaattgacaaaagttcgccgcgcgaatcacgaagtgatttttttgccac

SEQ ID NO: 74269 - DNA, 4615 bp, Oryza sativa
ggattttttgggttttgtttagataaaagtttagcttcgctacttttccgtgtaatcccgtgatcggttagatcgctggtttgctcgttacggaaccccaaacctatcatttgtattcaattcctatctgcaattcagattgcttttatcttgttctttcttgtttcttcgatttgcttgcaggaataaggttgatctgcaccggcaagatcaataacccatggagaggtgtatcgatcgctaaggcacaacacaacaacgtctagtacggttgtagtcgggtcgtcaacgttgctccctaattgtagttatcttcaactcatcgaaagatcgggccaacaacagccttgagtgtctcgagtggaactcagggttcatcatatttatactaagtgctctagtactaggactctagatagagaaggaagttcctgcgcaagtattagagtagtaattaataacttagacgtggtgtctaggttagagattacctttgtttgttgtgtatcccacggagttagaggtaggtggcagatggtgttagccctgagtcccgtcctagtaatcctccatgttcagatacatcatagagctatagccagaaccacgctggcagaccagcaggggtcgatgcccgaagcaacaaataggaaattacctttgtttagcatagataattaaaaacacatagaaagtcctctctagcctagcctgcctatcattagttgttgtccttggatcgtcttagccttaggtagattacacacgttccctgagttcgatatactttaggggtcacccgaaggtgaagtgctacagcggtattccgtgcgcttgcggatttatctgtggtcgtaagaaataccaacaattaataacatgattaatgatgatactagtttaactcctggtttgtaagggcaaattcctggtttggaggtttgatctgtacgaccggggttggttgttcaggtttagttaggcctatgcagcattggtgtactgttcagtgttgattaatattgatgattaattactttactgttttacaattctcaaatgtttgctaaatgctgcttttatacatgagtcctatattgtgccattctttggcatccttgtgcacttgcgtacttgctatgtggcttgcggagtattctatgtaatcaccttgcaataatcaatcaaaacttagttgaagaaaagatgcgaaggagaaaacgttcggcttataccctagttgagctgcctatgtgagtggagatgaagccatcgctagaccgttaatccgttgctgttgttttcttttcttttataaatatgtagctttattatgatgatggatttgtatattaaattgtcagtttgtgtacctcggctgattcctggacaaggattttatgcacaaattagttcagaaattactagtgaaatttctgggtgtgacttggaacacactttatagagactccaacatcacacatttggtttttgatgtcttgcgacacaaaagtccaagtgtgggggaggtcaacgagcttgtcatgacgagttccatcaaccaattccatcctggtttgcagttggtgttagtcctaccttgctaaaaaaagaaaaaaaaagggaaaagagagacagaaggaaaagaagaaaaagatgggagaagaggaagagaactagtagcgatcatgctgcctggatacactcaacccctctcttgagctcatgtgtcgcattagtttagccttcatccactcctagttgtgcacaacctctcgctcccgcagcacctacacgcatacaagcaagaggagatgccctcttcttttctcggtgtttgctactccactctagttggcacttgtatatttgcgtaaaaagatatgcatcctacgtctctgcagcattgtgccaacagatcacgccttcaaggcacaatgttcctgcacgtgaggtgtgtgcataaccaaaccacttacatgagttggcattgtaaagtgtcttcctccgctacaatccgcatcaagacagaggaaagattgataatcacatgtgaccataccaccactccagagatttcaacatatacatcatgctggtggtaagtacacttaggtatacaaaaggcaacaaaagattcacctcatcttttactcatacttatctttatttgaataagacttgagcatacatggttatgtttcttgtgtctatttgcgtatgctctagtttgggtgtttgtgcaagacatctataggcttttgaaattaagcatggtacttaggttaaggtagtcttctttaatcaaattagacatggagtcgagtttgattaatgaactctcagagttaatatgttcgtggacattggatatatatatcttctttggactaacccctataggaaagttttcaaattgacgggtaagtcctcaagttcaattcacaatggaggtaggtcagggccaggaacaaatcaattgcaaacatgcaaaggataacacatcagctttcaaggtgcacggtaagtatactgtcaattgcttctttgttatgatcgtgcaattttatcttaagctctgtataagtttttgcttaatgaaaatttggtgaacagtaaattttttgaaaaatgaaagatttcaagaataaaagaaatgtctctcgaaaaaatgataataataattggcaaacttgtgggatccacgcttcttaagttttgaatccaattcctttttagcatggatgtgaacaactaatcttgaggctacgataaaatcttctcaaatatttgtagttcctcgagtatttgttgtccactaaccttttgcaggaaataaaaagacaactaaggagcagtgtacaaaaactgcaacacccataccacgctccttggtttatgagagagatgcacagggaaccaagtagagcaaatgcaacactttgttacattcgattcggttctaagcttggtaagatctatttggtaagaaacccaagcaccccgtgtatcgtcgcctcatatatccgccctgctaagatacccaccatgctccttgttgctatttaaaaaattagataaaaataaaataaaataaatttaggcacttcatgcgcctaaagttatttgaatacaatttggctcaccggtattacaccccggtggaagcctatttgatttttatgttttttgttgaataaaggcaaggtacaaaacaagtatgggggagtctttccggaactcccgacatgcaacagcatcaacttgacacatcaatatgatgaacaccagcccatggccgtgcacaaaattcagcagccagaaacaagtcctggctgggttggccgaaccaagtgttcgcccgacccttgcctggcccggctctgtcaccctttcaccgtgtggtcaggtttgcgcgtctcctctcttatcctcccatgtttgtgagtcaaacatgcatggaaaattcgaatagaatttattttgactccaaatgaaacttaaaaacattaactctcaacaaataaaattttcctatgattaatcatctatactatttgttctttgctaacacttctcacttgtgaacaaccatctatcataggaagctcatctacccaatagttcaacatgttgttttactcattcatcatcatcattcatcatgtgacacatccaacggtcaaaagtcatctgaataatttgtatccaacgtcccagattagcgcgcgtgcccacccctccctccgcatcctctcccgcactgcgcctcctccgcatccgggcgacgcgcgactctctcgacctcgccgtctcgccgcgcctccttcgcatcgtgtcgccggaccagatcaccgcgccctccctccggcaaatcaccgcgccaccggacgcccttccccccggcaactctccctctgcatcgccgatctgccaccgatccccgccgccggctcgccctccatgatccccatcgcttgtcctccgcctccccgccgcacgaggtcctcccgtcgccaggtcgccgcggccattttgctccaccgatccccgccacacgaggtccttccgtcgccaggtcgccgctgatgagatttggacccttttgagaattgttgtggcaggagttttgcaccttgcctggttctatgttcattgtagttactagacgactcaaacaaaagatgcatgcttgcttccatatttacattgttcatttacacatgtacacctgggatacgtttttcagatgcatttttttttcaaattcatatgctcacttgctgttattccctttattttggattctcttctagacttgttagaatttatcttgtggtttacttccttctgaatggaaacaccaaacccgtacagataaccaattggtaaaagccatatgcagaggccattgagttttgttgcaaactgtacttccaaaaaaaaaaactctggctcattctttctttaccgcagttcatgtatttgattccattgaacattcgagaacaagtcccaatgaaccattttatacaatgttgcatgagaggactcacgtctactgtgacaactcttttgatctcatgcatattcatgattcatctcatgtatcctt

SEQ ID NO: 74270 - DNA, 32046 bp, Oryza sativa
cgctccccgccccccgcttgcctgtgtgcgcgtgagacagagagtgagagaagagagagaggaaaagtgagagagagaagggagagaggaaaagtgcaataggagtatgacaggtggggcccacctattttttaataaataaattgctgactggactgccacgcgtacgccatgtagaccaaaaccaccactgattgggtcgaggggggtaattcgtccggtttgcatagttgggggtgaagaatgtccggttttgtggttcaggggggtaattcggacgaccgcaatagttcgggggggtaattcgtactttttcctttagtttcaaaagcatttagaaatcacaaaattatacccatagcacatcatcatgtcgctcatgaccatgagcacggctaatcgattagtttttagaactctgtagagtttgtacagctttacccacaagatatgaacaacactctagtttgttttgtgctcgcgatgcaccaccacactctatacgttgagtgcggtctagaggtcataacgaagcctttacactacttagaatctagccttgcaccagcacgatacgtgttcctccatcttaggtatacttggaaatatgtctagaaccgttaagtggcgggcccacgccttaaacttaatgccgtggtggcggacacgacgggaacccaccacgtggcacaataccgttgtattggacagacttagacgcccatgccgtgaggtggatcagtacacccctcacggaacacacacacacacatagggaatgtatcatcctatgatcatcacaaacacacactcatgggtagttcctctaagttatcgacaaaattctcagaattatcgactaactcatacacaccggcctaccagaatgcaaggctagtcctaaatagattaatcagcttaggccatcccatactagcacatgtggatgtacggtaaacataatgggtgatatgttcggtccttaatcgactcgggcgaatactccccctatcagtatgcaactaccaccatatgcataccacatgccgctcaagtctaaaaatcacatttcatctcattttatttcacaaatatccagcgaacacatcgctgcccatatcacataaaaaggttttccaaatagtataataagtgattccatagccatgtttttatttattactaagcaaggctaagcattagcattttataaaagcttaacttagctatatgagcacaataaaagtactctaattattcctaaggttcaaaacagcaagggagtgattttcaaaagggttcatgcaaattttttttttttttggtcatatctacaatccagtttcgatagttcgaattacgcatgcaacttttacaatcaaaacatttagcccgaaaacatgggattcaatgtgttcaaaggaagggcaacacttgccttggttgatataagaccttcttgagatcagctataagaccaatcacctcaccggtaacgaattcaccgtctaaaagaaataacggtaacgataaatgccaaaacatgtaaaaatctaaaatgctctaaaatgcatgagtttactagtgtggttaggtactggtctaagatgaatttagatgaaagaatttatattttatcactttgcattagagagttataaattttcaagatgtaatactagcactagattaattaagctctaatagttcttaggtgcattttaggtctatgatttatgaattgttggcttgctgcagtgaaggggatgttctcaggtgttcaacaaaattggtttcacatttttgtagagttgggatgattttactatgaattttacaagctaagtgatttattatagtagttgttaactatttcaaattttagacaagttttgggtactgaaagtgtcatattttattttataaaaactaaggtcatggttcttataacctaacaaactttgagatctcttcctttagactggtattaaattttatatgaattctagaagtttctataccatcttttaattttaattcattattcaaatttgagtgatgtttttggatatggtttcttctacagatttatctacagaacaaatgtatatgcttttatcaaactaacaaattttagttcatctcatttggagttaaaataaatcacttatgggttttatagtttctagattacactatactagttattttaccaattaaatagttggtgattattttaatacagaaagtatcaagttttagttcatgtaaattaagaacatggttttgtgagaatactggagcttggttcactccaaattaagttaagatgaattttatatgaattttctaagttggagattgctctatgttcattatttcttatgtgaattattagagctatttattctactgcaagtgccaagttttatgtttccatattaaggttcataactggtgattctacagaaatttatttcatccagattggagctaaaatgaattttatatgcaatttacaatttaacctatttttctgttgattagatattcactaaggcattttccttatatttttccagattttaaacacatagggcccactggtcagtgagagatattttgcagaaagattcctagaggttctagtaataggtcccgaggtccctagcacgttttaattgaatcttcattaagagttcttgagttttaatctatttacatgcatgttcttgggtccacatgtcattgtaaggttatttgaagttacaaccttaccagatctaaacattcagtaatgaaagtccttagtgcctaatccaactggacccacatgtcagctagcctgagaggaggaggacagagcagcggcgacagcagcggcttcacagcgtagccggcggtgaacggtggcagatttcacgatgcgaccagaatagaaaatgcagagtggaacatggcgaagctaatggtggtggtttcgctggctgcggtggtcggtgtcagcgatggtggcagcgcgagcggcggtgagcttcggcatgcatgtgcatgtcgagctcggtgtgaatgagtgtatgcatgtgcctctacggggttgctggaagcttactgtgggttggacatgcgccggtaacgcttgaatggcgacgacggcgtgaaggatgctccggcgacggcaagaaacggcatggcaacggcgtcgacccccttccagactccggactgccaagaagagaagtggaacggctcaacgacaatctaaggatgctacacgaacgaggaactgcgccgaagctcacccgagagcgaggaacggacgacgttggccggcggccggacttgaggaagaaagagaggatctccttgttggctgctcttcagcgcgattcccttcgcaggccttatcctagaaccttggcgacgctcatggcgcagcggctaggtcggagatgcaccggatcatcgggaacggcgaagcgaccgacggcggcgctctggacaccgaggacgccgacgagctcgacggaatgtgtttgatccatggaaaggatctatagatcacgttcttatgattagattgtggcgaagctcaccagagaagacatacagcggatcaaacaccttcgggaaggatgaacaagtgggtgttctcggaaattccgagggagttttctctaagttcttccttggaacatgatgaggaaagtgggatgagttatctggtgaagtggttaatcaaagaatggatgttgtgctggcaatggagagataggtggcatgatatggctttgacacgatttttggagagaggatcgagtttagggctgagattcagcttgtacttcagttaacctagtatgagtggctgtctagtggccccatatagatgtttcccagaagaaatgggaggtatggtgagttcttcggtgaaacttggactctaactctctttctcccccactctctctctctttgatgaagtatatatagattataaatgagtgatcacatgagtagatggctggtacatgggtgacaaatgggcccatgtagatatactctaggtttatatgtgtggtaaggtaggtgagaattgtatttttaactctcctctcaccttttgagaaatgaaatataaattaattgagaggtgtgaagatgatgggttgaccgtgtgttaacagtgaaaattggtaatcgacaaaggcgtcatcggcttagaatcattatcggctgcagcatctcggaatcagccgatgggagttatcaagtcgccaatagtcggattcctgctatattcggttaaggaaatcaatctactaaaggaagcttatccctaagtgaccgagtttaaagaggatgcggcatggcagtttatctattaattaggaatagtttgttagtttccttttatctttagaaaagtgtgtttagtgtccgataaggactttatgttttccttttatctttaggttagtttctttcttgtccgataaggacttgtatcaacccatgggtataaatatgtacacccggggtctatataatctatcttcacgatcaatacaattcggtgcattgccaccttttaccttttctactttattttatcatccggcgggacttggcacctgacgcggggctgcatcgatgttcgatctccggcgaaggggtaagtccaatgttccatcggcctaggcaattgtctcatctacgtcagcgtcgttcaagactgcatcagtacattcgacctcttggattgctctggtttggacatctaccaccctgaaaatcagtcaacggcttgattgcctaggtattgtcagccgatgggattatatgaccagcaggaagttgaatttgcttctctcggagtagtagatcaaagatcttgtcagctttagtcatatcaaagtcatacttctcctcttttccagaactttttacccattgacatggtatgacctttttactcctcatctattcggctgcagctatttcagaatcgtcctcatcatcatccgacccatacatgtacagacaaacatgattaaccttcttagagcttttcctaacttctgcagatctatgctcatgcaaggttaccttctatcacagcctgaatttccgttttaggatttataaattatttaataaattattaatataatttatattaaatgttcattaatttacaagtgaagttaaatgtgggaaataaaatttcctaaatataaagcatggatagatttaatttgtattaagttctccatgattaattatactctctgaaattttctaagatttttcggagctcaattcctaattttaataatacaaagaacatttcagtaattattcacatattaaattaatcattaaatgagctggtttcaattttaataaatactctgagtgttcaagtatgttcaagatttttcttggaattatttgagcattggaagtatttttaacaattgaaagatcatctcattggttaatttattttgaaaagtaataataatcctcttcctagtcttgggccgaattcagcccattccattctctcctctcagcccgcagagaagtctgtttgacttccctggcgctacagtactctatcttcaacctccagacagagaccgagccgtcccaagcctgtgcagccgtgccgcctcctcccaccaatccggccacctcgttgctcctttttccaaattagttgcggcaatggaatcctctcaatctcctcttccttttccccaagaaatccccaaaagtttctatggaaatcctttccaatttcgcggttcaatctttccttactccggcgagaaccctagactttcccgagatttcccgtcgatttgggctcggacccgagctcccgtgcctatataaatgaccccctagtcgtcctctacctatcccctcatgtctcatcttccgccgtcgtcggaatcgccctccccgcgagctccttctctctccgccgccgatagccgttccagccgccgtgcgccgtcgcctcggccgtcgccgatcagcgccaccacctcccgcggctccgcaaagtcgagctctatcccggccgctggttcttttgcgccaaatccaaccggagattggccgtcatcgtgaaccggagcgccgccgtcgccgccgtgcctccagccgcgccgttcgtcgtcgtccgtcgtcaccttcggtcgccgtcgtctccatttgattcgcagctgcgaggagaagcccgtccgccatctgtcatccgccgaagatcgccggaaagtcgtcgccggccatctccttcgccgttcatcgctgcgtaagtattggtaagcatcgctgttgcctcctctttctcccgttgccctccatttgcattattgtaccgtggttcgccggcaaccgccgctcctatgccattcaccggtgtactttatctctagggtcttaattcaatctaatccgttgtttgtctagcatcgtcgtcgtctccatgtgttgccgccggatcaccgtagtcatctctctctccgatcgctttggttcggtgagacttctatccgtgttccctcggtttagtttttaatctctcgtttttgtcatcgagtagccgccaccgtgccacgcttagctgctgccctagcgtcgccactgcgctagccacctagccgtcgctgtgccgctccctgctacagccatgctgctgctgctcgtgcatgccaagtcgctgccgtcccactaccatagccacagtctgccgtcgttgtgtgtcgtcgtcgctgtgccgtcatcctaaccctagccgcgtgcctccgccgagtcgccgccgcctagctgagccaagtcaccctagtaccgccatgtcgcagctgtgtgccgctttaacctagccgccgctttagccgttgctcggtagccaagttgtttagccgttggtgcatcccttaattcctaccggcctatcgtttgccgtaccggggctttaccgtgaatcgtgtctagctcaccggtttagtcgcaaccgttgttgagtcgttcgctcgttcgttcgaacgaggtgtcccccatgtttcgttcgttcgtccgtgtggagtcatcctttagtttagagccgttcagagcagccggttccgttcgccagtttcggttgatcatttgggtgatcccgtgtcacgtagaattgactcgttgagtcggtatctcgtgaggcccgcttgccagatcaatctaagccatccgatcttggtcaactctcgatcaagattaatctcagccgtccaaaatcaatataaatccgttctctcttttcagtggcatattatttctttttaatatatgtcatctaccaaatatgatctaatctttttccagaggttgttttaatctttatctcagttataaatcatttctaaattgtttaattaatttagaatagtattttctttaataggtttaattggaattaaatcttgtaaaatttgtaactaattcatatgaaattagaatgaggccgttcaagtctcataattcatctaaaatcatgatctacatgtttctttactttatatgtactatttatttggagtttcttagtctttttcttcgttttgcgtgttagcttgtcgtttccgtcgttgcgaaggttcgcgagtgcgtcggaagtattccagaagatttattgaagaccgaatattgcaaggcaagtcacacagatcccaaacataatttctttgagcatgttgatcctatatttaaattctctatttatttcaattgtgcatttattttcgaatgtcaccgggtggtgtgaacctattcctttgttatgaccactttgcattgcttactctattctttgataccttgggtgacaatttgactaattggacttatatattggttcagctagatattagatataattgcttagccatgcttacaaacattagcacatgattgggataactaatgttccgctatcacttaatgatggatatttaattgtagctcacgatggctaattgtgattggttaattaattaatgtgccaactaaaacttgataatggtgggttgtgagcacatggttttgatggtcgtgctcatgacaattaaggaccggttcatgagtttcggttgtgaaacattaaccatgccaaccacaagtcagcgtgggcaacggctttaccttttgtatagcatggttcattgcggggcaccaaactgaaaagtggcggagataagcccacgggggtcgctggggagtccatgccttgtctataagggggtgattatgatccaggaacggtgcactgtggtggattgtgttatgcgaggggtactgtcacagctcctttccgaggtaccgtggtggcattgagccgcatggtgacatgttgtggggctgtgtcttgtgggtacagtggtacacctctagctagagtaaaactattcgaatagccatgcccgtggttatgggcgggtctaacaatgtctttcgtgattagtctcacacttctcaccgtaataaatgatgctataattggtaataatttgattagctcctggtttggaatggcacattcctggtttggagatagatctgtacagccgggtatggttgttcaggatggttgggcctgtgcagcatgggtgtgctgttcagtgttgattaatattgatgattaattactctactgttttacaattctcaaatgtttgataaatgctgcttttgcaaatgagccatatattatgccattctttggtatccttgtgcacttgcatacttgctgtgtggcttgctgagtatgtcatatgttcaccttgcaataaacaatcaaacctcagttgaagacaagttgcgaaggagaagacgtttggcttataccccagtttagctgcctgtgggagtggagccggagcttcgctagaccgtaattccgctgctgttttctcttttcttttgtaagtatgtaacgttgatgaatctgtatattaaattgtcagtttgtgtacctcggctgattcctggacaaggatttaatgcacaaataagttcggaaattactagtgaatttctgggtgtgacaccttctgtatcagatgtgacaagctatcaaagtcttcagacgagaatttctccctaatcggagcaatcataccttgaaaggccagatcggctaactgggcatcagttaaactcaagctgaagtatttgttcctcatctccttgaatctctgaatatactcgtgcacaggttcatcatgccgctgcttaaacgctgtcaagtcagataatttcatctcatgaaccccactgtaaaaatagctgtggaattgcttctccaaatcggcccaactattgatcgatccatacggcaaagaggaaaaccaagtaaaagtcgattcagacaaagataatcggaataacctaaccttcagagtgtctacagccgatgcttcaccacactgagctaagaatcggctaatgtgctcataagttgacacaccatcttgtcccaaaaatttggagaagtccggaactttgaaccgattgggaagaggaactctctcaaaccactcagggtaaggctgccgatacaagcttctagtctcttttggtttaagcccaaactgttccctcattacgtcagcaatcacatcggcccacgaccgttgctgagctgccccttgttgctgcatgggctcgaactgaccgtattgagacgcaaactgaggttgagccaatccccctggctgatattgggcttgcggggaaggaggctgatattgataattcaagttacccccttggtaattatgaaggttcggctggatattacgtaccaagtgctcaggaacaacttgaggcattactgtgccatccggctgtacgtggtgaaccaagtgttcttggacaacttgatttaaaaattgttgtacgggctgaccaccaggcgttgcaaacccggccgatgcgcttattgaaccttggtgctggatcaactgaacgatttgctgtcttaacagcgtctgctgaatcggctgtagaggctgctgccttggtggtgtttgctgaactggttgcatgacctgttgctggattggttgtacaacctgctgagttgggggtgtctgctgaatcggctgctgctgtattggatcaacaacaggttgacgtggcagaaacgtggcagcaacctaatcttgggtcagccgattcgcaacctgcccactatgctgtggatgctctctcattaacaaccgagggttcaccggctggcctggcgccatcgctgatggagcaggtaggggagttgatgtcggcgtcgttggctgagttgttggtgcaacggagggaaccgcctgaatagatggctggacatcggtgatcaaagaccgataatttgggaagacaccttgcaaataaactgggcctgcagcctgatgctcagctattgaaccatcggctattgacttcatcatgtttgataaggtattgactaacaccctagattgattgatcaaagcatgatgcacagcgtagtcaacccggtcttggaaattactgaaaaaatcttatgccgcatcactattctgattaagatttcctccttgcaacccttgggcaccatcaccttgcattccatggactccttgagaattgtcgccttgatttcctagagagacgtcggtagcacctttgttactcggctgagccgagtcgtctagagcttgtttcccatctccatccttagaagaactggtcccaggatcatcagcaaccacttttattttgtacttctgaacaagtgtccccttgcgggtctgcatgaatgagttcaagaactgatcccatgcttgctgcaacattgcttcaaactctttcttctgctcaggtgtgaatttttctggatcgatcggcacgacgtttccttcattgacgtcagtcgatcctaatttcagcatcttttccttaacagagcctgggctagctggagatagtggtggtggttgtttctcggccatgaggaagaattgttcatgccaatctgtgttgacgaaaaaatcgaacacatcggcctgggagatctgcttagctcctgtgcaggtccaaatcttgatgagatgcgggcgtgccagtcagtttgatcctgcaactgacaagatatgtaaacaacagataaaatagccgatcggctgacaagccgatggagtagttccagccggtagccgataatagccgatgctgataccagccgatagcgatagggtttaagcaatcggctatacgtccaatgtagattctaacactttagtaaataatgatatatagacaatcggctactgataataaaatataacaataatatagtccagtataaaccaatcggctagtattgatataatagaataagcattgatccgaaggttaaagcacacatcggctggtggtccgatgtcatgaaatccacgagattagattaaacagtgaaacctttgttgtcatcggctaaatccaacttatatgtatatgcaatccttatgagccgatgcaacgtccagataactcaccggctgaaaccctgatgaaacccttattggcagtcaaaaagcatgctagagattacggttctaagcatgacttagtaggtcaaacttaactgatgcagcactaagtatgaaaagaaacacaatatctagacaatcaagccgttgactgattttcagggtagtagatgtctaagctaatctaatctagcaacgcgatttagccgataccggcagaaaccctaaaacgagaagcagccgataaagctaaattgatatgctaagactagattaacagagacatatgataaatgggtaggcaaatatatcatccaaaccagagcaatctaagaggtcgaatgtactgatgcagccttgaacgacgccgacgtagatgatacaattgcctagaccgacggaacattggacttatcccttcgctggagatcgaagacgatgcagccccgcgtcgagtgccaagttccgccggaatgtaaaaacaaaagtagaagtaaaaagggtggcgatgcgccgaattgtattgaccgtgaagatagattacatagaccccgggtgtacatatttatacccatgggttgatacaagtcattgtcggacaagaaagaaactttcctaaagataaaaggaaaagataaagtccttataggacactaaatacacttttctaaagataaaaggaaactaacaaactattcttaattaatagataacttgccatgccgtattctctttgaactcggtctcttctagataagtttcctttagtagatcaatttccttaaccgaatatagcaggaatccgactattggcgacttgataactcccatcggctgattccgagatgccgtagccaatagtgactctaagccgatgatgactttgggcttaccaaatttcactgtcaacaccgtggtgaggatgacacatgggtcccacaatggcttggccccatatgtaagagagatgtagaagaagaggcctagaacatgtagtttatttccctactcctctcttccttttaaattagaattttagggagacaaggttgctgcaaggtagacaatgatttgatggttcaatgtgccaagttccaagattaaattactttttgagttactatggtaatttagtaaagaggtctaaattactatgttgactgcagtctaaatattgtttaagcaacttgtggctctcatttcaggtggtttaatttcgaatttaattaagccattgcaccaggtggtagagtacactatagttaacattctgaccaaatggtttagctagataagttatggttaaattttggtgaaggtgcaaagtaggctaaatgatatgctgttttccaaatttctagatgagttgttcgaattatttgagaaacatttgatgtgatatttattaatttgaaactaaaattaatatagactcaagatgttgtgtagtatttatgagaatatagatgcaatttgttgttgcataatttatttttaggaattttctttagaaacgacatgcatatgaaacctattatgagacgcaccaagaacatccaaaaacaaacctaaaataataaaatgcacatacaaccaagtatatttatttccatttaggttttttcttatgattaaaacttatatttccatttgttttcatttagctcaaatattttgcttaggttgaaatgcaaaaccaaaagagttaaatttctatttcatggttaaaccaatttatttgaattgtgttttgttaactcgatatattataaaatctaattttggattagctctaatctaatcccaacaaatctttatgttttaattttatatacaggattcaaactctaagttcaactattatgctcttaaatgctttagctttcaaaaagttttaaattttcctcaaaaatttaatggtgaagctccgaccgttatacgcatcgaggcgtagggtgccaggagcagcacttcgaccttaggtttggttctgttgggctttacaaccaacggttcgacatcgggcccagtagaccgcgaacacccccatggaagacgtaaagttctagccgacggctttttagtggctaaagagtaatttgggataaaagaaagtatttgaaaatgcaagcataaggtcaaacaatatttgaataaattcaaataaaattataaaatagcaaattgggtatcaaaatgtagggtttgaatttagatgaatttaggtcctagtttcactagaatcggatctacggttcaggagatatgggcttctagagaataggatttgaattaaatatgaaaattgcgaaatagtactgtactggggcccacctgtcaggtgtcctctctctcctttttcttcttcttcttcttcttcctcctccgtttcttgtcttctccagcgcgagcaacacagagagggggagagacagggtgccggtgctccggtgaccgggaggcgacgacgtcggcggtggaacgtgttcccgagtgtcacgcatccggggagggtggtggccggcagggggagtgagagaggaggccggaacggcgatggcaaggacttagctccggccggtatgggaggtaacggtggtggctaatatcggaaggagaaaggaaggggaaggttagggaatgggtttgcctcgtcgaggcgaaggtattggcgcgagggcttggtcggcaatgctccaacgagggagatcagccgatggccggcatggggaggagagagagagaagaagagctcgaagctcagttgtgggggaaaagaaggggctttgccggctatttttaggcggcggatgtcggttcgcagaggaggaggggaagaagggcatggcgatggcggcgtggggaagaagaacaaggcgccggccctgtccaactattggtcgacgatgacggttttgctcgcggatgacgccagtgaagtgatgtcacgtcccagaagtaccctaaaatatatcctttaaattataaattatgtctagaataattaaaatcctagtcaaatctatcaaaaattaaaatgtgtaaagttaaaagtcaaataaggctgggaggatttttttatatttcctaaaagcctaaaatgtgtaaataaattttagtggaattttcagagcacaaataataattatgaagaaataaacaaagttgaaaagattttataaaaagaaaaccctataaccctctcccctctctctaggtctgaattcggcccaactccctctccctctctcttctctccccgcggcccactcggcctccctccctccctacgtgtgcgccgctgacaggcgggctcgtccgccaccctcgctgacgggtggggcccacccatcatccccctcctcccactgctcccgccgctccctccgcccgcgcctagcgccgccgccgccgcaaatcctgccgcccccgaccgttcccgcgtgccattaagtggggggaaatgttccccgtgattccctctccctttccctccattttctcatctctctcccatgttcaaacggccggatttgctcccgcaaatctcgccggcgccattgatgccgatagggacccccgcgccggtttccttcctcgccggccgccctctctcactcccaaccctatataaaccctcaccgcacctccctcgtccgtttccgccactcgccgccatttctccccgccagaatcgagctcgcgccgtcgctctctctctccgtcgtcgccgccgagctccgatccgccgccgtcgtcgccccggaccgcttcccatgccacctcggcgtcgtctcctccggctttgccgcaccatcgccgacctcgtccacccctccgtttcggtcgccgacggccggaacgctagctcggaggatgacgctactatcatgcacctggcacgcatggtggaggcgtacgacacgggccgcatcaacttccatcatatggtgcgccgtgggttggtcgaggacaacatgaagatcctggagctacgttaggagaatttgcagctgaaggacttggacgccgtggaggcgcagctgtgtcagctcaagattgctcagggggagatctgtcgccccaagcgccgccgcgtttgccgcagccagaagatcaccgcccgcaagagtacctctaggcctgagcttgttcgtcagttcttggcgtggacctgcttcgtggagactccttgcgtcgagcccgcgcccttggttccttaggaggagggagcctctggcgttggcagcacggaggatgtgttgttgctcaccttccgccctggcccgtcgcagaagtagacgagcagctagtaggcacgcgcgtgtgttctttttgtttgttttcttgcagagtcgtgtggggcatggttataccggtgtgtggtataattgtgtcggagcctgtctttattttatttgcataagcaacttcaaccttaatgaaccaatttaatagcagaaataaattcaagaattatggtagtcgtgggtggttagttttaatcgtcagctctttctgtttgctggttctgtgtggaatcttcagatggtgacaaccaggagaagcgctgctaccggtgagggcagtcaccccgaaggcagcaaccacaacaaccatggcagcccacctccacctccccctccgccaccaccaccgccacccgataccaaccccatcctcacccaaatcctcgctcagcaggccaacatgatggctgctttcctccaccacatccagactccgccgcaacacaatgctccaccaccaccaccaccacccccacagcactccaagcttgccgagttcctccacatccgcccgcctaccttctctagctccaataaccccgttgatgccttggactggttgcatgccgttgggaaaaagttggacaccgtccagtgcaatgatgaggaaaaagttatcttcgcaacccatcagctgcaagggcccgcatcactatggtgggaccacttccaggctatgcagccagaaggacagccaatcacctgggcccgcttcaccgccgctttccaaaggacccatgtgccagctggagtcatggcccttaagaagagggaatttcgggagttgaagcaaggcaaccgctctgttatggagtatttgcatgagttcaataacctggcctggtacgccctggaggatgttcgtgaagatgaagaaaagcaggagaagtttctagtaggaatggaccctgaactttctgtgcgtctggtctccggggattaccctgatttccagctcgtagtggacaagagcatccgcctggaggccaagcacaaggaactggagtcacacaaacgtcgcttggcgaatttccgtaatcaacagggggctaaccaaaggatccgctacaccaatccctatccagggggatcctcctcacaacaacagcagcaacaacctcgcccagtgccatgacctcaatttgtggtacgcgttccacagccgcagcaacagcagaatcagcaagggaaccgtgcaccccgtccccctgcaccggccgtgcagcctagtcatggacgcagggatgttcaaggtcagccgcgtttgtgcttcaactgtttagagcctgggcacttcgcggataaattcccaaagccgaggcgttaggaaggccaagcgcctccccgccccaacaatggtggaaaggatgccactcggggtcgtgtgaaccatgttactgcagaggatgtgcagacaactccagatgtcatcatcggtacgttcttcattcattccatccccgctaccattttgtttgactctggagcttcccactcgtttatatctgtgcaattcgtggggagaaatcagctggggttagaaaggcttaggaactcactgctcatcaccacccctggaggagctatgacagcaaagtattatagcccggccgtacctatagagatccagggaattccttttccctcggatctgatccttctagacaccaaggatttggatgtgatcctcgggatgaattggttgacccaattccaaggagtagtggattgtgcaaggcgtactgtcaccgtgtaccggaagcctgatcaaccggttgttttctttgcgcacccgactcccaccggcagctcagtacttcatcaactaggactgtcagaaatacccgttgtcagtgagtttggtgatgtatttccggaagagctacccggcatgccgcccaagcgggagattgagttcaggatagatcttgctccaggaaccactcccctgtacaagcgaccctaccgtatggcagcaaatgaattggctgaagtcaagaagcagttggaagagttgaaagagaagggatatatacagccgagcacttccccctggggtgctcccgtgatttttgtagaaaagaaagacaagacaaagaggatgtgcgttgactaccgagctctcaatgaagtctataaaaaacaagtaccctcttccccggatcgatgatctattcgatcagcttaaaggtgccactgtcttttccaagattgatcttcgttccggatatcaccagttgtgtatccgtgaagaagatatccctaagaccgcattcaccacgcggtacggactgtatgaattcacggtgatgtcgttcggtctgaccaacgctcctgccttcttcatgaatttaatgaacaaggtgttcatggaatacctggataagttcgttgtggtctttattgacgacatattggtgtactcacagtcagaggaagaccatcatcagcatctccgtctggtgttgggaaagctctgggaacatcagttgtatgccaagctcagcaagtgtgaattctggttgtccgaagtcaagttcttagggcatgtgatatctgttaaaggagttgctgtggatcctgaaacagtaacagccgtcaccgattggaagcaacccaagacggtcacccaggtccgcagtttcttgggtttggcagggtactatcggagattcatcgagaatttctccaaaattgccaggcccatgacgtagttgctgaagaaggaaaaaaaatttgtgtggagtccgcagtgtgagagagcatttcaaactctcaaagaaaagttggtttcctcgtcagtgttaatcttatcagatactcgcaaggatttcctggtgtactgtgacgcttcgtgccaaggtttggggtgtgtgttaatgcaagaaggtcatgtggtagcttatgcttcacgccagctacgaccccatgaaggcaactatcctacccatgatttggaggtggccgctatggtccatgctctgaaaatctggcggcattatctcattggaaatcgctgccaaatatacaccgattataagagtttgaaatacatcttcacccagtcggaactgaattttcggcaaagaagatggttagagctcatcaaagactatgatgtgggaatccactatcaccctggtaaggccaacgtggtcgctgacgcgctgagtcgaaaaggccattgcagtactctttgcgtccgtggcattccaccggaatttaatcaacagttggaagccctgaacctaagtgtcgttagccatggattcttggctgcactagaagcaaaacccaccttgcttgatcaaatacgcgaggctcagaagaatgatccggatatgcatgggatcctcaagaaaatgaagcagggtaaagccgctggcttcacggaagatgaacacggaaccttattgaacggaaatcgtgtatgcgttacggacgacaaggaacttaaaaagttgatacttcaggaagctcatgaaagtccttattccatccaccctggcagtacgaagatgtacttagacttgaaagagaaatattggtgggttagtatgaagcgggaaatcgccgagttcgtggccctttgtgatgtgtgtcagcgtgtcaaagcagagcaccaacgaccggccggactcctccaacctttacaggtaccagaatggaaatgggatgaaattgggatggatttcatcaccagacttccaaaaacccaaggcggatatgattctatatgggtagtcgtggatcgactaaccaaggtggctcggttcattcctgtgaagaccacctatggagggaacaaattagctgtgaagaccacctatggagggaacaaattagctgaactttacttcgctaggatcgtgagtctccatggcaatcctaagaaaattgtatccgataggggaagccaattcacctctcacttctggaagaagctccaagaagagctggccacccgattgaatttcagcactgcttatcacccgcagacagatggacagaccgagcgtctgaatcaggtcctggaagtcatgctccgtgcctgtgttctagattttgggaagacctgggataagagtctcccttatgccgagttctcctacaataacagctaccaaaccagcatacaactggcaccctatgaagcgttgtatggacgcaaatgccggactccactgttgtgggaccaagttggggaaagccaagtgttcgggattgatattctgagagatgttgaagctaaagtcagaaccatttaggataacctaaaggtggcacagtctcagcagaaaagttatgcagataaccgacgccgcgatctggaattcgcagtggacgattttgtgtatcttcgggtcacgccattatggggagtgcacagatttcagacaaaagggaagctcgcacctaggtatgtggggcctttctgcatcatcactcgacgcggagaagttgcttaccagttggagctgcccgcatccttgggcaatgtgcacgatgtgttccacgtgtcgcagctcaagaaatgtcttcgagtgctatccgagcaagccgattcagagcagattgaggttcgcgaagacttgacctacgtggagaagccggtgaagattctggacacaatggagcgtaggaccaggaattgggttatccgtttatgcaaggtccagtggagcaaccacgccgaggaagaagctacttgggagcgcgaagacgagctgaaggcagcccatcccaacctctttgcatgttcttccaaatctcggggtcgagattccgtttaagagggggtaggtttgtcacgtcccaaaacgaccctaaaatatatcctttaaattatgtctagaataattaaaatcctagtgaaagcctccaaaaattaaaatgtgcaaagttaaaagtcaaataaggcttggaggattttttttttatatttcctaaaagcctacaatgtgtaaataaattttagtggaatttttagagcacatataataattatcaagaaataaacaaagttgaaaaggttttataaaaagaaaaccctaaaaccctctcccctctctcttgggccgaattcggcccaactccatctccctctttctcctctccccgcgtcccactcggccttccctccctccccgcgtgcgcgccgctgacaggcgggcccgcccgccgccctcgttgacgggtggggcccacccgtcatccccctcctcccgccgctcccgccgctccctccgcccgcgtctagcgccgccgccgccgcaaatcccgctgcccccgaccgttcccgcgtgccattaagtggggggaaatgttccccgtgattccctctcccttttcccccattttcccctctctcccgcgttcaaacggccggatttgctcccgcaaatctcaccggcgccattgatgccgaccgggacccccgcgccggtttccttccccgccggccgccctctctcactcccaaccctatataaaccctccccgcacctccctcgtccgtttctgccactcgccgcactttcttcccgccggaatcgagctcgcgccatcgctctctctctccggcgtcaccgccgagctcgggtccgccgccgtcgtcgccccggaccgcttcccacctcggcgtcgtctcctccggcttcgccgcactgccaccgacctcgtccacccctccgtttcggtccctgaccgccggaactccgccgaccccgtcgacccgagccgcaccaccgcctccctctgctccggccgcctcctccgtcgccgtcgtcgccctggggtgagccgtggaccgccgcctctttcccccttcccttcccctctctcggccgccgctccgccgcgcctatggccggcgccggcgaccataggggcgcgggcgccgcctaacgccagccgcaacgacgtggccgcctccgggcgcgccgtgtggccaccacgtggggctcggccgtcagccgcccgtgccctcgggtgcggctgacgcgtggggcccacggcgccggctggtgagccacgggtgcacccggtccaccgtcgaccgaggggctgccgcgtagggcccaccactcccgtggacccggtccgcacgccccctcttctcggctgacgcaataaaccctatttttaattaaaatttaaatgaagaaattcgtaaatattcacattaagagcatataaacttcaaatggtcatatcttggccgtttgaactcagaattggaccgttcaagtctgtaatttttccttaagaaatcaagaacatatttttgtgctttgtttctgcttgttatatcgagtttattagagtaaaagcctttttctttccgttggtcgtgtagatgcagcagctttggaagatcacatcatccttgaacaaagcctttttctatgtggaggttgaagccgacgtttgggaaagcgagcaaggcaagtcacatcatccttgaacatattgaatcccagtttataaaattattttggtttaaattactgcattatcgctttatttaaattcccgcgttatcactattttatttagccatgcctatttacctttgttatgaccttattaatattgctattgttattattaccttgttcaccctaggataaacaaaaccccaactagtgggtaccctattcatggttccactagtatgaatttagctagctgcttcgctgattaattagacaacattaggtcgttttataaccttagactttgggaatgctcatatcatttggacgttatggaatggtttgattatgtggaaatggacacacacctccctctctattcaaaaccctcaaaatggttttaggctaggctcgaggtgcatggttttgatagtagcacctcggccactataaggaccggtcttcaggcctctgttgcaaagtactactgtacttccacatgtctagtgggtaaggcgtagtttgtggctcagtctggtcatgggcaaaagtacacggatggagatggacaaagtcggggctcgatggatatctctagggcaaatgaaggccacacgagctgtcgcccggtagtcgagatgtcatggcacagggccggtgtcctactgctaggggctcaaccttggttacctgtctcgggaatcccggtcgtagccagggttgggtcggtactcttgtttatggctaggataggttgggaactatgtcacatctttcgtccgtatgccgtggtggtatgtgctacgtggttacacgtgagaaagatgtgtcttgtgggtaaagatgtacacctctgatcagagtataatctattcgaatagccgcgccctcggttatgggcaagcctaacaatgtacccaagttagtggtttacttcttaaaacttgcttaacaactaaaatatggaatggttggcctaggttggcttgggacgagctgggacccaggtcaggttgccagttcggtctgaatcatcgtaggccttgggttaaggcaggttcgtgcgggttcacggccttgattaataacactgtgtagctctaggatcgtctttacaaaatggccctaagcaactaaaagtcttgtaaatgttgtttactgcaaaccctaacccctttattataactcccttgtactcctttgcatttattctgcatttgtgggtgtgtcttactgagtacggtggttgtactcaatcttgctcaatttttccctaacccaaaagaggagttcctggaggatgaagactttggtgtctagctcgtgcctgccgtcaagtgcctgtggtcgttgccctagtcttccgctgttttccgtttatcttcgtgtgtgctgggccttcgtcgcccatgtaataaattaactatttacgcttccgcttgttaaactctgaattgtatcaacttttggtgtaccttgcctcctgggacaaggaataatacacgcacgtatggaatgatcgttgggttaattccggtcgtgacaagtgaggtggcggctaatgttggtggcgattccttggcggcgacggcaagacaacggcggcggtggcggcggcgcgcacgcgctgccatggcggacggcggcgcccacagaaggaagggaggagagaggaggcggctgagctgaggctgggccgacttgggctgcatgaatgagaggagtaaaaaggggaattcggcccaatcttaaaaggaagaaagtctaaggtttgaataaattggatttagagaagtatttgtgtttgaagggaatttagatagctaggcctcagaaaggatttgaattcggagagatttatgtgcggagatgaatttcaaagtaaagatgttctaatttgtttgagtgcaatattttggagtgggagtttgtttaatgcacttaaataggaaccataaataatatggctctgtatttctggaaatgtggtaggaaaaataaagagagggaataaataggattttatccccacaaatgggtggtatgggtttaaagaaatattttgtggctaataggagatttgcatgaggataaaatctattttcttagcacaagagcaattattcacaatatttgtaataatactgttcttgtgacgaagaggaaatcaagccacatgaattaaattggcggctagatcagaaggaggaatttggatatttagatcgaacatcaaagtataggtttaagatcaaaggataggttaacaattaattccaacggaatcggaattacgacggtttaggttcaagggcaatatgggaaggtttcttggaccataattcataaaagggtttttaattaaattgagaaaaaggaattttgcaaaagaaggtttaaggtgcagaatcaaatcaaagcaaataccttggtttaataaaatcaattttagaatacaaaccacgaaagattttaaataatagagagagattctacgcaagttaatatttggaagtctctctaaatatattttcctaggtttaaaaggttattaagaacataagaatcagcatgatgcaatattagaaaatagtgaattttcaggatgttacagacggtgggggtgaggaggaagaagctgagaaaaaagtctagtggtatttctgtccgagattgtactgtagcaaacaaacccaagatgaatgtgatattttatcgaagcccattgaactgatggtattccaatgaaaccatttttttatggcataatcctaattttctctaggtttagggtggtgggtatgggcaatgaaaggccatttggattgccaggataggaaaagttactactccctccgttccaaaataagtgtagttttagcactgttcatgttcaacgtttgaccgttcgtcttatttgaaaaaatattatgattagtatttttgttgttattagatgataaaacatgaatagtaatttatgtgtgactaatttttttttaatatttttcataaatttttcaaataagacggatggtcaaagcgctaaacacggatatctatggctgcacttattttgggacggaggtagtagattttttcgttggagatttgactagagaaatggcatgcaattcgaatagagagcttgttggagtggtgttcttattatttgggatagagagtgggatggcaagacggttggaggtgttctaatgtttgttgcctgtataaaaccttgaacgtgggagacggaatgtcctcttgcaagttgcaattttgtatgctgtacaaatatatttggttaagatcttgtttggttaatcccgaccacaagagaatcaagaggaatttgtatgggatttattcaatacctatttggttaatccatttaatcactcctttagtattaacctaacaagcctaacgcctaaggcctaagaagaaatacaatgctagccaggtaaaatatcatgctaaatcagtttgcccaaaaatcatgttattgcaataaacaatattctaccatttttttttgaagcgatgggtctgttcatatgatgcgactacacaatcatttacaaatatattgaaaaaatggatggcattttgcctaagaaggaaaagaagcaactgtttctacgagaaaaactacatatagaacataaacaatttactagtatgagatttattgttccaaaatgcaaacatgaatggaaaaaagcctggaattacttaagtgtgtgtttagtttggggatgaagtttgatggattaggttcgtcctatttctattttttttgggattggatgattccatctacatctacgtgcttgacataaaggttataatgatcctacttttttaagggttggaaggatgtggtccatacatcaatgagagagaaaattagttggattggtccatctgtgtttggttcacggtcatgcatggataggatatggccatccatattttgttggatatagcgatctaattttttgtttggtttgtatggatatggcgatccgatttcttgtttggtcggagggatatagcatggatggaaaaagccaaaagttagtgggacccatttgtcatatatatttttttatcaaaatataatcattcgagatcttgttttaaagatttaattgtaacaaatataatggtgtaatcaaatcataaattagataaacagtttaggagaaaaaaaatcatttggagcttacttaacagaaaatcaaaccaacaacagccaatcagaataggacacatcacccagaccaaaactggatggattcatctagccaaatcggcctgatgcactcatccagcatattgagggaatattccctattctgggccgcctcatccaccctgccctccaatcaaacactacaaaaaaccggacggccatctcctatccagtctcatccacccaaccaaacacaccctatctagagagaatatttcattctagagatcatgacttcttacctatcttcaagctaaacaccctgaaaagttctccccatctagacctattccattcctccaatcaaacacatgctaacattcactctgagtctagcttgggtgatgccattgctaactccatgatgccttatcataccatatgttcctatcatgataatagaaaaaatgattgaagagattcacctattgacattccgaacttcgtaaagcacatctagtactcctacttagggtttagggtatcactcagaaccacatattaaaggctagcaaaaaaaattaccacttatttctgaattgttttatttggttgtcttggagacaaaattttgggatagagttttggatatcttttaggttgagttttttttatttcactttcctaactccacctcccgaacgcagaattagtgatgctctgagaccaatgtgttaggttagtactaaagtggaaccaatcccttattttgaaactttagattactaaagttgctgagagcatcactagcagtaccctactccgtctccgatcctattttttttcaggatttttgatgaaaaaactgcttcaactgttccctacgcttcctctcaaaaatcagtactccattctacttcactctcgctctccaaaagttgggaatcgttctcgctcccaatttccgtcacttgagtgagaatgccatccgagaaaaggggtaagcggaagggcgttgacactagatgatatgatcttgataagttgcgggtaaagggaggcatacctttttatttttatattttagggagttaaatataagccatctattggaaggaagtatatacctatacaagttatccccacctactaatctcctgcactgtggttgctccacgtcatcaagttgatcacacccattcgatcataagagacatcttgaccatactctcacaatggccaattacagtactactaggggcagtagaataaaaaccacttcaaacaaaacgccaggcaaaaaaaaaaaaacaccaattctcaagagtggattttaaactctagagggaacatgtatatcactcgaataattatgaaaaaatttcaaaacaattaagaaattgtattaacatgtagtataccactccaaaagcatgcaagttataatttaacttttataagtaaaacacatataaaagagtagcaaattaactacaactagttaacatatattcacattaaatttatttttttcgttgcaacatataaaaaattaaatttaactttacatgtttatgaagttataattattttcataactaagtgtcatacaaataacgagatgacgtctcgagttcttcctgcagccaggttttgaaatttcggttcgaaatttccgaaattttgccccccccccccccgaaatgctcacatctcgtccgaaattttcggttttttgcaatttttttgtgtatttggtcaaaattttatttaaaatcagcaaaatttcaaaaatttcgtaaaaaaaatccgaaatcggttctttcgcccacctgcagcagaaatcttgggctgtgtttagatacaaacaactttcagctttgaaaagaactaaacacagccttagtttggaaccctgcctgctgcaaaattataatatatgtttcgaaatttcaaacccagcctgttgtcgtcctgtactgtactcctgtgcattgtctggatgggcaactttttcatagcgaggcgagtcgtcgtgtgcgtgcgtgtgctggctcgtctcgtcttgttcggacatgacaagaacagaactgaccaaaaatggactggacgcatcagatgagggaggtccgagtatgcaggcggctgttatgcaaacagcctaacagcttaaacaaaatgctggaaacactgttgcttggcttggattttgctaaacatatgttatgattttgctacacacttcgtccttgttcattttgatttgttgtaatttgagaccgtaaggcgattaatcaggacgggaagaaaaaccactgaaccataaaagaccagactaaaaccagatcttgatgcaaccaggttcatcagatagattcatcattcatttataatttataaatttacccccattcttctacgggaaatttaactatttgccactcttgtgacatgtcaattaacgatttaccacaccttgtcaatgacatgtgggccctcatgtgtttatgacacgtgggcttagtggcaaatcgttaagcaccactcgtaagagtggtaaatagttaaaagccccttcttctacagacagaagaagcactttcttcttgagctctcatacagcaaccaaatctagacaaaatcaaagaatccccaaatcctccccccaagttcctaaagccccaagcgaacgccatcttctcagaacccggccaccgccgcgccgaggagggcggcggcaacgagcacggcgccgctcgccgcggtcctcccggcgttcccagtcgccggcgctggggcgggggcctggaagaggccggcggccagcggggactgcgcgggggccggcacgggcgcgaagaacccctggccgcggcggctgtgcttctccgacatgacgaggacgatgacgcgctcgcccttgtcgcagctccccggcgcggcgccgacgaagaagtggtacccggagctcgtcagcggcaccgtggcggcgccgccggtgggcttgtgggtggcgaccgggctccccgtgccgcagtggttgtagtcgtcccgcgtcacctccagcaccgcgtccgccgcgccgtcgaacttgaacactgcgccagcccaaccagagaaggagaagaaatcagaacaaatcaagaaacagaggaatccaagaaacactgaggaaggaatcgagctttgttgactcaccgaggttgtcgccgatgtggaagcgggtggcctcggcccacctgttgagcgcgtcgggctgcgccggcaccttccacccgccgccgttgttgccgccgaccacgaggtccctggcgttcgccacggccacggccgccgcgaaggccagcgcggcgcagagcacggtagccaacaccttcgccatcgaagtagggtgggaggactagcaaaagtagaacacgagagcacgagaggagggaaacaggggaacgaggaggaggagatgatgctgtggcggccatgggaggcggatataaatagggtggtggagtggaggtagccgttggggtattcgaacgttcgggaggggaggcagtagagtagcatcgggtgccgcgaagacgcgtggcgacagcattcactggcattgggatgggatgggatgggatgggatgggatgggaggagtggcaggctgttgctggcttgctgctgctgcttctcagcactgggaaaggatgcttctgttttggaccttaccgttgctgttttggccttttgaggaggcactgggctggatgggatggcactgttctggtgtagggctgtcacctatggcccgtggggctggggaggcttgggaccagtggagtggggtccacagggaagtgagtgagaattgtgtgaaccttggagttaatattcctcctggaagaagtgtttgtgttgtggcaataaaattatcattttttttaaaaaaaaagtcacatgaatcgagtggactgttgggttcagcctcgttatcaaaaccctcaccaaattagaccctgtttagatgggactaaaacttttgttcctatcacatcggatgtttggacactaattataaatattaaacgtagactattaataaaatacatccataatcttggactaattcgcgagacgaatctattaagcctaattaatccatgactagcctatgtgatgctacagtaaacattctctaattatggattaattaggctttaaaattttgtctcataaattagctttcatttatgtaattagttttgtaagtagtctatatttaatactttaaattagtgtttaaatagagagactaaagttaagtccctggatccaaacaccaccttaatctacgtcacgtcaacctatgtgatcctgaacaattaagacatgtttgatagagttctaactctaaaaattaagtctttctaaatcaagcttcacctcttgagtttattttgtgagagcactttagtccactctatttttttttattgttggagctaaaactttttgtttggacttccaactttagaagagatggagttggagctgaagatccaaacatgcccttgatttggtttgattttgcttgtagatgatcaaggcgtcgatgttggatgagatcatcgatcggctacgtcaagttcttgctagaggcggaaatttccctgttggggtcggagacccaccctaagggccgggatcgggggataagggggtgttcagttgggactaaaactttttagcccatgtcacatcggatgtttggacgctaatttagagtattaaacatagactaataaaaaaaactaatttcataaatgagagctaatccgcgagacgatttttttaagcctatttaatccatatttatcaaaactttactgtagcatcacattgtcaaaatcatggcgtaattagattcaaaagattcgtctcgcgaattagtctaagcttatgaaatgggttttataattaatgtatgtttaatactccaaattagtgtccaaatatccgatgtgacaggtacttgaaataagtcctggaaaccaaacagccccctaattatcacccgtgggtgaacgggggcgagccgaccgcacccttcatctcccaccaatcgctattattgcctgtgagtgaggcacgctgtgcgggccccagtggtgcgggtcatcaaagaggccagggacgaggcccgggttcatctcttctagtaggatggggccgggtggactcgcagggggagcagggtggacccgcacctgtctcgcccccttgccatacctagttcttgcagctcatcgattgtgcgttttgatttgagctcagctgatgctgatggcagctaaggatcgattagacgtgtcatagtgactgctttgacactgcaggatcagcaaccagtggcgaatccatgatttacatcaagatggggctaaagcaaactagatatatcagcacgatcagcatttctctatgaaacccaaatacactacgataaacaaagagataatccatgaaatgctattg

SEQ ID NO: 74271 - DNA, 49951 bp, Oryza sativa
aaaatggaaaaatagtcatctgggaggggccttagttcaagcccgatagagattaatctatatctatcgggcattattttagggcccgtcacagatgagtcacccgtcaccgatgagtcatctgtgacgggccctaccgcaaagcccgattgaaatagattaatctctatcggctgtaaactaaggcccatcaccgatgactcattttccatcttttatttgttgtgagtgcaaaatatatagctgatgtgtaataattcattttattagctataatacattttcggatagtaaatgatttcaaatggaaatatggtcaacaacaaagttgtagagcctttcaagatctactagttttattttcgtcatttttctatataatttttttccaacagcttgaaattgattttgacaatatgacaaatctaattaacagcatttgtaaatactaaatggtttcaaattgtaatatggtcaacaacaaagttgatcctctaatcaggatctacaccttttattttggtcatttgtaataaaacaaaattagccatattaatgactacacatatcaagtctttgcaataaaacaaaatacttcattcattacaatagataagtacaaatccatcggtcacaaggttatgccttccgtatgatgtgaacgagcatatgccacaggctcttggggatcatcgtcaaggtcaatgtgaggtcttacatgaagattatggttgtattcttcttcatcgacgacgttgtcaactcctacaattcggcgctttccatccctcacgatgtgcatcttcttgtttgaagggtcttttatgtagaatatctgctcgacctgtttcgcaagtacaaacggttcatcggcgtatcccaccttagatagatctactaaagtgaaaccttccttgtcggctttgacaccagtgcgtagattcacccaacggcagcggaacaaaggaaccttgaacttgacgtagtttagctcccagatctcctcaatgcggccgtagtatgtgtttgacccaacttgatcctggaatgcatttatacggatgccgctgttttgcactgtgcttttgtcatcttgtttgacggtgtaaaatgtgtatccatttatatcgtatccttgccatgtgtctacggtccaagacggtcccattcccaacaactgtaatgtctcatttgggacatccgtggacattgtcacacgattcatgaaccattcgttgaaccgagaattatgttctttgttaatccatgcatcagatcgccccaagttctcatctcggattttcgctaagtgctcctcaaagtatgggccaacttctgccatatgttggagcacagcgtaatgaacctgcgcgtacgacgcttcatcgggcctaattcttttccttccgattgtgccaacacctgacaaccttccctcgtgacgaaacacaggaactccgataggatcggcatcggacatgtaattgacacagaactcaatagcctcctcggtcgtgtaaccttcaatgatgctctcctcgggtttagctctgttacgaacgtatgacttcagaactcccatgtacctttcaaacagccacatttcccttagaaaagctgggccacatagttttgtttgcttcaccagatgaacagggagatgaaccattatatcaatgaaagacagtgggaaaaaatatccaggtgacagagggtattcacaatatcaatctgcagcccatcttgatcttctggatctataaccttctatccaattgcattgaagaaggcgcacagacgttggatcgtgtgacgcactttcggtggtagaatgcctctgatagcaactggcaagatttgtgtgattagcacgtggcaatcgtgagacttcattccaacaagttttagatcgtccaatttaacatacttacttatcctcgctgaatagcccaatggaactttaatatccttcaagcatgataacattgcgatcttctcatccttccacagtgtgtggcaggctggagggaggtacactttacctgtctctgcatctcgtatgggctggagttcactgcgaatattcatgtcctatagatcaaggggcgcgttcaacccatcctttgtcttcccgggaatattcaacatcaggctaaccaaactctcacacacattcttttctaaatgcatgagatcaatgcaatgacggacatcaagatctttccagtaaggtagccgccaaaatatggattttttcttccacataccattctcctttgtcttgctacgttttcttttcttcccaaactcattgcttttgtccttgaccatattgtggacctcatcaccggacaaatctttgggagcaggctgaagttctctcttaccgttaaaaattttcttctttcttctaaatgcgtgacgtagcgggagccacctccggtgacccatgtataccatctttcgtgatttcttcagccaccggcttcgtgtatgttccttgcaatcggagcatgccttctttccttttatagtttgtccggaaagattaccgagtgcagggtagtcattaatggtgcagaacaatagaactcttagcttgaagttctcctgaccatatgcatcccaagtttccacaccttctttccaaagaatctctagatcgtcgataacaggctccaggaatacatcgatatcattgccgggttgcctcggaccttggattaacaagcacaacataatatatttctgtttaaagcataaccatggcgggaggttatagttcgcaataagaactggccaagtgctgtgagtactactcatgtcaccgaaaggattcatgccatccgtacatagacatatcctcatgtttctagggtcggcagcaaagtctttgtgttttcgatcgatattcctccattcaatcgaatccgctgggtgtctaagcataccgtcattccttctctccgtggcgtgccaacgtactaacttcgcttcgttcgggttggcaaagattctcttgaaacgatcaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcgttgggacaagcgtgaattctacggatctctaaccccagtggacacagaacctgctttgcttcgtatgtcgtctcgggcaatgtgttctcaactggaagcatagccttcaaaattcctaaaagatctgtgaaactcttgtctgtccatccactacttgccttcagcttcattaggtccaaggtaactgacaacttagtgtgttttgctttgcatctagcgtacagaggcgtctcggaatcactgaccaacctgctgaacttcattccatctctctcattctgggctgggtcctcaacgtcacgtaacatgtcttgcagcagatcgtgatccacatcaaccatttcacccccaatggagaaggtataaacatgtcatgctcatcttcatcttcctgattatgcgcaccacttctgtctgctgctgctccacttcctcattcttgctctccatgcttcacccaacatgtatagccctccatgaatcctcgttgtatcagatgaccgtgtacgtcctctccgctatcaaacatattctcttgcaatctgcacatggacaacacctgtaatcactgtttcttcttatccgatcctcctccgcggcgttcataaaatttattatgccctttctgtactccgtagaatgacgtttcaaattttttgcatacatccaacttcgatcaattgctacaaaataaaaaaaaacgaattagaggcacatattataagatcagtattgcaaaagtaagatgtgatgaaattgctcaattaatgattaatattactcacttgattgatccattttgatcacttttgggaatttaatttctgttttccttggaaaaatgacaaaaaatcgccccctacagcctcccaccaaaatagtgaacagtggcatacagttacactaggtggtgagggggtatttatacttgcaacaaatatctgtaatggccctacaacaatcaaccgtgacgggcatacaagtaatctctatcgggccttcataaaagcccgtcaaaaaagagtgtcatctgtaacgggcactaaacttatctcaatcgggcctctagttggagcccgtcacagatgaccctcatctgtgacgggtttcttttagggcccgattgagatatggaacccttatctcaattgggcctcaactatagcccatcacagataagtgtcatccgtgacgggctttagttttatgccgatataccatggttgtgcgaccatatctcaatcgggcgaaacttcagcccgattgagattacttccttctgacggcccgcaaattccagtcttgttatgggccgtcacagatggaaggatctgtcggttataaccgtccctgtcctgtcttcggtgattattctcatgatctcggtttttgtcgttgttgtgtcggtcattatgaggcgactgtctcgatcttcattgggggtattccctcggccgtcgtctctttctcaccgcgagggagagcaatgatggtgttgtcggtgcatagtaccgtcctcacgacgagaaggggagtgatggctgttgatggtcgttatcgatcagtttcgaccgtcaatattaccaaaatagagtagaactagtaatgcttgcaatgcataactatgtaagaataacaatattccactagtattaggtttactaaccttttgcagagaataaccataaagtagaggagaatcgatatcaactcaaacgataaatcagtcggacgatgtcaagaatcagacttatgtatgaatgggccaagaactcagaaatgacacgatcaattgggccaaaattcacaagtttgcagagaagaataatagaggaggccgccagccaaaccatgggatggttgggccagccccaggttcagccgaacctccctcatcgctgctggatgcagggtttcttctggacagtgtggattagctccaaatgatggttggagggtagttccgaccattccaaccgtcacaaccgtcattgggaggctatataaacccctcaccttctcacttcactcacaaacctcaagcaagagctctctcatttctctcaagtttagttcagtagtatctagctggtggaataggaatagagtagaaatcaggagtccggaagtcttcggaagagtttgggtatggctctagtggcttttctcttctcttttgtaagctttgtacttttattagaatactcttctgtatacatttatggtattgaaatactttccgagtatatgaatgcctactttacattatattcatgttatactgaatatacggctagcttaactgggagatgctttggtgcgggtataatgtttgcttatgcaattactctatgtcatgacgatgatattagagtagtatctggtagtttagacgtggtgtctagattacgggatatcattatttggggttatatgctgcggttgagaggtgggccgctgatgatgacagctcagtatggatattcctccaggcctatatagaatcctaagttaattctctagggagggtatggttgtatggtcatgatgggctgtcgtaaggaagtcgtcagtcaggggtggcttctcaaagtaccaggagggcatcggatagagggtattatctagtatatcggttaactagaatatatgtatactatatatattagaagtataggaatagattatctttctcttttctttccacttagcttagataatatattatgagaatgagtggctaatgcttgtgtgtcactctacccttagattatcttaacccctgcttaataatataattatcacaagtagcatataaattattagtcaagttctctctacatgatcttcccacgggataaaataaatacgatacccttggaatactctcgggtgaaatgctacaatggtatatctgtgcgcttgcggataaactctgtagccataatataccaggagtatttctgcgccattgctgggaattatatttctagtaatgtcgttaagaaataccaacaagcatttctggcaccgttgccggggaagattcataatagagattacctgaactaatattttatatttacctctgtataatcattttcctttgcaggctaaccttgattgtttttacttttgttgtgaaaactgggtagtgcatgactggtttcaacttgccggagaacttcaaagaaaatccagaagctttcttccagagcgtcaggccgcgagtcgttgctccacagaaaactctaccgacaaagaaaccagccgtaccagcgcaaccaaccttcaagactatggctgacaagacccttcgcgagttcgctgctctctctgctaacaatatggccattgggccgcaaatcaacatgggagacatggatttcaacttgaagtccaacctcatcacgatggcgcaggctagcccattctatggcaagcctaacgaggatgccaatgctcatctgcagcagttcttggagatctgtagcacgtacaccatcaagggcgtcagtccagacgccgttaggctaaggctgtttcctttctcccttctcgggagagcgaagtagtggttctatggcaaccgtgctgctgccaacacctgggatggacgactgcaggagtatgtggccacctgtcctcatcatgggatggacgactggctgatcctgcagaacttttacaatggactcaccccgatgtcccgcgatcgcctggatgcggcagctagaggagcattcttctctaaaacggttcgaggagccattgatttaatagagaagatggtcttcaatatgggttggagcgaggaacgactccagacccgtcagcgaggcatgcacaccgtcaaggagacggaactgcttgctgccaagctggacctcctaatgaaacgattggacgaccacgacaaacggctacaaggcaccatcaaggctttggactcacacgttacgtgtgaggtctgcagcaacacgggtcactctaggaatgactgctcggaaacccgtgaggaggcgatatacatgggcaacaacaacaacggtactgtccacaaggagatctggggtgaaaacaaccacgcccatattatcaaggaggtaacaacaacggtaacttttctaaccagccctccttgatggatctattctttgtggaagctaaaaccactgatgcactaagcaaaaagcttgcggccaatgacaagatcctagagaacataaatgttaagttagatggcttcgcttctgctttccaaaactagctgagcttcaataaaatgatagaaacctagctagctcagttagcatccttagtccctacaaatgaaactgggaggattccggggcaacctgactcctccgttgagaatgtcaaggcgatcacgacgaggggaggtaagtccactcgtgatccgccgtatcctaaccctgcaggaactaacgggattgcaaaagaagcgccatctagtgactcggctgacaaggaagttcagccagagaagaccatgctgcaggagtactgtgacacacgattgctaccgtttcctcaacggagtaggaaaccgtcagttgacgaacaattcgctcgttttgttgaagtaattcagaaaatccacatcaatgtgctgctgttggacgctatggaagtgccaacatatgcccgttatctcaaggacatactcaacaacaagagaccgctcctaacaacggaggtggttaagctgacagagcaatgcagcaacgtcatactccacaagctcccggagaagaagaaggatccgaggtgtcctacaatcacctgctcgatcggggcacaacagttcgaccaggtcttgcacgatcttggagccagtgtcagcatcataccaaaggacgtctttgacaagctcaacttcacggtgttggcatcgacaccgatgcgcctacaactggctgactcatcagtccgttacccggcagggatagcgaagatgtgccagttaagatacgggatttcttcatcctggttgatttcatggtgttggatatgggcacagcaaaggagacgccactcatcctagggcgcccgttccttagcaccgcgggagccaacattgacgtgggaacagggagtatccgtttccatatcaacgggaaggaggaaaagtttgagtttcaaccgaggacggaacaatgctccatggtcagaataaagtacggggcgaacccacagaaaattcaagtggtcgaagtggagccacccaagacggatagcctggtgaagttcatgcaaaatttcctggataaggaaacaacgatgcccatgaaccgttattggaggacgccggtaaaaccaaccataccggccaagaagcaagagcagccgactcagaggaagacgtcttccgcacctaagacaaggaaggtgtggaaggaaaagccaaagacgcctgctccatcacctccggagacggatggaaaatccacgaactgaatcagaagaaggtacaatcttgcacgtcggactttaaatgacgtgacctttgtcaacaggtacattggtatgtatccgcatatttattttcaacaatttaattcttgcatcaacacatgtttgaatttcaaaattgtatttatgatttttgaattttgaggaaattcttcagatgaatttttcagagaaagccaaaataaagttttcaacgaaaatttactgttccacgatcacattgaccgttggaatccaacggtcgaaagtggggctggttgagcccactaggggtggttcggccgaaccggccaggcaacgattacgtgccacttttggcagggtaactgctagtgggtcccacatgtcatttatgaccgttgtgggtaccctataaaagccagccgaccgagagaggaaattcaaccccatttcaacacattttcatttcctcttcaaaatttgctctcaagttcattgaagctttgatagtttccctcaaattcaaacactaattgcatatatacaagttgctttggtgaaactaaccggcaggtgaaactcttgctattctaacccccatcgagttagtctgttcttgctccattgtgcagaatgaggaggcgattgtctcatctgttcaaggggtccggctcttcatcaagtcatcatgacgagtctagtactcgttcatcagctgatatctcgatggaagacgccgaagctccgcgatgactcatgaatggcaccgacctcggccttgttggtgatcgggaaagacaagcctactacatgccgagcgaccgggagtatgctcacacacgagaatactctccggagctgctgaaaaagataggtatagatgttgaatttcgtgctatttggaaagttgttggttggcagagatttgttgtggtagatgagcctggttctcgtttgcttactttgcaatttctgtgcactttgaaagaaatagaagatgtaatttcctttcgctttttccataaggagtatacacttacatggaaaggcttaagcacacatcttggttttcacgattcctgtaaaatcgatcttcagaaaggaatttctgggttcgagaaaaataggttttgggaagatatttctggtgctctaatttgcaagaaacctaggacgaatgatatccataatgctacacttaggctcatgcataaatggattgctatgactttgttttctagaggtgatcttagacccattaggggggatgaattgattatgatgtttgccatggttagaaagatcaaaattgctcctgtgaaataaacacaataatggcaacaatttgctgatgctcagttcgcaaacttcaacaacataatgcagcaacagcacgatgaccttcaagcgtacttccgcttccaggggttcaatccttaccaaggaccctgagcgaaagctaagcttggggggggagacatctctctcccactgaggtaacttgtatcacattgcatatttccctttccaattgcatatttctttccaattgcatcttataaaacttgaaaataacataaaaatttgcaaaatagaaaaataccaaaaagataggataggtttgagtcatgctaggtaagacaagatagttctctttgttgaaatgatgaatagttgctctggtttatatctcttatatatgggttcatagtaagcgctctctcaaaaggttaaatataagtagccaacaattatctgaaaacctgaggtaaatgagctgcacttgctgatctgagtctaagttgttgtaagatatgagatggtaaataagagttgctatgatcctgatactagtttggcttgaattccggatgttctgcttttcaaaatgataaaattgagagtttctcatttgataaaaattcctaccaaagccaaaaatgtgccatcatgattaaaccatatacattttggttgcttgccattccattggactttgtcaaactcttgagacttgtgtagatacttctcatgctctatgatcaaaatcatacacccgtatttatgcacttgctaaactcctacactgggagttaagcaatattccattccatttccatattgccaccaaaataaattctccatgctttcatgtgctttcttctcgtaaaaagaaaagttttttccaaaaaaaaaagaaaaaaagagaaagagggaaaggcatggttatgaaaaataataataatcaagttatgctctcacaagcttgagcatgatgttaaaaaaatgtagccatgccctctcctaatcaataaaagaaggatttttgggagaagaaagtaagcaataaggagaagcaatttctttattttttctcatgtaccactttcatcatataccacacacacattgcacgatcttgaacttgagtttgtttagtcatctgctttagtctaagtttttgacttagtaataaatgtgaatgcaagtgttctatgtttgatccctaccgagctccacatatcaaaccttagagtagaaatcaaaaaagggcaaaatggtgaggaatccaaaattgatacacttggagagactgtgaatcatatgaggaacttggctttctttttcaaaatcatttgaaaacttccggaataagagttgaataaatattgggtgattagtgctctaattattgttctgtctttcaaccgcccaaggcaaggagaagtagtgtctcgtgggaatcaggggtaaggataagccatcgtgccaaagattatttaatccgagagagagtacatataccttacacatgtatctttgagatatgcagcctagtagcaactcctgatcaataaccaagtctttgtttcctttcgtccttcactcgggatgagcaaaggttcaagcttaggggttttgttgacggtcgttatcgatcagtttcgaccgtcaatattaccaaaatagaggataactagtgatgcttgcaatgcataactatgttagaataacaatatttcactagtattaggtttactaaccttttgcagagaatacccataaagtggaggagaatcgacgtcaactcaaacgataaatcagtcggacgatgtcgagaatcagacttatgtatgaatgggccaagaactcagaaatgacatgatcaattgggccaaaattcacaagtctgcagagaagaataacagaggaggccgccatccaaaccatgggctggttgggccggtcccaggttcggccgaacctccctcatcgccgctggatgaagggtttcttctggacggtgtgtattagctccaataacagttggagggtatttccgaccattccaaccgtcacaaccgtcattgggaggctatataaacccctcaccttctcacttcactcacaaacctcaagcaagagctctctcatttctctcaagtttagtttagtagtatctagctagtggaataggaatagagtagaaatcaggagtacggaagtcttcggaagagtttgggtatggctctagtagcttttctcttctcttttgtaagctttgtacttttattagaatactcttctatatacatttatggtattgaaatattttccgagtatatgaatgcctattttacattatattcatgttatactgaatatatggctagcttatctcggagatgctttggtgcgggtataatgtttgcttatgcaattactctatgtcatgacgatgatattagagtagtatctggtagtttaaacgtggtgtctagattacgggatatcattatttgggattatatgctgcggatgagaggtgggccgttgatggtgatagctcagtacgggtattcctccgcacctgtttataatcctaagttaattccctagggagggtattcgtctgtatttagccccggttgtatggtcatgacgggctgttgtaaggaactcggcagtcaagggtggcttctcgaagtatcaggagatcatcgaatagagggtattagctagtatatcggttaactagaatgtatatatactatgtatattagaagtataggaatagattatctttctcttttctttccacttagcttagataatatattatgagaataagtagctaatgcttgtatgtcactctacccttagattatcttaacccctgcttagaatatgattatcacaagtaatatataaattattagttaagttctctctacatgatctttccacgtgataaaataaatacgatacccttggaatactctcgagtgaaatgctacaatggtatatccgtgcacttgcggataaactctgtaaccataatataccaggagtatttctgcgccattgctgggaattatatttctagtaatgtcgttaagaaataccaacaatggcgacgacggtcgttgttgttacaatccctcctgcttcgccgacgtcagttcagatgttcgcgaagattgccatcttcacggcgtggcggtgtaggatctcgttcttctcgaggtgagcggtcgccggaggtatgtcttctgatgaggtcttctccatccacgtcctcggtaggtcgctcttcgttcctgctgcttcggcaaatgcgacattgaggttcgtcacggtctcccgcagtcgctctgcccactggatggcgtctgggtttgttgctggatcaaaaggactttccatcaatatcgcgtctagattccgaaactggtgagcgggcgttctcgctgctacagacacacttgtctcagtattatcgaccacgtttacatgagatcatgagatctagatatgtggatcggacagtaagtggctcccgttggtgaagtacgttgaatccctcgttcccaatacgcgtagagttcagcttgcacgtgaagtatcaccggatagtcctcaagagtatgcttggttgtcttatgcatagaacaccaagatctcagtcttagggtggtcatccttgtcggctttgatctttcacatggggggtaaatttcagccgcctgaggattcctcccgggtgttggggccgtcgatgttccgttctccacctgagtgggaggaattatcggcggggtgtcgtttctctcaatcattgccgtatctatctcgttcccgatgataattgggccagccgagattggcgtaacggtatagactggaaagtcaatggacctgacttgagtccacaccagcggtgtcgaggtagaagctccttgatcgacgctggtgatggcactactgtcgggaagtgttgaagtcatactggtagatccttgagcaccaagtccctctacctggcacgccactgtcgacgagggatactcgcggatcggatgagttgagtattgaggtacgttggaacgagggtctacgtagtacgacatcaaacaggcaaaagaaaaggattatactggttcaggctccctatcaggtaatatccctagtccagtttatatgagattgatgatgatgagaacagattacaaagggagtagtcgaaacagacggtaccgatgagatcgtagtcgaaggattcgatgagatctcccggcgactgggctccgtgcactccagcttcggaaactttggtgggtgtgttagcaatgagattcgatgcccttcacctccccttaggggtcccttttatactgtggattaccttgaccccaagtaagtcttggagatatgtaaattggcacgatatagcagagattctaccccctccgagtaggactccggtaatttcttaactcgtagaaatatttttcataatttgagatagattcctaacggcgtatacagaaacgatccgtgcgcgtgaaggtatacctcatcggtatatttcataagtcataggatagaaggtatgccttatccgtaaccctgacagcatgcctgttgtaaccgcatggcggcttagcatagcaagagggagcggctgccggcggcgcccggctgtgtgttgttgtaactccgataggctgtaatatgctggaacagggaggagcacctgtaatcagtgccctggagatgtaggcctcagctgaactccgttatcaaatatcatgcctcgatattgtcatgatgtctggatcttctatggtatttcttccacgtttggttctcagtgtgctatcgtggctggttttataccagcatagctgtttagattggagtagatgcgaatgttgttggagaaacatctagtttttcctttccttgggcagagtgcctcctgtactgaatgattgcgaagttgcttgagatgaacattcccacagaagcatggtgagaaatggagagtattgtttaagggttaatttgatttatgccaatacaaatatggcatattagaaaaataccgttgcaattcacgttatcggttaggtgtcactgaaaatttctaaaagtagtagggtgtccgtgcgttgctacggggaattttgttgatcacgggaaaaaaaaatctggcaatccaactacaagtcatagttgttctaagattaatttgaaagcaagatatatatgttattattacataagcgtagtgcaacctttttagcgcataaaacaatcttatggtatttattaaattataaaaaaccaatatagatagaagataactatgaaaatttgatgatgtcatacaaataaagcacaaacaaaaaatctaaaacatcaagcatttctaaatatggtattttcggttaggtgtcactgaaaatttctaaaattaaaaccatgccactcccattactatttccgtcctcctctctcatgtcgacatcctcaccgtcacagcccgcccccaacgccaccgctgcggctgaccttgcgcgcctccaccggccattggcgcctcgcccgctgcgtacaggcggggtccgttggcggtcgccgcccttgttccattccccaccctcgaagtgcgacgacggcgacagcgtccgcaccaccaccatgccacaaaactcgccggcggtgagcgttcattgtgcggtgtggaatgcggcgcgcagtgagtaccagagcatgagatcagcgacggccgggatgtggcagaagtggctgccgacgaggcgcccggattcgtcactactaaaaaaagtgtttctccaggcgacccaatcacatttttcgcaggggccaaaccatccgcatgcacctcaacgcctacgaaaatagttgattttcataggcgtgcaacaggtccacctgcgaaaatagcttcaagcgctaaaaaaaaatgggcagccaccgccgtttccggcggtcgcttcccgtttccaatccatttcccacccattccctatccaatccagtgaatccacattcaatagagaaatcaccagttcatccaaaatcaccgaatcaattctagcaaagaaaacaaataaaatcattcctaaaatcacggccgccaccctgccgtcgtccgccgccgccgcacggccacgccgcaccgtagtccgcgccgacgctgcacggccgcgccccgctccccttcggccaaatgtgggagggaggggccaggagccgctatcgcggcctcaacccccctcaccgccgtggctgggagccgcgccgcctcgaccctcctcgccgctgccgccaccgcctcaaccctcctcgccgccgtcgccatgtctgccctccccccgcccccctccggccagatctaggaggaaggggccgggagccatgccgcctcgaccctcctcaccgcagccatcgcccgccgccgcctccagccggcggccggggagaggaggagaggtgaggggaggggagaggccggtgaggtgtggagaggtgtggaggggaggagaggtgtgagtcttagaaaaaacctagctcgcaagtctatttatattcaagtctattttcgcaggcggacagcaaatttcactccgatttatatttttgtaggtggtcatttcgctctaagggtcatgtccgcatgcgaaaataagaccctcacgtcgagaaaaatgctttttctagtagtgcgtggaacaaggacggcttcttgaaccagttcgccgtggagatgacgacataggcacatgagtaactgtatatagttcctggccagagagtcgccgacgaatgccttggaccggccgctgacgacgtgcaggaacatcgctctggatctcatcgcaactccacgacgaacgcctgcccgcgcgcctcaccgtcaccggtcgcgctgcccagcccgctagccgcctgcgcgcgccggcgcgcgcctcgccgtcgccggacgcccgaatgcccggtcggcggtcgcggccgcggcgtcgcctcgccggccgcccacaggccacagccggctcgctggctgctcggctcgccgctcgccgcctccgcacctcgcgcctggccggcgcggcagtgccccgcgcccgacggccgcctgcgcgcctcgcggccttcggcctcccatcctcgagcaacatcacagcaaccgagcattcgagcaactgcaacggtgagtcgccgagtcggtgaactgaagtgtattgattattttagcttcatagtttatgaatgactatctagattactagattaggatttaggaaccaccgaacctgtgctgctttgctagtttgctcaattgctctttgatattgttgtttgtaggtttgaaacatgaagagaaaaaaagggtcccatggttaatttaaagagtttttttagaaaaagttgctaaaaaaaagaaatcaataaccaactggttctttgctcgcggtttgtcaataagacgggacaaccagttgaacggtttcttggtcttggttttgtatgctcaataaattaacgcattcaatttatggtcaattctattcatttataactttatgaaaacatgtttatacctttacatattatacaactattagaccttgggtttgaaaattttctctctctcttacaatttcgaatacccaagttgaaaaacctgggcccgatctcgtcgcaactccggttcgtgtagttcggcgcatcgccatcgtcggcgggggcggcaggcacccactgccgtggaagatgtcgcagtctccacttacgagctgcccacgagccaaacaaggtagagccctacaaggagtacaattggaagcctgcgggtgcgcagtccatcaaaagattcaaaaccatggccatagcagccgcaacatccctcggcccatgtcatagcctcaaagagacaaatacgtgcgcatcaggaataagttcactttgtgaccctcaggagtgatcgaaatctaatccgtgaccctaaaccacaaaaccggatatctcgacccccaaactcttaaaaccaatacaaatttactccctcggcggttttgtagagcggtttcactgacgtggtgcctacgttgcgatattgaccgagtcttcgttccacgtggcattgacgtggcacttacgtggcattagaattaaaaaatatgcgtgggacctgtttgtcattcacacaaaaagaaatgtgggcccactaacatgtggggcccatatgtcagtcctcccttcttcctcctccctctctcccttctctctcgttctctcccttcttccccttcggcaggcggcggggcatgggccacggtgtggtggcggcggcggtgggctggagctgatacgggttctggagcagggagctcatcctcccggtcgacggcgacggcgatgatgtagacaagggagcggatgaggctgggtagtcggtgccgcgatggggctgaggctgaggctgcggggggagctcgtccggcgggtctatggccgtggatctcggctcgatgaagaggcggtcgccacccccctctggcggtggtgccacggtccccggagtggagtcgacgatgctgaggccagcgctcggcgagatgggatctgcgtgttggacatcaggttggccaacgccggcaggtacgccggcaacatcctcacctgcagagacaaacaaggccatggcctctccctggttccaatcgaccatggatactgtcttcctgagagtgtaagcactgacgctgacagattttcttctagctaattgacttccattttgttcgttggtgatcatgcatcgatcacgcatgtgcagtttgaggattgcatattcgagtggttctactagccgcagtgtcgggagccattcagcgaggagacggtggagtacataaggtcactggacgccgaggaggacatcgccattctgaggttccatggctgggagatgccagccaagtgcgagcgcgtcctgcgcgtcaccaccatgctgctcaagaaaggcgtggacacgggcctcgccgcgttcgacgtggggagcatcgtgtgcagggatggggccaggcagtcccgggagtggaggagtcgacgatggcgaggccagcactcggcgagatggggtcagcgtcgtggaggaagtcgaccggcgggggttgtccttggcatcgtcgatggcccacgacggaggcggaggttgaaggcagcggcccacgcactagcctcgctcgccggccaacacggaggagccagtgtcgtccttgttcgccgccgccgctgccgctccggccctcgccaaatggaagaggggaggaagaagaaagagagatgagttagtgcgccccacaaatttttgtgtgtgaatgacaaacgggtcccacacatattttttaattctcatgccacgtaagtgccacgtcaacgccacatggaacaaagactcggtcaatatcgccatgtaggagccacatcagtgaaaccgtcctccaaaaccgctgagggagtcaaattgcactggttttagaagtttgggggtcgagatatccggttttgtggtttaggatcacaaattagatttcaatcacttttgagggtcacaaagtgaacttatttctgcgcatcaaccagcgcgagtgcgtgactgcgagagcccaagcagatcgcgaacgctctcatcaactagggccacatcgtgcagccaatgcccaccaagccctacgcctgccttaacatcttcacgacctagtgaagctgatttgcttcattcacttcgccttatttgcttcacttgattatctgtttgcttctgatttgctggtgcacatcgcttgattcacttctccccttcggcctcaccctcatgcaaggttgtcatatcatgatccatattctagtttcttacgatattatgatcctgtcaaattgtaacgataccgatcccgtctagtaccctatctttcatagtgtctcgatcctattgtttactttcacatgatcgtatgaaatcttaggtgctatcctgattctatggtgtctacgatcctataaattattatttaaaataaggtggattgataataatatgaataaatatgctcaagtttacaataaaaaccaattaaatttatcaaaatcattattatatgctttaatttatataatgtattattatattttatataaaaatacgtaatttctaaaatattatagtatctcgatcatcctatggtagtatcttataatactataatactacaaatcgaaaaattatcctacggctccattcgcttcttctgtaaatgaagattaaaagcgggtacgtaaaacaaggaaaccattaacatgtaattaattaagttttagttattacaaacttgagaaatggatttatctaatattttaaagcaacttctatatatataaagttttcgtataaaatatattgtttagcagtttgaaaaacgtgccaacgaaaaacgaggaaagatatgaatctttcattttaatgaaagttagaacggggcctatatctaaatactgattatcttgcccttacgtagctaaacgagcctagctcgttatgttggcacgagccaaccggagctggctcggctctactctactcgtttttgtttgagcgggaaagccgaaagaaacccgcgaagccaaaattccccaccgccgccgcggcggaaacaactccgatcttggacaccgacaccgcaccccgacggaaatccacgcggagaacggaaatcgcctccccccctcccctcctctttgatcctctctaagcacgactgcattgcacgaggttggttgttgcgagttctggcggcggggcgctgcccgcgtagtcggggcggctcgtgcagtcgcagttgagcggggcgagggcactggccgctggggcgagcaggaggcggctggcaacgggcggcgacgcgctgcgcctgtgcggatctggcgcgtggaagcaggcggtcggtggtgaggcaggaggttggggggagggcgtggcaggaggcgcgcttctccgcagagctggtctgctctctgctgcatgcattcttttgttgtattgttgaatttcaatgagattttattggatttatgagaaattgagccctatgtttcagagttttgatagatttgcaattggggaagaaaacaaaattggttatttgttttacaagcaattctagtaatactcacccaattgatgagggaacaaatcaaccaaatgtcattagctactttgagcccattccccttttttttggtcctggattcgtgcatttactgctgcttttcatcaatgtgcaacctatttatacagtgtagctgcttatgccaaagggtgacagaaatcaagaataagcaatagtattctgtttgcttggtgcaatgcctggttattacgacatcgatgatatcctgatggaggaggaggtaattttatgattgttttatcgtcttctggtgtgcttgcacaaatatgatctaaatgtgtttctactcttactgcagcctatttcggtagtttttcaagtgagtgcaaatggtgttggactactagatcctggcgctgaaagaaacagtgtaagtgacttttgcacctatggtttagtgctatggtgtaacttcctagggcacctactgacctttcttcctccatccctattgttctagaaggaagttggtttggaatctatgcagtagttaattgagtttatctgagatgagtgttatatgaccattggattttatttattaaaactgctttggaatgctaggtgtactcttgttggcttgtatgacacattttctagtaaacacaatctggtggtggatgcttttttagtttgtcttgtaaacaccttcacatcatttcttgctttggttggaaacaaaagtgagagatttgctccagttaaacattgtatcttctttatctccaggttgaaaagggtgctaaggtggaccttccattttggcttgcacatgggctgctgtctctggaacaagcagtttcaataaatgtacctccttgcttcacccagaagtaggtttcatcataacttgtttttcattgttgtatacagagaatcttagctagaattcatgtttcaacagatttacatgaaagtacttcttgtcaacttactgtagaggtcttcttcagtaattgcaaatgcctggtagtttcaatatttcctagaaaagttgtcctaagatcataacaacattgctacagaacccggaaggagatccaagctgatgcagcctgtgttgatttgaggattcgttgcccttacttctatgagctaggatgcaagatagtccctttgtaagttctgaaacgatttcaatctcatgcacttttaggatatagttctggcttactacctgcatccgctttttacttgatgccctagaatctgtgctgtcaacaattctaaagtttgaccaccggtaaaagaaagcagagatattatttacctttgtgttaaaaatcttactgaattattagttcatattaaaatgtttctatgtgatatttgatagaatagccacttcattgctttacaaaattttgtccacaaatgaccttattaacatacgctataatacttttcttttacaatgactaagtaattctttcggcgtacaacatacatttttctttgtgcatgtttgtttcaatattataaatgcttttgagtccattgaagatagattctttcatactttcataagacaagttcattttaaacccttgaactttgcaaaatttctacttaactccaacaaaaaaaatagatatgtttatctgattatctccagacttcaaacaatagagcaagggtggttttggaggttgttttgccattatggacaccaacttccatgccataacatcttggaaataccacattggtaattatcacttcaaataagatcgaaaatacaccaacactcactttatttcagtaatgtctctccttttaatcaacctatctatctttttgctcccctctcttttatccaaacaaattgcttggtttcacagaaaacaatcataagcaatagtgagttgctcctctccatattatggctgcagccttgctgatgtcaggcagcggttgtgaaagtgctgcttgatgaacatgacgttgctcaaaacatagctactgtgtgttaataataaaatatatctctgattccaagttggatttgatattggtagatcatccgaaattaaagaaaccaccttcaattgaaactctagtgagaagtataaacaaaaaatgtggaggcagtggtaagagaagaggttggtcggccatgccttgccacttcttggtatctagtcttgctgttcttgttttgcacaattgttattttccatctagtgatttcaggttgtttaacctaatcttcagcttcagtatgttaacaaaccattatgtacagatgatcatgaatcatataaattgctgtgtttgctacagataatattgtatcatacatgttcgatataaatgaatgtgtctgttttattaacacacccttcgtattttgttaaagcaaacacttgatacatttccacagttctatttgtaaaattagcatatatatatatatatatatatatataagctctattatacacccctcccttagaataactattctacaccccctcccacctcccatccgtccccacctcctcccctcccatcgctcctctctccctcccgcgcccccttccttcccgcactcctctcccccagtgccccctctccctcccgcgccccctctccctcccgtcgtgcccctctccctcccatcgcttctccctccgattccccctccttttttttttctctccctcctctcttttttagaaaaattaaaaataaattggtgaattcaagacttgaacccatgatctcatggttcatgacaagcagttctaaccaaatcatcgtatgatgatttgtgaacaaatcagttatgtacctataacaatcataccttgttactatgattcggcagtaacattatcccagaagctgcaaaaatgtataggttgttactgcacttttggcagtaacaatatgacgaaatttgcagtaacagagaacatgcatagtaacagtggccctatagtagtaatttttttagatctagagtattttaaatctcaatatttagagagtactaacgtacacgtcatgtcttatttttctaacccatttgcatcatggcgttcgtaaaaaaaaagtgcttaaccaaactagaaccatcataactattttttaacgttgttactgcgaaaagcagtggtgttactacatattggccatcgtgttactacgctgttccagtgagacaaggactaaaaaagaggtaaatctcaatctttagagagcaatatctctcacatcatatcttgtatttccaatccgtttgcaccatgaagttcataaaaaaacgcttaacgaaacaagatccatcatggctactttttgacgttgttactgcgataatgtgatcttgttactgcacgatgaccgtcctgttactgcacgattcctgcaagacgagagcagcaaagtggtgggcgggtttgaccggcgggaggacgctttgaccgaggtgggaggggggttttgggccatagggagggtgggggaggtgggtttggcccatgggagggggggtgtagaatagattcactatatgtatatataataaataaataaataatcttttgtgctaaatttgtatttagaaggtcgaacaagaaaagctaacaatatgtggaagtactgtcgaagggcaatttgtaaagctgatgtagaggtggagtggtagattcgccaccactaccaccattgcctttttaaaaaagcattatggatattggtaagatttagtttgaatattttgcagattttagttatctccgtaaaccaactgtgataggtttgagtttaggatttgtatgtgatacatgaaaataatcagtagatttgtcctgagaagtactttcagaatattagtcttgttaggtttaacaaatatatattacaataaaaattagctttcaaagctgtattttgaaggctctacaaatgctgaaaatgacttgtgacttgcctgtttgcttggcaagtttagggttttcagtggcaaaaaggttcccccagaaaagtttaccttttgctttatattttgtatcaaactatgtaatgtttggctttctattaaaagccggatcactcagtgatctgctttctaaaaaaaaattgtgttgctgacttgaatagtagtagagtagctgtgatagatgagggcttcgactaggcctattagaggaacagggagtgcagagagacatgtagataattgatctattcttgcctttggaatgcaggagattatggcctgaggatcccttgcaaagtacctaatggagcactgcatgcaactcaaagatattagatagatatttgaatacaactcaataatcaactactagatgatctaatgctgctcttaatgctgttgttgctgcttcactgctcatcgttggccatggcctgcaaccacggcattgtgatgttagcataccctaacttggtgcttcacaatcaacttccctttgtgattgacaattttattaaggcatgcttttgtttcttttattttttttctcaatttcattctatgaatattaaaagaagctcttaatttttcggaatgtgattgatcattcttttgctgacaatatgttcagatactcgaacaaagtcccttgctgtttcctctatttgtcagccaaacattcattataaatttcagcagtcctgacaaatgatctctgtgccaccaagacaccagttcaacttacacagaacagagtacatgagaactgtagttgtgctaaggatatcctctaaactttatgagcataagaacatattatattatagatataataattaaaagaaggtaatggtggtgatggcactgtggcggttgcgaatttgccaccccacctatagaatgtctttttatgaccccttcaacatgtctttttatgaatttgccaccccacttattgtagatcttgagcatgtttatttctccttatttgccttacaaagaaaaataaaattcagtatgggaagttccaaaatggccgaactgtcacatatagatggacttgtttggtgcaaaaatcatttgtatatttgggcaatattagactttttttttttaaaaaaaaaagggtagcaagtgtatttggttgttctgcagaacatttgaaggattgccttgtcagatgctccagtgtgttttgccttcagttttactggccaatagaacagtcatggaactactcatttggtctctcgctttagtgttgggtgtgagcaactggattaacatttggagctaccagtctaccacttatacatgatttgttcatgctcaccgttagtcatcctctcgggattcagcttttcctaatggttacggtattttcataataaaggtgcaatgaggacagagaacgaagtccacaatgaatttggagatgcacttctagagagggagtccactgctgttgtcactattttcttgcagtctgtcaagaagagttaagaatctgatgatgaagttatttatctagtgatctgtgggattattagatgtttggatgctgatatcttactaaattggtgtactttgcacatgcagaggtgtataatgatttattcgtttgcatggttgtgtaaacagggtgaacgacaggagcattggactgttcttgcgctatgcattcactagtaggtacaaggagatactaagcaagtcacacagctcttccatgatgacagtgcccaagtttgttccgcgccttacaaaagaagaagctcaaggtaaatacttctcccaactctgattttactcatcatcctgcatttcttccattaccattccaagctcccaactattatcacttcaagtaaccctttttttttctgtcgcgaagtgttcgaatctgctagggactcgatgaccgctttcaagaagtggcgcgctggcggtgtgaggctgcagaaagcgtccattcttggtaggaaaaggaagacaaaactgcctgatggaccttctgcaccttgaaccatgttttaggttcttctgtatggaaaatcgtacttgagctgatgtatgtatacttcattaatatgtcgctgtaagagaagaccaaaagtgaaacaattccgttcggagatcacacgtttgtgcattctaatctggtggctggccaaccaacacagcctcttgaacaaagggcagttagttattatattccttccttttggaatcaccgaaacgcgtaatacatattttaactgcatattgatgtgtgcgcgccttctgtgcaagtgaagagaagtttgtggtcttaaagtcattagggcaatagcagtgcttccttgatatttaccgttcttcgtacgccgcctaaatcaagaacgtattaaactacatactccacgatgcaagttacttgtagtgggttccaccaataccaatatttcacttttcatctcccctctcctctttttctttccccaccggtagaggaaaccgaggccggagaaaacaaggcattggggctgagtggtggcagctggcgaggcggtccaagcggtgacaacatcgggcggcccaagcggcgaccgagctagctgcggatcgagctcgctggctttgaattgatatcggccttgacctcgtgctcctttgcctctccgtcgcttccctcttcgtccccttctcttctcctctgccgtgcctccccctcctcctctggctgccacgccttcccacttcctcctttggccaccacgacagaatggggtggacggggcgaggtggcgcttgaggtggcggatcgaagcagctcaacgagaggagcaattgaggtcgtgctcgcgaccggcggcggtgatgagcgaggcggtggcgcgtggcccaagaggtgccgaggggggctccacctcgtcggggccggaaaccacggacgatggcgccaccaagctgtggatcaagcttgctggtagaggagacacggcacgcgaagagaaagctcctctccctctccctcctcctatcttcctcactaccggcgacctctcctccttccccaacgacagcagcggcgcttctcccctccccttctgcgtcgctacgtccccgtcgccaacatctgcccagccgctgtgtcgccattaccgtcgccggcctttctccgatcctctctctcccttcccggaggggcgcgggacaaaagattgtgggcccaaagctgcaaatctgatcatgaacctgtagcttattttggctccctattagggcatccacaatgtgcaaaaaaaaaaaaaaagtggatagtaagaagtcctattacctggttcaccattgtgggagtagctagtaaaatgggtagtagtatcatccggtagtagtgctactaccaggcaataaggaataaacaaatattaagactctctcatctctcattccctctcttcttcaaccacccattctcttaaatgtggggcccagcttactacctttacattgtgtgaactaaaataattactacttggttttgtaggttaatcggggcgttacataggtcccacccttgctacctaacttgatgcccttattggaggggaatctccgagctgaccgatgaaggctgaatgacaacttagtgtaatgtgaatgaccttactatgcgtcacataattttatgccgggctctgccagaacaacatgcatgtgagaaaggcccaatttcgagcctcacccttctttttaataaattttaataaggatatgcatgctgattttgttgggggatactatgcaaaatagtcaaaaacaatttctttttggcagtagactagactggatggcacggtagcagtggtagatatcctaagactttcccacagtggtctagctacagccttgataccgaagtgtcttcttcggcgaccctggttgtactttcccctctccacactgacccaactggcgacaccatgctatataaccaaatgaatcctctcctcgactcctccgtcccataccggcacagcatgcaggacacacagtgacgtcggtttgttgccacatgcgtgatgcagcggcggaggcagcgcgcgaggcagagagtcacgggagagagagagagatcagagagaggggaggaggaagaaacgaacgaaacgacgagaggaagaagacgacagcgttgagccaccagcaccgtatcctcgacagaacagaatggcgctgtttgtactgtactgttgctttctttcatctctccacccgtttcttccgatctctgcatccacctccactgcgctatgagtgctagtagccatcggtggtgccaccgccggtaaaacgtcgactagctagggggctgattgctacctcagagtgctctgagagcatgtcgaacctcacattcagaaccgtaccttggaatttgataccccgaaacggaacacaatttgagaccctacaagaatgccaagaaaaaaaagataaattagccgtggggctctgtaagaagcactacaacagaaaacgtttattggtgccagttgggaacccctataagtgttagatttcccaaccggcattgataagctgtttgaaaaaaaaaaagccggctcggctcggctcaatttgagccgatgcctcaaaagcaccaaaattaaatccaaaaatctaagaaaaaaatagacaaattcatataagagaatcaacaagttcatagaatgagaaatattcatgataagttaacattataggaccaaatattcatcaacaagtttattaaaaaaccaaatcaaagaatacaccaatcacagtggagaacttctaccgccaccgctgctcactggagaggaaggggaggctgctgcaaccacacacgaaaggaagggaggccgccgacgctcgttctgctgctgagggtaggcaaggtcgtggggaggcgatggaggcgcatcccccccttcgaggcgccgctctgcttgccaccgtcacgttgccgcaaaggagagcaagggaggctgccgccaccaaggagtcctggagagagagagagagatggagaggtggagaggtggaaagataagaggataagggagaggtggagaggacatgtccctctatcatcggtgcgcgtgaaaaatctcgtgaaaggctaggtcggcttggctccttcgaggtgttgtttttttaaaaaaccgacatctataatacttaaaatgttagtttattcaaaaaaccggcagcaatatttggtacctactttttaataaacatatacttatatggtgatgaggatacaactagctcggatataaccatgactaccttatgtattagtcaactaaaggtgcatatgttctatattagatttacttgttatatatttgaacaaacgttgctacacaatgagttttgtgtgttttcgtttgtagaggtacttgcttgggtgaaagaaaagagaccgagcataaagaatgcatgaatgattgaagaagttgattagggaccaaaccaagactttctccaagtcttctttcatctcaccacgtcacttttggtccatagaagacgagagataaagttccacacgttttggattcagattcagacctcctgacagcaccaacttcaaacggacctagccgctgatctagaaggaatttcggcgcccatgagtatttgttggaaagcttatggagtctactttcatatggttttggtcccacatcaaaattcctactgagctaccgggaatctgcaaaacaagccgcgtacctcatccagtccgaatctgatttgtgttttgggccttataattgtgtcgtggacttaggccaagggggtgtgcgccctaaggcaaccctaggacgtccctaatcatttttattcagtagccgtcatcgtttagagtcgggttttgcttagattattctgtcaagaacagtttcgccggtagatcggtttgtggaaccctaaattcgagtgcttaatcattcatatgcaatttggatgcaatctatcttgttcttgcttgtgttcttcgattcgcatgtagggattagccttctcggcgaggtcaattgggtttcggcacgattgataaccagaggagacgtggtgctgtgattgcggggctcagtagcgtgtttgttcagaagccggatcgagttgtgtctcgactccgtccaaatcgactgtttatcagtacctatcggaagatcgggacctaacacccttatcaataggatcaaatgtgtcggtcgtgttatgaggggtgggaaggggttgtaacttgtaagtgcctgttttagatgaattaacacctctagtgttgtttctttttttcctttcaatagtagcaaagattcttttaagtgaaggctgagaaaaaaaatatgtcatgatatagtgttttctttttattaaacggataaataaaatcgctgttgcccagaacacacgtttatattattgtcatgagctagctctttgtgttagcaatggttaccatcgaacgctttctggagcagaagaaaacaagtttgttatagccagatcagcataagagtaagagtgaaactttttgaatatcaaaagagtgatctttaaatacacatagacatagactaaaatataaaataattggggctctttttttttcgcgttgtaacgttactcactttacaccccctcaacactttttttttgagtttaatagtatagcaaactattaattagctttaaaatttgacacatcatttacagccaatcgaatagtctattcatacaatagttatatataaatatatactacaccattaataatatgtaccccgcttttcttttctcttcttccctctctctttcatatgtgctcgtagttagcttatactcttatattgtatttgctgatcttatctcctccacagatacttacagctgccttatagtctactacctccatccaaaaatgttgcaagattcattatcctaggataatgtcagtgaaatggtaaccggggtacccattatccggcaaaaggagcattatcaaataaataacatgatcaagatatctttagaaaataaaaaggtaaccttaaggtgacgtagctaggggcccattctgtagggtctcgagcccacctaagatttcatatatatgattctctttggctgagaaggaatactgtgtatatgagctaaaactctgagtataaaagtatcttggggcttaacttggatcccaagcataccccaaatataccttaagaatatagcctaaggtatgcatccctattccgggccccaggctcaccctagcccttataggttctatggtccttggcaagaggggcatagaaacttgtaaaacctatatcttaagaaaacgagctaaggtctgccttgagcccggcctagtcctaggccccgagctagccttagtccgcacaagtcacgcattactcgagaagtagaagtgatgatacttaccaaacatgaaggcgtaaactgaggtttgccttaggcccggccttgctccgagccctgggcttgccttggtccttgtctggctcgcctccctctgcctagaagggcgtcaaaacgtacaacacgcataatcttgagatattcttccatcaatgacactttcaagaagttcattcaagaataatcaaaattctttaaatgcgggaggacgcgatctcaaaaactgctaggaagttgagcgtgttccacagccagctgtgaggcagcacgccctgccataaatgaaacaggtttatgggggatccccggccagtctggagttgaaaggacgtagacaagacggcaacgttgagtcattttggacggtggtgcctaggacacgcgttgcacatgccccgcgtcacctgatttagccaaacagacagagaagcaaccgtggcgctgtcttgggcaggtcgggcctcatcgggcccaccacgctccacgtggtgagcacactggcagaggcccaactgtctcacacggagcccggggtaatatgaatagtaagatttgaagagtttcttgaagattgcattaaggaatcagccggcaacgacaagatggctgatgagacaagactaagagtagatttgtaataatgtgagccctcttggagtataaaaggaaggggaccaaatacggatgaatggttggattcttttagactttgtagtctagaaagacctcctttgtacttagctggtctatagaagacaacaaacaccaacacaagagtaggatattacacctctggatggcttgaacctgtataaattcctgcctccctctcctcgcagggtggccgggcccatcacgatcacagttacccagcacctctagccgactaaccccctggtcagatcttcactctcggagaggggtctccacttcccgctgtccgaagtaccaccccctcgatggatagatcacatcccattttaggttgcaacattttaggatggaggttactgtactcttatactactaattatttccgtcactttattatccctgccctaatatgctccacggaaaaactgcctgtctatgcaaaggagacgagatggccagatgggagcaaacgatggattgtttttccagatcaaactctgattttggggtacgtgcacgtcggacgagaaagtgagcaaaggcaacagtggggagagcaggtggatcgaggtggccatgcgtgatcgccatgatcgagccagcagtaggtccagtggtagctaggattggagagtacatgccctccgggcgttggtgtagcttgtcagcctttgttggcctcggcgtgtccccttctcgtcaggcaaattattaggggatcccgtcgatagccccccaccagcggccatcgatgcattttgtactagttcctgctttagggctgcatattcaaaccttaagttttccttcactcattgcttagcctgatctccgtacgtaacagaggaaattttcttgcggcatggaagtcctggaaagcacaagcaccggtggcatgctctatcatgtttcaaattcttgtgtctataaacactggagtaaattttatataactataaatattttcacaaaactatagattaaaggtatattttatacaaaatttctcatagaattacaaatttaagatgaagtgtcaaaaaaataaaaattaagtagtaaatatatcacaaaaatatagatttactgtcaatttaatcacaaaactacactctaacataacggtagtgctagagatttaaactatagaatatgtagttttatgataacttcaatattatatatatatagtttcgtgatacttagccttaaatctgttgttctgtaataaatttatcgctaaatctttagttttgtgatagtttgataaaactacacattgttttgagaaatttactctaaatattatgcttttgaagaaattagaggcagatggaatcaacagtttggttgtagcttttcatgactaaaaaaaaaggggaacgccattagtgtattaccattataagtttaaaatattgatttatttaatttgttttagaaacttttatttgaaaaaaaatgctatttaatttagcagtttaggaagcgtcataatgaaaagggtgaatgaaaagaactcagcctaagctcaaggacgttttcgataggaatagttttgcttattaagccgttcacggtgtggggacgtggcgcgttccttcactgcgccacgtcggaaaaacgcccgcgtgtcggtgcgagtcgtgtcccaccagagcgacttgtccccatggagggaagcgcgtttcttcgcctccgcgagtccgcacgggcggggaaagcgcgtcgcccatgcgctgtggagggcgtgccttcgtcgcgccgtgcccccgcgtcgtgcaatccaaccggaggaggagaatgggaagggagcggccaaatccgaccagaggagaaggcccatatggaccgcagctgaggagctcggcgccgccgcaaccctcactccatgctcgtctcgaccgccggcgccatagccctcgtcgggctcgcctcaaccatcggcgcatgcaaccctcgttgggtcgccgccgtcggggaagcctgaggaggccgtcgccgctccacgtcgcgacgaccccgccgatgctccatcgggggagctccttgacgccggcagagctcgtcgtcgtcttcttcctctacgcgccggtcgtgagtgggagagccagcaccggtggagggagaagggggacgccggccaatctcgcgatggatttgggggagaaaccgcgcaccgcccacaccatcgctgccgacgctgtcaactccgctatgagcttcttgcccgcaccggtgaggaggcgtcgatgccgccagatctgccccgagctcgtcgccatccacgccgccattgaggcttgttgccgggagctcgccgaacacacctagcctccatctgcgccaccgggagctcgccggccactccgtcacgcagccattgaagcgcgcctcagggatctccgcgaacgccaacggtagaaggaggagaggagagttgccggcggttgggctaggaggagaggacgccggtggagggaggaggggagagccagcgccgggcatgacatttgtgggggtggtggggtgaggccgtgagggagggggatttggtgagacaacactagttggtgcttgcactgtgaagaaaatgtcttagaagctcttcatcttaggtgccaccatgtggtatctcatagttggtgcttatacagcgagtgcccttgccaggtcattaccacatcaatcaaccccacccgtgaaagcctggtccaccatgcaaagcgaagcccgtacatgtacagggcggcacgcggggtggtggccagcgcaacagccgtcgtcgggtgatctccctctcccggagcccatatgcgcggccggccacagccgcagccgcaagagcgagagcgagcgagcgagactcgcgcgcgacgcgagatggcgtacgagatctctcctggagaggacaccgacgacgcagcggcagcgcagcgcgcgggcagggcagcggcgtacgtacgtgacaccggagcgagcggggtgggtcggcatatgccgtacgtacgtgctccacggcgaacgaacggagaacgcgacgaacgggattattcacggggcgtcgctgtcggggtgggcggggcctgctttgctttgcctgtgtccactttattcattcattcccctgtgaaaacctgcgcctcggctatcgtggattcgtggtcgctgccggtgccagtcggtccgtggcgtttccacactcggagtccatagatcagtcaatcgattctttctgtgtttgggagagagggactatgctgtgtttagtttgcactgaagtttgaaagtttggttgtaattgatacgatgtgataaaaagttatgtgtatatgaaaggtttgatgtgatggaaaattggaagtttgaaaaaaaactttggaacaaacacccgcttgtaattttttcttcttttttatacgagggacaccggatacacagtcaaacaaacacacacgatcgattctggtgtagtatactagtagtatgtcgtgtagatcggcatcaagaacgtgcatatggacgggatatcggtactgtcacatgccgataacgtagtgccgcagctcgtctctgagattgtggtctggctgggcagaatcgattttaagctgacgttaaaccttaacatcgatgtctctcttacctcctccttatctctcccttccttgttggcaagactaaggctgtgttcagctctatgaattaagaactaatctcccacatatgcaaaacaaaacgatttattagctactcccttcgtccccaaatacaaaggattttgatattttgctttcattgtttcaccattcgtcttatttaaaaaatttagaaattattatttattctatttgtgacttactttattatccaaagtactttaagcacaacttttagttttttatatttgtataaatttttttgaataagacgagtggtcaaacgttacacgaaaatagtaaatatcccaaatagtaaatatcccttatattagaggacggagagagtatttgtttgaaaatggattaatatgattattgaaaagagctttcctagattttttttttagaaaaacacaatgtttagcaatttgagaagtgcacacgaaaaacaagggagtagaggttgagagaaacacagccaaggcccagttctttttatcaacttcaaacttcaactttcgttttccgttagcacgctctttaaattgttaaatgttgtgttttttttttaaaaaaaactttttaggtaaaagttgtttaaaaaaatcaaataaatatattttataattttataataattaatacttaattaatcatgagctttttcgttttgcgtgcaccgaaaatatcactactatcaatttacagaacgaaccggtcctaaggattgttatacatgcggatcaatctacatcatcattgtctacatccccacctacaactaagtgcaaatttgtcacatttttgtctgctcctatttattttgttgcttttaagcatttaagggcacatgagtttttttatctctatatttttctaccccatatttatcgttttggataaggatacagtcttaaaaaaactttaattactattttttattataatataaatataaataaatatatgattttattaaaaatactttttaagattaatctatgcatatgatctccttaattctaagacaaatattttaggaattattcataatgaaatatattaaagtttgatatcgacctggttcaaaacaataagtattatcaacctagaaaatcattgaatggtataataaatatcagattaatacattctcatgtccaaaagacaccctcattcacccagtggtacttttacaacttttactgccatactttttttaccgtaaaaaagtgaggaggctcccatggtatattgaaaatggacatttagagggttttttacaagaaaatatggtagaaccagttcgtaagaaatatagcaaatgtaatgtagttgttgtcttaaaaagaatattaatttaacttgtgcacagcacactccgaattattttgcatttcaactaaattccttactgtcggctgaacattcatagtctaacttgcatgatgacaagcagggtagggttgtaggttgtgtggaccaagttgtaaaggtgagggttcacggagccttgctgaggatgagtgacgagtgtaacatccatgacaaaaggaatgaagttacaacgtgaggaaatgttgacatgagtgacataaggctcactattaaaactacacgtgatttgaatttcacattttgccaatccattctagtaactgaccatggcttgtgaaaacttttttttaagtgaaagcggcaaaagatttgccgaatatattagaagatcagaatatataagatacataagtgcgattgcaaatttagcccaaatacgacaactcaaaagggatgtgaaaacttttaagtaaaaggtactctttatttgaggaagaagtttgaatcaccatatgaatttattgcaacggtctgaattacctctttaaattataaaaccagacattctatactttgaactttctaaaccggataaataattaccctaataactcaatttgaagcggttttgattctacctagcatacacatgatagtccagtcagccaaaaaaataatagaaataagtgggctcgacctatcaatgctacatcttatactcccctcttctccattcttccacatcctccttccccttccatctatcaaacaaagacacacacacacactctctctctctctcccctcaacatgagcatgatttggcggctaacgttctccattacttggtgaaggataatagagaggaagacagtgacggcctccatgagatggcagaggaagacaacatcctgcaaagctccgacctccacttgtttccacaccttggcatcatttggggtaactgtagcgatggcagcagcgtccctaggcataggaggcggaacatgacctcctcaactccaccttcaccatgagtacatcatcctctttggcacacatgccaggcggctattgcatgcggagttcgacggaaatcagtgtgagaggagctagttgagagaaggtagtgagaccggtggatcttggtcacaccaaccgacaagagggggaggcaatggcagtcccatcttgacaaaccttatcttgctcccaacctcaccgttctctccttggcaaacaacttcttctttggcgagcttgcaatggagagatcctagggaggggggtaagagagggattgacttgagagggggcgaggagggacaaaaagggatggcaggtggacctatggatttattctatttttatggtgaccggattacaacgttgtcgccacgtgtgtcagctcatgttaaaaccgcacaaatagtgcttaggggttattcgtccagtttgagacgttcagggtgtaaaatgtctggttatgtcattcatggaataattcggactatcgccttaagttcagaggtaatttggaccttttcctttattaaaacagttgactaaaaaatgattaaaattttctttataaaatatacgtatactttggcaaaactaacaaaagaactacaaattaaaacttgtgtaccacagcactgcaaactggaggccaaatttactacaaaactacgtatttaagctcttttgaattataggaaaaacatattcagtagtggctttatgacaaaactacaaatcttaaagcttatcttatcacaaactatagaagttatggattttaagcctatattagaataacaatgtttggatgaagcacataaaatctatagttccatgataaattatatgctaaatatgtggtttaatgatttataaatttaaaatatgtaggttttagatgaaacacataaaatatgtggtttaataatttgatcaaaatatctgtagttcacggaatttaaattgaccaatactaacatctaagaaatgagtttcccatcttcaatttgcagctatgtgagcagtccccgcctactatacgagcctacccagtgcccctcaatcagctggtcggctggtcgcacacaccacgttccttctcccacctccgccatgccttcccgccttctccagcaactgccgcctccgccgccgcctcctcccctcaaccgccgccaccatcacctcctcctcgccgcctccgccgccgccgccacagccacagcgctgctgctgctcctgctcctgctgctcgtcgcgctctacctccggagccgccgcgcccgccgccgcagccccacgctgccgttctcgccgccgccggcccccgcgcgcccgctccgccgctactcccgccgcgcgctccgccgcgccaccggcgggttccacccgtcccgcctcctcgggcgcggcgccgcctccccggtgtacctcgccaccttccccgacgccgtcgcttcgcccgaccgtggaaagaccgatgcctcggttccccccggcaaacggaaggccttgccaaacccccttttcccctttcgggcccgggttttccggggcccattttgggtccccccccccccgggaaaaggaggttttctcccgggccccccgcggctcgtctccctgctcgggtactccggccccggcggcggcgctgacgaccgcccgctcctcctcgtcttcgaatacctgccgcacggctcgctccaggccgcgctgttcggcgacgcccgcgacgggaggttcctcgactggccccggcggctcgccgtcatccgcgacgtggcgcgcgcgctcgcgttcctccacgccgaatgccagccgccggtcgtgcacggcgacctcaagcccagcaacgtgctcctcgatgccgacttccgcgccaagctcgccgacttcggcctcgcgcgcttcaagacccccgacgccatcgccgcctccggcgctggcgcggatgacttcatgagccaagaactcggcgaggccggggaactcttctccaccgcctgtgccgccgccgccggcggcggcgtcaaggcggacgcgaaggacgagtccggcccggccgccgcgtgggggaaggagtggtggtggaagcaggacggcagcggcgagctcgactcccgggactacgtcgccgagtggatcggcagccaaatctgtccggcgagaaacccggactgggccgacgacaacgacggcgacgccaacgataacaacaagaactcaccctccggcacggacgagcacgccgtggcagcctcgccggaggacaagaaggacgccgactgcaacggcaatgctggcggcggcggcgacaagaaaccagaggcgaccaagatgagggagtggtggaaggaggagttcttcgaggagatgagcaagaagggcggcagcttcgacaagcgtcgcggcggcggcggtggcgggggcgggaagccgtggctccggtcgatcagcatgaacaccggcaacggcaatgccaacggcgacggcggcaacaacatcgaggcgacgagcggcctggacatcagcagcttcaggaggaaccggaagcggagccggcggcgtgggcggtccgtgggcagcggcgacatgcacagcggcgacttcctcagccgggagctgagcacgacgacgagcatgcgcggcacggtgtgctacgtggcgccggagtgcggcggcgggccgtgcgagcacggcgccgagctgctcgagaaggccgacatctacagcttcggcgtgctcgccctggtcatcctgtccggcaggcggccgctgcacatcctctcgtcgccgatgaagctggagaaggccaacctggtgagctggtgccggcagctcgcgcgcgccggcaacgtgctcgagctaatggacgagaggctggacggcggctacgacaaggaccaggccacgctctgcgtgcagctcgcgctgctctgcctgcagcggcagccggagcaacggccggacagcacggacatcgtcaagatcctcgccggcgagatggacctgccgccgccgccggtggactactcgccgtcgccgcgcgtccggccgttcccgcggtcgtcgcgtcgcgcgcagccgcccgatgccaccgagtgattggtaactctgctcacttaaaaaatttgatccttggggatcaatctacaagttgccatgccctgtgttcttgcaggagatttaacaaaatttgtcgaattttgctaatctactagtattgtttttttgtacatagcaatagcagcaattcgtcttcccctaattgagcaatggattctttggatgtcaattctaacaattgatcttgcatcttgcaaaaacttagcaatagatttttaggatttagtttctgatttctttgtcagtttcaacatatttagcagaacagtactagtatttttgttgattgttatgtttgtacatgggagatccaaatccatcttatcatggaattctttgcctgtcaatttcttgatgtatcttgtttgcaaggatcactaaacatttttgtgtgatttaattgatttttctctcgtaatttcttcatgtgcctgatcttaataaatgaaaccttggtctctatcaaaggtggagaaaaacaaacgaacaaggtagtgagcaatcaagttgatcagatattttttcagtgctacatccaaattgcacagaaaaggaagaacatttgcgtactccttgtgtgttacgatacctaacatataggtcaaatacgatgcgtctctatcaatcttcagccaaaaaaataacaataatgatttgtagcatagaagtcaaccctttgtacatgaaaaacctttatgaaaaccaaaggtttggattgcttcccctcgcgacaaaattgaattctccaaaattctctaccggataagttggtttatgttcacaagcaaccgatcctggagaaatactacaattagtacatttttgctttattctcaatctatttgctgcagcaaatggagtttcctgtacaataagcggccagtctgcagattcaaaatcaggatactttcatagtctcaaaatgatcaaaaggggtgacttcttcctacaagtttcaaaaagctcattttgccaggcatccatggttggtgttttcagtcaattttcaccaaccacacatcaaacatggttggtgttttgttcttttactattccttccataaaggttttgcttacttttcctcaaggagataactacaacccaggaaaaatattcagtaaatttactccatacacgtgtgaaaactattcctgatgaagtgaagtgaatcttcttggtaccaactctgatcacttgttgtctgaagaaggaaaggcaaaaggattccctgtagaatttcagaaatcaaaatcaaaacaactccctcttctcctttcctagcatgtttcgtgggacgattatgcgtatgttttgttcatattccttagagcccacccgagttgctatgaacaaaattcattcatacgctttgtcgtcttgcgccttttgaggacttttttcacagttcattccttcttgagactttcatagctcccacaaattccatttcagtgggatggtccaaaagtgccattttgccctccaacaccatctagatggccctgaatcagcttcagcctttgattgattactgctgttggagatggtgtttggtgattgttgtatggtgagtccgtgggttttgcatgcactcaaaatgctgccacaatgttcttgctgtggtactcccactgccactgcccacatgacctttccagctcccagtgctcttcatttccttttagtttatggccttcatttgtttgattagggtgtgagatgtccctccctgcactagactaatgaaattgcatatctgttccttcagtttggcaaggcaacaatcctttgttactactggtcaatggttttagtggatgctttgccttgtgacatcatctactcttcaagttgttgtcttaactgaagaatcctcatggctatatgttaaccaatgaagatagcaaagatcttgttctaaaatgctgaagttactgctgatgctttttgtactagctagtagaaaatctctgtcaggaagcactgttttcaccatcttaaacactgtgcatactggtcagttcttctaggagactgacactggacaaatagaatggtcaaattttgttaaaagacaaaagcacccagactgcatgacctggctttgtgcatgatggatcaagttgacctgtaagactgaaaagtcttttttacagtcaatttaatttgcaggccatgaaaagaaggaaaaggttgcatacttacatggtccctgatctaccatgccaagaaatgtttgagctgtgagcctgtgatagactacccttttgtccattatcttgtttataaaactcatgttttgtcacattttggatcctaccatcctagcaagtcattaaagataattaatggtcttttagggtcaaaaagtttgttaaaagtgcaattctagatctgaaaaaattaaggttcaagatagatactgcaaatcttggtgggtatattagcatttctgaagggatggattggatactgaagatatgagtgctatttgcaaagtgttaagaatgtgatgttcatatatgattagataaaatgcagaggggaaaagagagtaaaagtgaaacattctactgctatccgctagaccagctgacaaaagccagctactagtttcttttgtgacaactgaaattccacacatcctaatagcagctccaacgagaggataaaatcgaaccttgcaaaaaacaaaaaaaatcgaatgtgagtgaaaaaaaggggttcatgacagaagtcgaacacaaccgaatagaaaaaaaaattcatcgggttgtgcgagagggaggcatatgcgggtgaggctgagattttctttatgcgtgggtctcacactctcactgggtctatctctaaactgcagcgattgaaccgtaattttgttagattgcatggaccgaactactcgcaacaacgctagagatgccctaagaaactgaaacctaaataaaactcaatttactaattcagatatccaagaggggcactacaagatttcagtgtttctgtttggaaatatattatatcaaaataagttattgtacggttttctatgacactacaatttactatgcgatgaaattactatacaatttatatcaacaaacgttatatacccaaaattgtactttggagatcatgtcaatgtccaaaatacaactaatatttgactaaatggagtaccaaatgcagtactttgttttgagatatcacatttctaactgctactactaatataaagaaaagaaaattcattgtccatatattctccactctcatgtccctatcaacttatcaaggcgtttctcaaagaaattgatctatgagtcgtacgtaattccattattggatttgtctttcttgttaagtctttcccgcgtgcgtcatttaccttttaaacatgatatcctcatccatgtcactgaattgactcactgaatttctcaccttatttttctttgccttcacaaaacaaaaaaaaacatttcttttttctcaacaacattagctagagtcttcctgggtgatttttttactccctttaattaaattccgacaggtcttctgccgtcgttcccttaaaaaaacattagctagagccaggttgcttctacttcatatggggtcatatggggtcccacacgaattcatgcgatagtgctaattccctctagctaggcagctcacgtctgttgcagatatgctggataattattggaacaaaatattttttttctcagctagtagttaagatatacgatgtgccagcccatgaacacgggttttctgctcatccaaggccatgggccacagggacatgacgtcaccgtatgtatgtgttgtttactgcatttttttttccaaaacacaatacataggccgtgtttagttctcccaaattcccaactttccatcacatcacatcacatcgaaaactttcctatacatataaactatcaactttttctccaaactaccaactttctctaaactttctaacttttccaccatctaaacacagccataagcatgttcatataaacggtgctaaatgcgagcatactactgctataaacgcctacacacactctatccctataaacaggggcggagctagaacaaaacgaagggggttccacttacttgctttactctggtttgaatcaaatttagcttgatacggtgtgacatcccagcctagggtttaataggattaatataatactcatatcaacaagttgcagcttcttttccgaaagccgatttccaaagaactccaaggttaagcatgcttggcctagagcaatttgggatgggtgaccgaccgggaattctgtggccaagaggggacgttcctggcctggggttagtcgacggggacgtcttcccggtgcgcacgagtgaggtggcggacgtggccaagagggccacttcctggtgcgcacgagtgaggtggcctggggttaatcgacgggggacgtggcgaagaggggacgttcctggcctggggttaatcgacggggacgtctttccggtgcgcacgagtgaggacaaagtgtgcagaaaagacacgtgttggtctgtgagggcagtctatgacttatgaaagctgccagatgtaagcgggcccggcctgggagagccgggacattacatacgggtgcctaaatttaaactgacggggtatatatacagtgaaaatagataaactatagctaaattttttttgaaccgggttcctaggcacccctagctatactagctccgcccctgcctataaacacattcgaatactagatctgcatatcttaacattcacgaagtgttcatatacgactcgttgtcgatgaaaacattgcatataacttgagaaaataattagtcataaatacgagcacctcgtgccaaatctagcacttaaactcgggtgaacatgttccaaaaccaaaaaacctaacctaagtagctgagcaaggctcacttgcataaatttgatccggtgaaaaccatcaaataattaaaaacccgtgaaaactagacctaaaagttttaagaaaaaaaatcataacactccaccaaattccaaatccaaaataaactttattttgaagggacaaaacaaacaaatattgaaaaaaacaatgaaagtcccacgttctggagcagttgtcaaatccacgttctagtttcactgtttttttcaagggctttatccaaattcttatgtcagcttctcgttcctccaatattgcgcactaagggtatctacaatgcaagctactcttaaagtgtccatactaactaaggacactagtagggaaactcagctcgtaatggaggacactcctagatgggctcctcaaaatctgaagcaactaatagagacactcaaacccacaatgggtatcccagtccacaaagccccatatttatttttccaaccctacccataatctctctctcgccccctctttttttcaccacgcacgggcgcctctccatctcaccgccgcactcacctctccctctcgccgccgctgccgctcgcctctcccgtcaccggcgaccgcgaggacgacgaggagggccgcctctcccgtcgccggcattcaccgccgcccctctttctccctctctcccgtcgccatcatcgccatccacctcggcctcctccgtcgcgccatcgtcgccatccaccccagctctctctcttcggcggtggccgcgagaacgacgaggaggaccgccgcggccgccggagcttcatcggcaagggcgacgaggatagccgcggatccaccacctccgccttggatccgtcgctgccgctgctcgccgccgctcgccgctctccccacccctctctctctctctcgtcgctgctatttcaggccacagctcaagacctccgtcgacagctaaggcgagcccgggcgatggctactgcggcgcggtggccccgtcgtggatccgtcgtcgtggcgcgtggttggcctctctctttcttcggtggccggcgagggtagaagcggaaaaacaggaggaggcaacggtgtccttgggctactccctagccacgccccgcccagcgcgcctcctcgctccccccccagctgaggcgctcgtagagccgtgtccctcagctgggggacggcaaagcgacggagcggagacagccatgagcagggacacgctcggggatacgcattggtgatggcctaagggtatgtttggcacgtgcatagctccagctcaggtgaaactagaacccaatcaaatagtttgagtttagaaatttgagccctgccaaatagatcctctaagtgggttttgtttggcaaggttttgtttgtcatgtagaggcccgcaccccgctctatcccttagtttattctttagatcaccttagcttgctccgctttcttttgagtgaagctaaaccgtttggtttggatatagctctggaagaggaactgtagccctgccacgcaggcccaaaattgtcatatgtaacccacatatgaccaaatccaccttggatttggttagggcagtaatccagttcgaaccgttttagagattgttcggtattgcgttagagggaataaattggcctaaagcacaaattgaggagcaaattagactttttacttttatgagagggataaatccaaattacatccttattgggtttgttaaaaaaatatacttctcaaccatgaaaccaagcatttaacatttgtacttaaataccggtgaggctaatacaatccaatttttatgagcttgacatctaagcaatatatttttgagtaatttcagtcaaaattacagaaaaaaaaaacacacgagaatttttgtttgtggaataggttttatggtctaggggtttcacagaaccccacctttctcaagtaaatttgatatatatgaaacaataatatcaaaaagagtaaattaattacactctcaggacataaacttggtggatgtaaatagctacaacaattataaattgcttattctcaaacaataacttgtcatgagaacccaagccaaaattatccatgcaaagcaaaattgatttaacatgcacatactaatgtgtaattatattacatataagattttagacctacagaatgtgtaattattattcgtaggatatttttaagatttacatgactaaaagggaaaaaatgctaaaaatgtcagaccatgaaaactaattatatttgttcagaaaaaccgagaaatgccattgacaaatacaaaaatctaataaatatcatcaacgagtgcgagttctataaaataccattttacaagcactactataaaatatcaaataggtgtcgccactataggtgccagtagtactaaaaccggcacctatagaccttttcctacctccactagttgaaattacaaaaaaaccggcacctttaagtaattattggtgtcggttctaaataaaaaccggcacatattatattctgtatcggttttttt

SEQ ID NO: 74272 - DNA, 27066 bp, Oryza sativa
ttggaggctacgtatacaagcggcgcaacatccttcaatctcctcccctgcgtccaggccgattctcagaagcttattttggcaccaatagtaatcagttaggcaggagtatcaactaaacttaaaattcagttgttttgttgacattaccaagcatctacacaatgtaggctacacaagcatattcagagagcaggtttgacctacctctgtaaaatgtgtatttcttgattgcaacaacctgtaatcctaactaaaattgctgcctttgtggaggtagaatctgtgccacttcactagaaaaatgtgccactttgaactctgtttcttaattggaaaaacaatgttaaagtaaaaataagaatttcttttaccaacaaagtaaaattaagatttaaccctagatccccaaagacctatagttaattaattaatagacctattgctttgtgagtaatgccagccggtccacaccataaacacgaacacgcatctcagccgaaagccagttaattaatcaacatatagcggcatacagctaagtactagtaattagtctggcctcagttttggggatttagcaactgcagagctattcaaagaatctctaactcgctaaacacttcaaactcattattattttttgaaagttaatagtatataaaatatagaaattagtagacaataaaaaaaaaccatgggtttttcatattctcatccgctgcttctcataatctcttgctttaaaacattactctaccttagattttactactagataactaagtagtactaatatatttcgatcaaatcgcgattaacataggactgtttcgctgtgtacgcgtgcaccgtacctttttgtacgcacgcatacatgatcacacgcagctagcactttaatcaccctgtctaacccactgtcaattatttatttaaccatttccatccctaatccattccgacggtcaaaccaaacatgtatatccacaccaatgggccccaactttcagtgagacaccggagacgctgagcccattcacgttgcgccacgtgtcctattcgcacgatgtcaaatacttggcgccaaggtgtaacggctgcggctagagcttatagcccaaacggtagttaggcagccatgtctcccccccttcctttccctcctttaaaatccccagcggtgtagcaaacgtagctatcaagagcatttgcattttgcacccaatgtcttaagaggttagaaccacatgctctcttcctcctccctcccatggcgcccgtgcccatctccgtcttcgtcttcgtcttcatcttcattttcttcctcctcgacggctcgataccgactctcgggtcaaatgaccattccgcgcttatgtccttcaagtctggtgtgtctaatgatcctaatggagcactcgccaactggggatccctcaatgtgtgcaattggaccggtgtctcttgcgacgcgtcgagacggcgtgtcgtgaagctgatgctacgagaccagaagctctccggtgaggtctctcccgcgctcggcaatctatcccaccttaatatactcaatctctcggggaacctcttcgccgggagagttccgccggagcttgggaatctcttccgactcaccttgcttgacatttcgtcgaacacctttgtcgggagagtcccggctgagcttgggaacctctctagcctaaatacacttgatctctcccgaaacctcttcaccggcgaagtgccgccggagctcggcgacctctctaagcttcagcagctcagccttggtaacaatctcctggagggtaaaattccggtggagctcacgcgcatgtcgaacctgagctacctcaacctcggcgagaacaacctctccggccgcatcccgccggccatcttctgcaacttctcctccttgcagtacattgatctctcctccaactcgctcgacggcgagatccccatagattgcccgctccccaacctgatgttcctcgtcttgtgggcgaacaacctcgtcggcgagatccctcgctcgctgtcgaactcgacgaatctcaaatggcttctgctggagtcgaattacctctccggcgagctccccgccgacatgttcggcggcatgaggaagttagagctcttgtacctatcgttcaactacctcaggagcccagagaacaacaccaaccttgagcctttctttgcctcgctgaccaactgcaccagcctcaaggagctcggcgtcgccggcaacgagctcgccggcgtgatcccgccgatcgccggccgcctcggcccgggcctcacgcagctccacctcgagtacaacagcatcttcggcgcgatccctgcgaacctctccaacctcaccaacctcacggcgctcaacctgtcgcacaacctcatcaatggctccatcccgccggcggccgtcgccggcatgcggcggctagagcggctgtacctctccgacaacatgctctccggcgagatcccgccgtcgctcggggaggtcccgcggctcgggctcgtcgacctctcgcgcaaccggctcgccggcggcatcccggccgccgcgctctccaacctcacccagctccggtggctcgtcctgcatcacaaccacctcgccggagtcatccctcccggcatcgcgcaatgcgtgaacctccagaatcttgatctctctcacaacatgttgagaggcaagatccctgatgatttgtcggagctgagtgggctgctttatttgaatctttcgagtaatttgttggaagggatgatcccggcgaccatcggcaggatggcgatgctgcaggtgctcaacctgtcgtcgaaccggctctccggcgacatcccgacgcagatcggcggctgcgtcgcgctcgagtacgtcaacgtctccggcaacgcgctggagggcggcctccccgacgccgtcgccgcgctgccgttcttgcaggttcttgacgtgtcctacaatggcctctcgggcgctctgcctccgtcgttgggggcggcggcgtcgctgcggcgggtgaatttctcctacaatgggttctccggcgaggtgccgggtgatggcgccttcgcgagcttccccgacgacgcgttcctcggcgacgatgggctgtgcggggtgaggcctggcatggctcggtgcggcggccgccgcggcgagaagcgccgcgtgctccatgaccggcgcgtgttgctgccgattgttgtcacggtggttggcttcacgctggcgattctcggcgtcgtcgcgtgccgtgcggcggcgagggcggaggtggtgaggcgagacgcgcgccggtcgatgctgctcgccggcggcgcaggcgacgagccgggcgagagggaccacccgaggatctcgcaccgggagctcgccgaggcgacgggcggcttcgatcaggcgagcctgatcggcgccgggcggttcgggcgcgtctacgaggggacgctccgcgacggcacgcgcgtcgccgtgaaggtgctcgacccgaagagcggcggcgaggtgtcccggagcttcaagcgggagtgcgaggtgctccggcggacgcgccaccggaacctggtgcgcgtggtcaccacctgcagccagccggacttccacgcgctcgtgctcccgctgatgcgcaacgggagcctcgagggccgcctctacccgcgagacggccgcgccgggcgcggcctcggcctcgcccagctcgtcgccgtcgccgccgacgtcgccgaggggctcgcctacctgcaccactacgcgccggtgagggtggtgcactgcgacctcaagcccagcaacgtcctcctcgacgacgacatgaccgccgtcgtcgccgactttggcatcgccaagctggtcaagaacgccgacggcgacgtcaccaccaactccggcagcatcgccgccgcctcatctgatccttgcaactccatcaccggattgttacaaggctcagtcggctacattgcaccaggtatacttaactaatcaacttagctattataatcatcacaaaatttgtactaatcttaattatcatcttctaatcttgaactaattacgtgtttgattttgtgattagaatatggattaggagggcatccatctacacagggtgacgtgtacagcttcggcgtgatgatactcgagctgatcaccgggaagaggccaactgacgtcatcttccacgagggcctcacgctgcacgactgggtcaggcgacactacccgcacgacgtcgccgccgtggtggcgcggtcgtggctgacggacgccgccgtgggctacgacgtcgtggcggagctgatcaacgtcgggctcgcgtgcacgcagcactcgccgccggcgcggccgaccatggtggaggtgtgccacgagatggcgctcctcaaggaggacctcgccaagcacgggcacggcggcagcggcggcgacgtggtcgccgccgcgacggtgatggccgcggcggcgccgccgtcggtggcgatgacggcgagcgagcggtcgtgctccacctcggactcgtctttgagttactagcgttatggcccaaaaagattaattcgtggtgtagtgtagtgtaatacaaacttcatgcactgcacattttgatgcttaaatttaactcgtattttaggacattttgatgtgccatttagtgttagcacaatgctttttttgaaatttctctcttgattaatcgagtggaagaagatgcaacgaagtatcaatgtatacatatatatgttttttttttcaaaagccatgtatagttaaagagaatgtctgtaaaaagaagtatgaactactgggttggtgaaagtcagtgctaatttagtttgttcaaattatttttgagttctttggcctctaatggggatttcacttttcgattaaaactatagatgtctaaagaacaaatcaacactgaccgttgaccaaagggctgcgatctcgagttcagacaattactcgtgacatgttttactatatagtatttcacttgacaataacatgtctcacaatcgtgctgaaacactaacatttcaacgcgaaacgtcaccccatattgtggagtgtttcaccctgagaatttatccataggatagtcaactaatatccactagaacaatgtttgttttacacatagatacaatctcactctcacctgttatttacacaagactcaaataattataaaagaaataaaaaaatgataacatcaatgatataaatctacagataaacatgcaaggtaagttcaatttacaataagagaaaataaacaaaaataataaaattagacaacaaatagtacgtatagcgcaaatatttttttcttcatgtgtagagtgaatagtgggtgaatagtacctgtatttttgtaagtcggacatgacattaccaatatgagtttctttttttttttgaaagagaaactgtgtgcaagtacaatgtcataagcacctcaaccttgaattgaaaaaagagaagaaactacatgatatcaccaatatctacgtggaaattaggcatttccttttgacaaaccttgaatcaaactgaagcaatggtgcagaagcacactagggaaactctttttatttcctggtaggcgtccactcgtttattaaatgtcacttaaatgattaaagtttttttaaaaaattaaaaaaaaagattaatatgtaatatatcacctcataaaacaagcaattttaaatttaacttcttccagttataacgaaagtaacaattttgacatgaatacgatttacagtagccgtgtgtttatagagtggtatattacatattaatctatattataatttattttaaattattttaaccgtgtagttgatatgtaaaatacgagtggacgcccatgggataattagaatccctctccaagcacactattgtctcttggatccgagcgtatgcagtggtcgttgtcatcctcgcagcaacacttcctccaagcaccgtccttgaggcgagcgatctcctgcgccacgtcatccatggtgggcctcatcgccggcacgatccgagagcacgcgacgccgagctcaagcagctccaccacgacatgcgtctcatgtcgcggcgacgtcgccgccgagagctcgacggcggcgaccacatcgtcgtccgacgacaagcgcctcttgacccactcgtgcaggctgtgcccctcctcggcgatcacctccgtcggccgcttcccggtgatcatctccattagcagcaccccgaagctgtacacgtcgccttgcgtcgacgggttgcaccccaatccatactctgcatcaatggatcaaaaaatcttaaaactcggcttggaacgcgggaatttttcttgattcctactcccttcgcactaaaataaaccaacctcgtattggacgtgatacattataatacgatgaatctgaacacctaaaccaacctcgtaccaaatatgatacatctagtatgataaatttagacatcagcgtgagattgacttattttagaatggatggagcacatgaattgggttgtttcatatgaaatgatacgacacatcctaatacgatgaatctggacagcagtacaaggttagttaattttagcatggacggagtacatgaattgtactgtttaatatgaaattatgcgtagtaagttttgatatgaattggactatttcttgtgaagatacgggattgatcgattaccgggagcgatgtagccgacggagccttggagcaatcgagtgatggagctgcgtggataaggagtggatgatgcgtcgtcgtcgtcgtcgtcaatggcgtctggatctttggcatcctcctgctgcgccaccagcttcgacacgccgaagtcggagacgatggccgtcatgtcgtcgtcgaggaggacgttgctgggcttgaggtcgcagtggacgaccccgaacggcgcgtggtggtgcaggtacgccatcccgtcggcgacgttgcctgcgatgctcagcagcagctccaggtccagccgccggtgggccttggccgccggcttgccgccgggaggcggcggcggcggcgggtggatgaggccgtcgaggctgccgttcgccatgaacgggagcacgaccgccttgaactccggcgagctgcacgccgtgatcacgcggatgaggttccggtgccggatgctccgcaacacccggcactccctctcgaagctgccggcgacgacgacatcatcgccggcgcgaagcaccttcacggcgaccaccgtgccgccgtggagaacgcccctgtagacatggccgtacccccctttcccgatcaggttcgcctccgaaaagccgccggtcgcgtcgacgagctcgcggtgtgagatcctcggatgctcgctgtttctctcatccatgacgccgccgctgcttagatgtggactgactgaggttgtcgtcaacttcttcaaccatgtcaacgccatggcagaaacaccggcaacgacagcgacggcgacggcgactatgcagaggaggcgccggtggacatgcctcctccggtcgcatcgagccattccggcgatagacccgcataggccggggttaccgacgaaggagtcatcggtgaggttcgcgaaggcgccttcaccggacacctcgccggagaacttgttgtaggagaagttggcgtaccggagcgccggcgacgcttgcagagacggtggaagaacgccggtgaggccattggaggagacatcaaggacatggaggtttggtagcttgccaatggaggttggcaagctaccctgaagcgaatttcccgacagattgatgtactccagcgcgacgcagccggcgatcgtcgccgggatcgcgccggagaggttgttcatggagagatcaagagcttcggtcatttccatgttgccaatttgcagtggcacatggccatccaagagattgttagagaggttgagatacacatggaagtttcctagcactgtaatttctgaaggaatctggcctgtcagcttattgtaagaaagatccaatatcaggctgcaattgaggccaggtggtatggttcctgacagcatgttgtggtgaagaacaaggtgatccaattgagttaggttggataatgactctggtagtgtgccttggagcttattctgagacaggttaatggtctctaaacgctggctttcgccgacggatctcggtatttcgccgacgatctgattgttcgacaggtctagtagcgcgagccgcggcggccggagtatctccggcgggatcggcccttccagcatgttgccaaacaagcacaattctgtcaggttgacaaggtttccgatggccggaggaattttaccgacgaactcgttgccactcaggaaaagcgaggagaggttggccgacgacacgttgccgatgatcgccgggatctctccgccgacgccggccgacgcgacgccgagctccagcaagccggtgcagttcaccagggaggagaagaacggcacgaggttggtgttgccatcgctgctggagaaatggttgtgcgagaggtagaggaagacgaggctcggcatgctgccgaacatctccggcggaagctcgccggagagggagttgtcctggaggagcagccaccggagatccgtgcagttggacagcgccggcgggatcacgccggagagcgcgttgccgaagaggctgagctgcctcagcgccgggaggccgcggcaccgcggccggagggggatgtcgccggtgagggagttgccgctcatgccgatgaaggtcaggccggagcagttgcagaagacggcctccgggatgccgccggcgaggccgttgccgtcgagggtgaggtaggtgacgctcgtcaggcggccgagcgcctccgggatctggccgccgaggaggttgtagtggaggctcagctccctcagccgcggcagcgcgccgagctccggcgggacgccgccggcgaggtggttcccgtcgagatacagcctctcgagcatggagaggttggcgatcgccggagagatgacgccggcgaggttggagttcgacaggagcagcccggtcacgcgcccggagcgattgtcacatctgacgcccgtccagttgcacatggcagcagccggggagccccagtcggagaggttgccatggacgccggagctgaaggagaggagcgccgcgcggtcggtggcggcggtggaagcagcgggtggagcatggccggagatagcaaccacggcgatggcggagaggatggcgaggaacctaggcattgtcaacggggttacgaggatgtgcatgcatgcatggatcaaatcaagatagtaggttatattagtgcctaattaacctgtgctactaattgctttggagtgtagaatgagtgaatgacagctctagcttagatatggggaccagctaaccttccagttctgaagagaggctatggctaatgacagatatttatagatggtatattggtatatgagcagtgtttgcaatttcggaatgaaattttggaaattttttaaatatcggtaatttcactccccacatgcaagcacatatctcgctcgaaattttcggtttttttctaaagttttgtgaatttgtttaaagtttattcaaattcgtcaaattttcaaaaaaaaaaatcggccaaaaaataccaaaatttacaaaatttcggtgatttcagttcattcggcccccaccagtaaaaacccctgtttcaaaattgcgaaattgcaaaccctgtataggagaaatttcattccggcttcggttagcccagagctgattataagctctaatagtttatcaaaataatttatagatagaattttatggatgtatccttaacgacttaatagttaatgctgaaaaaggaagtacgttaaaacaccctaaaattaactccaaattaagttttaaaatttcaattttgatagcgttttattttcaaatgatggacccctaggtacagtaagtgcaagctgaagagcaatgttggatgaatggtgagatggagggaaagctttattgggtcggtcaactgggtcctaccagccgttgaattgaagggtcaatgctttcttgccatcaaattttcactcaacgattaggctggatagtggatagtggataatggcaaatctgtgattgattaattaatgggatgatcatgtcaggtgattggacaaaattgaaccgcatgcgaatggcgatgcttttttctttttctttttcttttttgtctgtgagcaagaaaagcatcgtccaacgcattacacatttttgttggtgtactttactcccttaccaagttaccatttaaaattttaacaccatcccatggtacacaccagaatgaacaagtgtgggaacaattcaattttctatgaatttggaaatgttcccatattccaaacaatcatataaataaataaacctatacaaagaatcaaaagtgccaaatataacgatgcaatgtccaatgctgtggtgctgccagagagttctatgtaggacagtacgagtatcaatgattccatgtacagcccaaaacctgagtaccaatttactcactttgtctcgaaataaaccaaccttaaaatagaatcagatataaagtatgtccagatttgttgtcacatcctaatacgagggttaatttattttgacacagagggagtatgatagagcaaaaatgatgacatagtgatgatatatatggttggatgtagaggccaggtaaaaaaatgcccttatctaaaaaaagtgatgatatatgcgcctcaaagtagattctgacgacacccacaacaacggatacttccttcgtacctccgtaccagaaaaaaaactaacttctaatgctgcaacagaagtgctttttttaagcacggagggagtattaaggaacaaatgcattggaatgtaacttcacgaaaatatatggaacaaaaaggatgctgcaacagagacggttacaggggccagataagcttacagatttgatatcctataagtctcatgttacaactatatacgtgcacatatatataaccggtgagtaattttacacaagaaaaaaatgatatataatcaagtaaaactctaattatgaggcaaggcatatgtacagaagagcttagctgaagtgtgacctctagtacttatgccgcaaggagtttctggatgtccttctgcaagagatgtatataaagaagactgtgagcaacggggaatggcacaatgcattaaacagaataatgcggcacaagtgatttggaatattataaccaaaagagggttcagggatgtgcatctcaaccaaatgcataaacttttatatggaaagcacttgaaataattcaaaggtaattagtacatttagcaaagctatcttcatgacactaaaatatagcatgaaaattggccgaaagtaaaatagtgaatcgattcaataataagaaaaattgacttgtgactgatggactctggctttccactctgtgatgataacacaacgcaattacatgtgacaatgcacctagtactgcaaattggtatatttttataccaaagcaagcaccatgagtctaaagctccatatttgatgaaatggctacagtttagggatatatcctttaacggttagtaccatctgaagttctgaaccacattatctatttgcagcttgcattccaactgagcaactctcaactgagttctgggactatattaaagcaaatagccaatagagcccatgcaaactccataggcagcctcaggccatctgggctctggtgcaaataggtatatctaagggctccccaacactattgtaagaccgtcagatcagtgctctagtgttcatttttgttagacctggaaaggtcaataattaggtggacgccaacaacacaccaagggactgtatccattaattcttaatataataatgaggtaatgactttttagtaatgtcaactcttactaaagaggaaaaaaaattctagattgaatctttacagctggggaaaattggcatagaaatatatattacgacaatggcatggttcaaagagatttgcacaatatcttgcaaccactattagggctgcctcaccatcagtacctaggtacacaaaaaaatatgcaaaacatgcttgcttctttccaaaagtatgcatacatggtaggctcacaaaggctagtccattaatcttcttacaaatgcagtgtaacatatgttgggaatcttagtagagacagataactgaagttagtaaggttacaatacatattgatagatatgaattatttcattgatcttcaaagttgtacagaaaaaaatatatttcgagaactcaatctggcaaaccaagcgaatacaataaagcaagggtgttatgataaaggcagaaacaaaattcacctcaatctggaatggtgaagttgtaggtgggtatctctcaacaacttttccagttttgtccaccaagaacttctcaaaattccatttcacaagatcacccaaaaatcctccagcactcgacttaagaaacttataaataggggctgtgttaggcccgttgacatcaacctgccattgcacgtacaagcacagaaatgcatcatgcattcatatactattaattggcaggaaatattgagccaatcgcttcttacaatggagttaacataccttgtcaaaaataggaaattcagctttaaaccttgtacaagcaaactgcttaatctgcgggtttgacccaggttcttgtgcaccaaactgattgcaaggaaatgcaagaatctcaaatcctgcaaaatcagatgaagtattggactaaggtgatatcgcatacagtatatgaatccatgttcattccatgcctacagaagctttgaaaaaagaaaataaaagagccaagtgttgtctagtttcttatgcaatagctgaacaattcaatgcaccaaaacctaaaccagtgattatattaccttgagtcttgtacttctcataaagatgagatagttccgtgtaatttgctgttgtcagcccactggaatttaatttaaagaacagcgtgaagtttaatgccaggtaatgctgtataacttactatattagtatacagtatatcagaggagcaatgtattaagaaaaaataccactgagatgcaacattaacaattagcagcgcccttcccttgaacttgctaagcgcaacatcttttccatcaatgtcctgcacaaaacagagcaattttgttcaggcatgcatctcaacctataattctggcacaatgtgcccttgatagctggagctgtgacatgtcaatttgcagtacaaaccaacaaagcttctgactgcattaatctgatttggctaaatttcaatcacgttcaacgacacatctttcggtgatcaatctatggttacagttatgtgcacttataagcctatgactcagacaaacctcaaaaatacctagttactgaaattcagcacatcatttctacctaagtaccaacaattctgatacaggacgcccctgataggcgatagctgatttgctaatgttataatgtcataacatgagaggttggaagtgttctcaggataattgtatcgccttgatgtaattgttgagttcaatcaaagcttccattatctaaaaaaataatgtcaaaacaggagattttgtaaatacaacagcattcaccttaatccgtttccattatctaaaaaacaaaacagcattcacctgacccagccaattgcaaacacgttcaacaacagaacaaaatttaaacgataatctatcgatatatacgtgcttccaaggtgtacctacctcaacaacactaccagccacatcaaccacacacaccgcaacatccaaattctcaaaacctaacgcgcctcatgccctcacccatatcccatcgtcacatcacacgcaacgaatccaaactaaagcgcgggggcggtaccagtaccagtaccacgaggggcaaaagggatcgaaatcacgagggctcgaaatgccacaaccttgacggtgaagtcgtggacgctcttcccggtggcggcggtggcgtaggcgacccctggcgcccacctccgcgacggcgccgcgacgacgggcaccgccgcgctcccgtgcgtcgtcgccgccccccactgccgcgccgggaggaggaagcggcccgcggaggcggaggcggaggcggggcgcgtggccggcgcgaggcaggtgaagcgggccgcggccgccgccgtggtggtggtggtggacgccatgtggctcgcgctggcgtgcgccgcgtgtggctgtgtcgaggggagaggagaggaagtggaagcgaggcggcaggggtggttactggttagcgtagtggttgcggcgccggattggctcgcggcgattctggttaaggagcgggggaatttttgtggatacggccctgaggaagaacagatttctggaatagtatttgtgctgcattagatttgctccttttgtttttttttttgagaaaatgatataggagtacgagatttttggattgaatgctacgttaagatatactaaaaatccaagagatactccctaagatcattaatatttaatttttataacatgatttagttaatttttatgatcaaatatttatgaccaaaagactgaacaacagtttctcctgggttgtttgtcgatatgatggatgcatgaagctgtggaccaaagactatctgtgtttaagaggttaaccttgtgagctccataccattattcgagaaatttaacattgaggggttatttggttgaaaaccacaatatatcataatttgccacatattaagtgaggcaggttcgattatattagttatgtgtttagttcataaccacacttcacatattttttttatccattaaattagtcattagtcaatgactaaaaaaagtgtggcaaggttatctcttgctaactagttttgctaggctccagctccagctccacccctcatagagctggagctgtgacaaacatatcctaaagtgtggctttaaggggctgcttggttactaacaaaaatttgcctcaatttaccacaagtatggcaagtagaattgactaagttagtatagtgtttggttctagccacaagttagtcatgccaaatttgttggccagatcttaggtaagttagcttaaactctatgacaactctaagtacaaccccttaatttgccatccgcattcgaaattgtgcgcatagtctttccttccaaaagtttggaccatatccaaattgtaggaaccccaagggtgttacgtggaaaagaggcgggtgttgtttagctggtgctgtgggctggtggggaagcggacacgtgaaatgctgcgggacctcgcgcgcgttgcagcgttgggcgggtgttggtcattttcagtgggagagcctccgcgcatgggtagaacgtagaacaaattgtcaccaggcaattgtcaccatctttttaggtggtgtttggatccagggtctttaactttagtctctatatttagatactaatttagagtattaaatatagactacttgcaaaactaattacataaataaaagctaatttgtgagacaatttttttaagcctaattaatcaataattagtgaatatttactgtagcatcacataggctaattatggattaattaggctcaatagattcgtctcgcgaattagtccaagattatggatgagttttattaatagtctacgtttaatatttataattagagtccaaacatctgatgtgatagggacttgaaaagttttagtcccacgccttatccgcttcgttgcaacgtccagagtcttgcatttattaaggcccctggagctgtagtactactgttttctttttcccttttattttttgcccattttttgtggtggcacatggttcgtttgccgtcgctctggactgcttaatcctttggaatgtgatagtttggagggtaccccataaaccattttgtaggaggtttataagaaggtcaacatctttttttaagacgcatgcgagctttcacttaacgtgtgcttgttggtttatcagctagagacactaataattttttgaaacttagttttaaaggattttatgatttttattaacatagtctatttttcagcgttagtttctgaaaagcaaattgtttttttagtggctttgttcgtacttatccaaatggtatccattctactagggtccaaatagcagtacgagctactttttcatttttcgttttcaaaccgtttaacagtgtattttttaaaaaacaaatctattttttaaatttgtatatctaatactcccctttccactttatattataactttataagtcgtttgacttttttttccagttgacctaatttatagaaaaatatagtactccatgctatcaaaacaaacatatttcaatgttaaaatttaacagaactaatttaatattttagaagttgctaaatatttttaaatttgtttaaacttaacaatttttttttaaaaaacacttcaatatgaaactgagggatcgagggagtaacttgattaatccgtacgtctatcaactcagcccgaaacgctggatcgaacccctctacaagtccacattcatcttgaccatccatctccgatcggacggtcgatcatccatgttacactgaagtttgaacctgacgagaccacccatcgtctccctccctcaccgccgcgcgtgtcgatgcctcctccgcgccgccgcccgccctccgccgccgacgccgccgccctccgccgcccctacctccgcctcgtcgcgctctcctccacgctccgccacctcgaccagatcctcgccgtctccctcgcctccggccactacccgctcgaccccgccccggccacctccctcctcctccgctacgcctcgctccgcgcccccaccggccacctcctccgcctcttccgcggcttcccccgccccgaccggttcctccgcaacgcgctcctccgctccctcccgtcgctccgcccccgcctcctcttcccctgccccgactccttctccttcgcgttcgccgccacctcgctcgccgccttgtgctcccgtggaggcggcgccgcgtcgtcttccgcggcgcgcgcgctgcacgcgctcgctgtggctgcgggctacgcggcggacacgttcgtggcgtccgcattggccaagctgtacttcgtgctgtccagggtcgaccatgcacgcaaggtgttcgacacggtgccttcgccggataccgtcctgtggaacacgctgctggctgggctttccggttcggaggccgtggagtcattcgcgcggatggtgtgtgatgggtcggtgcggcctgacgcgaccacgctggcttccgtcctgccagccgcggcggaggtggcagatgtaacaatgggaaggtgcgtgcattcgttcgcagagaaatgcgggttggcagagcatgagcatgttcttaccgggctcatctcgctgtactccaagtgcggggatgtggaatcagcacggtgtctctttgacatgatggagaagccagatttagttgcctacaatgctttaatctctggttattctgtgaatggcatggttggttcatcagttaatctctttactgagttgatgaccctggggttgtggccaaactcgagcacactggtggcactgattccagtgcacagtccatttgggcatgatctgcttgctcaatgtttacatggatttgtcctcaagtctgggtttactgccaattctccagtgtcaacagcaattacaactttgcactgtaggttaaatgatatggagtctgcaagaaaggcctttgatacgatgccagagaagaccatggaatcatggaatgcaatgatatcagggtatgctcagaatggcttgacagagatggcagtggcactctttgagcaaatggtgaagcttaatgtgcgaccgaatccaatcacaatctcaagcactctttccgcatgtgcacagcttggagctttgtccctggggaagtggctgcacaggattatcactgaggaggacttggagcccaatgtctatgtcatgacagcgctcatcgacatgtatgcaaaatgtggaagcatttctgaagctcggagaatcttcaacactatggataacaagaatgtggtctcgtggaatgcaatgatagctggatatggccttcatggccaaggtgctgaagctttgaagctctacaaggacatgctggatgcacatcttcttccaacaagtgctaccttcctgtcagtactctatgcatgcagccatggagggttggttgaggaagggtggaaagttttccggtcaatgaccgatgattatgcgatcaatccaggtattgagcactgcacatgcatggtggacctccttggcagagctggccagctcaaggaggcttttgagctcatctctgaattccccaagagcgctgtcggacctggcgtatggggggcattgcttggcgcttgcatggttcataaggatagtgatcttgcaaaattggcctcccagaagttattcgaacttgatccagaaaacagcggctactatgttctgctctctaatctgcacacatccaagaagcaatactctgaagcagctgtggtaaggcaggaggcaaagagcaggaagctggtaaaaacaccagggtatactctaatcgagataggcaataagccacatgttttcatggccggtgaccgtgcccacccacagtctgaggccatctattcgtatttggagaagctaactgcaaagatgattgaggctggataccgaccagagacagaggcagcattgtatgatgtcgaggaggaagagaaggagcacatggtgaaagtgcatagcgaaaagttggcaattgcctttggattactcagtactgaaccggggacggaaatcaggatcataaagaatcttagggtgtgcctagactgccacaacgccaccaagttcatatccaaggtgacacagaggctgattgtggttagggatgcttcacggtttcatcatttcagagatggggtttgctcctgtggagattactggtgattcaattcagctgaatgaagtgcctctggtcccgagcatatgattgacttattctggtgatgaaagaaacgatcgtctcttactctttggaagagtatctgagccactgggatcaagaattgcaaccatagaaagccaattttcattggaccaggagaatttcagaactgaccgataaactaacatagcaggttacagattcaatttcgtagtgttggaacaagcacatttgtaatgcatcacaaagtgaatcttttgccaattggccattggcgttggatttaaatggcataacttgacttaggaagaggaaaacagtatgtcagtctatgcctctataagtgtttctctcgccagtagaatgatgagagaagtcatctcacgaactacgagggaaacacaagctttgtaacagtctgcaagtgcccaataggatggtgaaagaagtcacaaaaaaattactccaggtcaaatgcgatctatatcagttgcttgcttttcctttaacaaatctacacctatacattttatgcctaacatgctgaaaggactgcagtatctcagcatcgattgtgctccgtttgcttttggggtttcgttgtcttgatcatttgaaaattcttcagcagatgggcgataagtgcatctccagttctctatatgcatgttcacttgtgtcaactatcggcttctatgcccattccaactgcttcaaggttcacatgcatcctgatgaatagaagatgggcaggttgcttcaatgctttgaactttgaagctttgtatcaatcttgagacaaatttgatggttgtgatagtgcatgtacataatcaaacttgtacatgtgggaaaacagttcttgcagatgggtgtcatctttccaactagaagccttcctgttgcaattggacacagttatattagcgtctttcaagcaatattactatatttgtgaaatatagtcaatttatattattgtgcagtagtagcaggagccaaatatttatctttgaactgtaagtatgaagaaatgattgtttaagtagcttggttgatcaaaagattaagagtaatgtatgagaaatgtcgatgactgttaggcttcctgagagaggagataacttccaaactaaatgagaagcaagactacttgttcctacctagtccatcggtgcttggctgcttgtagttagactctgtagaccattcaatttgtgaaagtgacatttttggagctcaatggggataataatggatcttcaattcttcatgagctggtacacataacttccatgcattcacaaggaattgtgcactccatacagagagtattactgccttattctcgttctgcttctttggtaatccttcaccagtataatatttttgcacatctaaaaacttcttgctttcatgttaccactgccatatgtcctcaacagtgcatatagatgttaccaaacaccaaatgatacagctccatggtcttttctattttgcaagcacctctgtgtcgtcatcatccattttcatgccccacggagctgcatccaggcagtttcacgagtccctgttcctgcatccatctcctgatggtttgagatttatcccaccttccatacgaggtgtacaagttggacatcagcacataaaaatctggtgtttcaggatgaagtgctgccatcttcttgatggcttcttctccaaactctaacctggaatgtagcttgcacccatggagaaaggatccccagacactaattcctgctttgattggcatattctgtatgaactccaatgcttcctccagatttccggcacgggccatcacatcaaccatacatgcatagtgcttcatggaaggggtgatgttaaaatgtcgtgccatgctatcaaaatactcctttcctgcagtaaccattccagtatggctgcaagcggaaagtatgcttgtgaacactacttcattcgggtggatattttctttcagcatttcattgaaaagatcgatagaaccagctgaatcaccctgcatgccataaccgccaatcattgcagaccaagtgacagaattacggtcagtcatatcattgaaaaccctctgagcagatgggagatcagcacacttgctgtacaggttcagcagagcagtattgacatagatattggacataaatgcatattttatcgcataagtatgaaaacctttaccaatatgcagatctgccaagcatacgcaagctgacaaggcattcaccacagagatggcatcaggtgatataccctgcatcctcatccggttgaatagtaccagtgattcattggccatcccattctcagagtagcctgccatcattgaattccatgcgacaacatccttgatcaaaatccttccaaatatgctgttagcttctggcaaagcttgacattttgcatacatatcgacaagtgcattcctgaccacatcagattccatcgttcccaacttaacccctatagcatgaacagatcttcccaggggtaagtggcgtaactgagcagaagcggaaataacagtggctatggtaactgaattgggaacaatgctcacgaatttcttgtgaagaaaaagctgtagtgcatcaagaggcctcttattctgtgtgtacccaacaatcatcgccgtccacaaaacaatgtcaacaaactcgagctcatcaaacacacgtcgagcatcctctactttctcgcacttggcatacatatctagcagagaggcactgatgaaagagttagtagataacccgtatttgataactgatccatggatccacctcccttggtgcaaaccaccgagcatggcgcaagccgcaagaacactcaccatagtgtattcgctcggatgcacattgtcttgtctcatctcattaaacagaaccaatccttcttcagctataccattctggatggaaccgctcagcatcgacgtccacgacaccacattccgttcaggaactctatcgaacaccttccgggcgttctccaggtctccagctttcgcatacatgtcgaccaagctgttcatcacgaatccatccgcgccgccggctttgacgacgtcgcagtgcagcctcctcccgtaccggaagtccgccgacctgacgcaggccttgagcgcgagggacagcacgacgtcggcctgcgccgccgcggggcaccgccgcctcatgtcccggtggagcgcgacggcgtcggcgtggctccccgcgtcgacgagccacccgagcatgaccctgtaggcgtacgcgtccgggcggggcgtcccgtcgagcaccccgcgcgcggaggcgaggtcgccgagcgccgcgtagcagctgagcagcttggtgcgggcgcggatgccgcggaggaggccgctcgtgaggaggaggaggcgcccgtggagcgcgcgcagggagcggagggtcccgcatgccgggaggaggaggacgagagcggaggcgtcgcggggagcggaggcgcgcgccaggtgctcgacggaatgcgcggccggcgggtgcattggagtctcggactctgggtttcctcgttgcacgagcgcatccaatttgggacttcgaatgtggaatccaatggattagccgtgcgacgggctaggcccaatggtgatctaaggcccattaatcattgatcagtggttgggaatttcattttggaaaggaataagttcactttgactcccttaaatgtgacccgaatctaattcataactctaaaccgcaaaaccagatatctttacccctaaactgttaaaaccggtgcaatttgactccctcagcggttttgctgacgtggcgcctacgtggcgatattgaccgagtcttcattccacatggcgatgacgtggcacttacgtggcattagaattaaaaaaatgcgtggacccattagtcattcatacaaaaagaaatattcacacaaaaaaatgcgtgatgatgctgccgccgagctctatggcggcctgacccccgccgagatgagtggtgtagacgtggccgcttgggcgggcgtgaccctctaggatgagcacgcggatgccgaagcggagcagctggcgggcggtgcggcgaggctggcgccgacgacgagcacggatgcggcgaggcgctgcagcgcattgggggagagagagagagagagaagggagaggcaggaggaagaaggaaggagacagggaggtcccacatgtcagtgggctcaattttttattgtgtgaatgactaatgggtcccacgcatttttttaattctaatgccacgtaattgccacatcaacaccacgtggaacaaagactcggtcaatattgctacgtaggcgccacgtcagcaaaaccgccctccaaaaccgctgagggagtcaaattgcaccggttttaacagtttaggggtcaagatatctggttttgccgttcagggttatgaattagattcgggtcacatttaagggagtcaaagtgaacttattccttttgaaaaacaaaattcttctgctttactagttacatcatgtactcatatgttgtaacgggccaagcttatataattttttaaaaaagagcccatatattttaacagatcatacccatataattaaagaggggttgggagcgagactaagaatagaatactaggtctggtggttacttttcgcgtagtacgtgctgcgcgagtcgagttgggaggaggtgatgaaaggaggacgactccgcttgtaatttagttttcatatcacccagaattctaatatcatatatatatatatatatatatatatatatatatatatatatatatatatatattttctctcgaataccaaaagagtgcaacttaaatctcttatcatctttgcttgggctatggcttattattacctaagaataatatacggagcaaccaaaaaatgattttggagtaagatttttatacatctactttagcaacccaaagattaaggctgaaaaacagacaataaaaaactatctaaaataattttaaaattcaaatttggctctatcttaagtttagaaaggaaatttaactacgctaaaagttgagaagtttaaaccagcatttttttaatttatttatgcgctggtaaaagtttacctcatcccttcttgtccacctcaattgcgtggggaaatagagtaatcaattattgtaacaaacaattagttttcaataatgaaaagatgatgtgaggccatgactttataggttgatatgactattaatattgagggtatagaccaattagcacgatttttgtcccattgctggttttaagatcatgtaaagatgatgacacaagctttatggcttcaacgttacaaatgtactgtattactgtgttgttgtgatgtgaggatgatttaagatgatgtcacaaactttaggggttaagtggactatctaatagcttgggtagtaaaatgaagtattgtccttctgttgatctatatgatgcgaaaaaaaatatataaaccacaatacagttcatgccttgctgaaatgtgttgatgtataaagacaacaacacagttgtaattcaatagtagatggacaatgtgcatatatacaagacaacaagcaggtatatatataaagatcttttatattgatggtgcatgtacctatctcatggacttctttgatgaatcatgatttggtggaagatgttgcagcatcactgtttttttctagacgacatggtaaattaatgccacagtttcatgatgcatgtcctatagctaattctgcattttgttagcagtatttgcctccgtggctccatgcatgtctccgtgtacagcactaacaaacagaagaggacaaatcaagggtgtttctatatgcatttgtacagatcatccgtcatgttcactcacatgcaaaaaaaaaactactaattgtgtcttaagtcttcattttatacgcatatataatcataaatggaaccatcctgtgtacgtatgctatcataaatggaaccatcctgtgcatgctcttaattaatccctattacctttcaagcaatatatatatctagcaatataaaaacacattagtttcttggattgatcatggagcgcatgaatgtcgatagagcaaagattgctcctgtataggacgaagggttagatgcatgagaaaatggacaaccattgaaatttgtagcatgcatgcatatataaatgagttatatacttttatatgtattgtccttgtgttgatttaaggattttttttaagaaacatagtacaaccattgaaattgtagcatgcatatgaattagtatatacgtttatatgtattgtccttgtgttgatttaagattgttttttttaagaaacatagtacaaacactgaaagtaagtacaatgaccttgaaacacatccaatcaccttaaaacatctacaagaactgaaggaggcagataagtccacttgatcaaatgactgctctatttgtagaatttatggtagtaatattagtaaatgtcttgagccgtggtcctttatagtcaaagttatttgcttcattagttgggtttccaactttccatcaactgctggctctgtggaatttactctttaaaatatgcctgactgttccttgtggtcctacaattcttttcctcccttgttgcacaagaatatcttttattttggtggcaaatcattcaatcaatctacacatttttgactgcataggaaaggtatgtgaacagatgggacataaataatgaaggttgtttagaaaagcaagaaaattgtgcttacactttgactccaaaatccagcataccctatcattagatcgacatacattgaagtacatatgagaaagcatcttcagtctaatgggtagctagagtaatccgcgagtgactctacctactattgttcaaaacatagtagtcacatttacctgcagatgtgtaagtttttggtagaagttcgtaggtgttgagtgtgtcctcgtgtgggttctccatataatacagaaatataaataatgcctccttttttaagtgtatgttattcttaacttttgaatataacgtttaactatttatcttactaaaaacacgtgtgcatcatttaactatgtaaagtagtaggtaattattttatcatcaaaagcagttaatttaagcatatggtttacatatatggattacatatttaatttgtactaaattttttaggaatatagttaaactcattttttatataaaaaacaaataacatcacatttaaaaacggtgagagtatttgcctatagtgaacacatatgtgattgaaaatggagcaatattagtcaacaaaagtcaccggcgttggtggcgccactccaccagacgcccaactttgctgcacggatttaggtaggtacgagaaaactactgacagaaacaagcactgccccattttattttattattattgagaggaccaagagtcaacttagtttgacgtgatgccacaatatttgatcaagctggacactgtgacatacgatggctggccaataattattttgccatctagcttgaagtggcagagttactaattaaacttactccgtacttataaaagaagtcgtttaggacaatgtttaagtaaaaaatttagaatataaatcatgaatatctctcaagttgttgagtttaaaaatgtaaaaattatatgaatagatttgtcttgaaaaatactttcataaaagtatacatatatcacttttcaataaatattttttatggaaacatgaagtcaaagttgtgttttggagac

SEQ ID NO: 74273 - DNA, 757 bp, Oryza sativa
ctccgccacttctcagtctggtgccccgcaatgaaccatgctatacaaaagataaagccgttgcccacgctggcttgtggttggcacggttaatgtttcacaaccgaaactcgtgaacctgtccttaattgtcatgagcacgaccatcaaaaccatgtgctcacaacccaccattaccaggttttagttggcacattaattaattaaccaatcacgattgaccatcgtgaactatcattaagccatcattaagtaatagtgagtcataagttatcccaatagtgagctaatgtttctaagcagggctaagctattatacctaatatctagttgaaccaatataaataaagctcacctagtcaaattataataacccaaggtatcaaggaataaagtaatcaagaacaaaagggctataacaaacaataggttaattccacccaatgacattcgaaaataaatgcaatagttgaatagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaattttt

SEQ ID NO: 74274 - DNA, 6390 bp, Oryza sativa
tagctttaaacgggatcaacatgctcaaagggttgtttgggatctgtgtgacttaccttgctggccttggaactcttcaaactcttctccggcgaaaacggactctccggaaacgacggaatctaagcagaaaagagcaaaatcaccaaaacagcacataaacaagcatgaacagtacatgtggatatttttaatatgtagatctcaattttagaaaaatttagagacttgaaccaactaaatcggagctaagatgaattagttatgaatttttgaagattaaatcggattaaaacacttaaattgattttaattgaattatgacgcaataatgaattacttttgaaaaggaaaaaagggatttattgcgtcagcgggctagggtttcggtggaccgggcgcacggcggcggttcacgcgaacggatggccgagatcgacttgatccaaaacggacggccgagatcgatcggtccacgaccggctcacgggagagggcgacgatgacgtcagcgatgacatcaccaccggcggcggtggctcggcggctcgggcttgcatgctcgctggcgaacgacggcacggcggcgcgaacggaaggcaccaatgggtagagcgcgacgcggcgaactcaccggtgaccaaaagagcagcggaagatcaacggacggcgacggcgacgaggaggaagcggcggcaaacttcgggttgacggcggcgacggtgctccggcggtcttcggcggcggcgaaggagcggacgagaacggcggcgacttggcgatcacgacggtggccttcccgagcgatgacgacgaccgagacggcggcggcgcacggctgaagcgacggcggcgacggcggcgctatgttgcacggcgctagaactctttcggcgacgagaggcgaaggcgagagaggcggcgggtagaggagacaccggggaaccttttaaaggggctcgcaggcgacggcgaaggcccccggtggctggcgacgagaaggaaggtttagggttcggaggaaagagacgaatccgattcgagctcgaatcaaacgatttccaaaaagaattagccgatgattccaaaacagtaaaggtagatgagatcccggagattgtttcccctctatcaattcggccggataaggaaaggatcgaccgaatttggaaaggaacggcggcggcgcgaaactagggtttcgggcggcggcggccggaggtagacgacgaccctgacaggtgggccccacctgtcagcgggcggacgcgcgcgcgcgcggcggcggactgggccgacttgggccgaggagagagagagcggttttgggccgactttcggcccaaagccaaaagaagacttttaaaacctttttcaatttaaattatttcttaaatgcaattccatttattgaaaatacttccttagctcaaataaatcccagaaaaatctaggaattatagaattaagcaaagtatttaatgaaattttatctggcccctttttatattggaatttattaattaaaattagatcttctcttctagacttttaaaataaattctaaaaattccatttaaacaataatttatatattttgaattttcagggtgtgacaaacctaccccccttaaacagaatctcatcctcgagattcggaagaactggcgaacagatgcggatgagctgacttcaattcatcttctcgttcccaagttgactcttcttccgagtgattactccattggactttgcaaaaacggataacccgattcctggttcttctctcatctatttccaagatacggattggtttctcaacataggtcagatcctcttggacttctatctgttcaagattagcttcttcggtaggtacccttaaacactttttcaattgcgaaacatggaacacattatggactcctgccaaagattgaggtaattccaattgataagcaacctctcctcttctactgacgatcttataaggtcccacaaaacgcggtgccaattttcctttggtatgaaaacgatgaactcctcgaaaaggcgtgacatgaagatacacataatctccttcttcaaaactcaaatctctgcggcgattgtcggcataactcttatgacgagactagaccacacgcaatctttcttggatgattttcaccttttcttctgcttctcttaggatatccgtcccgaaaacttgacgttctcccgtttgatcccacaaaagcggagtgcggcacttctgaccatatagtgcttcgtaaggagccatctgtagactagcttgataactgttgttgtacgaaaattccgcatagggtagattcttatcccaacttccaccgaagtctaaagcacaagctctcaacatgtcttccaaaatctgattcaccctttcggtttgtccgtctgtctacggatgataagcagtactaaagttcagcttagaacccatctcttcctgaagtttcttccaaaaatttgaagtaaactgactgcctcgatcagacactatcttcttaggaacgccatgcaaacacacaattcttgccatatacaattccgctaaccaacttccggaataggttgtctttaccggaatgaaatgagctactttggtaagtctgtcgactatcacccaaatagagtcatggcctgatgacgttctgggtaaaccagtgataaaatccataccgatttcttcccacttccattcaggaatcttcaaaggctgcagcaaaccggcaggtttctgatgttctcccttgactcgctgacaaacatcacatactgctacgtattctgcgatttcacgcctcatacttgcccaccaaaatctttccttgagatcctggtacatcttagtactactagggtgaatggagtataaagtatcatgagcttctttcagaattgcatcttttaaatctttgttgtcggggacacagattctctcacccaaccatacagttccgtgctcatcctccaagaaaccgatagcttttcctcttctcatattcttcttgatctcttgaatatcaggatcattaatttgggcttctctaacttgatcaattagagtgggcttcgcttctaaggctgcaacgaaacctatactgacaattcccaaatttaatctttcaaattccttgcataattccaatggcaactgtcgtccttccgtagcattgcaatagcctttcctgctaagagcgtatgctacaacattagcctttcccgagtgataatgaattcccatgtcatagtccttaattaattccaaccatctcctttgtctcatgttcagatccggctgagtaaagatatactttaaactcttgtgatcggtatatacctctgtacgagtaccgaaaagatgatgacgccaaattttcaacgcatgaactactgcagctaactcaagatcatgagtagggtagttcttctcatgcggacgtaactgacgagatgcataggcaaccaccttcccgtcttgcatcagaacacaacctaacccaagtttggatgcatcgcaatacacctggaaacccttctttggatcaggcaaaatcaaaataggagctgatattaagcgactttttaactcttgaaaactctgctcacattcttctgaccacttgtacttcacatctttctgaagcagtcgtgtcatgggcttagcaatcttggaaaaattctctataaacctccggtaatatcctgcgaggcctaggaaactgtgaatctctgaaactgtctttggttgtttccagttggttacggattccacattactaggatcgacggcaactcctcctgctgagatgacgtgaccaaggaacttcacttcagacaaccaaaattcacacttgctaaacttagcatacagttgatgttctcgtagcttctctagtgcaaggcgaagatgttcttcatgctcttctttggttcgagagtagataagaatatcatcaataaagaccaccacgaacttgtgtaggtattccataaacaccttattcatcaagttcatgaagaaagcaggggcattggtaagtccaaaagacataacagtacattcgaacaacccatacctagtggtaaaagctgtcttaggtatatcttcctctttgattctcaactggtgatatcctgatcgaagatctatcttggagaaaacagtagcacctttaagctgatcaaacaaatcatcaattctaggtagtggatacttattcttgatagtcacatcatttagtgcacgatagtctacacacatcctctgggtatgatctttcttttccacaaaaataaccggagctccccatggagatgaacttggtctgatgtatccttactgaagcaaatcatctacttgcctcttgacttctgccaactcattggctgccattctataaggtctcttatggatcggagttgttcctggtaccaaatctattctgaactctatatcccttttaggcggcataccaggcaaatcatctgggaacacatcgggatactcccggactataggaatctcttccaaagttatctggttcagtcttgaccttaaagattcagaagacaatgcatgaacagttaccactcgaccatcattgctggtgagagttacttttctgttagcacagtctatcacacctttatgtctggctaaccagtccatccctaggatgacatctaggtctttggattctaacaggataagattggccagaaatggtactcctttaatttctattctgacagaggggctacgttgcaaagagagtgcttgattacttggggtactaaccatcaaaggacgtctaagatcttctactttcatcccatgatttcccgcaaaactcatagataagaatgaatgtgtagcaccagaatcgaaaagcactgttgcaggaactaagttaacaaggaacgtacccaaaatcacatctggagcatcttgagcttctgccgcagcgacatgattgacacgagcctttgatgctggtgcggtagagttgctctggacagggacaaccttcatgcgtcggggcttcggacacttgtcagcgtaatgtcctgggtctccacagttgaaacacaccacgggcttgctgccatgctccctcttggcaggctgttgctgtgttggagctgcaacagggcgtagagcttgattgcggatgttgttgccagcattgttgttgaagaactgacgctgcggacgaacaacagacgaagaacctccatgtggcatggactggggtcctaaagtaagacgcggcctctgattattcccctgttgtgtcttgaattgagcaatccggcgtttcttctgctccatgcggttgtatttgtcctcttgacgaatagccttatccaccaacttctggaaatcagaataatccccagtcatgagtgggtaagaaagctcatcattaagtccttctaagaacttctcctggcgctcttcatcattgcgcacatcctccggagcataacgagccagacgattgaactcgtgcaaatactccgtaacagagcgagatccctgggtgagcgacctgaattccttcttcttgagggacaccactcccgatggtatatgcgtcttccggaaagcagcggtgaattcaagccaagtgataggttcagcagtagtcctgttcagacggaagtgatcccaccattcagaggcagggccatgcaactgatgtgatgcaaatgaggccttctcctgatcagtgcactgaagcaaatccaacttcttctctatggcatgcaaccaatcaccagcttcaacaggattagtggtactagagaaaataggcggcctcacacgaagaaattctgctaacttgttatggggaggtgcatggttatttccttggttctgctggttctgaagttgctgcatcatcatgttcattaactgagtctgttgagcaagaacttgagcaagagtgggattcccttcattgttattgttactggggccattcccattgctgcgagtgttcaccatctggcatggacagggcacaagaagagacaccgggggaaactacttaggacagagaattactttaacttttattgatcttaactgagtttcattattacaaactgaagactctcacaccactaaactcaccaacttcctaacactcaaaagcaaacaaacacatgcacttacatcccaccactgatgtaaatcacatgcgagacacacacaaccaaacttaaaacaagcaagctaacacaacgatctaagacaacgacttaacaagtcactctagttcttccgagcatcggaggtcgattgaaggctcattcgggtcgtcttcatcatcttgagttgctacccactca

SEQ ID NO: 74275 - DNA, 1184 bp, Oryza sativa
ttttattcaaaaaatttatgtaattatcatttattttattgtgacttgattgatcatcaaatgttctttaagcatgacataaatatttttatatttacacaaaaattttgaataagacgaatagtcaaacgttaatcaaaaagttaatggcttcatatattaaaatacagagagagtatcaattctttgttcagtacggaggccgagatctgtgatgcgaaaataccgggacggcggacagaatctaattaaatcggatcgcgtggatgacagatgatgcatggcgggcgtcgggcgatatgagacggataaaaatcaggtgtgtgatgaaaataaaattacctattttttaaataatttcgattagatttctggactggtatatatatatagacctgtatttaatttctctggggtagctcgtattaaggacacccatacatggagtacatgttaacatgtatgctgtggattaaggaattgactgcatctcttagcagagattcctccaatgggacagaaaaaaaaacagttgctttactcctataaagcacgtatggcctgatgttaaaacctgcaccacgcatgaatagattgtccacacgagacttgtactggcttgatgggttggaaggcaaagtctgccatagcttgataggtccctagcaagattatttatttgtggcttccagacaatttggtaaaccaaactttagttactatccataaaaatattaaatatataggcccacattagtttggcaagattagcaagattggctttctagtaatgttgtggctcaattttctctaatcatgcatgactttactgactaagaatctcttttgtaatagagagaacacttggataattggatgcttgcatacacgcgcatcacactaaagatcattgcttcttaaatcttaagcagctgcaatattgtcggatatttcaaatttttcataaaggaaaaagtcccagagtcttattataagtggtgggctagccggtttaagttaaagcctccacaaccttttaggctgagttaagatgttttgttcactttcccaaatccacctctctcgtttttcacttgtacgtttttcaaattactaaatggtgtgtctttcgtaaaaattttctaaataaaagttgttttttaaaaaaaatcatattaatccat

SEQ ID NO: 74276 - DNA, 2286 bp, Oryza sativa
taagatcgtctcattcaaattagttaagatgtcttattgtttcaactatattaagataatagtctctaagtgatgtgtaactaattaagagctcatcactagctttgtacatacactaatgaactcattttcagtatctatacttctttcaaaataaggcagtgattatgacagtgaagttgccacctccaccaactattgacaggctatacccgtctacggtatttgtatagtataagaatcgttggtactagggtatacatgatattgaggtaaaagcgataggagacagagattttatataggttcgttcgaaccccctaactaacaggtaatagtcatactcctatttatcgaagccggtattgcctttatatatatatatatatatatatatatatatatatatatatatatatcaatcacacaagtacaatatatggtatgagctaatctagtttccatcagcctaacagcatagagtactcacatgtggtcggcgactagcgtagtcagctttcttaaatatattgggtagctctagattcatcatgtcggtctctattgcaccatattgggtttatctaggtatatattgtcttgtcttgtcttccatgttagtctctctcttaacctcctatggatgtcttgtatttatacccttaagtaccctcctatccaagtaaaactagggaaacaggtatgtaaaaactatccaagtagtcctaggactatgtttctccttctttatctggaacaccttctatatataagctgacttgattctgtataagacttgatatatagtgggcctcaccgagcctaacacaaaagtatttggtataatttatctgtaatactaacaaatattgtatagagtattattacttatttatattttttttacctactcttcctttgcatatttacatataaaagtcattttacgtatgattctacattattttatcttaaaatataaaatataagtttattatgcaaaggcatatacatgcaaagggacaaaattgtcaaaaagaactttcaattaatttgttccaagcaatattagcatacattcaatttaatcaggggaaactattctaaactataaggtgacgtcccatcgatatttgcatgccacttaaatagttatgaaaaaaatttaacttttacattttgcaacgaaaaaaattgactgtgaatacacgtaaactagttgtattttaatttgttttttcgttgtgacttgtagaagttgaattttaatttgcatgtttgtgaagtgatatatcacatgttaataatttttttcaaatttttttaatttattttatgacgtacgaataaccaggggacgtcccctccatagtttaaattaaattcactctcttaatcattagccgggtacttaaatagttagtcgatcgaaaaaatagaactcatcaattcttcagtgccaaaaactcatttggaattggaaactgtcagctccaccaaccacgaacttcgcctctatttaagcgaacgaaacacacgcagaaacctgcactaccatctcaccactgatcagtagctagctcgtgaagaagccatggcgacggtggacgtgctgacgtcggaggtggtcgtccccgccggcgagacgccggcgggcgccgtctggctgtccaacctcgacctcgccgcgcgccgcggctacacgccgacggtgttcttctaccgccacaacggcgagccggggttcttcgcggccgacgccatgagggacagcctcgccagggcgctcgtggcgttctacccggtcgccggccgcctcgggctcgacggcgacggccgcgtccaggtcgactgcaccggcgagggcgtggtgttcgccacggcgaggtccgggcactacgcgctcgacgacctgatgggcgagttcgtgccgtgcgacgagatgcgcgacctgttcgtgcccgcggcgccggcggcggcgagctgctgcccgcgcggcggcgcgctgctgctggtgcaggtcacgtacctgcggtgcggcggcgtcgtgctcggcatggcgctgcaccactccatcgccgacgggcggagcgcggcgcacttcgtggagacgtgggcgagcatcgcgcgcggcgcgcccgccgcggacgcgcccgtgccgccatgcttcgaccacaggctgctcgccgcgcggccggcgcgcgcggtgctgtacgccacccggagtacaagcccgagccggcgccgccggcgcgcgccgccacggcgtccacgtacgcgagcgcc

SEQ ID NO: 74277 - DNA, 21911 bp, Oryza sativa
ccgctgccgccggggtacttcggcaacgcggtgatccgcacgtcgacggcggcgacggccggggaggtggtgtcgagccccgtggggcacgcggcgcggcgggcgcgcgcggcgacgagccagggcgaggactacgcgcggtcggtggtggactacctggagggcgtggacgccatgaacctgccgaggagcggcgtctcgcgggcggacctccgcgccatcagctggctgggcatgtcgctcgccgacgccgacttcgggtggggctcgccggcgttcatgggtccggcgatcatgtactacagcgggttcgtgtacgtgatgaacgcgccggggaaggacggcgccgtcgcgctggcgctgtcgctggagccggagagcatgccggagttcaggaaggtgttcgccgacgaggtggcgcgattggcatgacacgagtacacgacgctccctgcggttgcatgcatggtgtccacgtaaacgttacgtacgttggcatttcgtatacgtatacgatcgagcttgatgtaagtctgtaatgtgtatgcatgtacgtactgtacgtatatatgtacgtacatgtagaatgttaccgtgcgtatacatataagatatacataaatctggagtttccggattcacgtatgaaagtgaagggtgtagtgtatattcaagcaggcatggcataattaatcacaatatttgaattgaacttgctaagctagctagtgctgatgcgatctccacgtgcttatttgtaggggtgcttttttaataatgtttagtatgagtgctagccctaccaaaagttttgtgatagtgactcatcttcctagtatgttgcaatatggaccttataatcccccttctacttttaccgtttttagtaagagattaaggatgaaaaaaagactaaaatacccttgaggtatgattatggatagaaaggtggtctagggctataatgggaataaatttgaattcgagttaattaatgagacaagtaccgcaccaaaaccccttaaaattttaggccaaaactagaatggataaattccttacgttatgagatagaggtcatattttaccaggagtacttcaattctttctctcccacaaactctctcatgtggatgtcttatggcaaaagtctactttacattccttcactatttgttgagatggtccttcctctcttatctcgctgcccctatcaccgttcctatggtttcatccattccccctaccccgcaccttcctctcctcctctactgatgtgccttcctccttgcccgtcttctcatgcctcaccaccaccggcctccctgcttccttcctctccatctattggttacccctcgccatagctttctaggcttcatgatcggtggcctcctagagctcgagcttaagtggcggtggcaatcggtgcagagctcgagtggcggtgtagagcctcccaatatgcttcgaggagggccagcgtgaggtgcaacccccatatccaccataatcaccacctgggtttcgtgatagtccgtggggaggacaaggacaaaaggagttcaatagcaatggtaggggagctaggcggtgcgatctgttttcaccaccacctccaggtcatccttcccgctttcacatccaccttctcctcgtcgatctatcccccttcgccattatcatgcggtcggccaccaggctgccacctacttggagccatgctgttggtgtagtccacaggaatgagagggaaaagaggagcaagagaaggtggaggaagaagacccgttgtcgtgcaggttaattccatttgtatttttactgaatgtaatgccacatatacatcacatcggatgtaactatcgtcaaaaccacctagagaggtaaaataaaccgatattaataattaagagaggtcatatacttggtttggttttattgtttaagttttattgtttaaggaggaaaatcacgaactgacccgtagttaagagacgtaatctggatactttttctatgttttgcatactcctagaaatggaccaaatactcggccagtccatggtcaggagcctaggaacttaggaagcctggttgaagtgggcaaaatgtcttctcaaaaaaaaaaaagtgggcaaaatgtcaccagacaccggctagcaaaatattcggtccaaaaatagactaaggtggtctggtgttgacccatttcttggttcgcccctaagtacttcctctgtcgggtttaaatttgaatgcttgctcgtttgattaaaaagattgttaggatagaatatgcaagtgtttaagtatgcacttgcagttgcagatatgtacgcaagtctatgcatggcactcctagtaggcttttttttttcaaaaaacaatccggcggttgaccactcatagtgaatacagtcaaccataaaagtcttaaatcatggggcttgaggctaggttatacaatttctttctcaacttctgcttatttatttttcgcgtccacgcttttttttaaaaaaataaagaaaattgttcctaaaaaatcagaataatttatttattttaaaagtttttagctaatactccctattgtattttaatgtataacgccgttgactttttatatacttttgatcattcgtcttatttaaaaaatgagtaaatttcacaaaactacaggtattttgcataatttatcacaaaaatatagatttaagagcttgtttcacaaaactacagacttagtatgtccgtttatcacaaaactacaggtactttgtacaacctatcacaaaactatatatttaagaacttgtttcacaaaactatagatttagtgtattcgtttatcacagaactacacatttagtgtcttcatttatcataaaactacaaatttaattagtatctccattatcacgaaactacaggttttaacaatgctgaaacatgtagtttgtgataatgaagacactaaaacctgtagttttgtgataaatgaagatattaaatctatagttttgtgaaacaatatcttaaatctgtaggtttgtgatatattgtgcaaagtacctgtagttttatgataaacgaagacattgaatctgtagttttgtgaaataagttcttaaatatgtaattttgtgatagatcgtgcaaagtatacgtagttttatgaaatttactcttaaaatttatgtaattataatttattttattatgacttgatttaattatcatcaaacatttttttaaggatgacataaatatttttaaataaaacaaatggtcaaatgttgataaaaagtcaacggtgtcatacattaaaatactgtgggaataattaattaatcatcattagctgatgaggtgtatcgtttttttctaccgaacgaattagttacgaactcagaggcgttcaacacatccttagagactgcttttccggttgaaaaagcatacccatgattacttgacgggtggaaattggacacagattttgcgtcgtgcaacttttgactgaagttagtgaagcatacacacgtagcaactagcatgcatgacggatggtgatgcgcacacgtacagtcgttggaaaatattgttagctttgtgcttcggtcgtgcaataatacccagaaaaagtacgaactatcctctaaactatcagactgtatgaattatttctctgaaccacaaaaccagacatttttcacccctacctatttaaaccgaacaaataacctctctctcccggcttaatccacaattattttggtcctacgtggtagtccagtcaacaaacattttttacaaaaatcggaagacccaaccagtcagtttctcaccctctctatatctctctctattctatctctttccccaattcgtccctccgctctctctctctctctccctcttctccctcccctcacctccatcactcaccggcagcagtgagttgagaacggcggaggcgggggcgaagccggccagctgggggtggtagaggggggccgaggacggcgacgggctggagtgcagacagcgcggatccagaaaaatgatgcggcggttggcccggacggtgtgctctacctcctcctccaccgccgatcgcccgagctcgccgcctccaccactggccacccgagatcgctctgcctctgctgctagccacccgagctcgctccgcgtctgcctctgacgccgaccgcccaagtttgctccacctccgcctccaccatcggcaccagaggtcgctccacctccgccgttgggtaaattacactttttccataatatattttaaaatttagagtaaattctagtttgggttagtatttttttttaccaaactttcattttggactacccctaacctaaagttttcacataaagctgagatacgtttacctcttttgcactttggatcaccctctccatctctttctttgccacgtccagctctcaccaatcaccacctggagcttgattgatgaggcaccggtgagcctctcttctcccacaccagtgagctccttccctatctctttctccctcggataccctagtgtctcaaccaccgatgccgctggatcaaaaagtaggggcagcaaggtggcaacaagcttcgccgccaggttagaatgacgcaagggcagtccatcggtttaagacgacagagagatgtaggtggtggtgggagctagaggtggagaagagagagctgaagaaagagtggcccacaatgtaaaaggggtaaacatacctagctttatgtgaaaattttgaattgggggtagtccaaaagtgaaactttggtaaaaagaacctactctaaactacaatttactctaaaattaacagtttctacaattaaattgaagctatgatactctcattggttataaatacagtatttgacagttaagactacatctaataaaaaaagttgaattttgaccaccaataaaacttctcaaatgcttagtattttataaaagaaaagttatatgcatagattagccttaaaagttatcatgatcttattagagtttattaacttgtcctgatacctaaaattaatggctaaagtttcataactttgatcgactaccgaatattgtgactgtaaagacagatgcaatagagacatttgaagagtgacatttggtaagggaggcaaatagttagattcagagcatgattcaagttttatgtacggatttttaataagtacatgatttcattatttgttaaaacacgcgagtgtaaggccccctttgatttggaggaaaaatataggaattttgtaagattatgatcctataggattttttttcctatatgaccctttgaaacaaatgattgaaaactattgaatcctatgaaatttctaaggaaagtctcaatccacaaagttttagaggatttttaacatgaggtccaacttcatgagtttctattgagtctatctctctcatctcattcctatatttttcttgcggtttaattaaacgattattcctgtatttttttctacgttttacagtcctctattttgtaataaaatttctatcaaaatcctatattttacttattccttcattttctcactccttttattcagaggagcccttgtgtgcactacatgtcagtgcttcgtgtgttgtggtggccgcaataagtctggaaaaaaagggcagtttgaccactcatcatgaacgaataccatcaaccgtggaggtctaaattgtgggggtttgtggagtactttagccaattctgctagattgcctatccggtggaacctactttaaattcactactagcaaatttaattggacagagatttgcatcgtgcaacttttgactgaagtaaattaaacacgcatacctcataagttattttaactttttcacaaatcatacttatttagctttgtccaaatttataagaaaatatagtaatatttcaacataaaaaatattaaaatatatttaatattggatttaagaaaattaatttaatgctataaatattattatatttttctatatatttgttaattttttaagaagatattttaaaaaagtcaaagtaaattataatatatgaaacgaaggtaggacgtagcacgcccgatggtgaattggtgatgtacagcagtacattactaagaaaaatattcttacctccctgttttggtcatacagtttacatctttttagtattaaaaataaaatttgtagttacagtgaaactatagttacagcgagactcctatcaaaaatgagatacatgtgaactatggtaatttgttcaaggggcaattacatccatgcccttactttgaaagccaattacggttttacccccactttttagggtttgcatttttatcctcaccttttaaatttgaatcagccgtgtaccatcacttctaacagttagttttaacagtgttagttgtagagaaaaggacatttatacccttggtggttattgtattttggcctctatttttttcagccttgtgtgattttgcccctattttgtgatttcagctggtgtgattgttataaataattcaaatatgagcatttcttgtgatgtttttgtactttaaaaaaaatcacaaatactaggcaattacaaaatttgaccaaaatttgaataaaattttgacaacatttcgacagaattttgacacaactagcacaagtcacatatatagcaagcattacaaagtgtcctatacaaataagtcacgatacgtataagtcatctgttggaattaatgaatgggccttagcccactcgaagattaattctttggaaaatcacaaaagcccacctcatgggatggcatgcatgtggagtttagtaccaccttacttattctaggagagggggacctccttaaaagggaggatgccctcctagccacttgaagcatgtgtggtggagagaagaggggaaacacacgcgcgcgctcgctcgcctcgcctggcagggcaggcggcgcgcgtgcacgacgtacgcgtcgaatggtccaaaaaattggctcctcacccttgcgcaaatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcgtcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttacgcatatttgatatgttcatgttattctgcgtagtttacatgtgtagatctaatgatgcgttcatgctagttttcatctgtaatgtcataatttatttatggaataaattaaatcattatatgcccataatctcaacaatccaaaaaaccttattataggcactgtgattttactatggctggttttgccggtgcactgaggccggataaattcaccggtgtgcattttaagagatggcagatcagggtcactctgtggctgacagctatgaaatgcttctgggtgagtacgggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctaaagtttacttcgggaaagatcgtgcagctgaagaacgtgcagcatgtcccttctatcgacaagaatcttgttagtggctcccgtctgactagagacggatttaagttggtttttgagtctaataaagtagtcgtgtctaaacatggatattttattggtaaaggttatgagtgcggaggcctgttccgcttttccttttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtagactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcaaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtatgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacttctaatccgggagatgatcactggcgtgcgcttgagcgagtaatgcgctatctgaaaggtactgtggaattggggcttcactatactgggtatcctgtggtactggagggttatagtgattctaactggatctctgatgtggatgagatcaaagccactagtggatatgttttcacactggttggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctatcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggttgtaacccagtctatgtgatcggagatcccgtgaattagatcctgggaagaacaaaccattaataaactagaggagagtaccaatatatataccctatccaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcacagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcagggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcgtcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctttaatgtcatgatttatttatggaataaattaaatcattatatgcccataatctcaacatcatcgagcacaaatattacttagtgtccacagatcaaaccttaacagagacagatctcactgaggtgaagttaatcgaggggtggaaggggaggaactcgtcgatggtgtagatgtacttcttcttggagataaacttcttcatcgaagcagtcacccggatcgttttcttggggtcgccgtccaggacgatgatgaggtggtacggctggaagaagggccttgcacaaccacacagagccacagaaaagacatcttcttttgaatcagaatgccaccttgcactttgaacgataagcccaagagcaaacctaccaccttgctcgtgcttcctcccaaatcctcttcccaaatgaagccacacacgcttaactttgaccaggacgaacccatgatagataccaattcaaaaaagaaaaagaaaaagaggcaaattcaaaatcttcacacacgacgcacctcgatgctcttcaccgccggcttgttgagccccttcaggtgccggtgcggtgcgccctcccctccggagacctcgccgccgcgcacaacaggcagaccaccgccaccagcagcagccaccaccgccgcgcgtggtggccatgtgcggctcgcctcctcacgcctccaccgctccctcctcaaatcgcacttcacttcacccccactttctcttcaccgacgaactcacctcactgccgccgccgccgcctccgcgcgctccctccctcgccgcagcctccgcgccgcgggcacgccgtcgggaacaagatccagctcgttctaagtcagaagcacatggtactctgacagggggattttcagccgtccgatccacaacgaacagatcgatacagtaccgtgaatagtattttccaaacagcaactctaaaccatatttttcactgtttcgcactgttgctacagtgttacgtcagaggaactgtagcacgtgacgcagattactgtacacctctgacttagaacgagctaagtcaaggagccggttccacgccgtcggcgctagcgtttctccctctatcagtcaggccctatccactccctaggggtacaaaggtaattgcatatttatccataccctaaaaccttttctttattttcttttgtatttctttaacataaaacgtgggacctaccaaacggctgtcacaagtgagggtagacggctggttcagattcaaaaaataggggtaaaactgcaaaccctaaaaagtgggggtaaaacagcaattggctttcaaagtaggggcatagatgcaattatccctttgttgaatattaagttgtatgtcgacccaatcttcggagatgtacttatagagaaggaataggtttgccttgtccggcggcagcgaacgcgcgcggcacgcgcactgccacaccagcgccaccaccgcgcggaacgtggacgcccccgcgcacgccgccttcagcgcgcccacctgctgcttcgtcagcgtgatgatggcgctcgcgtacgtggacgccgtggcggcgtgcgccggcgccggcgccggctcgggcttgtactccgggtggtcgtacagcaccgcgcgggccggccgcgcggcgagcagcttgtggtcgaagcacggcggcacgggcgcgtccccggcgggcgcgccgcgcacgatgctcgcccacgtctccgcgaagtgcgccgcgctcctcgcgtccaccaccgagtggtgcagcgccatgccgagcacgacgccgccgcaccgcaggtgcgtgacctgcaccagcagcagcgcgcacggcgggttcggcggcggcgtcgggggcacgaacaggtcgcgcatctcgtcgcacggcacgaactcgttcatcaggtcgtccagcgcgtagtgcccggacctcgccgtgacgaacaccgcgccctcgccggtgcagtcgatctggacgcgcccgtcttcgccgccgccggcgagcccgagccggccggcgagcgggtagaacggcaccagagccctggcgaggccgtccctcacggcgtccgccgcgaagaacgccgcctcgtcgtcgccgttccgccggtagaagtacaccgtcggcgtgtacccgcgccgcgcggcgaggtcgaggttggacagccacacggcgcccgccggcgtctcctccgccggggcgaccacctccgacgtcaacacctccaccgtggccatcacagttagtacaaatttttggtcgccggcggcgaggtctcggtctcgttcacgttcacgttgatccgtgtgccgcgcgctacgtttttttggtggtttttcgtggccattttgggttggtttatatagagagagcgaggcatgtgtgcatgcagtggtgtgggttggtgagttgggttgggtgtatgaaatggttggcacgatgggtgtgcagcaaaggcagtgaagtctctgcagtcaaattgcagaaaaaagatcaataagactactgtcacgtagaacgagtccatttgtttttgaccggagatgcaagtcacactaggccagccatacttaatagtggtactagtagatgcgtagtaggtgtataaggggtttaagaataacgaggtatctcttctatcagtgtcactttgatacttaggatcagaattattaattaagtattaattattttaaatttaaaaatggattaatataaattttagaacaactttcctgtagaatttttttacaaatatatacaccgtttaacggttcagaaacatgcacgcggtgaatgaaagaaatctcctttctttttgtccatggctcaaaagtagtataatttgtaagaagaaacaacaaattgtaggggttacaaactaatattttttttctgtatatatgtacttgtatgttgaatatgtacttaacatcatgtggaaatggataatatatgagaataaacaacaaattgtaggggttacaaactgatattttttttctgtatatatgtacttgtaagaagaaacaacaaattgtaggggttacaaactgatttttttttctgtatgtatgtacttgtatgttgaatctgtactaaacatcatgtgaaaatgggcaaatggttcgtccttaaattactgtattgagttgagactgtcgaggttttcccattgagattcgagagtattcggaaaacgtgcgaatctcgcatcatatgattctcgtagaagtttcactgcagttaatcatacgtacagtagagtaactgtttgtgttatgctcattgctcccctttgcgtgtttctgctctgcatgttaattctactttttcatagcatctatagttttgtagctaggtttgaatcaagtaaagattagtgctgagaaaaactaagttgttttcactcggttttggacgtttggtggactagctaatataatcaggttgaactgagcgcacacgttttctttagaatctccacaaacttcgtcaccacgtagctaatggtgagctaagagcaaaaattaccaacatcgtgtctaacgttcaagctgaatgttttcaataaagtggatgtgaaaactagtaaagagtcgctagtgggacctgaaaaggaaaataaagtagttttgttagttatccttgtaaggctgtctttagttggatccaaagtttgaattttggttgaaatttgagatgatgtgactgaaaagttgtgtgtgtatgacaggttgatatgatggaaaaggactgagtttgaatccaaactttggatctaaacacagcctaagtaacttactactaattaatgttagctctttactgactgaagtgtagatgcatttccaatgcagaaattacccaggccctgtttgaagagcttttggtgacagtaatttttctctagaatcttcacgtttctaaacagtccagattcttatatattcatattaagataatatgtagttatagaatttagaaaataaattaaaagccaaaaacttaaaaacctatttttctatatatattctcaccggcgctatctctgaatcatattactggaaagaagatttttgcaggcggctgaaattgctttatgcagacagccacacacgtcgcatctaagtaaatgcctgcgaaaatgtatatcttcgcaggcggacggtctacccgcctaggaaaaactttttttttaaataggaaaaactttttatatgaaaggcttatctcattcttataagtagaagtgaaaacctaacaactacggccgctcgatagaatagagccactggtgctttctttttatgtggaatcatatgaagtcgagatgctgattgtaattaactagttagtgtgtgtttgccgcttggacgtttggtggaatagctagctaagcagtttgaactgatcgtgcacgtttttagaatctccataacctcgtcatcatctagctaatgatgagctaagagcgcaaaacagtgacgtcaagctgcataaacctcttcaacatcaatataccgtggtatttgaaaagtggtaaagaatataattgcaggggagaacctgaaaaaggaaaatgaatggttttatagagtattataatcatccttgttattattagcactagtattttcatatagtatcagagtattaatcatccttgttattggcagtagtattttcatagtattatctccgtctacatatacagggatttttgactatatatgcgtacatgtaggcggaggcggaaatatatatgtattattctccgtaaataattattttgtcagttgtacatatatgatctcaaatcgattttcatggttttttttctttgtttgtgtggaaccatagtaaaccaaatactgacgataactaaccaagtgtgtgcttggaatggtatttttctggctgggttagttccacgctaaaattgaaagtttaaagaaattggaacgatgtgatggagaagttggaagtttgtgtgtgtagaaaaattcgatgtgacgaaaaagttaaatgtttaaagaaaaaaggttggaatctaaatagggcctaagactcgtgactgatcttagatcagacaggtggaagagatgacagatttgagagagggataaggacgaatgggatgaaaggaggaggagggtcaatttagtaagaaaaaactatatagatgcattgaagtggtaagttgtagtatatatttgatttctgtcaaactgtaaaaccatgtatccaaatatatgaataatatgatatttataaggtagtgtttagatttaggaactaaatcacatcggatattttgacactaattaaaagtattaaacatagactaataataaaactaattgcataaacgagagctaattcgcaagacaatttttttaagtctaattaattcataattagcacatgtttactgtagcatcacatacgctaaacatggattaattaggctcaatagattctctcactgattagtccagggttatgaaatggtttttatcattagtctacatttaatacttttaattagtgtcaaatatgtagtatgatagggactaaaaattttttttccgtgatccaaacagcccctatcaaagaaaaaatgtaatggtacgaatttaattgagccactaatttagctatggtcgcacacgaaaaaaatgcactaattaccgtcggcatctggtctggtccggtctggtcccatattactgtgcatttgtacgattgtactcgagctgtggaaaaaaaaaaacctcagcttgtgtgtttagtttacattaaaattagaagtttggttgaaattggaacgatatgatggaaaagttagaagcttgtgtgtaggaaaattttaatgtgacaaaaaagttaaaagtttaaagaaaaactttagatctaaagagggcctaatgcagctccagtggagaactggagaatcaatggcgatgatgcacatggcaattaatgagccgagacgacgttgactatgaaggacaagaggttcagtctccggtggccaacgaggcatggagctgcgccgcctaaaatcgacgggaatctgatggacgtggtgtagcctacaccgtgtactctaggtcgcatcgctcgcaggggttggtggcctggacccgtgtacagatgattacggaggcaattaggcatgggttggtcgcttcctccgctgaaaccaagcaaaattttcagctccctgtcgctggtcctgtcatttcagtattgttgtgatgcgtctcgcgttacttatcaacgccctcattggatggcaaatgctttggctgataagccatttaagcaaaataagctaaccaatttgtattgaagtttggctgaattggaggtagctttggctgatcagccaaagtatttggccaaccgatgaggccgcaaggtggcagcaccaaccaccaacgatcgtagactttgtggtacaagttctttctagctaattgattcggggtacttaaaaaaacaccatatcccgtgttagattaacgtattttggaacatagatactatgaatcacattcgacataattttagaagaatttgcacatatttttaagcttaggatttgtatcatgattgatgctctgactccgatgatccagctctagtgacccccttctcctctaactccaaatatcccagcgaatggaagtggagtttgggtttagggccttggattgggaggggtgagagaaagcggaagaagggagagatcgctaggtttaaagtgatagctatggaaggtgacggctaggggtggacatggaagggtggcgaggtgttggcaccagcgcgagagccatgggaataaagtagggaggtggattggcattaaagttgagagcaaagcgagcttgtgattaggaggcgacggccaatgataatgatagtggatccgacaacagggagtcattggagacgggaaaaacagcgagacaagggaacctttccgtcaccggcttagagaacgaggagaggaggaggaggccggtcagaaagggcctggccgatcaagccatcgacacctttcagatttccagccaaccgacgaggccaactggtggcgaaggacgccaggtcaatgagataggggcctagttcgcgtcctgtggcagctaggagggaagacacaaaatgaggaaggggttagggtttagggaattcacaccaaatttagagcagcatgattgaatgggagttttgaatcaaatagaccttttttttcaataggagggttacagacttacagtttatagagtcatcgatagaaagatatcaaaactgaaatgtggctagttactagaccagcctcaaatacacacgcagggaactatttattaaggactacccattggacgattcaagcaataccctctttcatatatgaaactcatttttaatgttaccaaacaactgcattgttgtgtgaggccgctgattaaacactcctgcgttcctttctttctaaatctgccatcacatcgatagtacaagcgtatcaaacgactttccatagctgttccgaaaaagaaactggggcttttttcagccaccaatctcctagctccatgtccatcttgctcagcccttggacaactgttaggccagtttggccggcatagctaaaaggtgtgtggttgtgatcgtttagtttagtttagtttaatcgatggacaaatccaattacgtaattaattaatcggttaatcgaagagacaaggttaataaaataataataattagttgtgctgtcataaagtgttagtttgttaaatactcctctgattaagggctaaatcaaggagggacctacagtgtaaacactggtgtcaggtaacaccgataattttcagcaaaacttatggctaaactgtttgtctgtatatattataacactatgatcaaaaatataattagcatactatgactctgatcaacaaatcaattttctggatccatcgctagctaaatggaaactcaattcatgttttgtgctaacaaattaacacatgtctcactgccgttaacagtttctcgcatctcggtaataagcaactgctttctaacgacgcattttcaaaccgatgacgaattgtaatttagctggatcgaagacgaagacaccgtgatatttatactttcaagaagattctcctagatgatcaccataaggaatctccttcactaatcacaggacttgcgtcttcatcacgccagtattgccttcgtcacgctagcatcaccattcatcagcaactggagataatggttttgctaaacctgtggcaacatattttagggttgattaagagcaattaagcgtggcacctgatcaagctccaacgcctccacttattagcaatttgcaggctagagaaattaataataaatttatttttcttctcacacttttttagaaaacagagcattgtaattccagtgtaagtttttaatgtacagtgtaattactttgaaagtttatggtgtaattgtaatgtatgagtgtaggtaattggcagtgtaaaaacgatggctactttaagatgaaaaaagttatgctataaatatatctacttccatatgagatatataactcaacaaacatgtaaggccaaatttaactttacaagttataaaaaaataaaaaaataaaatgaaactacttaacatacacattcaaagtatatttgttattttt

SEQ ID NO: 74278 - DNA, 3877 bp, Oryza sativa
cggcgacgccggaccggtgatcgtgtacgagctcacgcccagggtcgtccacgtcgagccggaggagttcatggccgtcgtgcagaagctcaccggcaatcgcaagctgtcgacggcgacggcggcggcggcggcgccggtggattcaaccgtgagatctgcagatgatcagatgaccgccggaggcggagctgagatcactgacaccgccgcggcgacggtcgccgacgaccaactggcgctcgcgtttgggcagcagcagcattggcctgcaccaccaccggagattgatgatgacaattcggcgaatcttccgtcgccgggtagcttcttcttgtcaccgaccacgatgcaggccttacaagagctggcttctaatttgttctaattaattagctcgatctaggattgcaattttggggtcagatcatactcatacatttaacacgaagaacagatgcacacagctatgctgatgttgtatatgtaattaatagcttgtttcagttcggtccttcagatattttcctattgatcttgagcaaagtaaaattcatttgttgatgaattagttttatccaatcgaccctccaagtttgcatttttgttgatcggtacatatatggttaagtgacagactaataacccaaagaaaggcacgattatattaattcatcgagccgatatttcgcttgcatttgggcgttgcagcttccctccctcgtatcgtctctctgtttatatcgtcgttgatgacggcgggcgggtggtgacggtggagaagacttcgccgtgtcgccctcgagctcaacctccgcttcgtgcatcacggccagtgttttccattttggaatgcatgaaaatttcggtaagcaccgaaatttcggaagaactttttttaaaatttaacatagttttactcaatttaaagaaattatgaccaaattcacaaatatttgaaaaaaaaatccaaaaatttccctcgaaataattgcttgccggagggggggggggcgaaatttccgaaatttcaatctctaatcaccaccggcgactctttttttttaagataatggatattaaatttggtgtttacttcaattgaagctaccactatttattacattttttttggttcaaagcccaaacacgacaaaaataatcaaacatagatcctcgaaaaaaaaatcaaacatagatgaaaagatgacgcaaccataactacgtcaaccaaagaaaaatattaacttattcaaagttcatgtcgtcttcgtcatatgcacgttgccttactcacagtattcatggcgtcgcgtcggtgtcgagccgcgcttttcgatcccctcttgctgcaatgttgcggctcacatccttgacagcgtcggtgaagttggagttggaaactcctcgtcacacagatgatgcaattgcacatgtggacctcatgtgtgatgcaatcgacgtgccggcccatatcgatccatgggtctcatcggttgcacatatttcctaataagccgttttggcttatatgtaactcaagttgcacaaattaatttatatgtaaaacttttatatatttgttcgtagagatttaaaagccaacgctaaaaagaaattacgctgaaaatatcttaaaatcaactcgaaaatcaaatttgaaaattcaaattttgacttttgatttggtttattagactaaccgatgggctccacgacttgctaacatatactaatttttttcttgagcttcgtgtctctcccaattatgtatattctatgtaaacactttcctaggaattacacgactaaaagtatactcctctggttatactctttatactcctaggagtataattcaagatcaaccctttatatcttttggttatcaatagctttaaaaaatatttagtttaaagacactagaaatatatatatagttatcttacttagtataatggaagtaaaaaaaacatatttatgtattatatatgttataataaacaaatataattaaagatatattttagagatcatatcatcggtgtatgtgacaatacaagtatatgttgttgttccttttgtctgtcaattttgctccgcgtataaagacgcatgtgtatgcactggtggagaaaccgtttacagtcccggttggtaaccctcctttagtctcgattgtctaaccgggactatgaatccgggactaaagatagctatctttagtcccgggtgaaataaccaggactaaagatcgatctttagtcccggttcgtgttaccaaccgggactaaagatcggtcagccacgtggccggcttaccaaccgggactaaagatcggtgcaccattttttttatttgcatggccctgtttgctgtatggttgattatatatatatatatatatatggcaccttaaggtgccacgaattaaatggcacgtgacacagtctccacacccaccgcctgcgcgtcccacccccatcccccttcccgtaccaccaacgatcttaccggtagttaaatttttacttctatatatccacatgatagcccaccacatatagacagaatgtacgttgtaaatttttagctgaacatttttttatgttcaccactcgggaatacgatttagtgtatggagcttacatatcccatttgcagggaatatagtcaattagagcatttttttatctacaagtatttttcttttaatcataccttattttttttattatttcttatttcttggttcaagtttagcaaaaaaaaaaccattttaatttatttttaggacaatacaattatttttttaactgtcgtctatatatcgctaatacgtcattttttatttgaattaaatgttctcatctgcaatgtttgttacgaatcaaatgttcctttttttcaacactgttaacagtgaaatttggtaatcggcaaagacattatcggcttagaatcattatcgactgcagcatctcggaatcagccgatgggagttatcaagtcgccaatagtcggattcttgctatattcggttaaggaaatcaatctactaaaggaagcttatccctaagtgaccgagtttaaagaggatgcggcatggcaatttatctattaattaggaatagtttgttagtttccttttatttttaggaaagtgtgtttagtgtccgataaggactttatgttttccttttatctttaggttagtttctttcttgtccgacaaggacttgtatcaaccaatgggtataaatatgtacactcggggtctatgtaatctatcttcatcatcaatacaattcggcgcatcgccaccttttaccttttctactttattttatcgtccggcgggacttggcacccgacgcggggctgcatcgtcttcgatctccggcaaagggataagtccaatgttccgtcggcccaggcaattgtctcatctacatcggcatcgttcaaggctgcattagtacatttgacctctttgattgctctggtttggatgatatatttgcctacctatttattatatgtctctgttaatctagtcttagcatatcaatttagctctatcggctgcttttcgttttagggtttctgccggtatcggctaaatcgcggtgctagattagattagcctaggcatctaccaccctgaaaactcagtcaacggcttgattgtctagatattatgtttcttttcatacttagtgctgcatcagttaagtttgatctactaagtcgtgcttgaccgctaataagggtttcatcggggtttcagccggtgagttatctagacgttgcatcggctcataaggattgcacatacatataagttgaatttagccgatgacaacaaaggtttca

SEQ ID NO: 74279 - DNA, 39076 bp, Oryza sativa
cttatcaatgcatcagttgccttcaccttgcgggagatagtctcatggttaaacaaaggtcaggccaattccatcctgcggtggagcgctcggacggagaggacttgaaggacattgacccgtcgttgaaaggctgggcctttggcttctcccagccaatgcagggggctggggcatacgcgcgggtcgcagggtaggccgtgcgaggtggagccgaagcagaagccgccgccgacgacccggacgtgttgtccatcacaagtgagccggagatagagagaccttgaacgctgccggcgtggcggcggacttgttgggcaacggtccatcgaaaggcatgtccttccgcgtttccgatgaggaggacgcagtgtaagcccaaggaatgtggcaccgacgccgacgaggacccgttgcccgtcagcccaccagtggggaggtcgtacgctgacgaggaggacggtgagaccgacgggtaggcggaggagcgcggcacccacgaagaagctgatgcagacgaggaccggttgcccacatttcttggtcctcctcgggggcgttcatatgccgatggaggaggccgacgaggaggagtgcaggtgcgacatctcgattgcggcgacaagggcacgttgagtgaccggaggagcactggactctgaaggcgcgcgtggggagttggatgcttggagcgtatgtgcgtgtgttggggggatgactgaggagacgatggggaggaggcgcgaagtggaagaagagggggagacgagtcgggggctcgggccctttttagcgtgtgctattgcattccttgttgcgatccagtccgcttcggtgttagggtttcgagtcctatgcatccattggtgcgggtgcagacgccgcagcctctgcaccaccgccacgcatctaacgacctcatcttgtttatgcttatcaaccaaaatttaacttttcaataaagttgattttgagatttttttaatcatagtttatttttcagcctttgcttgtaggttgttaaagacatgtatataaaagtttcatttacaaatatgtcatttcgctttttcctcaaattagtcaaacgatggggctgtaaataatctcaaccggtcaatatgccagaagcaccacatcctaatagttgatccgcccatcgttctctcaattggctgaagatctggcaattcaggcggtgtttgagatgaaagattaagttgtcgcttgtaaaacggaaaacctattagcacatgattaatttaagttttaattattgcaaacttgacaaatagatacatttgatattttgaaacagcttatatataggaagttttcgcacggaacgcaccatttagtagtttgaaaagtgtgctaacgaaaacctagataaaatttgaatcttaatgaggaaagtaattatgtttataccttgtcttgctcatgacaacctttttctgtacgcgagtacgtcgtgatattggtggacaggaatcaagctgaacacaacctgccgagtgtgtaattggatgagaaccacgtacatttatatactttatatgcaagaaggtgatccatggatcttcatcaaacccaggtagagttagagcaatgtatgtcatgtaggggagacggtaaggaaaatttggggtattgatttcaaattaccgacaaaaatctttgtttagtttggagatggtggtcggctcgtaacaaggccaattcccgaatgagagtggagagtacaaagccgaagttacttatcattatgtgcaagagtttgacaaggtttagttgccggttggattccttcgacgcttgatacatatagctgaatgcgggtggatcattccacatgactactagaagaggaggacggggtttcatggcgtgtgaccacaagcgccaatttttgaaagccggtgttggtaacgtccttagagcatctatcgttctacacgccaatgctttgacaacgcctattatgattggaacaagctgcagagtgggtatgcctcgtggggtgcttgaaacatattccctcctgtatcaaatatattgatgtttgtgggttgtgccctttggatgcaaattattgacgttttggtatttgattgtcactttggactgctatatccttgcatgcatgcaaggcttgtcttcagtagctcatcaactatagcaaggctcccaacttcccaagcaatgacacattaactccagctttgaaactaaaggctatagccacacaggtcgtatgggagtttttgataaaagagctacacagaagtttttaataagggtaaaacaagaaataggcaacctaattgatcacttcttggtaagtgagatctgtccaaaacatcaataaaatcgaaaccggagagagtatgttgctaatatggaatgaactctcacatatgcagagaatccagagatggatggaagtccaaagcgatgcctttgccaatacaaatgctaaaattcaaattttagcaacgaatgataaggcaacaagcatacagtggttaaaaacatattatttggcaatgcaaaacaattgacagaagatatataccctaagttacgttcagcgagatttgttgtaatggtcaactaaaatttggatcacctaatatctaatttatctggataaaaaaagtgtagtagacgcatacacatggtgatgggatttattcggacatgatttgatcaattcttttcaaaaactgaacattacaccggtcgggtcccgtctcttggtcggtcgttcccgtccacgcgcgcaccaccgcaccacccagacaggcaactgacggaggcataatatcctagccgtccaatcatcccgaaccgctgcatcctggccgtccatccggacaccgtccttgtccctgcaaagcttcttccgctcaagaccaactttccacgacccaaaaacctcctcccccccttctcattctctctcttctctctcctccacctccccacctcctcgcgatctccacccccacaccccacccccaaccccgcgacccactcccaggtgggccccacatcgccgccggcgaccgcgactcatctcctcggctcccgcgccgccgcgtccgcgcggccatgacgacctctcccccgccaccgccgcccgccgaggtaatcgcgcgtggggttgcccctgcccttcgccccctcatcctccctccgccttcgcgcttcccgctggctcgtgtgtgtcccctcgccgccgccgcatcggacggcgatgcgggtggcgtggtggacgcgggccggcgggtggtcggctgctgtaggtcttcgggttggtttctttgtccgggttgtgatgtggaatgtggggatgggcgtgtccgcatacggaattctagggtttgtggttttgctggctttgcctcgggcttggtagtgtggatctgaggcgagtctcccatgtttattttttgcgcagcagcagcagcaacaggaggaagaggaggtgctcgtgccgcgccaggagttgcccaacggaacgcagccaatggaaggttcgattcggtcatttcgcctcacgattacctgtacatgcttttgtctttctgcgtataaggattattatttggttagtattttacgttctcagaatttgtactgtgtcaaactactgatctatgttctccgcggatgcacaattccaacatgtacgtttgtgcacatacatgatatatttcttttgctatgtcaatctggttttatatgagctttagggtttgctaattttgtttgtttttaatgcaaacatgacgacctcaaagcttgctctcattttgtgtggtgggttgcattttactgtatctgtatgcagctgttggtatgtgtaggttgagtaaaataatgttcagtaatgccctttgtttgccatatctgctgattacacttaatggatctcatgttgctctgaattgtcatgccagttgtgccttctgagccagccgccactgtggaaaaccagcagattgaagatccaccaatctctagatttacttggaccattgagaacctatcaagagtgagcacaaagaaactctactctgaaatttttgttgttgggggctacaagtggtgagtgcctactgcttcttttgtctgagtttgcgtgctatgttgatttctgcccatcgaaggggttactgtcgggtgattgatggaaagtcattttgtttgcaggcggattttgattttcccaaggggaaataatgttgaatatctgtctatgtatttggatgtggctgattcagcagtcctgccttatgggtggactagatatgcgcagttcagcctctctgtggtcaatcaaatgcacaacaagtttacaataagaaaaggtgcattcatcatctatgcctttttctttatttagtcaattgggttgcgaaaagtattttaatctgaaattctttcagaaacacaacatcaattctctgctcgagaaagtgattggggttttacttcctttatgcctttgggtgatctctacaaccccagtagaggctatcttgtaaatgatacttgtatagtggaggccgaagttgctgtatgtaaggtggttgattattggagctatgactctaaaaaggaaactggttatgttggtctgaaaaatcaaggtgctacttgctatatgaattctcttcttcagactctgtaccatattccatatttcagaaaggtacaaaatgtagttttactggttatataattttgtacttaatatatttgtatggtgctaacagtagatagtgcttgtcaggctgtttatcatatgcccacaactgagaatgacatgccttcgggaagcattccattagctctgcaaagtctcttttataagctgcagtataatgacagcagtgtctctacaaaggaactcacaaaatcttttgggtgggacatgcacgattcattcatgcaacatgatgtgcaagaactaaatagagttctttctgagaagttggaagataagatgaaggtttgacatctgtaaggtctttccttttatgtattcggtgttgtttttcgagtagtgtaactctgactgaattatgcttgtaaattttgattcaagggaactgttgtggagggcacaatacaacaattatttgaagggcatcacatgaattatatcgagtgtatcaatgtggatatgaaatcaactagaaaggaatccttctatggcaagtgattgtgttatcgcatcatggtcattatgtccaaacatgcccctttgacctgattggtgtacactccaatgcagatcttcagcttgatgtcaaaggttgtcaggatgtctatgcttcttttgataagtatgtagaggtggagcgcctggaaggagataacaagtatcacgcagaacaatatggactgcaggttagatttttgggagcttctgatagctaaaccaatttacgctagagctacactgtcattctccctctctcacatatatgcacacagacagccacacatcatgtatgttatagtacaatggtatctgtatgtgtatgtttaggttctaggacagatgttgaaatgaaaagactgttaaccagatgaacatacatttttttatttcatagcaaaattagaatctcggtaaccttgtttgaataagaattaacatggtttcggagcaactcattgtgctcaacttaatagcacaaacatcaaactcgtgattaatttctcaaagcatagcatggaagttgaaatgaacactattctcaatatggattaaagggatcttgggaatttcaaattcaaagaaagaacatgatgggaatctatttagtgtttatacaatctttgggcgcatttggaggcctgtctggatgaacaattcatgttatctggcaacagagaaaaacatggtactgtatgggctttttattcagattttttttcttggtttcaggatgcaaagaaaggtgttcttttcatcgacttccctcctgttttgcaacttcagctaaaacgctttgaatatgatttcatgcgtgatacaatggtaaaggtttgtatcagtgccatctgctaagaagttcccttcatccattattgttttagtggtgaaatgaatgaacagttttgtggtaaaggaagtgcgttcttcttgcttccttttaatgcttatccttttgttcctaattctctatcctgctaagagtgtttatgctccattctgaacttcagataaatgaccgctatgagttcccgattcagttggatcttgatagagatgatggaaagtacctctctccagatgcagataggaatgtgcggaatctttacactcttcacaggtcagttagatattaactattatttcttgtgtacctgtgttccatttcgtgatttaaggtttcaaggttcttcatggctgaactgccaacaattatagagatggacttctggcctcaccattttacctatcctggactttatttaataatgatgcaattctattacaatttttatgtcactgctgtctttaacagttaatttcttgcagtgttctcgtccatagtgggggtgttcatggtgggcattactatgctttcatacggcctactctttctgatcagtggtatgattattttggttatcattggttcttttgtatataaacaacatgatcttatgtatatctgtgtcattggctatgcttttgtacaaaaacaacaatatcttaggtatatctttcatatgattggtttgtaaactttgttagttggtactaactgttatcaaccagttgctgcttacaggcttacagctagtgagattagccatgactattttagtatttttctgtgattgtgctccttactaatcaaactctcatgatttgaagtggccctttgagtacttttgttaatacatttatgtcttcttttgaaataccttttcagttcactgtaaatgttaatttagaccttacactgatgggttcttagctgagttcggtagagcttcttagctctgctaatcagctacccacaaagcgagatgggtaattagtgattaattaagtataaattactataaatttgaaaaatggatttgtttgatttttttcaaaaaaatctttatatacttttctttttcacgaaacacaccgtttagcagttcaggaagcgtgcttacagaaaacgaggtagtagctcacctcataagcccttccgaactcaccctgagtccagattagcaagtaggaacaaatacttgctctataagcatgatgcatgtcagccaccttttcattacatatttgtatgcttcttggatggcttgttgctacttctatgtttattatttgctgaacaaaacgtttccaggtttaagtttgatgatgagcgtgtaacaaaagaggatgcaaagagggcattggaagagcaatatggtggtgaggaggaggttcgttgccattttgaagtctgagtgcttatgtttgttgccgtagaaacattgagctgatcaatttccttttgcagctacctcagactaatcctggtctaaacaatactcctttcaagttcactaaatattcaaacgcatacatgcttgtgtacattcgcgaaagtgacaaggacaaaataatttgtaacgtggatgagaaggacatagcagagcaccttcgagtaagttgctacctaaggttttttagttattcaattcttcattttagtttagtctaattcttctgccactttcagattagattagaaaaggatcgtgaggaaaaggagcgtcgaaagaaggagaaagctgaggcccacctatatactatcattaaggtgtttagtcaacacgctgggcatgtcgaattgattgtttttcctcctatttccgttggttttgttttactttctatttagttatctaacatgttttggtactgtaaaggttgcaagggatgatgacttgaccactcaaatagggaaggacatatattttgatcttgttgatcatgataaggtcccaagtttccgcatccagaagcagatgcctttcactcaattcaaggtaaattacatgggttgaagactatttgcttgttgtgatgatggcatctttccatattctaattgttggaattgctacacattgtttgttgtcctgtacaaaactatatagttcaaggacccaggtgtgcctattagtgtggcacgctgttttgcaaaatcaagcttttatttattttgagtagatcaattgtctttttgtattttacaagttgcaagaaatgcaagtaagcttaatattctgcagtctatttattctccaagcagtttgtttgcatgccttcttctcaccctttcatgattagctgtacatgctgagcatgtgtatcatgcatggtttttagtgatataaagcagggatttctttcttgagtcttgacgcagctcatgtgcacagctatgttttagtttttttctttgtattacttgtcggagtagagttttgcagttgccaaactgattactcatatatgaagtgctttacaggaggaggttgcaaaagagtttggtattcctacccaatttcaaagattttggctgtgggccaagcgacaaaaccatacataccggcctaaccgtccactgactcctcaagaagagacgcacacagtaagatgaattaatgacatattgcgttgattaaatgatgcacagttgtagttgatgctcttgatttctagtgctcattcgtgtctatgcattgtgctgtgataatctgatgacgaattaaataagcaggatacagaaaatacaatggcattttctgtaatttatgccaagttcagttgctttgctgatatattatatgcttttcatggtggttcctgtttgtatttgtcatggtgcttctcttggatgctaaaattgggaatttctaagtatgatacctttagtctgtgccctttgaactttgattgaaacatcccacaaatgatgcatatttgagtatcttaattttgttgatccagctaacttgctcatttattatttcatccgcatgactaacacaccgcagtatcttttatttttcctggcaactgctatgtaatttgttttttattgatcaaggttcaccgttccttgtattgttaataaggatctgcttattcggattcgacactgaagttaagatcatattattatgttgctgtccttgttaggccaacctgatctgttttgggatttcttgtcaagctaatacttccttgccttcagcatatatttaagcagtgatctaattctgtgtaatggtaaacatgtggatagtaaggtcaacaactttgtgtaggttggacagctaaaagaagcagcaaataaggctcataacgcagaactaaaattgttcttggaggttgaacttggactggtaatagccttttccctcgcgcttttctgcatttctttctttattttcttatgtttggctgccaatctgttcatctactttcaaattgtaaagggagtctgctttaaatttttactggcaatgtaggaccttaaacctcttcctctgcctgacaagaccagagaagatatattgcttttcttcaaactctatgatcctgaaaaggaacaactgcggtacttctcataatttcaaatagccaactgtatcatcattgatttgtgttgatgttcttacttataccctgaatgagttcttcaggtatgttggtaggctctttgttaaggcttcgggaaaacctcaggacattctgccaaaactgaggaaaatggctggtttttcacaggatgaggaaattgaactttatgaggttgctttctttatcatgtaaaaaagcttgtctctgcaagatatgcatatcattctggatcagcatgtgaccttttttcccctttcaccaatactaggaaatcaagtttgagcccaatgtaatgtgtgaatatattgacaataggcttctatttcgagcttgccaggtatggcgtgatttttttttcttgaaccaataacattcttgtttctatgatattatctttacctggaatcttttgcgtacagcttgaagatggtgacatcgtttgttttcaaaaatctccaaagccagatactgctgaccaatatagataccctgatgtcccatcctttctggtgtatatacggaaccggcaggtacttgagggtgccccattcaccaatcctgaactttatgctatttgttatttacatttcctcaacttctcgctgcaatgttgcagtgaggaattattttacctctttgtccatgtttaattacaaggaatttcattgatgacagttcaatatttctcttcccaaaaaggaatgttctgtgattttttgcttacttttcttgttgtcttgtttgccctatttcatataaattttcttcagtagtcttgctctatatgcattgtgatgtccatcttgacagcatcaccatataatatttttgcattaataacttctgtgtgattcttcaggtagtccattttcgttcattggagaagcccaaagaggatgatttttgtttagagatgtaagcatctcgacatgctatgattagtgaatcttaatattttgtattaccactgatattttttctttgctgttttctgtataggtcgaaggctttcacgtatgatgaagtagtggaaaaggtggctcaaaaacttggtgttgatgacccaactaaaattcggcttacatcgcataactgttattctcaacaacctaaacctcaacctattaaatacagaggtgttgagcgtttgctggacatgctgattcactataaccaggttgttactctgactctcatctttgtggtcatttgtcgtttaatcactaaagcgaagaactgaagtgtgacatagctgttggcatctcttgtacagacttctgatattctttactatgaagtattggatataccactcccagaattacaagctctgaagacattaaaagttacatatcatcatggcacaaaagatgaggttattttcttgataccttctttttgtggtggaaaaacttaacaataggttgtttttgctttttaatcttaaaacatgttttaccaggtgtcagttcacagtattaggttgccaaagaacagcactgtcggtgatgtgctaaatgatataaaatcaaaggtatatttttgtaccccttatttatggtgtgtattccacattctccagttattctatttgttggttttacaaagtttaacttatgccctatgtgtgccttcggctattaccaaaccaggttgagctgtctcatcctaatgctgagcttagactacttgaggttttctatcacaagatatacaaggtgacacaaacaacagttctttttaatgccctcttagttgcagttggttccacactatatcatcgtctaacttgtatttccttcagatttttgcaccgaatgaaaagatagaaaacatcaatgatcagtactggaccctgcgtgcagaggaggtatattacctttgtgtccggttttacaagatcaattttcatttgttaagaggttcaatccctcaatccccccaggaattgatggatgccattcctttttctttctaggttccggaggaagagaaaaatcttggtccttttgatcgcttgattcatgtataccattttaccaaagacactcaaaatcagacggtaatggaattctgctaataatttatctacatatatagcttaaatggataactgcatatgcactgctacaaaattttagccactttgttgcctgtaattttaaattagtcgctgacagaaattcatccgagttaggtgtgtttattggattcgactctcttgttttttgtttctttatttcaactgtttgccagcatcagtatcatgacctatacattttattcaagatgaacttgaactgtgttgtggcttgtttaattgagtgttttttattatatatctgtttactatctaaacttcagcaggctctctacatgtcaaatcatctgaacacaagtgtagccatgtgttctttttgtgtcgagctatggatgtttccctttttatttttaattgtttgtagtacctttgtggctttgcaaaacgattatattttgcctatgaacagcatatttttcatcttcactttgttatatttaactaatcttcactgtcaaaatgattaaaggagtccttacaaaatcaatactcctatatccgtaggtagcagaagcccggttaagaagtatttgtaagaagcagcatcaggctcctgtagtcctgctttcgtcatgtcatactttctgcttttgtgtcgagttatgcttgtattttccattttcatatccttaaatgaatttattgaaaagaatgttataggctttataacacgatagatagtcagcttttggacatgggcgtatttcacttgctacccagcataaatactggcactgatgggaacacaatattgttagccaattttagcagttctgcatctaacagcatacttctatatctagtaaaacttatgctgatatttatcctgatttctacagcaagttcagaactttggagaacctttctttatggttattcgtgaggatgaaaccctttcttctattaaagaacggatacagaaaaaactaaaagttccagatgaggatttctcaaaggtactctatactattccacacttgtagataattttaaatttatgatttcctttatgttatagcgttctcctggaatcttatagaagtgatgtaattggaacatgttacctgccagttgtttatttgcctaacaccataagaacatcaattagtgtcgttcccaagttctctgcttctatccctagttcgcctcagaagtggcgcatcagatgcatcacttggttttatttttattattttgttgacttccgtttgatcatgaaatatactgagtggcctacatttttgtcatctggcggtcaacatgctagtttgatctctctaatattcggtttaaatgttgcatagaaagaatatgtttaatgaaacactcaactgcaactgcagtcctggtacttctctactttggtgcattcagataatgaaagttgtattgcttgatatcacacaaacatgatatcactctgctcttttagaaattcctataatatgttcgtaattgcctctattggtttaactgtttaagagcttgccatcagacacaacctgctgctgacaattttatctgttagccaaatgaacaatgttagttaataggtagagcaacctcaaatgtatttggaatgactgatacttctctaccatcgttagtggttaattagtgggaactgagctctaaattgaatagtgtacaatatatatttttttaccaaaatctcttcccagggtaattagtagtccttttacgtatctttggtgctgattgtgattaattatttggcttgtggcgggtggtctatggcaaacatacatatgttatttcttgcgtgcttttgctttctgatggttttctgcttgtgaactgtgacagctagtgtaatgcatttccatctttgatgtagatttgctaatgattaatgtggttagatcggtttgagtaatgtgtttgcttaatgtaaacatgcactgctaagcaatgttctcatctccttttgtagtggaaatttgcctacatatcacttggtcgcccagattattttgaggattcagacactgtagcttcaagatttcaggtacaatattttcttgcttgctaaacaatcactgttagtgcttaatttggttcacatttaaactttttttgcttgcttatttagcgaaacatgtatggagcttgggagcaatatcttggactggagcatccagacacggctcctagaaagacacacaacgctaatcaggtacatccttggcagattaatacggatggtcatgggatgtctgcccctagttggacaaacccgagagagaattgtaacctaccactacaactatttcttttctgtttctggaatgtttgctaattgcatgttcttcatgcagaaccgccattcatttgagagacctgtaaagatctataactagacttgagaaatttgagtgacgtgccgccatccaacaccaagcaagggcctgaaaagtgctggcttgaataaattgtgtaccataattgatggtaggacgggttgctcaggtttttcgatggagctagaaagcatgcatggtgtttcctgaggagacgttttttagtatctgaggcagtttctcatcttccgcaacttgccccagatatataaagttgtgcagagatgacccatcgtctttcatcagtagataaggcggtattttccagtagtcatacagttaaaatagctcaagttttcttcgttgatcacatggttctgcagttgtactaggactccgagctgtttatacctgttgccctgtaaattatccatgtacaagggtttttcttgctctgacggcagtcaacacggtattgtaattccagctataaatatattgttgcctcttatatacttttatctgattggcagttcgctatctcctgagatcatttggagtacatgagagctttcaggaatcaggactggctattctgtgaacgaccgctttttaattaaacaaacatattcctaagcctcgtctttggacatttggggctttagtctcttacctcgttttgattgacctcaattccgactgatacacgtgtgacaagtttgaagaaacccacatttcggccttgccaaacaaggcttatgtggccttcaattcgaacgaggctttactcttatgaccttccaggctccaggctggacttgttttcttgggtataaagcctcgacacagcgtggtgagaaatttcgtatgccgttctcttatgtcctacactcctcgctttgtcatccacatttagatttttttttttttacggaggttgttaacagatcacatcgtagctgccgctcgtgttgttcctgaaattgaccaacgtgtactctgacgtggacgtgggtccaggattgcagctagagattgtctgctatggtaaatgtgactactatatttaaatttatccatattattcactaataaattaagagtcaactcatacaatatgtcacatctagtaaaaaataccaatatctctaatactttcacaccattcttgaaatttgtgtggaggttatctcttgatttagagatggctcatcatctctctcctcgcttctctccacctcatcactcaatccaatgtagcacccttaggggcagcatatgtagcattatagcacttgcccatagggcaaattcagtccacacactagttttgcaggacccatgcacaaatttttaaaaaccagcagcgtccgccctccctcacactgtcacacaaattgtcgaagctataataaccacatgcaacaaatattttttttaatggggtaagataactctttggctgaggtcggttttctgttaacttcctccgttccgaaaaaaggcaacctatgtggggatttgacaccacctaagacaaaatatgtccagatttattgtcctgtggtgtcaaatcatcacctaggtttttttttttacggagggagtaacaactaacggttgctctcacaatgtgtttagttcgattttttgggcgcatgcgtcgttttcacctcattggaatcgcccttagactcgaccaacgcactgactcggaaattgcacactgtagtattccctccatcccacgtgaccatcatatataattttttaggttatccctaaatgatattagtatttattcgctaaatctatggatactgatgtatgcatccatgcacatgcacataacgtgttacaatcaacatgcaatatcttggtttgctagtagctaggaagtagcgggtatggtgcatgtatcgagtttgttaccggagtaaatgtagtacgagagagttattagttttccctaatcttggtgcactcttataatgtgatgatcaattaggacagagggggtagttttatccttctctatctctacggattactttagttcccctttgcatctttgataccaccaccacactgcctattcgccaacttatcaccctcgtccccgagactactgctgcttctctgctctgtcaatccccaaatctctgtatcccttcacgaattcttcgcacattaagcaatatgattggggatgtaacacttgctctgtctgtccataacaaagtagtcatctcaacccgccaaaaccccatcaccgattgaacaaagcagccaaactgaccggcctctgtaatttagccccaatctgctcggccatgcttagcatgcccctcctccataccaccagcatgatctacacgaagaacctcacagccggcctcccggatccgtcgctggacctgctttaccccggtgagctcatcggcgttgccggcaactaccaccaccaaagatgagtgaagcagttcattgggtaaatgtaacatgtatagctgctagttggcactaaaagaatcaactgatcatttaccaatagtcaaggcaagagcacttcccttctttcatatgatggaacctactaccatctctcacaataatctccctctgaaaaaccattgtcaccatcttactgaactcatggcaatccccacagacacgaaggttcttgacgatacggattgggctgccagcttcaagaactatgaagccataagcaattgccaatcgctcgctgtgcaccttgaccgcgtgcaccttctcttcctccccaatgtcatgcaatacagatgacacatccggtacataccctgcctctgtcaaccttttgttgatcatgtcaagtgtatcatagatctgcacagaatccttgtgataagtgtctcctactagaaatttgtgcaccttcccatgcgcttccatcaagctccagccggctgacttgttggtaccgcgactagacatcaatttcctgacttccctgacttcatcccatttgtttgcctttgcatatatacctgagaggaggacataatagccagaatgagttggatccagttcaattagcttgttaccaacagaaacccccaaatccaccaggccatgcgtcttgcaagaagagagtattgtgccccagagaactggatcaggtgcaatatgcatcccttcgatcaattcaatggcttccggaacaaggccagcacgacccagaagatcaaccatgcagccataatgctccatttctggctcaatgcgatatttctccactatcagtttgaaatagcgtcgcccctcagcaacaagaccagaacggctacagccattgagcacaccaacaaaagtcacatttgtaggggacagaccctcactgataaaccgctcgaagagctccaccgcatccctccccaaaccatgagcagcaaggccacagatcatggcgttccacgcgaaaacatccctcctcctcatgccatcgaaaacctcccttgcaaccgccacacacccgcactttgcatacatgtccacgagtgccgctcctacattcatacacaccggcattcccgacctctgtaccacattatgcacaaacttcccatgttcaagcaagcccaaccgtgctgctgccgacaatgccgtcaccactgcagcctgattcggcctcacgccctgctccaccatgttccggaacactcccagcgccacctccagctcctctttcttcacatacccgcccaccagcgtgctccaagaaatctcatccctcactggcatttcgtcgaacacctcccgcgcaacggtcatcatgccagctcgcacgtaccccgcgagaacctcgttccacgtgaggacgtcccgcacgcgcggcagctcgtcgaacaccctccgcattgcccccacgtcgccggagacgccgtagaagtgcaccagcgcgttccgcacgaacaggtcgcccgcggcgcccgccttcacggcgagggcgtgcacgtgggagcccaggaaggagcaagcggaggcggagggtcccgcggcgttgaggtggttggagatggaggcgaggaggaaggtgaaggagtgggggttgcggcgccggaagcgggagaagagggtgagcgggagcggatgcggcagcacgcggaggaggttgttggacgcgaaggcggaggtggagttggcgcgccggaacagcgcgagcgggtaggcgtagtggtcgccatcgccgccgccgtcgtcgccgcggtggcccggcttgtccgggagaaggcgggggaggacggcgaggaggtggggcatggcgcgcgaggcggcgagcccgaggacggcgagtcgggcgtgcgcctgctggacttggcggacggtggggctcggcggaagcagcgccgcaaggagctccctcgcgtcggcggcgcggcgggcctcgaaggtgggggctcgccagacggcagccgccgccgccgccgccgccggcggtggcgcgccgagctgcatggacgaatggatgccctctcgatctacctcggcttctcccttcgagaagtaaagatgcttcacatttgatctggaccgtctgatttcgatcggacggtgctgattgacccgctcgggattttattagccccttgcaatttgtaaatgtgcagtttgaaccattcagattcattcaaacggacagacaaaatgcatgagaaacacatcgtcagttgaactgatgtccctttgaatgagaataaaaatcaaactagaatacttattacttatctaaaccaaggaattcgatcaaatctccacgtcaaaataagtctagagaaggacgatgggtctgttcactttgatgtcattttcaaccttaccaaattttggtaaagttgccaaaaaaagtggctacatttagtttgctgctaaattttgataactatataagaaatcctgccaaaattttggcaataccaaaacttggtaagttttttttttcatcaaagtgaacaggcccgatgatttggaaaagtttggagttgtttgcatattgaaccaaatttattaagggcatgtatctaaacaaaggaattcgatcaaatctctacgtcaaaataagtctagagaaagacgatgatttggaaaagtttggagttgtttgcatattgaaccaaatttattaagggcctgtttagtggatgcttcgagtagctacagtttctgatagaatcagaagttccccatacaatttctaagaagctatagttgtaaaatccagaaaatgaattagaaaccaaccgctaatcagaattttgaactcccccaaaagcccaaacaacccttaaaaggtgtgtttgaactctctagcacacaaagcgaagcacatattagcacgtgattaattaagtattggctaaaaaatcttaaaaaataaattaatataatctcttaaagcaactttcctataattttttttaaaaaaacacattatttagctattcggaaaatacgcacgtggaaaacaagattggtgaaattggcaacattgactttagaacacagcccaaggcattaacccaccaacatccggggacacgatcttgagttgagtttcctactgacgacaagttaatgccaactacagtactaatcagaatctccatctcagttacaagcatggtgaagagttaatagagttgtcgtgtctccctaccacaagaactcagtgagatggcaacgatgcatttggccattcccagagaagctcataaggttgatgcagctctccctcctggcaaacctcatcttgacccgacgccattcttctgaagacagcgatctgggaagcgaagcctggttcatcgcctgatccgccaacgccactgaactcgacgctgtagttgtgcttttctgcgagtccggtagcccagtgctggaactgggatcttgtccactcgaacttgtggtcatggtttcggaacttgcaaggaccagcgttttcttctggttcttcttccttgtttggcatagctgatctctggaggatagggttgtattcatagttgggtgttgaaacaatcagcaccgtagggcagaacgaactcaagacgacgtcgccacataaacttgcttggtcctcctctacgtgctcaatcacctgcaagtagctttggtcagtcgaatagcatgtccaactaaatctaacgtttgagagatcaaagagaaatccacatcagcatttgtaaggatggacttcccactgtactactatgaacaaaataatgaatccacatcagcatttctaaggatggacttcccattgtactactatacaaatgtgattaggctatgtgattcttaatccaatcaattaatcgtggtatccatgtactagaggcaattgagaagacagcagaaacagttcaggagtaactgacctcaagacaagtgccaatgtcaaatctgtataagcgagaatcaaaatccgttatagaaccatcatagagcacagccgttggaacacttgtctgcatcaacgatttcttgctcagcttctgatgaaggctctgcaaattcagagagatgaaaggagtcattgccaagcattggagagaacaaaagggatggtttaaagggtgaactaactatcaacagtcatcaaggctctgttacgtgcctttgctgctcgtgtgagacccttccgagaaatgtcaacaccgacaactttttcaagggttgttggatgctcaagcaatgaatcaagaaggctaccagatccacagccaaaatcaacctgaacaaatttacttcaatagtgataagctaatatgcttggcaaatatggaagtaggatgagaagaatatttaccaatgtggtagcatgcagctcattgatgtaccgaacagcgaattccactctttgtttagataaaggaggattaaacaaggctttttccattctatcttctaatggttcagttacctgcaatacctttacagagaactccaagaagcaattgtctgcaaggatggttaaaacttgagcatagtgcttcagccaaattcaagctggtaatgaaaattatcagactgaggtgttaagattggacctcacctctagatatcttggaaaggtcatgagaaaactcattagctgcagcaaggatcaaatccttaggaggcaattcagctatgaaacatgcgctttgattaactgacagctgactcacgcatgattcaatctgattcttaacagccccagtccctatctcaaactcaaactcattgttgctttctagcgtatatctgtttgttttgtccttcaccaccaaggaagcagtatagcttatgcaagtcaatgatccatgggatggaaaaacaccagaatctggaccatcaatgtgtgctaaaactgcattgttttcaagcttttgttttgaggtatccatagaaagcgatccaactgtactgcatgcacttgagtcatcacctcctctgttgccataaatagataagaacatggcaaattcatgcaaaaaattatctggacatattgtgaagccatcagtgctcttagaatgagagagcttcagtacatgcttgttcggttgcttgaaataactacagaaccaaatcaacaccttcaatgaagaattgtgaatggcatcagattccttgctccaagtatcagctgtcgaatactccaataaaagctcctgcttctttgaatatattttgacatcacatttgaacatatctgggttttccttgtcattctttccatcactagcacactgattttcagcattctttagcacgtccatctcctcggagcttacaggtgatcctaacactttacaagaggcacttaccctattgacagcgaagtagggctctgctagtctgtgaaggcgacaaaatgagcagagaagatctcgtggagagagacccttccaactagaacgagaatacacagatggaagctctgccaccagaattgaatccctggatatcttgtaattcccatctggtgatttgcccagaagaatcctgagttaccaaaaagcaagttattcagaagaattagaaactaagatgagaacagaaggtgtgcctaaacaatagagaaaatcaattcaaatgatggaagagtagtagtcgagtagatgacagtgtgaagaaaaatcagatcaagatctatctacaaccagatgattcttataaaaaaaatgaagtatgcatattgaattaaactaaagtcaaaatatatctcatacaagtgacataatcaacaaatcgatacctgtaatagttggataaggtaacatcttcagtatgaagctctgagtctctccttgtatatccaacattagccaaaattgcatctccataaattgtttgaccagaaatgaaggaagctcgcttatttattaggctctccatatagccatctccaagagaagaaaccacattgtgtgatatctcagaaacaaattgcacatttggagctgagaaatatagccttatctcagaagatgctttgccaacagttctgcagtgagacaattttaagattatcagcacaccaaaaataatgacaatggtcagaagagaaggctcggcacaatactgaccttgaaacaacagcgtgggaggaatcacttgcagagagcttagacactatatcacccatgtaatgttcattatgtgataaagtaagtcttattgtcttaggttcatcctccatcatacaaggaacaaaaatcccatctacttctatgggatccgttatgccagaccaatgctgaagtgccaaatcaacagcctcaggggaataaggcttctgactccaaatccagaagttgctatcactgacagagacaccaggggattttttggcagcattatagattaatgataaaaccaagagaggatcaaactccgctttggggtcaataagtttacacagtccaatgaccttcacatcacatgcagcaattgctgacataggaatcataccaaagcggtccccggttcttctgaatgtcacacacatgtggccaataagaggatgagatgacgaggggaagttctgaatagaagagtaggaaaaaaaaaagacagacatgttagaaaaggtcggttagaacaaattaattgtttttcagttacatctgatgctctgaataataatatgattatatagccgcatgcttcaactataatcctgtattcttgtgtacacaaaatgattcagacttcaatattggtatttggtgatcatgtgacatgtctatgtaaagaagaatgtgtaccaaagcaggttgaaactgcagaaacatagaaagcaaagccttaagggaaatgttttttgtagtaagctcgatggtccggtctctttaccacatagatacccataacctcttaattccagtaatacagagtctttcttaactccaattataagagttgcaatggttatgatcatgcaaccctacgacatacacagcccatcataaggatcctatatccctattacactcctcaattgccagcagagcatagcattccactcaaatatgtaacatcatgaatatgaaaacttccttttgctgtagccttctgttgtgtgcaccttaatccctgaactacaatgacacaacaccaagatcaagtggaaaatactaacctcatctgtaaaaaaaccagatatgcgagcaataagttcatcccatgcttcttcaggagtactgggagcatttgcagtgggctgaataccaagctacaacgaagacaataaaagaaatggtaatcaccataggtccacagcatgaacaacatttcacatagtaatgatatttcatatatcataggtacatagcttatccgatagagaaatacaaaggagctaggttactgtgcagcttgatcactaacgtcgatggcattggtttgtcagaacagaaaacagagggtactatcaaaagaaatggcaacaaagacaatgagcaacacaattaggtgctcactcaggaattgaataaccaaactaaggtgagatttgactatttgagacttgagagaactccaccttgcacttgtgacattcctcaattcctcataggtgagacacaattgctaactgaatcgtgcattgtgcatatcgccgtatctaatcacaaacttaaaggctacacgataaatctctatgtatatggaagatgattttgcaactacacatgtaaagcaaaaaaaaaaaggtgaagttgcatgccaccaccacaatgctcatcaataccttgtcgagggcaatctgcgcggcggcttgctcggcgtccttcttcctgacgaaggtgcccggggtgacgacggtgaggccggggatgtcgagcgagcagcggtagacgctcctggtctgctgcggcagcgcgaggccggggcagccgccgtcgacggcctcccgcacctcctccacgctgtagcacgccttggcgccgtacttctggtggatcaccgccttgggcgtcaccgtcggcgccgccggcatccctcgcttcgatcccccgccgcctctcagccgcaacggcatcaaacgcccaaaaaaaacaaacaaaaacaaacaaacaaatgcgattggtaacgaaggggattttcgcaatcgatcgacgcaggaactgaggcggaatcgggagggggtggtcgccgaattgggggaggcgctaaaccccccagaaaaatcggaagcgaggcgaggaggattcgaggagtcgggtgaagtggggtttagggaagggaagcgagggggagtgtgtgaagggggagagaaggttttgatggcgctgcatccaataatacgccttcttgttaacgttagcggaaatgcagaatctctttcgagggtaaagtgtcccttgagaaaatctcgggcctatgtcccgtaaaaatcgattgttatattattttctgaaaaatacggtcgtttcactcgtatataaatatttaacgcatcaaagtttgaccaaactagctgggttttttaatatatgcatttgcataaaatttttaaataagataaatggtcaaacattttttaaaagttaattactaagaaaagagggagaacattttatttaaaaatttagtgcaaatatgtaaaaataaaagtcatactaaactaattttaataacaaaataggttaaaaaagtgatatttacataaatcttttgaataaggcaacggtcaaactatatggtctaaaactattgtgtcaaatggccgaagggagtaaaatgttaaacactactctatatttcacagttttttttttcaagtggtttttgcgaatgcagtatgcatatactcttgcttgattggattttacattaacgaaactgaactaacgtgagtttaagcaaaaccatggactgagatgctattgcctagttgcacatagaagttaataatgaaatactccctccattccaaaatataaggcataaccaccctaaccaaaagatcaagaaaataattattattattttgtagtttcgatcattctaataaatacaatgcatgcatccaataaaattagataacataaaagtagaggatttaaaaaaataataatttaatggagaagggatcacagttaattacctatatacatacatgttttatattatggaacataaattatgccttatattatggaatggagggagtactccgtagttctactttatagcgctgatgaataggttaagatcaaaacaaactacagatggtgggtcagtgggtgagaggagccatcaacactgccctgatctgttgcagatcaagagcatgtttagctctttaatactcttcagttcacaacagaggatcctaaacagcttggactctgtgtaaagttagctagaatcccaaatctttgagttcttccctccatgagcaattgagttcctaatttccagtagagatgcaaaaaatcaatcaagctggtttgctaataccatatgctaggcttaacataaaaaatgataacgaggcaacagaaatgaagcggtgaaatgaacatcaggatcattcgacagacgacaggatggtaaacttgactctatttctaatacaactgaacatccaatacatgtcaacaaggttgttcacaaatttcacctaaaaacacgaactaccatcttaattctccagtcaaaatttggctcggtatatgcaagctacattcagggaaccccagtcagcccactacactatggatgttgatgagatcagcagtcaggcttcagcagcaacacatttagggctctgcttcatcattcaatttttctttgcctgtatccttggttttcctcagacagcggccctcaaatagcacttcgtacagtagccttttactcccccatttccaccagaagggtcctgcccctcctgcatgcttccttttcatcttgtttacttcagtggctacacatcgcaaaaagagattatatcaaaaaacatataaatcactttactgcagaaaacaatggtaagcagaacagtagtcctcagatagtttctagtgcacataagagagaaaaactaatctaacagtacaaatcagaacaagatcaaatatcaagttatctagataaacaagacacaacataagaaagaacaagatcaaatattgtctactaacaattagaaatacatgttcttttcctttggttgtctacgcgtgtacccaaaatagtatagaaggtgttgtattttaatgcatgctgtaaatttcccttgattcctcccaaccacatcattcactcactgtattacttattacaatatcagcataaagagctgcagcgcagctataaatatcagcacaactgaaattcgtaagagctaacatggctagtctaacatgagatcactcaatcttctatctttttcagcagtggggaagtgggaagcaaattgggcaaagccaacctaagagaacgcagtagaacctttgcaagggaaggtgaactttagcgtccgtttattgttttgagtctaaaagaaaatctattctcaagtaattctcaccaaaaggaacagcgcaaaacctctttggtctcagtgagactacacctttactataaataggtctctggcaagctactgttgggaacaatatggcagatttgggacctcacaactatagccagctgcaggaagaaatggaaatcatcggttgtttaacatggaactcaaacaatattatgagaatagcatctccaccggaaaagataaatttagaatggtcagagctaaagttaaaagatcaagcatgatctttaagccttaactcagtaataaaatctaacccataatctagttatgtgaagaatcagaaagttagcaccattgccccccaaaccatgtggctattagtgtccaaaaactagcacagaagtcaagagtctgattattctaatccttgtatccacaataaataagctactgatcaatatcttaatatatctagtttaattagtggcaatgttgattgcacttttgtcactcactatatctggaaaaaaccgaccgctgcagtgccagaactgatgcaaaggatggaactaaaactggccaaaattgctgctggatactcaggacttgtaagacagtctgtatgccctcctctgatggttcagttgcatctgtatcataaacaggactatccccaagtaggacctgcaagtgtcaaatatcatcaagatgggtcaacgacagtatgtcaacattaaaaccataacaactctcagctgaaatgaataaagcagctgcccgtatttcgatatctgcattatatcatatacataaaatgctgaattgtctgcaaatacaataatgcagttaattgaataaaaatggttatataactgcagaatgccatccatcatgttagaattttatctgcctagcactaaaagaaagaaaatcaaaccagttgcaacatatgtgttccttgagcttttgatatccatagggagttaggcaacaaaaaataaattgaatccttgactaatgccacaaacagaattttcattcagagatattgggacaattgctgccaaggagagttacgatgctaacgcagttgatcatacatagcttagttccttacctccttatggtatttataaattccattgaacaagaatgagatgttactgtgaagaatgcataccttaacaacttcagtagctgatgaggatatagaccgaagattgtatctgcaccaaaggtaggcaagacgaaaaaacattgcataagtgttgatgtggtattctcaaatctcaactaaatatacttgcacaaaatttagttagctgatcaaaataaaaataaaaaattaagatttagtgcctacaaatccaaaaactctaagcaggatgctgtgtatattaggtccaagatgacagcctacaggtgatcatctcaagcggatcaaatttctaggcattgcctaccttttgaatatatatttatcttaaattgatagaacatctgggtacctaccctccctcaagtataaccaacaattttccctgtgaacaagcagttagcatggacgccatcctagaatatccagcaggtgtgacctattaattaaagaggaagttggtcaaaattatcagactcagactgacatggagtgcattgaaatatcaaacaggacaaaaaaggcacacagacaagaataaattagcaaacaaacacgaatagtatcgaagttgagggttgcatggatgatatagttcagtctaacttgtgagaacatcagcatagttatcatcttcatatttgactaagctctagtatttacaaacacatatgacaaaccaaacagaacagcaatgcatctcacaaccataccagtgtaccactgactcaatgagtgcatccctaaagaagcaactgtgtatgagcttgaatggcgtttcaatgtggtccaagaaaaagtccatacatgagttgtgcagttaaaattagcttctaaaggagcccaaataacatgtaattttcctatatgatgtcatatgaaaggttagcctaagtttcacaagaagaaaatcctctgcaaagtctgaacgttcatctctaagaagccagttaggaggtacaagcgtacaccagaaatctagaatcatcaaagatttctaaaatgatgcaaaaatggaagtggaaaaaaacaggttcatgatttagagacaacaatcatgtgttagtcttacgaacttacatcacaacaacccagagggtcacccctcgctgcatcaaatcctgcagatatgatggtgatgtctggagcaaattctgcagctgcattcatgaaagaaaattcattgaaacgagaacatgcaatagcaatatacaaaaacgcaagcgggtaatataaggtattaaggtaataatgtaatctacataacaaggtgcctgtgacccaagtactttaggcagacatgttttacccaaatgaatagacaccctgtttgggggagctggagcttctgggagaagctgcagctgctagaagctcccccaaacagggcataaacaggtttttgttccaatgtgtcaatatattttgtctgtgccctttctaacaaggatctaaagttctaaaatgctaagtctcacagaagacgaagcacaaaaaaaattcaaaggagtccgcgtgagctgctcttgactttacaaattaaagataggtatgttccgggggacatgtccggtgaaaaccatcaaataagtgaaaactcgtgaaaaccatatctaaaagttttgtaaattcatgaaaaaaatactagagataggtatagacatgaaatacattcataccaaatctcaactcatttgaaagaaacaaaatagacaaatttgaggtgaatagtaacagaacactattcacccgaaatttgtcttttttgtttctctcaaatgaagttgagtttggacttaaaatttggtatgaatgtatttcatgcctatacctatctctagtaattttttcatgaatttacaaaacttttaggcatggttttcatgggttttcacttatttgatggttttcactggatattccccatgtttacgttgagaaaatattgttattagcaactttaagttgactagcacatatgcaaatgcccctattcaattattacctatcggaagcaccacatgcttaaaagcaaatatgtagtcattgtctccaacaccaccacggctccaaggtatattgactgagaatccttggccatccataactcccacctgaagtgatgcccatgcaagaagttacaatataaaacgaatcatcttagaactcaagtttccacatgctaggtcagaaactctgataaaaagagtcatgcaatctgtcaaaggagatgccccaaatactccagattcggttagccagcatcagttggctcaaataggatgtagttcactagttcagagttcagatgtagtgttgtataaattatcttcaaatgttaaagaaaatcacctcatttgctgccccagttccagggtagaagcttccatcctcatgccgatgtaatgatatgtacaagacctgaaagaagaagaagaaaacttatccatgtaagaaataaggactcagggaaagaaggtcaattggtggccatgcatatggaagtatagtaaaggactgcaaagcaattagcaacacaaaaggaagatgataactcacagaattgtccccatcaaatatctcctgtgttccattgccatggtggacatcctgcaacaacaattgagcaccactgatgagatggattaacatccatttgaggcactatctttttttgggggggtccatgatgccaacagaatgcaatggtataagttcaaatgcaaacttgtaactagcattacccagtcaactattaagactttcttggcaccagctctttgtgcagctaatgcagccactgctgcattattgtgaagacaaaaacccatggcttgtttcacccctgcatgatggccaggaggtctcacctgctctccggtagacacagtcagtatcaacatgcaaagtatatcaaaataataactctcaggtgtctaggtgtactgtgcaaaaaagaggtcgagaattgcaaatataagatgatatgcacagtaccattgcaaatccattgcgaacacgcccagatactatcaagttagcaagatcagcacatatccctgctgcaagtttggcagcacatgctgagtgtccatttgcataggtatctgaagtgaagtaactacaaatcgatcccaaaatgacgttatgacaatgcaaatctttccagcaagactagaacacacaagcagcaaatataatgtcattagcatgcaattaattatactaaaacaaacagtacagtacaaaactaaagcaaggtaattacaagatggcttttaagtatggaataaacacagtacctgtaaagcatgttctttgtctgctcaacactgtcaatgtgatctgaagtatggacctagaagtaagcacgattttgaatgtgttaggattatcgaaaagattgtactaaggacaagtatactgggggaacatagggcagcaaaaataattaacatgccaaactcttacatacccttaggagttcttccttagtgatttctcgaggaggtaccatgacacattttgaagggaagatacctgagatattggaaatatgagttaaagtaaaacttgataagcagtggcatagcaaggctatttcatcaacccatttcaattaacatggttgacaaggaaacagttttgtggatttgctacagcacaaatcaactattttcagtgtcgattacttgattagctaccatatgtgtttttggaaaacattgtataaatctgctagagcacaagaagtaacaaattaaagtctttgctttcaacaagatcagatacaccttttagattagctatccactaccatatatacttttgggttacattgggcaacacggttgcaacagtaagcaatcatcaaaacatagacagtctttgctttcaacaagatcagatacaccttttagattagctatccactaccatatatacttttgggttacattgggcaacacggttgcaacagtaagcaatcatcaaaacatagacctagattaaatatttaaacaagatcagacaatcacaaaagtttgtagaggtattttttatcacagttgctttcactgaataactaaatagaaaagatatctcaaagttaatgatagagtacctgcagcagcaagactggcagcgattgcacgaaggcggtcaggcctttctggatgtggatttggtttaatctctatctgataacataggaaatgtgagatgtcagtccagaattacagtggctctgtgctgatagagaaaattaggaggccaaaaaaaggtactttcaaaataattttttttggttaaatgcaactagttttgagaaagaattattttaatctatgttcaaagagaatataattagattatattgtttagaagcagatacagaaacaagaaacacttcaatattgtcatgttatacgaaagcacagaaaaggaatatttatttgattccaaattagcaatgtaaatgagcttgcaattgcaggtttctgttttgttctccaatgggattgaacaaatatctctcagatgaaacaactcataagcaatcaaacaagaaggttcactgagcacactaaggagcaattaagatttatgcgaatccttgctattaaacaatgggagaaagagagaaaagcaatggccaattttgatgtaggatgtcagatccaaacatgtcatatggtgctagtttatacaacataatcggaagttcattgcttacctcactatggagcaacattctttcatcaaaaccgacagctgtagatactgatggcagcgctgcataaaatagtgagattgtgacaaattaagaagttgttggatacacataacatatgaacaaccgatgtaatgggacacattctgtgcttcaaactgcaagtgtaaagatagctacaagtgtaaagaagaacctaaaccctgagtaaagaatgtaaagaagcacctgcgtcagcagataacaaagctgcctgtgcaagatgagctttgaaagcatcatatccaactaccacagatcccttaagctcatcgcaattctagagtatgagaataaacatcaagaaaaccaaaatcaaaataatgtcactggatgatctgaactaaaatttctaagaaatcatacggcattcctgattacactgacaaagtaataacctttacctgacaatgtgtaaacccctccatgtttggcactgtacagttcaagcaaaaccacctgctcaaagcaaggcgagcagagggttcccagtcactgtcatcatcctcttcatcattaaaggaaaatagatcctccagtgtacccccaggctgttctttgtcagactcttgaagcagatcatcacaagccatacagctttcattcttgacatgcagacaaccatcatggcctgaactgtcaataagttccgaccttgctgtagaaactttggtcccatctactgataaaggattggcatggtcggaatttaaattgcatgctccagagttctctttcaaaattttctcatcattatgactcccgctcaacgaggaaactccatttgctttagcatgtgatggttttccatcattgccgcttttgcttttgctgtggcaagcttggtctgaaactccacaactctgtcccttttggctgttgagtgacctcatatcagacgccatcagagcatgcaacgcaatctgtaattgtgatacgacaagatcagcataggaaacacaagagtggataagaatttggacttccgacagggagccctaagaattattaatagctgattatcacatgccaaatctcagtagcattattgataatcgattactacatgccaaacctactcacgccttatccaaaaaaattgccgttacgcacaaaaccataagaaagcagttaatgcatcaacatagctagccgccaaattcaacatctcctcatgaagcgcatcgacaatcctagcactaacgctcgcagaggtactttctataaatggggatgcggcgaaatgcatctcctgaaactactgcataatctgctcaaaacccttccaaaacctcagcgctcttccatcgcatctactgattctgcagcgcaatatcagtaccaaaacctcaccgcaaacctcacctggttcttcttcctcgcatagattcctcagaacacaaaccctcccaaccccatccccccaacaccagaaacaacccaaccgcacgctacggctaccctcgcagcccggacggcaaagctaccacgaaatcaccggattgaacatccgggccgcgcaaaactcggatacaaacgattcaaccaaaccctaacccccaccatccaaaacctttttctcagaaaaaaaaaatcctacactccccgactagctctccccggaacggtgaaaccgcgggcgaaaatcgaagaatccgacgagaaatcgccgtggcgacctcgggggcggaggcggccgtacctggagggcgatcccggcggcggcggcgctcgcctctcgcgattggatttttggaggggcgcggcgcggccacgggatgactgtgaagagcggctcgtgcgcttcgtgctcggctcgagtgggtccgtctctacttgcctgccatttttgtcacataaaccctaaactgtcacaaaattctatttagatccctaacttgtcagtttctgaactgggccagaacacttagggatcttattgataataacgttaattttaggggccttattgaaaaagtttcgcctaacccaagtgcgggtccataggttggcgagcaaacgcacgcttatctctatctggcatgaacacgatgataggcccagctccgtctccggcagcggccgccgccgcagccgtgtcgccgtcgtgttacgcgtcgccggcggcttcgtccgtgcgaagacgcggcgtcgtcggcgtcgtccggtgcgcgccggatagcgggcgaggtggagacggcggcggcggcggcgggaaaggcaagctcagggtcgggtctcccatcgtcatcgtggaggcaccggtgatgctcaagaccgccgcgtcggtgccgtcgctcaggcacaacgccggccaggtcaaggccggcgacgtcgggaggtagaactacgattccatccgatgcttattgtgatatgctcttctatgcattggaatttggaagtataatttcggaccaccgcttcgtccctgcttgggcggctcggggtgcgaaacctagccgccggagcgagcctccggccaaccgtgaggcgagacgggatggcggcggcgagttgtctcgggcgcggaaaaggtcgtcacaaggaaatcgtggtgacggttggtcaaatactttggctgatcagccaaagctacctccaattctgccaaaattcaatgcaaattggttagcttattttgcttaaatggctgatcagcgaaagcatttgccatccgatggaagtaggaaatccaatgcagtagtagtgatttatttcttgaagcttgaaaataggaattttgggcgaatatcaagagagtttcacaaaaatttgaacaaaacgaagaacatgacacagaaattcaatgcttagtgatactccctccattttcaactcctaaatgacaacggtgactttgttatttaaactttgaccactaattgctcttaaatagttgaactaaagcgaacaaatgtttcatgattatgactaggacataacacattttaatactataacatctcttctagtgtttgcaaatatttttaaaaacgaatggtaaaagtttgaaagcgaatagtgtcagttgtcagttatttaaaaatgaatgtagtttttttttgtttttttaaacattgaaaataggaatttgcagcgaacattaagagaattccagagaaatttaaacaaaacgaagaacgttactacaggaatttgaattacactgacatccatgtgcaattgtgcatacgtcgagcagggtgatggcgcggaagccgaaggacgtctgggccgtgcggctcgccatcggaacctacctgttggacggcaagtatttcaagacactggacgtcgacgacgacgatactgcatcaccagatgagtgagctgcaaatgcagcagcattacagctacggcatagcatgcaagattgtttgttagacagaggcacagctgcaatgttgtaaaagatccaggaattcacaatttttgttgagactgatgggaccattgtttcacacataacccctggcgtggtagattgcacaggaaatctggtatgaagatgaatcaacctgcgcctaagggcaaacgaatctcaatctcatcatgttgttttgttaagcatacgtacaggggtaggagggaatcggagacacaactacacatattgcacaaacagggaaaaaaatatatcccacgatcttctttttccaagttacaatcaagcacccttcttccatggctggatgacggcgacgacaatgatcaccactatgatgagcaggaggatgatggcgtagcacatccacttcctggagttcttctggagcttcttcgcgttctgtagagcactgacgccttgttgtatgtggttggtagcatttgaaaccttgaagcagagaaaacgaaaataaggtgaattcttggtgatatacagtttgtcttgcttccaagaacatgtataacttggtgcaagagtgggcaattcttacatgtgtctctatgttgttgatcatgtctccttgagcatcaaccaaaactgccatatccatgaatatctacaaggcaaaaacaaggaatggagtaattaggcacattaactcgagctcacaagcatatggattaaatcagattagtaaataagtgcttatgtcaaaaaagtcacctgctgcaactccagaagcttcctctctagatctcttacagcatcgtgacgttcctgtatctctgcaacagtgtccagtatctggaaagacaaatatggttgagattttagtactgtgaacaggcagaaccgcaaaaatgtagttggtccccaaaaaggcattatcccatacagaaagaaatgcatatattggataacatacttggcctcttccctgctgttggatagcttcttggaaaatttgctcacttcttccagtctctattaaattgtcaactgtctacatagtacaaagcaacaacatgagaaatagtgtaaatcgaagatcatcagaccacagatcaaaattttcactgtaaagcaaaggcatgaagaaaacaaatttaaccaaaagtcagaactgcagagatcctgtcattgtatacctcttcatcaggacgactaccagttactgtaaacacccttctttcaacgacatcacgatactcctgccggattgcttctctcaaaacctacatcagagggtaaaggggcattactcacaagtcaccactttaggggcattgcactagtcctagcaggtgttcatagtgactaagaattgaatcatagcagcagagacagctgatgaaagtacaaaccataacatatttcaccaatgtatttttttcctttttacttcaagtagatacaggtatcagtatagacacccactactcatgaaatgctatacaataaatcttatacttggatagcttctagcaatggaaaaacaatgtgttttttctctgctgctcaaagaagcatgtctaacagaccgagaaaatgaaatatggcagtagtttaactgtgtaatgatcgttgacggaatagcagaatcaccccataaatggcaagttaggtgttccagataaggaaactcagtacctgaaaatcatccatgcgctccttcaatttctttttcactgctctgtagaatttagcaagcatagtggatgaacaactattcatggctttatgcactctacagaaccaggaaaaaaaaacaaatcgccagtaaatttacccagtagtctgttctcttgatcgatctaccgcagatcctttcccacatccaggcttttgtctgtttgataagttctgtttcacatggcagcgaacagtgagagacaactcaatgttgctattgacaaatgacactagcacgtgagatggcttagtgaaaagtatagcaaatcctacaatttgttttaggggcactactaaatcataaccttgtgatacaagttgcagagaatgctcttatgaaaatataatgcatacgttggatagacatggtcaatttgttacttactgcagtgctatatgactgttgatgatttatatatattgtatatagagtgcagacacatgaaataaaaacagaatattacgcagatatggcaaattaatacaatgccattagctagcagggccaagtgacatacatctttttccaattcatcaacttttgtctttgccatgcgagcgattttccccacttcatcaatatctttctccatcctctgtttaattgctatggaaaaataattgttgcatcaacaataggtaaagtgggttatcaaaagtgtacaagaactttttagacaaggttaaatatactaaactaagtactcacctttcatgtcccttgcttttgtaaccgctttagattcctcatttgcagtctacaagcaaaagtaaggtgtatatgaaaattcaagatgctaaatgaattcatcaaaacttagacacaacattatatttctggtactacgaaaatcaatatcatcagaacaagacaaggaccagaaacagaaagaaatgaatggaagtgtgagataaataaacct

SEQ ID NO: 74280 - DNA, 34278 bp, Oryza sativa
cggcgtcatctattaaaaaacggaggtagtacatgatttgataatgtggtgctacagtaaacatttgctaatgacagattaattaggcttaataaatttgtcccgtagtttataggcggaatctttaatttgttttgttattagtctacatttaatacttcaaatgtgtgtccgtatatccgatatgacacgtaaaaacttttcacccctggatctaaacagggcttaagtttatataggacaatgtgtgtatagcgtctgaattcaaatgaggactcagaagatttgatgtagctagctgacatagttcagacttcagagggtcctaactgtgaaacaaattacagagcacttacttctctagattccaatcaagccaaatcttgatcttattatctaatttaattaattaactgcagctaatccaatctaatagtagaacctattcaacttaggaatcaagaatcatggtacaagcagatgcgaaaggtttaccttgggtctcttggggaggaggcgggaggtcccctgccgccgccggcggcggcgagggaggctgtgcgccttcgacggggacggcggagttgcgccgtgctgacgtgctcgccggagtggtcgcggtgccacagggggggggggggggggcgttttaacgggctctcgttgacacacggagtacctaaatcctaatatgatacgaaaaatcagaaattagcctagaacctgctttatctgaatttcagcacgttgcataaggtaaggaaaagccaaaacttttccaaaaaagaagcaccaaataatctaactctaatctaatactccctccgttccttaaatatttgacgccgttgactttttaaaatatatttgaccgttcgtcttattcaaaaaatttaagtaattattaattattttcctatcatttgattcgttgttaaatttacttttatgtatacatatagttttacatatttcacaaaagtttttgaataagacgaacgggcaaacatgtttaaaaaaatcaacggcgtcaaatatttagagatggagggagtataatctggagtatctatctattactccctccaattcatattataagtcgtttaactttttttttctaatcaaatttctttaaatttgatcaaatttatataaaaatatagtagtattttcaatgcaattcaaacatattatgaaactatatttaaatttagtgtttcatattttagatattgttaacttttttatataaacttgatcaaacttagcaaagctttactagataaaatgtcaaacaatttatagtatgaaacggaggtagtatatgttatcgccaccgatgtggtcatcctccgtagagctgcagcttcgcctcctccaaaaggccatgttctcaagtgtttgatgaaattaaggccctgtttgtgggagtttgtcccagctgcagcttttcccaaaagctgcttctgctagaaactgccccaaacagtccacaacttttgttcttaaaaatgaactaagaagccaaagctggagaagctgggttttaaagcttttcagattctcagaagctggctatcaaacagctgcttctcagaatctaaagcttcctcaaacaggccctaagtctagggatgccacaaaatttttgacaaatttttatgagctttggctgcttgtgttacctttgttttttactcctcaggttcacgtccgatagttctcttttggaagtttttccccttactgccagttgacacttgacagtcactagctacatggattatgctaatcacacaatgttcgagttcttggttgcaaccagctagacaagaaggacgggtccctctgtattttcttcattgaagagtttttaagatcactgcaggtcccatttttacctgatgatatgtgaggatgaaaagaattcctgtctagaatagtggtggttggagtgttggacatgttaactagtgtcacttaattaaattcgagaaaattttgaattaagagaaaacaatagagaggataacataacaataatctggtgaaatttgaatgctacagctagaccaacattggtggcgatttcttttttttttgttacaaatgaattcaaacaggcacctgctccacctttatgaaattatgataaactctgcaaatgccttggttattcttcctgtgtgggttttctcctgtccaatgttgtgtgcaaatactcctactgtatcacaaggaatttcacaaagtttacctgctgtattattttaaagttgggaaaggcccgggatctttctagctagcaatgcaagctgcgagctagctggtccgggttcaagactcaccccctccttaatttaaaatcaatatagtccttcctatattggtctttttttttcaatcacattggaaattgtgaatctatacaaatacgtgtaccgtgactccgtgagatgagttgaatccgaaggactatgaactacccaaactcagatatctactactgtaacagtctgctcattacgagctcagatgtacttgactactcctaattaaacctttacctcaaagtcgaaccactgtttcatcagtatatcatcctgtagtccgaagcgtaattaaccagccccaagatctgtcttgttctgctcagcgttagcctcgagctcatcgagttgatctttcagcttctgcccccatctcctcttgcggctgcttctttatcttgagcgcatccaggttgagctgccagaaggctcgatcgttgtgctttctcatcatcagccttctgcgccttggtcagcttgtcagatttcatgggaagacctccgagatgatacggtgcgattggcatgtcgccctgcgattcaaacatggaatggaatagcattttgtggaatcaaacaccaagcacaacaaccacactggggctcctcgatcgaacagtcgaactcgaaaaacttgtatacataggctaaatgaatacagcgtaaaaaacgtggttaacaagctgacggtaagaaaaattaaccaggatcctggatgcgagcgcagttgtcgcacggtgtgccgccgcgccaactcatctaataccacttatagaggctcactcttagagatggggcaatgggaaattcaccgacgggaaatacatcgtccctatgttgaaattataagcacgtaatgatttaagttattccataaataaatcatgacattatatatgtaaactagattgaacgcatcattagatctacacatgtaaactaagcagtaaaatatgaacagatcaaatatgcgcaaaatgtcgaacacgtaccgaggtggcggaaagaccggttgctcggcaggaactactcgcggttgcgagcgtcgacgaaggcgcgaagcacgcgagcggagaggaaggcgagccgtcgcggacgaacagagagctgtcgcgcgaagcgcttcccaagaaccttattgccgccttctcccggtgcaggacgtcgaaggcagaggttccggagacctgctctcccgatcgccggtgcacgccggcgagcgggatggagtagtctacgagtgacggcgcagtacagagtaggaggcaaaccctagattgatttcgcgtgtgttgcgtgaagacggcggctcggtttatatagagatagatcgcctgatcagggcgcccgcgtaaaccgaaccggataagtcgcgcgtaacctatccggactccatgccgttttcacgtaccggatttttcggaatgtttccaaaacaaaacaaatccgaatttcccgcagcaaaacaaaactgcaaaagactccatgccgttttcatgtaccggatttttcggaatgtttccaaaacaaaacaaatccgaatttcccgcagcaaaacaaaactgcaaaaggaggctgcatctgcgcaagggtgaggagccaattttgtagaccattcgacgcgtacgtcgtgcacgcgcgccgcctgccctgccaggcgaggcgaggcgagcgcgcgcgcgtgtttcccctcttctcttcaccacacatgcttcaagtggctaggagagcatcctcccttttaaggaggtccccctctcctagaataagcaatgtggtactaaactccacatgcataccatcccatgaggtgggcttttgtgattttccaaagaattaatcttcaaatgggccttagcccatctattaattccaacaatcccctaccaaatctcaaaatcccactgagatttgccttttccaatgtactgtttatataccaacggctcgatagagaccgattaaggttgaacatctatctagaactccaagctacacttactcacaacttgaacaatggactacggcttggattgcaagtcttgtgcaagcaagtttcactcagagtcttatctggtattagaccgtctgtagactacccctcgggtggagcgtataagttatactcctaggtctttagtaagcttcctagaagattcacccaaaatctccatagactgcgaccaacggtcaagcttacaaaggtgagttctttcaagaatgctctgcaggacagcgtcttcgctaattaaagccaacagaactcattaaggcatagccaacctgccttgcagctcacgagagtacatgcatcttcacttagggagggtatagattggtactctcctctagtttactaatggtttgttcttcacaggttctaattcacgggatctccgatcacatagactgagttaccaccatagtataactcacacgggtctcaaacccatctccttcgatgcattatctatcacatttcgtgataatcccttcgtgaagggatctgccaggtttctagctatttggatgtaatccaacgttataactccggagtttctcaatttcctgacagacttcaatcgtcttttcacatgtctaaacgatttcatattatccttagaactattcactttgacaattaccgtttgattgtcacagttcataaggatagccgacaccggttttcaacaataggcagatccattaatagatcatgcagccattctgcctcaacagtagcagtatccagtgccgtcaattttgcttccatggttgacctcgtcaaaatggtttatttgcaagacctccacaaaacagcaccaccacccagtgtgaagacatatccactagtggctttgatctcatccacatcagagatctagttagaatcactataaccctccagtaccgcaggatacccagtatagtgaagccccaatttcatagtacctttcagatagcgcattactcgctcaagcgcacgccagtgatcatctcccggattagaggtaaatcggctcaacttgctcacagcaaaggagatatcaggcttagttgcattagccaggtacatcagcgagccaatgatttgggagtattctagttgattcctagcaattcttttgttcttgcgaagcaacaagttaggatcataaggtgttggagaaggcttactatcaatgtagccaaagcgattcaagatcttctccacataatgggactgcaagagtgtaatctcattttcacctctaattagcttaatgtttaagataacatcagctactcccaaatccttcatatcaaaattttgagacaataatgatttaacctcatttatcacctcaaggtttgtcccaaatatcagtatgtcatcaacatccaagtacagaataactccctcacccccaccatggcgatagtacacacatttatttgcctcattgactgcaaagcctgcagatgtcaatgttttgtcaaatttctcatgccactgcttaggagcttgtttaagaccatacaaagacttcaacaatttgcacactttgccttcttgaccttcaactacaaacccatcaggttgatccatatagatctcctcatccagctctccattaagaaaagttgtcttaacgtacatttgatgaacgagaagaccatatgaggctgctagggaaagtagcacacaaattgtggtcaatctagcaacaggtgagtaagtgtcaaagaaatcttcgccttctttctgagtatagcccttagcaacaagccaagccttatacttttcaatagtaccgtcaggcctaagcttcttcttgaacacccacttgcaccccacaggtttacacccatagggtcgctctgtcacctcccaagtcccgttagcgataatggaatccatttcactacggacagcctctttccagtagtctgcatcaggagatgcatatgcttctaaaattgacttaggagtgtcatccacgaggtacacagtgaaatcatcaccaaaggacttagccgtcctttgtctcttactccttaaaggagcttcactgacatcctcctcagagacatgttcatgtgtatgtttagtttgttccggtggtgtgattgaactggaaattatttcagagggttggctcgaaccactatgtgtatccttcattgggaaaaagctctcaaagaaggtagcatcatgagactccataattgtaccaacatgcatgtcaggtacctaggatttaactattaaaaatctataggcaatgctatgatgagcatatcccagaaatacacagtccacagttttaggtccaagtttgcgcttcttcgttattggtacattgactttcgccaagcacccccatgtgcgcaaataagaaagtgatggttttctctcaatccatatctcatatggtgttttgtccttatttctgttaggaactctgtttaacacatgattcgagataaacaatgcctccccccaccatgccgtaggtagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacaatcagacctaagcctttttatctttctgtcaagttgattttcaacttctgccttataaattttaaaatagtctagaacctcgtctttcgttttcaacaagtacacatatctagtagcatcatcaatcaacgtcatgaaatatcgttttccacccttcgtcaacaccccattcatttcacaaagatctgaatgtaggagttctagtggtgccaagtttctctccttggcagccttgtgaggcttgcgaggttgcttcgattgcacacaactatggcacttagaacctttgacaatggaaaacttaggaattaaacacatgctggaaagccgagacatcaagccaaaattaatatgacataaacgtgagtgccaatcattagcctcatcatccacactgccacaaatatggttcacagacttattgcagaaatcagaaagggaaaagcggaacatgcctccgcactcataacctttaccaataaaatatccatgtttagacacgactaatttattagactcaaaaaccaacttaaatccgtctctagtcagacgggagccactaataagattcctgtcgatagaagggacatgctgcacgttcttcagctgcacgatctttcccgaagtaaacttcagatctaccgtgccaacaccatgagcagaagcatgtgacccattccccattaggacggtggaaccccgtgcgacctgataagaagaaaacaatgagatgtcgcacaaacatgtacattggttccagtatcaacccaccaattagtagactgattaactgaaaaaacagtaggtaaattaccatacccgcttccatctccagtgttgccaatggtcacattagcagacttagaagtctgccctgcaggtgccttcatccccttgcgccgtggaaacttcctagccagataaccaggttgcccacacacaaagcaagtcctctcatcctggttaggattgttgttgttcttcttctgcttcttgaagttggtggtctgttgagttttgtatttctccttgctcttgttctgggccttgtgcacaacattggcactggactgcccaccatcgcccttagacgcggcgtctttttcccgagctttctcctcaacatcaagagacgctatcaacccctcaacggagtattcatgtctcttgtgtttgagtgccgtaccgaaacttctccacgatggaggtagtttcgcaataatgcacccggccacaaatttgtcaggtaagacacacttaaggagttcgagtttcttagccatggtttgtatctcatgagcctgttcgactacagaacggttgtcagccatcttgtagtcatgaaactgctctatgatatacagatcattgctagcatcagtagcaccaaatttagtatttagtgcatcccacaactccttaacgtcgatcatatgcatatacacctcgaccagacgatcgccaagaacgctaagaatgcatctcacaaagagagtagtggcttcctcgaattgcttctgctgatcagcagtaagaattcctttaggtttgccagtactcacccagaagcatttcatagccgtcagccatagagtgaccttaatctgccatctcttaaagtgcacaccggtgaatttatccggcctcagtgcatcggcaaaaccagccatagtaaaatcacaacgcctataataaggtttttggattgttgaaattataagcacataatgatttaatttattccataaataaatcatgacattgcagatgtaaactagattgaacgcatcattagatctacacatgtaaactaagcagtaaaatatgaacagatcaaatatgcgcaaaatgtcgaacacgtaccgaggtggcggaaagaccggttgctcggcaggaactactcgcggttgcgagcgtcgacgaaggcgcgaagcacgcgagcggagaggaaggcgagccgtcgcggacgaacagggagcagtcgcgcgaagcgcttcccaaaaaccttattgccgccttctcccaatgcagtacgtcgaaggcagaggttccagagacctgctctcccgatcgccggtgcacgccggcgagcgggatggagtagtctacgagcgacggcgcagtacagagtaggaggcaaaccctagattgatttcgcgtgtgttgcgtgaagacggcggcttggtttatatagagatagatcgcctgatcagggcgcccgcgtaaaccgaaccggataagtcacgcgtaacctatccggactccatgccgttttcacgtaccggattttttggaatgtttccaaaacaaaacaaatccgaatttcccgtagcaaaacaaaactgcaaaaggagtctgcatctgcgcaagggtgaggagccaattttgcggaccattcgacacgtacgtcgtgcacgcacgccgcccgccctgctaggcgagacgagcgcgtgtgtgtttcccctcttctctccaccacacatgcttcaaatggctaggagggcatcctcccttttaaggaggtcccctctcctagaataagtaatgtggtactaaactccacatgcatgccatcccatgaggtgggcttttgtgattttctaaagaattaatcttcgaatgggccttagcccatctattaattccaacaccctatccccgtccccgcgagatacggcaggggaattttggttcccatccctatcctcacacggggaattaatccctgcagggtcttcatcctcgcttaaaacaatatatacaatattaaagcatatatacaatgtatccagacggagatatgtctcttcccatttagttccgtatggagaaccaattctaacaattcctatttcctaaaaggtgaatttcccatgatgagacggggaacggagccgttgcaatctctactcactctaaagaggtagagtgttttaaaatctgttaagagagtacaggggactgctgacaaaacaaaccaccgcaaccttatttagtattaggctcatagcatttggagcccctcattgctcctcgagattggaaccagcactttggtcgttgcttgaacttgctgggcattctgtgcattttgaactttggcagggccgccttggtaccacgtacgaatatatagtgcacaatgaaaaaagtcccgcaaaatacccggtattaattatgttaaggagcaatctaaaatctgccaaatcgctgttgaacagaaaacaaaatcagtaatgtttctacaaattcaatttacatatagccacatcttaatattatctgaccaatttgtgtagtttaagaaggcaaaacaatgacaattttatttcaacagtttgtctagtgaaatgttccaggttcaagagggtaaatttatatacagggtctaaaaaaacacaaacacaactgattctttttatgttccaagtagacaattcacaattagttggtttagggcctatttagatcgcatggtaaaatttttcaccctgtcacattaaatgtttggatacatgcattgagtattaaatatagtaaaaaaactaattacatagattgcgtgtaaattgcgagatgattattttaagtctaattgctccatgatctgacaatatggtgctatagtaataatttgctaatgacaaattaattagggttaataaatgtgtctcgcagtttacagatagaatctgtaatttattttgttattagtctacgtttaatacttcaaatgtgtatccgtatattcgatgtgacacgccaaaacttttcacccctgacctaaacacaaccttattattatctctgctgcaagtgaatatgataatatagattcatttcgtgttcaggtcaaacttgattcagcaagtttctacattttacattttgcagttctctacattttaaatgtggtgcacctttctacattttgccgtttctcagtgatggatgatgcgacatgatccgatgtagatacaaaggagagaaaatagtgctgctacttactcacggacaattggggtgagtcggtccttgacagttgtactgtataaagcggttgtgttggcatctctagcacaacccaggggcttgatcaagtgattggtgtgatcaacagagggcagcccagtggttgggcagtttattttaagcttggggtgagcacttggaaaggtgttgaagttcctcgatgcctgcattaggtgggataaaaaatcaggacggtcaattgaggcaagtatattctttgcaagtatatgaaatattatactattatataattttttggcgttatttagcactccatccattctaaaatataagaacataaaatcagataagatatttctgtccagatttatagtactggaaaatgtatcatctgatactaaattcttatgttttcggacggaggaagtagtaacaaaaatgtaatggtactgtcatcttgccacattacgaattagcgtcataaactctttataactaactacttatatattcaatttcattgtctaataaaaaaacaatactcaattgaatggacggatgggcgtgtggtgcacgaacctcagcggttctagggaagaggcttcttgttgatttagaagacagatgggaggccaatttaggaaacacgaaacggccggccatgtcgacgacgtacggctatcgatctaatcttcaaaaccagacgcacggacagattggattgaggccctccctgccgcgccgcctgctcatataaaagagggggccaaacacgggagacactggaaaacctattccgttccaagattggaacaactcggaatacatgtccgattccgaatgataatcattaggaaaacaaaaataaataaatccaggatagtagagaatatcagagaccatctagcccatactaataatcttgttaaaaaatatgtaataagtccccgaaaataaaaaaggcattgtcattagcaactactaattacgaacatcggtgaagccagctctaaggctggttaggtattgcctaggctctacatctccattgtgtattggcgtgagaaatatcaggagtcttctggctagcttcacaaggtggtgagctagacgatctgggttcgaaaccttaccccttctaattatttgatattaggtcattccctaatattcacgtcttttcatcgtgtattggcgtaaatactcatcaaatatcgtcaatgatcgagaaatgctctttaattaatcagcatgttttggcaacatcaatcataagaaggaaacatatcctatacatataagcttcccgtgcacacaaactaacaaatgtcacaaaatattctaaaaaaaattgaacatttactcctaatagtattacacatatatgtaaagtctcatattcaaatttattatatttagcagtaaaaaacatgaaaaatctaacagttttgagggtaaaaatctattatgattttgtctttttttttacggctaaaagataaaatttcatatgtaggtgtatgtcttttttttttttgtcttttttcacagtttgggctttgctcgaagcgagctacggataatcggttcgtttggtttttaagctgagccaagcccgagctctttgtccacccctacccgtgcgcgagttcggttcctagcgcgtatgcgcgaaataggagtagcattcctgcgtggggttcgtcaccctcccgcgttatccatcctcttccaaacccaaaccccacgagctcccctcctcccctggactggatagcaatctagggttttatcccgagcccgcgcgccgctccaatggcgctcgcgggcgcctcctcgtcggcctgcctccgccgcctcaacccgctcctcttctccgcccaccgccgccccgcgtggaccccgcgccgcgccgcccgcaggttctgcgcaggtaccggccgtcttctgcttctactgccctttgtttggtccgtttggttggtgttgattcggtgaaggggttggttccgttgcagctgcagttgcctcggagagagatgtgttcacctccccggaggtcgccaagtcgttcgacttcaccaatgaggagcggatttataagtggtaagctagcatttctaccagttatccactatttccccattttcatgaggtaatggaactatggctgagatgattttcccagtaattaatttgtcaatcttaaacgtgtgttaccttacattggacactcaccagtaagttaatttgtgatactcatgatacagcgagcagtttagtgccatttttccttgcagttttagactgttcgggtgattttatggtattttttgatatagcttcaaccattagattggcaattgtatctggatgagcaaaattctccttacactcccatgtagttgtgccctgtagtatttgagaagtaagcttctcacaatgcttctacttaatgcctttaagctaaacaatttcaatttccagaactaaaagtgagttccagtaacagaaaagggtatgctataacaagctttctcgcaattgattttctattatccatgttagacttgatcacttactagtgagttagtgacctgcctttgagcattgcctaatgtcaatgcaaggtttagcattacgaccgtatcaagattgaccgattaatactcttattacttgactcaaatattgtgtttttagtagattaatactcttattacttgactcagctattgtgtcgtcagttttttactgaaatagcattctaaatgcaaagtacaactctaggatctaggttgaagatagtctgtataaaggtatcatgatttggtccagttccatttttctaaagtgtgtgtgtgtgtgtgtatatatgctgttgcattagattacattgatatgattgtttacctgctctagttgacacataaaaatgtaaaaactgatgaattgcatttaacatatttaagtcaacaggtctagttttattttgctacttgctttgtttgcctgtttcacttcaagttcatgaagaaatgcacttcggtattttctggtcctacaataaattttccttataacatatatgttgtatctttgtaggtgggagtctcaaggattctttaagcctaactttgatcgtggaggagatccatttgtcatcccaatgccaccaccgaatgttaccggatcgctgcatatgggccatgctatgtttgtcacccttgaggtaggtatgatgattgaaaatttaagatttttttcctcttgttgaataactatagattgattatttctttactagcagatcataattgagtacatttcatgatttatacgttcactttgttgaatcatgacatatgagtttcatcttttttacccatttgaagtgatttgcatgttaacatgagcataagctgctatggatgtacttaccaaggtgaatctgtttcttaaagacaagaacatcatttttttaatcacactagcaatttagttctcttgcactggacccatgaaactgtgccatggatggtaaactgaatagtacttgcaattgctatattaagcagaagtgttggacagcatctgataatatccagaggttctgtgaactgacatgtttcagttaaactagcttattttgtggtctgaattcgtagatagttattggtgacagcactatgttgataatgagttatttttgtccccccccccccccattttttaggcactgtaatctttttactactaaattgtccctttttgtgtaagtactcaggatataatggtaaggtatttccgtatgaaaggaaggcctgcactttggttgcctggtactgaccatgcagggattgccactcaggtttgtagatcttactgcacatctgatatgaaatgataaattctattttgtgttcagcatgactttgtgaagtgatgggctgatttttatttactttttttttgcatttacattttagttggttgtggaaaagatgttagctgctgaaggaatcaaaagaacagatctgacccgagaggagttcactaaaagagtttgggagtggaaagaaaagtcagccctttttctgaagctagatcaatttttcttcattgtttctttatgcacctgtaattgctatatttgtttttctaatatgaagtgatcattgctaatagttacttggatttactattaaccatatatacccttgctcctacctccatttttttacgtgtttgccatgaaggctcatgtgcattacagtttattaactatcttctggtatcattatcgtgttgggtggtacctgtcataataatttgatcatctagatgaccagccttttgttattattctgaattgccagttaaactatcatgaacttgggatggaataataaatattctagttgataaaaaaaatcatgattcaagaaggttacatattttataaattctagcaatcactccaaatgatgtttcctttccaggtacgggagcactatcactaatcagattaagcgattgggtgcatcttgtgattggagtcgtgagcgtttcactcttgatgaacaattaagtcgtaagtgtagcctttattttccattgcaaatgatgcaatttgcatttgttagtatatgtatcattatagtgatggtagtcggtcgatcaacccctcaacctcaagcttatcatcagcgcttggtggtttgtacaactgatgtctcactagtttttttctttctacttacaggtgcagttattgaagcatttgttaggcttcatgaaaaagggcttatatatcaaggtaattaatataatcatttactcgctctattacaaaggaagcaaatgtgcataatcttgtgctgatattatgtgtgatagttttcagtttttaatcttttccctatgttttttctgtcagtgtaacctaattttcttggttgtagtttcaaattgactatgttaacatatttagtgttgatagatttagtactaactgattttttttttaaaaaaattcagtgtcaatagtttgaacagtagtgagaggtacaagaagttggggcatgtggtaataactttattttctatgtaatgtattatcactttatcagttacagcacaagtttcagaagtttcccagggtcctatttggaacaaactttaaacttttagccccaaactatatcaagtgcatccgtttattttgctgataggataggtctgtggtgtaatgtacatcataaatttttgaatcagaattataggatttgttggctctgagcttttttgttgcttactggagactaagttctcttatgactggaatttacaagcagagaggagcggcagcaagatttactaaaattatgtcccaagcaatttgttacttccatcgctagtatcaagatgccttttgccgtacgtttttaatatgttctggtacacacttgggtgtgttcatgtccatgatgcccgtgcttgttatggcattttctattgtgatagttgcgtcgttgaacagaaatttaggattttttcttcattcaattcttgtgtttttcctgaatttgagagtctagttttgccttatgtgaccttgatggtaaatattggttaatttattgtattttcgttcacaggatcttacttggtcaactggtctccaaacctacagactgcagtatctgatttagtatgttacaatattacctctcattttttaagaaatagctgcacacttctatctgtgcagatatataatctaagcaaaaaataaaaaataaaacttgagaataattacatacagaagctgacaaacttcaattacttcttcatggatagttgcatgagccaactccagatttgatcctgaaatggtttatctaaccaggaagtggaatactctgaagaacctggtaatttgtacttcatcaagtaccgtgtggcaggtggatcaaggtacttcttgacttatctttaatcttgtggctatatgttttatcattattcattttttaatcgatggtgatgttatcattgtccatttttgtgatgtttaaatgtgaatgagtttggatgatgcgcgctataaagtttatgttttgcattctattacaaggaatctaacagcatggtcgacactgtatgttgatgaaaattacttatatgtatttaaaacttaagcctctggtgcagggatgattttatgactattgcaacaacacggcctgagactctctttggcgatgttgcaattgctgtaaacccagaggtatcagaaaaagaaagcattccttgtgtcctgttacaacttacttcccccatcccaaaatatagcaacttctagcattcaaaagttgtcctaaaatcaaaatgtagcaacttctccacctactccctcctctcaaccaaccacaaccatcctccatttaatatcgccacctagtattcttaatctctgcacaaaacctaaaaaagccttatattttgggacgaagggactgcatcaaattgttctatttctcgaactgatttatttgaacaaccaatcttattttctttgttaaatgcaatgcaggatgaacgttatgcaaaatatgtgggcaaattggctattgttcccttgacatttgggagacatgttcctattattgctgaccgggtaggaattaatattacctgtaatatttgtatgattctaataaccaagaaagtatgttgcaacacggatcaaagtaaagcaattcaacagtaccgtattcactagatgttggcgttctcttatctttattgtgttgtcccaatggcacatctacatgcaaatgtgatgccatcgcttgtcagttcaagtcagaactcaggaaagctgttgtttctgttgaggcaaacttcactgttggcactgtttttggggctaaaatgccaacgttttgcttgctgagctgacgaaagcttttgcttgacgaatagccatacatacaaaagatgtgcattctttgtataagggcttcacacttgtatgccctcgtttgtggtttgatcttaaacatactttgtatgacttcatgtgtatctcccctggctcaagaatctcacttaatgataggcatgcattaggttgcaaacccggtttataaagaaaggtgttcttttatataatcgatagacttcgattatcccttttaacaatatatcggttttatgatctacagtatgttgatccagaatttggaacaggggtgctgaagattagccctggacatgatcataacgattatcatattgcacgaaaacttgggttgccaattctcaatgttatgaacaaagatggtacactaaatgatgttgctggattatacaggtattaattttcgttcaaacttcaatttaagtaacctgttcacttatttccctttgaatttgtttagacttgcaattttcaatgtttggtttctctgttctattccatgttgcatcataactactatctagggactgtagtttgtgctgcttataaacccatgtatcctctttgcaacacgaccagtatttatcttctattataacatggaaatttgagtatagtaaaattgctgttggaaaatttaagagattctgtggcttttagccttcacaatcagtggaaacagaaaacagtcaattcgacctcaattatttcatatcgaagagaatgtacaatatttgttcgattatacttgctccgcaggcaacacagctgcagagccctctgtatttgacatgttcttgaccttgactttgctatctttattcagtggcatggatcgttttgaggcacgggagaagttgtggtctgaccttgttgagactaacttggcagtaaagaaggaaccctatacacttcgagttcctagatctcaacggggtggtgaagtgtgatcttttctcctgtacctgctcatacatgtaggctaacgatgcttaccataaagattaatgaacttaacttttgtgtgtcactaggtaatagagccattgattagtaaacagtggtttgtcactatggatccattagctgaaaaggcccttcatgctgttgaaaaagggcaactaactattcttccagagagatttgaaaaggtaatacattaatcattagcttttctatgcaccaatcttctgctcactagtaagcacacataaaacatgtctaaagtttttattggaactgctaagcaggaatctgtctctgtattcccactttctcagtaaaactatgcatatgccaaataaagagttaatatctctggttatatcttactcctgtaaaaatgatttctttgaactgactttgctgctctccaataatttatttgtgctgctgctgcagatatataatcattggttgacaaacataaaggattggtgtattagtaggcaactgtggtggggtcatcggatccctgtttggtacatcgttggaaagaaatgtgaggaagactatattgttgctagaagtgcagaggaggcacttgcaaaggctcaggaaaaatatggaaaatcagttgaaatatatcaagatcctgatgttcttgacacttggttctcaaggtttgtcttccatctgtaaagctgtatgctcgtaatgacttagcatacatgtattttcctctccttgtccgcttcctgaagtttttttttgttttgctttgttcataacatgggcctaaaatagcttttacaacttgcattgtagagcagaaatgtgtttattaagatgtctgaataggttttagccatctccttgtattatttttcatgtacaacagtaagatgaatagttaatggagctcctatactgcagtattctttttcccttacagtttctgattggcatctgggatatctgtatgaaccttatttccatgtgctgtaccatgtagaagtataaacactttcagacacaaatcgctacaggtattaagaaaactgcatatagttttttgttgttttgacttgttgcagttgtcctgcagtgctctgtggcctttcagtacacttggttggccagacctatccagtgaggattttaagcacttttatcctgcaactgttcttgagactgggtatgttatcttcagcaacaactttatttaccttctgatctttcagtccagcgataatactgttgcgctgctctttatgttgattatttatttttccatttacctccattatattatagctttctctctctttttttttttggcagccatgacattttgttcttctgggttgcacgaatggtcatgatgggaattgagtttacaggaactgtgccattttcttatgtttatcttcatggtctcatccgggactctgaggtgagagaggagcaccttaatcactagttcctgttctgtacttttgagggagagtcgattaaacaaacttttcttgtagttgtaaaatgacatgattgaacttctaaagggcatcaaccattaaaggctcataacttggaaattttgttttcttttgagccgggattgaaccctctcagatcaaacattgcacctgattggggtctcatgctttatgtgctaattgactgtatgatgctctagtgcagctagtcacatactgcacattacctcaaatttgaagtcactgcctccttttatctgatataaaagtggtatcaccagttaaactgttaaatgagcccattgtgaaatctgttttgtacccttagtcatcgtgttcatctgagttgtttctgttgccatattagctctctgtttccatggactaattagcaagttaattttcagggacgaaaaatgtctaagacactggggaatgtcattgaccctctagataccatcaaagagtacgggacagatgcattgagatttacactttccatgggtaccgcaggccaggtttgcttatacagtcgcttttgtatttatcaagattgtttgattttgtgctgttaataccctttttgcttcaggaccttaatctctctacagaaagattgacatcaaacaaggctttcaccaacaaactctggaatgcaggcaaatttttgttgcagaatttgcctgatagaagtgatgccactgcatgggatgtcttgttagcaaataaggtatctgattgaatttcgaattgcacttgatgcattgacataatttagttctttttagaactgttgctaacaccttgcatctattgcccagtttgatacagaagcgtcacttcagaaactaccactgccagaatcctgggtggtgagtcagagtacattactatctcgaattatttgattaatgttcagtttgttaatgaagagaatacactacgatccaggtgacaggattacacgaactcatcgatagggtcagcacaagctacgacaaatttttctttggcgatgcagctagagaaatctacgatttcttttggggggactttgctgattggtaagattttttttattacctaagaatatgaggccaggccttttcattaagagcacattaatatttctgcctcaattaatctggagactatcagccctattgacaatgtaaggagacacagggggcctgagtaaccaagtgtacaacttatcatatttggtagacctgcccaccatgcagaacaaagaatttcctatttgagcccttttttatgtttcctttaatttacatagtcctgtttgtctaaattctgattgcagcccttcccattgatgggaagaaatatgctagttgtatgggattaaaagaactaaaatccttttatgtgcttaacttttgtctggttttcttaatctgagcttatatccaaatggtaaagaactgtcaagagctttagtggaaagctgaggtctttcttaacaatggagattccatgagcaatttttctaaaagaaaatgaaactaaaacatatcacaatgttagacgccatgagccccagctagatcccaaaactcccaaaactgtccctcttccttggcaagcagaaaagcacctgccaggtttgagggtagcaccataaaggacacaacaattaggatgcttccagggagtccaaacaccaagaatgttaaggacttaaggccttgctgcaccaggccattaagtgcatcgctagctcagctccactcgtcaaggactgattccccagcgatggcgacagggcagggaggccaacctgctgcaggagactcaaccaaaatcgtctaacagaaactcatgtagtgagcaggtgatggatagtctcaacgtcctgatcacaatgaagacaacaaggagggtgcggcagcctcacctagtgaagtgatctgcagtccagcaccaattgtgcacaaccaaagaaagtagtgtcacatttacctggggcccatgatttccaagtatgctcccatggctgaaatcggacagcaccctccaaaagaaaaataaaggacaacaccttggaggcttggaagaaattgtcatgtgcagatttggccaactattaccccaaagctgatagccgccaacggtgaatgtcttccacacccggctgcaacacagacctcagataaaagatcctataatcagagatctgggtattctcaagggcgccaacagaggttgcaccttgtatatccaggatccatctgtattcctttaggtcctcaagaaccgtgcgcctgttggttgtttttgtaggaaccagagcaaacagtttaggggcaaggtcagcgatccgctgcccatgtagcctcctatctttccagaacaaggtgtgcgcaccattgctgacctcaatctcaactgctatggaaaagaaagcatggacatcatcatgcatttgaattggtaatgccgactatggcctatcaggctcctgtttttgcagccacagccagcatatcctgagggcccaaccatgatgcatcatgcattgtttttagtatatttttgtgtgtcatccagtcaaccaaattagttctcttgcaggtatattgaagccagcaagacacgtctttaccactctggtgatgattcagcttcttctatggcacaaagtgttctgttgtatgtgtttgaaaacatactgaagctattgcaccccttcatgccctttgtcactgaagagttatggcaggtagtgaaacctaaccgtaaattattattccctgcaatgtagtatatcacttttaccttcaccattaatagcatatcattatcgttcttatttcaggcattgccatacagaaaacaagcaattattgttgcccactggcctgcgactgatctccctaagaattctctctcgatcaagagatttcagaatttgcaatcgttggtaaatctttgacttgagctgctcatactttaagtggtgacattgcctgtggtgaccattttgttccattgtaaatgtgataacagataagaggtatcagaaatgttcgagcagagtattctgttgagccagccaagcgaatatcttcatcagttgttgctgccgcagatgtcctagattacatatcggtgagcattttcttacattacgggtttttctttgtggcatttcatcgtatatatattgtatgaccttttttatctattaatctgagaatcaacttaatgcacatgcatgtttattaccaagaacggtaagtattattattctttttatcttgttgcaatactcgagttaaagcttttcattgctagaaaacaaagcatatgcatagttattagatgtgcaagtttcactattggaacatagaggtgcatgtgtgatactgtcttgccttttcagctctaacttccctgcgtcttgacattatgaaaaccctttatttgttttgtgaaaaaaccctttatttgttcagcatcatgatctgtactttgatgcctgcagaaggagaagcaggtcctggctttactttcaaagcttgacatgcagagtatacattttagcgagttgccgccaggtgtgtgcctataacttgtcaacataatcttccttgatgcacttggccaatataaatcatctacttctgttgctggcaggtgatgcaaatcagtcggtccacattgttgctgatgagggtctggaggcctatctacccctggctgacatggtggatgtttctgaggaagttaagcggctgtcaaagcgcctctctaagatgcagtcggaatatgattctttgctggcccgtctcaattcaggaagtgtacgcatatatttcatcttcatgacaactatattatccctttgaaaccaatttctgtatccttttaaccatgcatttctttcgtgctgtagtttgtagagaaggccccagaagaaattgttcgtggagttcgtgagaaagcatcagaagcagaagagaagatctccctcaccaagaatcggctcgctttcctgcagtcaacagtatcaagttagattcagcagtcaccattgacggtgtcaacctgccatctaaataacaattttgattagtcctgatttggacgagagatgccacttccggatataaattggcgtgtcagagtagtgagtgccattccattttcgcgtgtgcaggacattgcaactggtgcacgcatcttaccgataagttctactatataacactcatttatacgtctactaggtatgcctgtacgcctgtgcgttgtaacgggacaatagttgtacatacataaacaatacataaacaatgaatggaataaacagttgcacacatctgtattagtgaaatgtgaatctcaaaacttaacagggatgaaccacgtaatcaagaaaacatgaaccgttagattagaaaacatctgtattagtgaaatgtgaatctcaaaatttaacagggatgaaccacgtaatcaagaaaacatgaaccgttagattagaacacatgagccgttagattagagaagataaaacaaagagatacaagagccattagattaaaataaggtggaaaaaaattatactccggtcaatggagggaatggagagaagtgttgggatacacgtaggctacgatagcataaatcaaaattttctatcgcgtaaatcaggaaccatgcaagtattagatcataaatcgttaccactcgacgcactgcgcaacggaagaaggcgttaagaagtcgaaggaattctcacgaagtagcgcgcgtcgatgtagaggaagtagtcgatcgcactagctcgaccttctcctcctcgtgcgttctcctcgtcgtattcccacgccgatcagcaccgcaaaccagcggcgcctctaccggtatccacacgtacagggacggaacaccaggcgcagatgtgctagcacccccgcgcggctagggttttgctcggggaggggagtgacggctagggtttctcacgtgatgcaatccctccgccggtcacacccctcacgaatatataggatccatcattcgggcctccaaggcctgtaggactcctattcggatccctatccaaattaagctcatattggatctccatccaatccccttattccggcacattaagcgtgcgatcctgtaggttcatgtacactcggatgtaacccaaaaactccttttcagtccacgcgtcaacagctgcccctagcaaaacgtattgacccaccgggcatacataaagatcatatcggctgaacctctagtgtatacttgtatgaatccctttgcctcacgatatcgattaagctcaaggctgatatgtgccatcttctaatagctcaatcattcactcgaacctgttgatagattatataacttgtgattgactcctcaatcacctttggcatagccatgcacttccataatctacaacatcaaggggcccagcgatatctctccataggagggacaaatctcatcttgattattcatatcccactacatatttcatagcatactcaaaaactacttttataactacccaattacggagtagcgtttagcaatccctaagtaagctactacatatgttgggaaccatgataatctcaggtctaaggattcaacaccaatactaaatgagatcaccgataacacaacacatatggctcttgcagtgtctcatgttgggtctatccaacaacatgttcaccaacatgtgtccacattattaatttgatatctctatatcatgatccatgagacatgatcatcaattaatacatgtgctgatcatctaaacatatttgttccacatatgatatttgatcagggatcctttagaaatagcaacacataacataaagagtctcatgaaagaatcacatattcattaaccaataatgagttatctatttcaaggaacaaaatcggataaatatgtaaacatagtatgtgatacaatcatctctatgattgcctctagggcatatcactaacagtctcccacttgcactagattcaatcatgaacgtatcttatacccattgccctagtgtatgcctcatgcttaggctgagggagtggcctaagcatacataaacaatgcatggaataaacagttgcacacatctgtattagtgaaatgtgaatctcaaaacttaacagggatgaaccacgtaatcaagaaaacatgaaccgttagattagaaaacatgaatgttagattagataagataaaacaaggagattcaagagccatcagattaaaataaggtggaaaaaaattatactccggtcaatggagggaatggagagaagtccctcaaagcatcgacagcgcatgtcttgagggaaaagaagctaggaaaagcatcgacaccgcaggtcctggagggaaaagaagctaggaaaaaaaagaagatggaagtcgtagcactcgtaggtactgcaatcctaccagcgcaatttaatacagattaacaaatttaatacaggtgtcttcacaattactactagctcagctaatcggctatcctatatacctatacaaatcatccctactactaggaattctctgcatcctcatgcttccacgtcaccccgttttctcctagccattggatctcgatcaagcgcttctcccggttgatctgttggcaatccatcggatcaaatatcaatggttcagatgtgcagtccctctgttttcttttgctggccaacaagcccaactttacacaccatcaagcccaatccacactccttggcccaatttccaccgcatcttcccacactccatccacaccaccattcccgttcccctcctgcgtccgagcggtcgcttctccccgcgccgccagaaactgcgaccgcggcaccggcgcctcaccttccagatcctgcgtagcgtcgtggttccccgccagctcttggactgctcgcctccaaacggaaaccaccgttcacatcgagcaaactttatggctgtcatcaagatagttgttgtctcctcaacttcaagaaactatcttcttccacatcttgctcggtcgagtcctcacacgctgcccgattcacttcctactgcatcgaaaaccatagttccgttcattttccctgcctttaaagtttcagccacctcctcaccttcaagaaacctcaggggtatatattcctctaccaaaggtatgcttcttcctctttttcttgaaccataaccatatatgttcattcaatttattggcctacatttctcctttgagtcacactcgattgatttgttcatgttatatatcagattatcaacggattaaggacatacgagtattgatttggtttcagctcttcttcagatttccactgtcccaatatttatttggattcgtctcttcttcagatttgtactgtccctattcaataggattgaaatttatttggatttgtcacttcatatttctactgtccctattcaacacgactgacatttatttggatttgtctcttcttcagatttatactgtccctattcaacaacattgaaatttatttagtatgtacaatttgttaaaggtgccaattcatgatcatggtattatatgacgactctaaagatcatatatatgcatataccggttttatgtattgctgcaccttaatttgttttatttctgaatactacggttgcagatcattgctattagtagattatatactgtcgttgtagtagcagctctgggctaccgctgaggtcagtcgccatggccatccaaagcagcagttgcagcatatatttcctccgatatgaatcctctattaagaaaaatatcaacaatacaatcggtaatgtttaattttctcatcttcattcatggtcatgttttccaaatattatattatgcccacccgacgttacttgctttgcaatttcttccataagaacaaatgaacaatatcatattttctgcagactatcagggactgagttcagcaatgaacttaatttaggtaaatattggtccttggaagttttcattttttttagatgaagggcaacgccctctgcatcctatggtggatgcaccttgcatctgtccatgctaaccttctttgctatatgatgttcttacttaacatctttcccttctttcttagtagaatataaaggatgttctttgtaatagtacacaatttaacattttgtcaaacaataagggattcagcatgtatgtttctatcgacacaatctctctgccctaatgattagtatcatcaagaaagaaaaataagagagtttctgatgctttgtttagatatggtagctatacttttttcaaatatagaaaatgtttaattttttggctttcaatttactttatggtataggatggtaagggattgagcaatgttgatccaatactttatggattttttacattaatcataaaacatagattacctcacatgtagaccattttaattgaagataggtcaataataatcaaaattattttctcttacattgctataactatttgagatatttgtatctcaaacttcacctttgttgggcattccgtttatatttcgtccaacaatatactaaatattgtttgctgaaataaaataaaataatcattttccatggctatctattgcatttgccttgcatctccacatatagtcttatgttcctacctacgaatcccgcagcaacgcgcggggtattttctagttacatatacacgagagtgggttaaatcaaaaccacgatgaaattacatcacacatcagttgatcagtagagtcttctgccaggtattataggaaaaaaatcatctgttttaaaatatagcaacctaggatatatcccatcattcgtagattgctatatatttcatgacagaggtagtatacgaaggaacaaattgaacatatagtatgaagaaaggagacctgcatgcttcctcttactctcttaatattcttttaatatttctctcaaaatattcttttaaaaatgacaatattcttttaaaaacttgaatttgaaagacaataggaaaagaggtatatattatatggaaaaatttatcttactcttaatattcttttaaaaatgatactacctccatttcaggttataagactttctagcatagcccacattcatatagatgttaatgaatctagtcacacatatatatctaagattcattaccatatatatatgaatgtgggcaatgctagaaagtcttataatatgaaatggaggaagtatgatctatttgtaaatttatgttattttgattttcaaaagaatatgaaaagaattatagttaaagagggaaaatgcctaaaagatgttgatgaaagttaaagagtaacagatatcgcacaaatggggactacctcttgcaaagatgtcgtaggtctccaacactaggctagcaatggtatgctgttttgaaaggcccgcgttagttcagttggtttggtgctgagctcccatgacttgagcagtaggcgctatctcggataggatctccgctccaatgttaatagcactaaggtgttatagctcagcacataacacctaagtgattacaagattagcactaaaaaaatatatgtttttataataagtttttagcacagtctaatcttcaaatgtgttttataaagggcaaattttcacatcatacggggtagtctctcttgcaggtggtaggtaggtttgaatcccaccctcttcatcttttatggtagtgcaatacattttaaagtaaattgcacaaaactacaagcattttgaccaaattattatcacaaaactacatatttaacacttaatttataataacactacatatttaatattgaagttatcacaaaactattataaatccctagcatcattgatatgttggaactataaaaatgtagttttttttactaccttggttctaaacctgtagatttatgataattttattaataaatatgtagtttcatgacaacccatattaaatgtgtagttttgtgataattttaattaaattgtagttttacgatagtttgatcataatatctgtagttttataaaagggcaaattttgctaaagggtatcacgactttatgggtttggctgtaggacaccgcacaaactcacttttaggggaaaacactctctaaacctggttagcacaaactcactcacttttgggggaaaaacactctctaaacatggttatttgctgctggacaccgcgcacattaaaatattaatttctggttgaatattagagataaggtgaaaggtcaaaagtaccccttgccccacttgtcatattcttcctctcactcctaatttcccttcttctaatctcacgaccgaccgtggagctccgtggtgaaggcagtgctccaccgcgtcgtgggcgcgctctggcgtggcggcattcggtggagacggcgctcgacggcatctgcgagtagcagctaatcatgaaaagttgttgttcataatactcgtgagacttgctgtgtaatccattattggaaaagaaatactcgtgagactgataagctacatcgagaccttgaagcacaataaatttcaaaagagcatttttaagaacaatactccaacatcatctaagaagggaacactatagcataaactggaaacaagtattgatagcgcagattaggaaatacattttgcttgttataaaatgataatacatgtcaattcatagtattaagaaaataccagtgcagtaaccaagctacccgatatgtcaccgaattattaacacacattttgacaaaaacaactttatgaaaacattttctaggaataacaggtgcaaatagttatagcagcaaaattcaaagtattccactcaatcatcaacacattccttatatagcctttagaccttgttcctcatttggttttagctggcaggttggtataataaatatctgcatgccaaactcatttgactttagctgctagattggtacaataaatatctgcatgccaaaaaataactttagacatataacaaaatatttaaagaaaaaaaagaggatagtgaagactgaagggtaacacgtgactcatccctatcttgtcttattgaacatggaacaaaaaagggggtgaattacttcatttcgtaaatcaactagtagatctcgaagaatatttatataggaccgatataaaaaaatctatgatcatcctacgacagtacatccgcatatatggacttatccagtagaacttgtagctcattttctgttataggttcttcataagataaccgctgatgatatcgctgagtaactatgaatcaagagtcaatgttacaattaggcaagcattgacttaagaaatctagtcagtacattttcgtttgtgaatatgacataactaatagtgcaagattttagctgcagcgaaaaccaaatactgaataacactgagcagaaactagaaacaagtactggtagcgtagattaggaaatacattttgcttgttatgaaacaagtactggtagcgcagattaggaaatacattttgcttgttatgaaatgataatacaactcaattcatagtattaagaaaatatcagtgcaataaccaagctacctaatatgtcaccgaattattaacacacattgacaaaaacaacttcatgaaaacaatttctagtaacaacaggtgcaaatagttatcgtagcaagatccagagcattccactcaatcatcaacaccttccttatatagcctccagacctttcctcatttgcctttagctggaagtttggtacaataaatatctgcatgcaaaaaatctttagacacataacaaaatattaaaagaaaaacaagaggttagtgaatactgaagagtaataactgtgatggtgttacccattcctatctggtcttcttaaacatggaccaaatagctagtagatcttaagaatattcatattgttctctaggaccgatataagaaattggtgatcctcctgcgagacatcagcttatatggacttatacagtagaacttgcagctcattttctgttatccgttgcagctcattttctgttatccggtactttataggataaccgctgatgatatcgttgaggaactatgaattaagagtaaatgttacaattaggcaagcattgattatgaaatgttacaaaagtaatttacatactaggggaattctatattttgaatcgtcgacatttagattaggaccttcacttttgatcttatatatcaagctcttagtgttgccaatcacttgctgaatgttctcagagaattgctcaagctcatgtaacctacatagttttttttttactaaatcaccgggagagcttccccacccgaatttgtcatttcattgaaatggaagagtagaattcatagttttttttactaaatcaccgggagagcttccccacccgaatttgtcatttcattgaaatggaagagtagaattgctcaagctcatgtaacctacatagttttttcttttactaaatcaccgggggagcttccccacctgaatttgtcatttcattgaaatagaagagtgcaaggttcattacattgaattgagagattggggggggtgatttctttctaaatatgaatttgtcatttcattgaaatagaagagtgcaaggttcattacattgaattaagagattataggggggagattttttttttactaaatcaccgggggagcttccccacctaaatttgtcatttcattgaaataaaagagtgcaaggttcattacattgaattgagagattggagggggggagatttctttccaaatatgaatttgtcatttcattgaaatagaagagtgcaaggttcattacattgaattgagagattatagggggggagattttttttttactaaatcatcgggggagcttccccacctaaatttgtcatttcattgaaatagaatagtgcaaggttcattacattgaattgagagattggagggggggagatttctttccaaatatgaatttgtcatttcattgaaatagaagagtgcaaggttcattacattgaattgagatattatagggggggagatttctttccaaatagaagagtgcagggttcattacattgaattgagagattgtagggggggagatttctttctaaatggttgcatacaggaactccatgcctgtaatgacccgcctctcccaagctctcccaggccgggcccgcttacatcggtcatagactgccctcacagaccaacacatgtcttttctacacactttgtcctctctcgggaagaatttcccgatcggccacccatcctgaaattgctcggggccaagcacgcttaaccttagagttctttcgagatcggcttgcggaaaagaagttgcagcttgttgatatgagtattctattaatcctattaagccctgggctggatgtcacaataccccgtcttcaattgatgaaacagatgcacatcctaaattgtcggttgcactcctattttatcctagaaactttttgcaaacgggcataaaaaacaaaggtggctggccgtttttgttccttcattggagatgtcgcaggtgctagtgggaacaatgtttttcttctgtaaatttttctttgtggataggcggtgcttgacaaggagccacacaaacaacttcactttcagtggggctctgcatttccagatagtatctcatagtggagagacaactccaggaggtagctgatgcattgatgataaggtacac

SEQ ID NO: 74281 - DNA, 103444 bp, Oryza sativa
agcgccgcgccggcttcgtggcgcgccccggcgacgtcgtgctcgcgacgctgcccaaggccgggaccacgtggctcaaggccctcgcgttcgccaccatggcgcgcggcttgttcccgccggcgagccccgaccacccgctccgccgcctcaactcgcacgactgcgtgcctaccgtggagagtggcctgttcgcgtgtgggcgggagggtgtgctggacaagctgccgtcgccgaggctcttgaacacgcacctgccactctcgctgctgccttcttcaataaccgacaatgatgattgtaagatcgtatatgtttgcaggtaccttctttttcctactccctccagttttggatttgtttacactgcacaaataatcatcagtgcccgttccaaagacctcaaccaattggtcagcacctatgtccagggtgcataggtgccggatctggaaccggcacctatagttttcaccgaataaaaaaaatcccggccaccgccaccccacacctcaccaccttcaccaccgtagccactgccgttggctttctccatcattggcgctgttgtcggatggagagaagaaggcagcagagaggagaggagatgaaaagctgttgccgttggtgcgtctagaggaggagaaggcccggaggaggatctggaggaggtgaaggctgggaggagaaaacccaccatcacctcgccgctcctcaaggtgacgagaaccacccaacggtgttgagaagcgaagaagacggagaggagcggcatacttgagagagagatagacggagaggggataaggttgtgacttgcagtgcgtcagtggacttttttttaataggtgccattttttaaaagaacaggcgcctatagtgctggttttaaaagaaccggcatctatactagtataggtatcggttcttttaaaaaaacacctatagtattggtatcggttgttttctagaaccaatacctataatataagtatagatgccggtttatctagaaaccaacatatacagtattggtatcggatttttccttgaaccgacacctatagtgtttaaaggtacaggttatatttttttcattgcgcgcagggtggaaaaggggggcataggtgccggttttaaataaatcggcacctatatgccagtccttattagggtttttgcagcaatgttactcttcttcaatttggtaaaattcatagaaaaatatagcaacattttcaacatagaataaatacaatgtctgatgtttctcatatcatgtcattaacttttgttataacatttgaccattcgtgttatttaaaaatttactgtaaatatatgctaaactataagtcaaaccaaaagtttctttgataataaaacaaatcacatcaaaataaataacatgtatataattttttaaataagacaaatagtcaaatatcatgctaaaagtcgacggtattatctattaaaaatatcttatgaaagccacctagaaagatgttgggatgcatgtcattgacaagccaaaaacttgtaccggtccacatgtcaatagcccgcgataaaatattttcgagatggaacattggtatatttcgaaaaaaatatttaacatatatatattagtttctactaaatatttaatatattaaacaagatactataatacaaagcaaaagtttatccctaattacatactacttgtcataccctgggcatatgataaaaaaaagactaactaattagttgctgcataatctctttgcctctagagccaacgtttatggccgacccctgtcggagcacactctagggcccggtcagccggtgccatggcgctagtggtcggcccataccagagtgcgtgcttggggaatggggacgaccgggtcctcatgtgaggactctggctgcaccttctcctccacctctacaggtgcctcctcctcccagctggttgatgccctagacttcacctcatgcgatggccccacgactagtcgattacccatctcatacaaggaagatgaacaagacatgacataggtggacacaggggcggagctacatacagctaggaggtgcctagaaacccggttcaaaaatttttttacttatagtttatctattttcaccatataaatactctattagttcaaagttaggcacccgtattaagctaaatttgattcaaaccagggtaaagcaagcaagaggaaccctcctttattttattttgtgctagctccgaccctaggtgggcgtgggcatttaacggcacaacctgaaaaattgcatgatatgagcagggtattaactgcatcacacatgtaaataaaccaatgttttcataggtagagttataagacagttgcctgaaaaaaacatgttaccttgggagggcgcttaaggtagtcgcccatggtattttgtttacataacggtcgtggacctcccctaccatggtaaacataaagcaggtgattcgtatcttcgtccacctctggaattaaggtaggggacatgcaaaaattattttcctactagtgcgatccaacgttcatgatttttggatgacgtggatcaatgcatgccgtgcttttggttttcactattagaaaagtttaagagttaattgcatctcttgaattaaaatttgttgctgacatgctaatttgcagagatgagaaggacagagcagtctccacatggcacttcatcaagcgtatcaaacgtattggatcagatgtgccattctccgaggtgtacaagtctatctgcgagggcacttctgcctgtgggcctgtctgggatcacatcctcggctactggaacgcaagcaaaaaagagccaagtagggtactcttcctaacatatgaacagatgctccaagatccgatgggcacaattaggcaattagcagagttccttgggcagccgatttctgatgccgaagaagaaacgggtgttgttgcagagatcgtagagctttgcagcctagagagcatgaagaaacaaaagatcaacagggaaggataccagggtgtcggcattacgttctcgaacgatgcctacttcagaaagggagtggcaggagattggctgaaccatatgaccctcgagatgggacaacacctggactcaatccttaacgagaagtttgatgggtcagggttcactatttgatgctttctctatgtttcttgagaggttgtttgaataatctgcttcgggaaaacatctagttttcctataagccacctttagcatgctatgtggtaatgtggaatttctcgtgtggactttcaacaaagaataagcgtataaggagaaccagttctcactgtatggagaattatgtaacactagtcgttgttgacccttgcattgcacgggtatcattatttacattgtagacatatgttaaacctttaaattgaaattgcaggagtggctgaaaagttagttgaaattttaaagatggtattttgactaatttgtatggctgtggcatcgcccatgtccctcgtgcgccattgccaccgctctcggaggcaaggcataatgcatgtcatgccctgaagttttcctttttctggtcttaattcatttaataaatcgctaaaagaaattgtttaagtttaaccttgagctaaccctaattaataattttatttaataaatggaaatagcttggtgggatttttcttgagttccctatgctttaatacaccaattgaatttttagtggaattttttggcaagaagacaatcacgattaggatacctaaagccttgcggtggtatggagtcgctaaccaccccaacctagcaaaaaaactagatcaagatgggtttcgatatattaaccggccagcggagtcgatttagatggaactaaagatgaatacatgtttcatgggcgaatagaaggtctatgggacaaacctgcaaagatatttcgcactctcacagcgaatgcggacgattcataacgcaaatagataaagatggacaaaactaagctaaactaggcgaaaagtagatgcaatatcgaaaaaaatgattcaattggctatattgtgttgaaagtagattgcttccaatagaaccggccttggcccttatatagaggttggtcggatcaagcctcacccgttacatcgtatggtaaagcctagtctgaaattttgtgattttcacaaaaagtagagggcttttatataagtactaagaatggggcacatctcacgttccaatgagattacatctcttgaaaagttaattactatccaactccctccattaaaaaaataaggtccaactatatttttaaatttttttataatataagacgtgcatacatgagtgtaattaactagcacctcttctttactaaggccccctttgatttaaaggaaattcataggaattttagaggattttattcctgtaggaatttttcctatatagccctgtgaatcaagggaatggatcttatggaattctatgaaattcgtatagaatgcataataccatgcaaattttggaggaattctaacataaggtagaaccttgtggaaactttcctttcagtttttatctctcctctaattcctgcgttttacccgtggtccaatcaaatggttatttctatgttttgcaatcctctattttacacttacatttctatcaaaatcctacatttttcctattcctatgttttctcaattttacgattcaagggggcccttaaaattattatttacttcactttcaaaatctctaattatattggttgcatgcattgtatcttttaaggtgttccaaatgaggaggtgttccaaatgaggaggcgataattgttgttcttttatttgggttaaaggtggttgtggcttatattttggattagaaggagtattgtataagttgtgacaaatctctaattttattttttctcataagagcggcgtgggtggagggaaggggcggtgctggaggagggcgtcggcggcggcacggccggaggggaggtgcggcttccctccctctccctcagatctactctccctccgctgctggccgcgacgacaacgccgatgacgacgccgcttggatccggggaggggaggggaggcagcagcgagaggagctgaggcggcagcggcgacggcgtggctcccctccctctcctctccctccgcggccagccgcaatgacattcgctgcgacgacgacgatgacaatgactccacctagatctgggaaggggaggggagctttggcggtggcgcgcggccagaggggaggtgcggctccccctccctctcctctcccgcagctctactccttcgtgcccggccgtgacaacgacgactaccgcgactacgacgataacaacaacgacgacgccgccgttgccgcctggatcctgggaggggaggggaggctggcggcgccgccgacgggttagggtggtggcggcggatttttttttattcgctaaaaatattttcgcaggagggtggttctactgcctgcgaaaatagatgcagcctgcaaaaatggttttcgctgggccgcctgtgaaaatcatctattttcacatgcctttgcgtgtaggtggtcctttttccgtttggaaaagcgattttctagcggtgtgtgtttcagtgttttaaaagattgaaacattttcgatttagttggtgaaacattttttttaattagtgaaacagcacgctatttttgacaaactaatcggtgcccgatttataggtgctccgaaaaggaccggcccttaggagaaatacagttgtacaacttctgatcttccgacgaacatacaggcacgtacgcacgcaggccagccggtggcgacacgtcgccgtggtcatcatcggccggccggagcggtatgtaaaacaaaagcggcgcgccggcgatcgctagctcacggcatggcggcggcagggacgaagggaagcaggcccttgtcctggaggctgacgacggtgtcgtacaggcactggctcgccggcatgacggcgacaccgagctccgccagcttgcggctgctgaaccggcacccctcggccgtctcgccggcgtcgcccttgcacctggtgggcaccgggtaccccgggaagagggcggccaggatgcggcacacctcgccgcggtgcagcgtgcggccggcgcagaggtagcggccgcgcgcggcgggggactcgtaggcgcgcgcgtgcgcgtccgcgacgtcgcggacgtgcacgtacgcctgcgccgcgtcggcgtaggtgcgcgccgagccgtccaggtacttgagcacgtgccacgtgctggcgttcaccccgcgctgcagcagcgggccgagcaccagcgacgggttgacgacgacgaggtccagccgccgctccttggcgagctcccacgccgcctgctccgccaccgtcttggcgtagcagtaccagtttccggtgtccctgcagtggtcgaggtcgctccagcacgtctcgtccacctcctcgccgccgccgccgcccatgtacacggcgccgatcgacgacgtcatcaccacgcggcggacgccgcccgcgtccgccgccgcggtgatcacgttcctcgccccgctcaccgccggctcgatcatcttctcctgcgagcatatgcattccggtcagtctctcttagactgtcgaacacgtacggcgacgtcgtctcgtcgtcgccggcggccggctggtgcaggtgatgagtcacgtaccgggtcgtcggtgatgggggaggcggtgtggaagacgccctcgcagccggcgaacgcggcggcgaggctctccttgtcgagcagctccgcccggacgagggtcagccgctccgcggcaccggccagcgccatgagatgcgcgttcttggcagcgtcatctgcagcaattaattagaagtaattcattagttaatgagttagctaaagaaactagaattaattagctagcgctgactaatcacatcattagtgattaattttgctaccctttctgttgctaccagggttctcgatcgagcgcggtgtgtcagccagccatatgggccggccgtgttcttcgctaattacttaattataagattaatcgatcgagggtcaaacggttgagatatattaatatcgggatttgcaaaattaggagattgtgatagttgatcgttgcctctttatttctcagcatccccgatatattgctgcaacggcatgtgtatgtacgctgttttgctcataagatctggagtatgtttttttatcatgtgtttcaacatgaaggtcctgttcgacatatcctgatctaagattttcagagttggatatttataactctacaaatccaaatacataattatattggtaacatttgaataaattattttaatctcattttaaataaaatataatttttaaaccactatgatttaacataaaaaaattaaacccagctagcgtggatctggaacaccaaacaaactgcaaaaatacttttatataatacacacataattacgtattaatctacatggatttcttaaaaactaccgataacaatatatatacataccagggttccgaacggtgccgcggacggcgtagcccttctcgaggaggagcttgacgagccacgacgcgatgaacccgccggcgccggtgacgcagacggtgcgccctccgccggagaccgccgcggcgccactgccgccgttcgccgtcgtcttctcgacacccatgctagctagaacctagtgttaattataatttgctaggaagaagagaaagctagagcttattagcgctgcaaattaagctactaactatatactatatgtctctctttgcaacaagttcagtgtgtgctgaagtagtgaagtgatcgaaacaaacgatgagagagggggtataaatagtgctggccgggggtatatggcggatgcacgcgtgatggccgcccgggggtttggtgtggccacatgcgtgtcacgttgtggcgtcttcttggggttaacatggcgcagatagcgtgtatctatgagagaatctcttcttcgctaatattctatgctggttttccttgtactatttgtttttgttttgaccataacttgggaatcatctgttaactggaaacttcgttttagggtgtgcattcctcgtttatgtcctgccttacttctcgaagaggaaaggcgtgtttaatttgctgttcaggggaatctgcagtttttagttttcctaaaaggaggcattgaaagttgttcagcttctggataacaactcgcaagtcgcctgtacttttacatggacggtgcataagtgtaattttgtaaacattctttatttgatgtagtgtataataagaagaagtattttaaatggagaaatgaaaacttttagttctatcatgatattagagtctctcggccacagtgccgtctctcttcgtgtgacactggtgattggcacatgagctgtctctctttctctccctagaccccgatccccgcttcccactcgcacattctctctctctcttcacgcgccaatgtcatcatggctattcactcactctctcagaaagatgagaacttcttgcgagatgcgtagaggtgagatccgcgtgcaacaacttctctggcactcgtaatgttggtgtcggtggtggcgctagctatagggtgggccgttgggctcacaacacatgccatgacaagagcgacatgcagctacgcggtgaggtgatgttacagccgtgttaggccctacaccatggatgggatgcgatagacctcttgctcaccctcaccgttggtgcacttctctcccctatactaagaagctggcgagatctcctactgtagcccatgagataaggctgttggggaggatagagccgtggaggatgtcattgaacccattggtcctaagatggaggagggcagatgagggctcatgtcactttgtcatccctctctcaccctgatggctcgtccccacttcattagagctagatttgggctcccaaggcttgctcgtgacccagggcagtggcttgtgggagggcgaagatggcggcagtttgcggcgggcaaaaatgcattttttcttccaaattcttttctcttccttttttgaaacttgcacgatgttgtttggatttttcttttcattttactctcaagtaattccgtacttttctttgattgaagaacaagaagaaattgaaaggggatttatcttcagattacaatgggacatatagttgggaagcatctagaatttaacttattattttctggatttcatttatatttttatccccttatttgattttatcaggtaatgctacaggtgtcttcaaccttttttatcattagtttagctttaatattgttttgtttactcctaggtcacttggatcaaaccaaatttgaaggctctatatttctctagattttaattttttattcttttccatgagcttgaagtattttgagtgatgactcctaaaagcaacacgcgtcaacaatttatatattgagcatccctataaaccaattcaacttgcagcaatcctgccagctttagatggtataagataccctacattctcccacaggcgtattatgtttcagccatgtgtgaacggcgtccatgataatttcaacctgtgtacgtacacgggatttgccacacattttccacgaacacttgcaaggccaatgcaagtggactaaattcaaagaccaagcaacaatgtgaactgaatctcatgcatcaaattagaacattaattgtggccggcgacgatcgagtcaaacataaggcacgtatataattaatatgtacggagtattaggtatcaaatgaacgtctcttttttttaaaaaaaaaattagtactcctcgcagctaattaataaggccccagagattattaatcttaatattctaatcgtcttcacacatgcaccttccctaacatgcactgttactctgcattgatgatatccatgtgaatattaagatcactgcattgaggaataggacgacgtgagagaatagattaattaataagattccgagttcaatctatttgttaaatttgcagattaattaattttaagtggtttcacatcagatgacctgagtcatgtatgaatatcgatcgtatgtcatgcaagcggtagttgcatttgcagctaattaatagcctaatagcactactaaaaaccctagtcactcagaaccggcacatattagcctttcccatcccccgacctctaggcggctttaaaacccgcatatatgatgcagtactgatttattgaaaaaacgataccaataataataatataggtgtcaattttttttaaaaaatgtgacactgatatgtaataaaaccaaagtgtagtagttttgaaaaaacaacacttttaggatggagccaaaccgaggccgagcatgtagtgggaaaaatagaaaaagaaagccactaaggtctgatttagttccccaatttttttcccaaaaacgttacatcgaatctttgacacatgtatggagcattaaatatagataaaaataaaaactaattgcacagtttgcatggaaaatcgcgagacaaatcttttgagccaaattagtccatgattagccataagtgctacaataatccacttgtgctaatgacggcttaattaggctcaaaagattcatctcgtggttttcaggcgagttatgaaattagttttttcattcatgtccgaaaaccccttccaacatccggtcaaacatcggatgtgatacctaaaaattttcttttcgcgaactaaacacatcctaataagtcccccgtccattgtttcctccgcttcttatcctttcccaatctctctcatcttccatctccccctccggtcccaatctctcgtcaccttttcctatcttcccacccacacctggttagtggcacaacaaggcctttcttctccctgccatgacggccatcagatccagccgatgggatgagcagaaggagtctcctaggctgctccacttcttcctcttcactgtcgttgttccgcctctattacttcccccacgtgtgcaatgttgatgagatctgctcaggagggaccgagggagggaaaggtggaagagcatggagatacggtcaccacgtgcttggggctctagaacagcaaggtcaggttgctccatgcactaatacaaaagacattttctcaaacggtcaaaatcaatttttccacgccgttgagccagccgtttgcatcaaaaggtctttaaaattagcgatttttccatgcgggtgtttatgcggaccgcatgcaaagataaaaaatcacaaaaaaaaaacaaaccctagcgcccccctctcccgccatcactcgctcattcgtctgcatcggccaagcccaccgttgctgctcccgccatcgccggcgccagatccgctgccgcagcgcctccctctctagatctgccgacgcaatggggagcggagcagccaccggatccggccgcccttgtgttgatagaaaacacgaggcctgggagatctgcttaactccagtgcaggtccaaaactcgtctttggatgtatgagcgtgtcagttgatttgatcctgcaatcaacaagaaacaaagacaaagaaaccgtgattaaattcataaatgatagccgatcggctagatgccgatgacatatcatttatctttgagccgatgtcatgtgtaaatcgatcggcaattgtttaagtaaacaaatcagaactaaatctactcgatcggctgtagatatcaatgatatataatccttatatcgatatatacttgaatcaagtgattgggatagatcgatcaccttgccgagacagtataaatcacctagatcgaaatatatattaataatgagattatatatatattcatagcatagccgatcagatagatctagcgtgtatcggctaatactgcgatactactttatattaagatattaaagcaaatagaatatactaaacagaaatctaatatacttaaatgcaacaagatcttaacataaagggcagatctaacatgttaattgagcatgtagaacaaaagcaattggatcagataagatcggctgaaactccgatactaccctaatcggcaaccagtaggtaggctagagattgaaattctaagcacgacttaatagatcaaactcaactgatacagcattaagtataaaaagaagaacaatatctagacaatcaagccgctggatgtttcatagagtggtggatatctcatataatctaagccaacgtcgttatttaacctaatcggctgccttctggtagcagatgttagccgattgtaggttaaatgacgatattgtcaaggattatgcaagatatatgataacttgacagattacataaacaagattagagtatcataaagatggaagcgctaatctcgagaacacaagccgccataacaagttttacctcttgttgaagatcgaaactgatgcagctcaacccgaaagcaataactcatcgaaataaaacgaaagcaaaaagggtggcgatgcgccgaaattgtattgaacgtgtgtatgtttttattacatagggctcggggtctatttatacccgagaaatacaagatatgtccatattggacacgactcttatctctaacaaactctaagataccataagtctttgcggcagacttttgcccacattttatctctaaggaatttacataaaatatcctaattaatagatacaattgccttcccaggactctatccatgcgtgacaatcatcttgaagcacatcaactcgaacccaatgttgcacacgggtcgtattgtcggaatcggctgtatcacttaaccagtccaactcagacttagccgatcccagtcgtagccgatccggactccagccgattcttactctgtttccgaaaaaacccttatcttcgattccgcttcgatttcatcttcatctccgatgctgatattaccaaatttggtcgtaacacatgccccccaagtccgggatatttggtaatgttccggatttaccgtgtatagactccgagcaagtttcgcactctgccgttttcccgattgttactctagtgcttcaaatactaaccgttatccctgagaaatctcacaccgtgacttccgttttccccgcttaagcgaaactttaccctctctctctccggcgattcctccgacgcgcaaggcgatccccaggcgacttcatctccggccagatctccgcctgcgacgatgtcgacctccgccagcccatctgccgcaccatcagccgaatacgctgaggtaagttaccatcggctagatcccctttttcatcattggatcggttttctctcgcctcatactgctttcttttctcggttactctgaacttgtagcatctctccaatttagtcgcaattccaagcttgtcgcatgaaaaccactactttctcggcccaatcggcaaccccgaccccactgagttcatcatcggtgagaccaataggattccttttagactgtccaatccagatctaggtcattggaagaacacctttaaatcttggccgtctctagaaaaaacatcacccgagaaaagttggattacatggttcaagcgcatgtcggctagcaaaagagttcactgggatgaaatcggaatcggccaagcacttgacctaaccatagcaaactcagccaaggatgaacctctaatggcagctgcctcttacttctggtccaacaccatcaacgccttcttattcaaccaaggaccgatgaccctaactctcatagacatcattatgatcatgggtctggatgtcacctcaacggctaaccccatgaatctgaacatgaagaaccaatacgacttcaaaaccaagagtatacgaggttggttaggctatgtagcagcatacatgagccagggttctgtcaccctcgagaacatgtggcctttttgctaatgtggctagaaaaattcctcttttatggatcaagctgtggccctacaaccaactggcagttcatagccgaagccttggaagcaaagaaacaatttcctttaggcaaaatcctcctcggctacttgtaccaaatgctgaataatgcttcggctaagttagctgtcggctcagtagttggagcaggtggaccatggtggctgctgcagacttggttgaatctaatagtcatgaaagtcgttaatcggccatccgtcacagaagctgaatttccgagattagagccgattatagaagatgacgaagaacgcactcatcgccgatgtatgtcatatagagtatacgcatccacaccggccgatgctggagcaaagttatcagccgatctgctcaaagattggttctgcagtttctatgaaggctttcaaaaagatgctcgagtttggtttccctatgaagattcagcagacctcgagctcccatcagatttcagattcaaagacattaatcatgaaagattccaaacatccagagaagtcttcatagctgcaatcagtccatgcattcttccagtcggcatccatcaaggaagaaacatccaagcctcttatgaattctatcacccaatgagttcagctagacagcttggaatgggccaactcccaatcggcttattctttgctgacaagatccaatgccgaggagaaatttcatcaaccttgatgatggatcggctgctcagccttccaggaccccctctgggcagcattgaaaacatagagctagcaatgttcaggagcaaaaactttgatagatggtggggtgaatggaagttgcatctattctaccaactagcttcaatgtacatgacaaacctctttccagatgttgtccctcaggtaagtctttgactttacttgatttcatttgaataactgcttagccgatttaccttaactaatctcttctttgatttgtagacaacagaatcctcccctcctcgtcaaagcaacagtggcagggacatcacctacaccccaggcttaattcctaatggaggtgggccatctcctcctgtcatcggctatgatgcccccaagacttcagctcttcttcaagagctcatcagagaaccagccgatgccggcaagaaaaggaaaaccagatcatcagctgtagatacttcagccctggctccaaagaagaagatcaaaaagaaagctaaaccagctgatgatctgcctgccctagatccatccattgaacaagctctggataaagaagaaatcggagaagatgttgatcaagccgcagccgaagtaagcgatactgaaagaacaccatcggcttcacctaagcagacccctccaactccttctgctccaactccttttacaagagtaagcaaccttctctaaccacttttgtaatcatcttactttatagccgattgctcacatacctggtaattgcagaaaaggaaggctgctgtgaagaagaaatcggctccaatggcatctaaaccagctccaccggtacaatagccttaattctttcattagttaatctcagccgattttatataacacttgtctattttcagcctccttcctctccttctcctcctattcaacaatcatcaagcgatcggaccccatcggctgtagggagtcattacatagaagaagaagttcaactaactgctccgactatcccagtaaatttcttataaccaacatatgcagatcggttatgcctatttgatctctaactctctttaaatcatcactgcaggtcttagccgatcttttctcttttgatatcagagattatcttgatgaagagacagaggttgacactactagcaaagctctagctcctttctctgatgacgtaaagaaaactcttgaagacatctctcatcagctagagacatcgtcactagacagcctagtagtcgactgtggatcaattaggactcatcttcatgaggtccaaactcaaatcctagatgagttagccgatatccttactccagctgtttatcttgaacaacatcaatttaagctggaaaaggccaagctgagattagccgaacatcgagagcgcaaagacattgaagcaacaatccaggctaatcggcaacttgttcatgaagaaaaagccaaactcgatcaattatctgaagtcccgatcaaatccaatattgaccggcttgaagctcgcaagattgaactcttagcataacttcaagaatgcaatgccaaactggatttagagcacaagaagttagccgatctcccacaatctatcgaagaacaaagagcaaagttaaaatcggctatcaagaatgttgctgatatgaccaaatctctgaaggtcattcctggaaccgatgctcaagatgcccaagccatagaagaagtacaacaaattaggcagagagctatatcggctatccagcaatacttatctcaattttgccgattaatatgacatataagctttgctcaaaaatttttgcaaaaaatttttttgcactgtattgtcttctgtattgtgatagacatatatgcccccccagttttacaatgtcaagaacattgataaaaatatgaaacaactaagggcaatataacaatatcggccattgtacatcggcaactctcaaccgattacaacaaaacaactaagggcgatataacaatatcggccatctcaaggcgatgcaaacgcaccggctatcatgtatcagcaatattagccgatcatgcatcaacccaaacacttgggtaatatttcttcaaatacttgccattaagcgctcgcccaaaaacttctccatcgagtccttgcaacaggtatgctcctttagacacaaccttatggatttggaacggcccttcccaatttggtgaccacttgctgaatttgcaatcccgagttccaatcggcaaaaccaatttccacacaagctcaccgtccgaaaaagtcttaggtaccactttcttattataatgccgagcaacacgttccttatccctagtaactcttgcaagtgctcataattgcgactgaaccaagtcctccggttcatcggccataagattatagtactcttcggctgtcaaatcattttgcaactctgttcttcttgagccgatttgaacttcccatggtaaaacagtttcatgtccataaacaagcttataaggaggaacttggattgatccatgacaagccatccgataagaccacaatgcttcggctaaacgggtatgccactgctgaggataatcagaaattttccttttaatcaacctgatcaaacttttgttagatgcctcggcttgcccattagcttgtgcataatacggtgaaaaattcaataatttgatacccatactatcggcaaactgaacaaactcataagacacaaagattgaaccttgatcagttgtaatagtctgaggaataccaaatcggtagattatatgttcttggacaaactgtattgcatctccagaatcagccttcttcaaaggaatcgcctctacccatttggtgaaataatcagttgccactaatataaacatatgccctttactcgatggtggattaatcatgccgattatatcaatgccccatcctctgaatggccatggtttaatgataggattcatagccgacgctggcactctctgaattgcaccaaatttctgacaatcttgacagcccctataatatctgaaacaatcttctaacatcgttggccaaaaataccccgtacgccaaagtaaccacttcatcttatgagccgattgatgagtaccacaaattccctcatgaacttcgccgattgcaactttagcttgatcagcgctcaaacacttaagcaatactccatcaatcgttcgataataaagctcatcattcaataaaacatatttcaacgccttatatcttaacttcctagaagccgactgagatggatttcgtaaatattgatgcacatcatatctctaatcatcggccgttatggcagcaacttcaatctgaacatctttgatcatcggcttatatcctgatgccccttgagctagatcattggcctcaatattctgctctcgagatacatgcttcaaagtcactagccgaaacttcttcatcagttcttggcacttctcattataaactatcaacgtatcattcttgcactcatattctcctgccaactgactgataaccaacaaagaatctcccatgatttcaatagcatcggcttcgacctccttgagcaattgcaaccctttaagaactgcttcatactcagcttgattcgtcgcataaggtttaatactataagcaaactcaaagcatgccccccgaggcgaaattataactaagccgataccacaaccatgagcacaaaccgatccatcaaaaaataaagtctagggcacaatctcaactgagccgatcgaatcatcatgatagtcaactatgaaatcggctatagcttgccctttgactgccttcggcgactcataccgaagattgaattcagttaaagaaaatatccattttccaacccttcctttcaaaattggagccgacaacatgtacttaacaacatcggtcttacatatgatagtgcattcattggacaacaggtaatgccttaaccttgtacatgaaaaatataggcacaaacataaattttccacagaagaatacctagtctctgcatccaagagcctacgacttaaataaaacacaactctttcttttccttcaagctcttgaatcaaaaccgagccgattgacttctcaccggccgacaaatataaccgaaaaggtactcctttctgtggagaaatcaaaactggaggagaactcaaatattccttaatattatccaaagctttttgctgctctgccccccaagtaaactgctgatcggcctttaattgtaataatcgcgtaaaaggctttaatcttccagataaattagaaataaaccttctaacgaaattaatcttgccgatcatctcttgcaattctgttttatcctccggaggcttaatcttcttgatcgcactgatacttctttgggtaatctcaattcccctctcatgaacaagaaatcccaagaactgaccagccgacacaccaaaagcacattttgtcggattcatcttcaagccatacttcctggttctctcaaaaaccttcctcaaatcggctatgtggtcctctatctctttagacttaacaaccacatcatcaatgtagacctcaaccaaccagccgattaaatcatggtatatataattcatagctctttgatacattgctccagcacttttcaagccgaaagtcattacaacccactcaaacaatccgattgcaccgggacacctaaaagctgtcttatgaatgtcttcttcagtcataaaaatttgattgtatccagcatttccatccataaaactcaaaatcttatgccctgatgcagcatcaaccagttgatcgactactggcattggatattcgtcctttggggtagctttattcaaatctctaaaatcaatgcataccctaaccttgccgtttttcttggtaacaggaactatactagaaatccactaagcatatcggcaaggacgaataaaaccagcatcatataagcgttgaatctcagccttaacaggttcaagcatatcggctttgcatcttctcggcggttgctgatgtggtctaaccccgggtttgataggtagccgatgttcaacaatcgatcggctgagtcctggcatttcataatattcccaagcaaagcaatctctaaattcttttaagagctctatcaacttagttctgaattctacacataaatttttactaataaatgtcggtcttggccgatcgcctggacctatatcaatttcctccagatcatcggccgacataaaaccttgaccttgtttgtcatcaagatcatctactgtatccttggtgtagacgttcgaaccctctacgacgccctcaaaataatagcttgggttctccatcttcaattggctgtatatcagaatcatatacttttaaaaaatctccatcccagacctttccagataaaaaatcaaggccatccatctcccaaagagctaaattagcactagcaacattgactgacttgtcagccggcacgatctctaccttgtcgccttgccattgaatcaagcattggtgcatggttgaaggaatacaacaattagcatgaatccaatcccttccaagcaacaagctataagaacccttcccatcgatgacaaagaatgttatagggattgttttactgccgactgtcagctccacgttcaaaacccctttggtttctgatggattgccaccaaagtctttaagcaccatgttcgttttaatgaggtcttcagcgttcctacccaatttcctgaacgtagcataaggcatcaagtttactgcagccccaccatcgataatcatcttagacatcggcttcccattgacataaccgtttatatacaatggtttaagatgccgattctctgtcccctcaggctttttgaacattgctcgctccggtgacaaaaccaacttagccgattcctcttctacctcgtctacatcggcctgatcaatcccgaattcggctggcaatgtaaagaccatgttaattggtgccgttacaatactcttcccttttgccaacctttttgcctcttcggctacaacatcatcggctataggaacctgattcttaacacgtcattcctgtcttggctttgctttctttagccgatagttaatttcctgttcaacctcttgaagacgctccctgttcctcaacctttgaacccttctcttctgattcttcgtgaaaataccagaaggacaccattgatttgtcctaactatctcatcctcctgaccatgaccttgattcactgggcccaatctttgatgaacagacactctttcctgcctcagccgattactcctattatatgaccggcttgagctcccaatgatatcactacacccagggcagttttcaatggacggtaacctcatcccttcattccagcagaatctaaagaactcacaaccccaatgaggatcaaaaccatcatcgtgttcttcataatgcttctcctgctgcttgtcatacttcctctgatatttgttgattatcttagccgaactcacttgaaaaccctttgcacagaccctatcggctgattggccagctgtatgtaccatattaatagaaaaaggattaccatcgaccttcattggtttcttcgaatcatcaaacttgatttttcctccctcaatagccgtttggatttgctgcctgaagaccttgcagtcattagtcgtatgagacccagaattatgccacttacaatacttcttcttgcccaactcttcagccgatggaactttcctcttttcctgaggtctttacccattggcatggtataacctttttgctcctgacccactcggctgccgctatttcggaatcatcatcctcatcatccgatcttctgtgtaagatgtgacaagctttcgaaatcttcagatgagaatttttccctgatcggagcaatcatcccttgaaacgccaaatcggctaactgggcatcagtcaaattcaagctgtaacatttattcctcatttccctgaacctttgaatatactcatgcaccggctcatcatgcttttgcttgattgacgtgagatcagacagcttcatcacgtgaatcccactatagaaataactatgaaactgcttctctaaatcggcgcaactgttaatcaacccatgtggcagagaagaaaaccaagtaaaagccgacccagctaatgacaaccggagtaacctaaccctcaaagcatctactgtcgatgcctcaccacactgagctaagaatcggctgatgtgttcataagtcgatgtagtatcctgtcctaagaactttgagaagtctagtactttaaaccggttaggtaaaggaactctttcaaaccattcaggataaggttgtcggtacaaattcccagtctcatttggtttaagcccaaattgctccctcattacatcagctatcacatcggcccatggtcgctgctgaggtgatccttgaggttgttgtggtgtaggctcaaactggttgtagaactaaggctgaaccgatcctgcctgttggtactgaacttggggtgatggaggctgatattgataactcaaattgccccctggtaattatgaaggttcggccgaataccacgcgccaaatgctcaggaataacttgaggcaccaccgaaccatccggttgcacatgatgaaccaagtgttccgggaccacctgatttgcagggtactgcacaggctgaccaccaggcattgcaaacctagccgacgcattcattggggcttgttgctgaatcggctgaacgacctgctgtctcaacggtgtctactgaattggctgtaaagccggttgccttggtggcgtctgctgaactggttgcacggcctgctgaattggggatgcttgttgaataggctacacaacctgttgcctggacggtttttgttgaatcggctgctgctgagccgaattaatagcattttgaggaggtagaaacatagatgcaacctggtcttgtgttaactgagtcacattcggtccaggatgctgtgattgctctcttaccaataattggggattgattaattgacctggagccgatgacggtgctgcaggtgctggagccgatgctggtaccgtcgattgagctggaggagttccccgggtaagtggatgaacatcggtaatcaaagtccgataatttggaaaagtacccccttgcaaatagactgggcctgcagcctgatgttcagctattgaaccatcggctaccgatttcatcatatttgacaaagtattagttaatactccagattgattgatcaaagcaatatacacagcatagtcgacccgatcttgaaagttattgaaaaaatcttggaatgcattgtcattctgattaagattccccccttgcaatccctgagtgccgtcaccttgaactccatgtactccatgagagtagtcaccctggctctcctgagtcgacccatctgtaacacttttgtcactcggctgggctgatccatctggaacttgtttcttttctccctctttagacgaaccgatcccaagatcctcaggaaccaccttcaccttgtacttctgaacaaatgtgtcgttgcgagtttgcatgaacgagcttaaaaattgatcccgtgcttgctgcatcattgcattgaagtctttcttctgttcgggagtgagcttctctggatcaatgggcacaacgtttccttcatggacgtcagtcaaaccgaacttctgagtcttttccttaactttacccgggctgcccgacgacggagacagtggtggtttctcagccatgaaggaggctgccttctgacttctaatcggtcccaccaggcgtgccaaaagcatgttgatagaaaacatgaggcctgggagatctgcttaactccagtgcaggtccaaaactcgcctttggatgtatgagcgtgccagttgatttgatcctgcaaacaacaagaaacaaagacagagaaaccatgattaaattcataaatgatagccgatcggctagatgacgatgacatatcatttatctttgagccgatgtcatgtgtaaatcgatcggcaattgttaagtaaacaaatcagaactaaatctactcaatcggctgtagatatcaatgatatataatccttatatcgatatatacttgaatcaagtgattgggatagatcggtcaccttgccgagacagtataaatcacctagatcgaaatatatattaataatgagattatatatatatattcatagcatagccgatcagatagatgtagcgtgtatcggctaatactgcgatactactttatattaagatattaaagcaaatagaatatactaaacaaaaatctaatatacttaaatgcaacaagatcttaacaagatggaagcgctaatctcgagaacacaagccgccataacaagttttacctcttgttgaagatcgaagccgatgcagctcaacctgaaagcaataactcgtcgagataaaatgaaagcaaaaagggtggcgatgcgccgaaattgtattgaacgtgtgtatgtttttattacatagggctcggggtctatttatacccgagaaatacaagatatgtccatattggacacgactcttatctctaacaaactctaagataccataagtctttgcggcagacttttgcccacattttatctctaaggaatttagataaaatatcctaattaatggatacaattgccttctcaggactctatccatgcgtggcaatcatcttgaagcacatcaactcgaacccaatgtcacacacgggtcgtattgtcggaatcggctgtatcacttaaccagtccaactcagacttagccgatcccagtcgtagccgatccaaactccagccgattcttactctgtttccgaaaatacccttatcttctattccgctttgatttcatcttcatctccgatgctgatattaccaaatttggttgttaacaccttgccactcaccgtcgcagacgacgcagctgcacccgagatggatctggtcgtcccgaggatggcaccgccggatctaccgcccttgtcgtgcgcccaccgcgacacccaagggacacctcctcgtcggcggcgccacctgtcatcagaggagaggagatgagagagagaggagaggagagaaacagagaaaggagagaaaaatatagagggagagaaagaaggttgaaaaaaattaaagtggtgagggaaagagagaggaggggataaaaaatgaggagttatttttgcatgcaaatcacataagaggagctatccattatctcttaactttacgattcaataacatgcatgtctagattaatctaggataaaagtactgcgaatttggataccatgtctaaatatgtagtcttagaacatatggtgtgtcagggttacggataaggtataccctctacccttagatatacgtcatgtatcgatatggtatatctgcgtgtatacggacgttctctgtacacgctaaggaaattcatcacggagtccatagatgggaggattcctactcggatagaactgggtcatcactgtattatgtagggtccgatgtctccaagtcctacttggaggccaactgacctgcggtataaaagggaccccccgggaggacccaaggcatcgaatcgtaccgccaacacatcgaccacagcctacatgagccaaatcgcctggtgatctagtcgaaccaactcgactatgatctcgtcggtatcatcgagttccactattccctttgtaatatgtgatttatgtcatataatctcatatcaactagattagggctattacctaccaaggggcctgaaccagtataatccctgtttttgttgcttgatatcgtattacgtagatcctcgtaccagcgtaccccaataccctctatatccggtctacgggtatcccccgttgacagtggcgcgccaggtaggggcctttggtgctcaaggttctactactatgtcatcaagcttcgtcgacaacagcgtcaaccctggcttcaaccaaggagtttctacttcaacaatgctggtgtggactcaagtcggtgaaatcgtcttcccggtttacacctcggtgccgatctcgactggtccatcaatggccggaagtgagaacgccgtggttacaaccctggacgactccatgtcgaaggatcctcccgctgaagtagagaacggaacgtcgacaacatccaagcccgagaaggatcctagtgcggccaaaatcttgtccttccgacaagaatcacgagccgacaaggacaacttccgaggtgacagggtcctagtgtcctatccacaaaaccaggaaacacaccttgcaagcttgctgggtttttctcaacgtacaagctgagattcgtgcctgcaaagagcgtgggattcagcgtacttcttcaacccgtgatgtctattgtcctattcacaagacaaagaatcacgacctctcaagctgcaaggtccttctcagcgccatgaagacgtcgcctcctaaggtccagcagttacaaatctctcttagggatgaggacaaggaataaggagcgacgcttgtctcagatcgattcgttggggtaatcgacattgatccccatgagccgtcagtcctacacttgctcgaagaatagggctcatcgtcaacgagtacaccacgcgatgtatttgctatcgatgggaccagcacgtcagcgcgtgctaatgtagaagcggagaatcaagtggttacgccggcccagcatatcagggccatcaacacaatactgagggaaaccccttatgatcccgttctgaacgatgatcttgcacagtggacagaatgactacacgaatcagtggccaacctcagcaacgcgttcgaggaggccgctgccagagcacagctagaacaaccgacagctggcggcgccgatggcgaaccacctgagcagcggacatcacctcaatgagccactcctccacctcgtggtaccggcaatctaaatgaccatctgaatggtcgccgagaagcacgacgcgtgcaagacaacgagaaccgttcccgacatcgcatctcttcacgatgtcacgagaacgaagagcgaggagacgctcgggcgaataccgagaccgtgataactgccacgatcacgatgatcacgaacagcagatgccgggcgatactggttgaggacgtcgccataacgatgacgacggtggagatcggtgccgggacaataacggggggcgacgacaggattctcgagatcccgaacttcatcctcgtaatcgtacaccggaaccaagtgactcatcatcatcgtcatcatcctcttcatcctcatcgtcagatagacatccacgaaggacatacgatcgctgacaacccaccgcccccagcgtcgggtgtagagctttcagtcgttcgctgcgtgatgtccgatggcctgagagattctaaccgggagcagaagtacgatgggagtaccgacccagaagaattccttcaggtctactccatggtactctacgctgccggagcagacgacaacgtgttggcgaattatttgccgactgcattgaaaggttctgcgcgttcatggctgatacacctctcgccctactcgatttcttcatgggcagatctgtggtagcagttcgttgctaacttcctagtaacttacaagcgccacgcgatcgaagacgacctacacgcgttgacacagaacccgggcgaatccttgagggactatgttcggtgctttaatgagtgcagaaatacaatccctgaaatcaccgacgcttctgtgatccgcgctttcaagtccggtgtcagagatcgctatactacccaggagttggcaacaaggcgcatcacaactactcgaagaatatttgagattgtcgatcgatgcgctcacgtggacgacgcactaagacgcaagaacgacaagccgaaggcagggggagagaagaaaccagccaaggaagcacctgaatcaagcaagaagaaaagtcacaagagtgggaaaaggaaagcccaagcggaagtcctcgcgtcagaatacgcgacaacgaggcatggacaatggcgttcgacggcacactcaacagccaaggagcaggggcaggattcatcttgacatcaccttcgggagatcagggcaaccaacaacttcagggcaaccaaccaacaccttcaggagatcaggggcacgcaattcaccttaacttcagggcaaccaacaacactgccgaatacgaaggactactcgctgggataagagcagcagccgcacctggagtcaagcgtttgatcgtaaaaggggattccaaactagttgcaaaccaggtgcacaaagactacaagtgttctaaccccgagttgtccaagtatctcgcagaagtcaggaagttggaaaaatgatttgatgggatcgaggtccgacacatataccgcaaggacaacatcgaaccagatgatctagcacggcgtgcgtccagatgggagccactcgaacccggcacctttctagacgtcctgacaaagccatcagtgaaacaggcaaacgacgaagatagcccagtcatccccgacgtcagctcgggggctatagaggcagagcgcgccgtcgccgacatcgagaccacggacgactagcggaccccactcattaaattcataagcagcgacgagttgcccgaggacgatgcagaagccgagaaaataacccgtcaagcaaaaatctactgtatgatcggcgacgatctatataagaaggcgccaagcggggtacttctcaaatgtgtctcgtccgacgacggcaaacatctcctccttgacatacatgaagggatctgcgggtcacacgccgccagtcgcacattggtcggaaaagctttttgacaagggtttttttgggcgaccgcccttaaagatgtttgcgaaatggttcagcggtgtgaagcctgtcaatttcacagtaaacacacaaagctaccagcacaagcgcagaccatccctcttacttggccgttctcgtgctgggggctcgacatactcggaccattcccatgaggacagggcggctacaggttcctattcgtggcaatcgacaaattcactaagtggattgaagcgacacccacgggggaaatcaaggccgacaacgtcatcaaattcatcaaagggatattctacagatatggattgcctcaccgcatcataacggacaacggctcccagttcatcagtatcgacttccaggattactgcatcaggctgggagtcaagatctgcttcgcctcggtttcttcccctcagagcaatagactggtcgagagggcaaacggcatatcactacaaggaatcaagacccgtgtctacgacaggctcatgtcacacggcaagaagtgggttgaagaactcccctcggtactatactatgggccgtacgtactacactgacaacgtccaacaaggagacacatttcttcctcgtgtacggctcagaggccatgctccccaccgagctacgacatcagagtacacgactacagaagtactccgatgaggatcaggaggagcagcgaaacgatgatgtcaatctactcgaagaacatcgagaacgagttgccgtcagagcagctagctaccaacaggcccttcaccgataccccgagaagcgcatcagagcacgcacgctttcaatcggtgactacgtcctccgacgggttcaaagccaagcagggcgaaacaaactctcacccaaatgggaaggaccgtacacgatcacgcaagtcttgcggccaggtgcattcaagattgtagacagcgatggtcgcgagttggtaaattcttggaacattgatcaattacgtaaattctatgtataaatcaatagtattcatacttgtaagacatcttacagcttctataaagtttattttcaggtaaagattacaatcaaagtgttccttcctgacgatcccttaccacgatgacacctagcgttgaaacctatcctactgtccctttacgccgtcttgacaaggcctccgaggaacctaagggaacttcggctggggacgcccagagccgataaagccttgtcggatcctgtagagacaaaagaccatgtaagatctggtcgtgtaagagttctcaccgtgcgtattaaccaagccgtgtaatcggaaattaggttttccaacttcacggctgggggctaggatcagtgcttgttcaaccaaggcaggtcaaaggtccaagagccttatcttctaggggctagggagagtgtatgactcaagtgagaagacactcgtacacaccgcatccagagtaaggaaacttagtaagatatatttcttttcaatttcacaagtacttcttacagttcgtaaaaattccaaaatatattacatgcctccctgagatatttgtcacaggatataaagactaccaggaaggccagcaccagtccatggactgaaagactttctccgcaagcggcgccatcgactttgccaggttatctatctctgcgagagtcctccgagaacgtgaaaaccctccgtggaggaactcgagatgcagctgcggacggcgatctcgcatacaagccagcacatgccctcaagcatatcggctcgatcgacggcactcctgcttcagggcctcgtcgatacgcttgccgatgccttcgagctgagcgcaggccctattcaaccacgagatatatccggctgccgactcctcgggatccccgcgaggtactcggagttccctgtagactccggccatggccgtgcaacagctcctgaggtacgagttgaaccacacttcgcgacctcggagtgcttccacggaccggtccttcttcacttccaccatagtcctctcgagttcggccacctcgaacttcgtcctccagtattggatgcgacgatctcggtcggccagtgcactctcgaggtctgctcagcatggaaacgactaagtcaagctgttcttctctctcgagaacacagcaaattaagtcaatcccgacagaagagcaaaggagatgaaaacaaaaaaaaaaaaccaacctaaggaagtcgtcgccatgcccgctttcatgggcaagttctaatctatgtcgacctgcagcacatatggctcgagcgcaagtgccggaacgattacaaacaactcaggctgtctgcgctgctggacatcctcgacatcgacatctctacaacgacaataaagtactcgggatcaaaatgctaaagaaaacgaaggtgatgactgcacacacaaaggcagttggaaccaacaagagttttacaagcacgactaattaaggagtacaggggaactgaaatcctactcttcaaaaaggggaagaacagactcccccagatcaccgacttcttccatcacgcccttacgcgcgtcattagcagccccctgatccaagataatctagaggtcaagttcagggtgcgccaaccttacgcattcgaggacgtggcacgccccggtgtagatcccgttggacgtctcctccccgatcctggccacatgcttggaggggatctcctccatcgccgtcaccagttccgcgagcgaagtcgtcagcgaaaactcatcgggattcaccgggatggtggtcgtaacaccgcactccccgacgagctggtgcaggccggtgtaggtaatccgcagggagccacggatctccgacaagttgttctcgagctccgacatgcagtgctcgagcccctgccgctgccgctcgttgccgaccaccagctctctcatcttctggaggtcctcacggacctccgccaggtcacgcgccagcttgtcggcgcgttcgttcaccgacgacgccgctgccgccttcgcctcctcaatctcgcgccctatgccgcgagcaccggcctggaggatgcgctccatctcgatttggagctccccccagatgaggatgtcagcgggcgggcctcgagcgggcacaaggccgcctgcagggccgctgggcgtcacctcacgactcttgggcacgaccatgacctttgtcgaagccgctgcaggagacgcactggagttctctccagacccgtcttgcgccgccttcgcccgtgccgccctgtgaaggattgccgtaattgccatcaagacgggctgccagagttcgatgaattaaaaaacctcaaatttgtctacttacttctcgccaagtgtcaccagcctctaccgtcgctgaggcgggggagacgcatccgaggcctgagtaaaacgagtacggtgtgaggacaatatcttccgactacacaataaatgaccaaaggtgcttaccgatggggtgggcgccttccgacggttcttcggaatgttgccgccactggtcatggcagcggcagcagcagtagcaacatcgaatgcctcctgggcgacgccctccttcaacgaagctgccgcctagtggtccacgagcagcccgaagatgtcagtcagagggagagcctacactacatgaagtcacaatgcgatcctagaagaaaaagataaaagggtcgtcaaatacactcacgttgattgcagtttcacgctcggctgtccctttctcgcaaagggggacatggacgttgctcgccgttgtggggccgctgatcatcacttgaccgacgcggctctccacggtttcgctgttcaaacctgtagatcgagaaccagaattcgataagtcaagaggaacatgcacataaggaatggaatccgaaatacaagaaaaataccccgaggagaaacccgggtcgcgtcctccggcctagaataatcaaaggctggatgggctcgagcctggagcggctggatccgcctaccaatgaagtcggcagtgacttcataccccgacaaccctcacactcggaggtcatcgatgatatcgatgaaggactgaagggagggggttaaggcgggtttgacggtccaagacgaaatcttgtctggttgttcctcagggacaacaaagactggatccgaattctctatctgaaaatagaaccacctcgcccgccatttgctatgagaaaaggggcactaaaaggggatgtatcgcgacttcaggccatcccgaagtcggaaaccgacacatccggacacctttttaggttccatccagcgcaactcgtagtagaaacgaaagagatcaagaaacggctctaccccaatgtaggcctcacaaagatgggaaaaaatactgaggaaggcgatggaattggggttcaaatggagcaaagaaagaccgtagaaattcaagacgagaagaagaaactcggaaggcggaggaagaaaaccacaaagaatatagtcctaaaccgcaaccatgcggcccaagacaggttcgggttcaaccatactaggacaggtatatacctcctagttctctctccatggtcccgcgaccggggagagcgtcgtcctcctgcagcttcttcagggacgcgccggtggaagtggacttgtcgagatccatagccgccggagatcgctgaagaagggactgagatgagcaagctagggtttttgcgggagcggagaagacgaggagcgcttggaggctggaaagtttttcacaacaggcggacttcaaaatggatcctcaaaactcccttaaatagacgcactaccgacagtatgaattccaaggaaaggagagagatggccgccggaaatttctagccccgttacgcgtggcagttttcggacttcaatttaaattcacttatgaccgttgaacttcgcacggggttgtcgattactccatgtctctacggttctcacaccgagatcgaccagtagagaacgacaataaccccgacatcagaagtcgcgatcggtcacatgagttcatttaagcagaagtcgggggctactgtcagggttacggataaggtataccctctacccttggatatacgtcatgtatcgatatggtatatctgcgtgtatacggacgttctctgtacacgctaaggaaattcatcacggagtccacagatgggaggattcctactcagatagaactgggtcatcactgtatcgtgtagggtccgatgtctccaagtcctacttggagaccaactgacctgcggtataaaagggatcccccgggaggacctaaggcatcgaatcctaccgccaacacatcgaccacagcctatgaaaccggagcctacaggagccaaatcgctgggtgatctagtcgaaccaactcgactacgatctcgtcggtatcatcaagttccactattccctttgtaatatgtgatttctgtcatataattccatatcaactggattagggctattaactactaaggggcctgaaccagtataatccctgtttttgttgcttgatgtcgtattacgtagattctcgtactagcgtaccttaataccctctatatccggtctacgggtatcccccgtcgacatggtgtatattatggaggcacctacaaatccctattttcttttgcaaaaatcgggcactgtttcaccaagtagatcggaattgtttcactaagtagatcgaaaatttttaatattttaaaaaaactgaaacacaaccaaatcaccttgtgaaacattttgctacaacgtacgaaacaatggttttcaaaaaaaatcgggcgttgtttcaccctatataaaaataatatttcagcaaatagtgaaagaatgtttccattcactgcaacatttgatctatacatagtgaaatattacgagtatacttgctgaaacattactagatgaacaaaaaataaaacggatttccttaatacaacgtttccgtaatatgcggatgatttgttgtaacggcgtgtgtggtggggtgcgcgtgtgtgtgtgggagggggggggacagcgcagaggcgcgggcggcggcgggcgcccgatcgctgccgttttcagtatattatctcatattaggttaaatatatagtattatctaatttctacatgccatctaagatctgagagacagacttaattaaaattagaataatgcattaacaatgttagtgtatgtaccgagttgcgtccacttgtacgtgccaacccatcgtgtcttgcactttggaatgcaggaatttcacaggaaatagttcggttcgtccaaattaaatttccctgaaattaatttctccaatccgaatatatagggcctaattatatatgctgaacgagatgaaccggccggtaatggcgctggtcagcagtaacagattggtaagatctgttggaatgcgcagcccatcaatctctgcgatttttttttccttctccagcttctcacgtggccgatcgacgatgacgtacgcgtatacgcctgcatacaatgcatgacgagattttcaccagaaggagagcctagcttagctagcagctagatagctagattatcgatctactggagtagctaggacggcgacggccggccaccatgtgcgtacgtgcgttgtgtctcccgcggacagaccggtaaaaacgacggtagagtgagtgatgagtgatcgttgaggttgacgagccgagtggggtcgtaagtacattttacccactccaatcatttatttaagagtaaattttactttggaccatatttattgaccaaaattttacattgggttagggctagactcatgttttcgcttaacaccacgtataattaccgttctttgaactttggacctgattttatagttaccatcacacgagttgttatctaggtgcttagcattttacaagaaacaatgatatggaaatttttgccatgcaaatatgcttagcacaagaacaatgatgtaacatgttacaggatatcctatcagattaatgggacttcattactactacatatgaacattcacaacccttatactatagacaaaattggagaaatattgagtttaagaactatttttttagaaaagatattacatgttttacaaacccaactgtagtgttagtacaaattgttgaattctaagttttctaacacaaaaaagaaatgagatcagctctacgatcattatactatgtgtaatttgtgaaacccggtccaaagtgcaaatgatggtaactatatatggtgttaagtgaaaatataagtctaattctagtccaatgtgaaaatttggtaaataaaggttgaccaaagtgaaatttactctttatttaaagagagaatatcttatataccactagtctaatcccttttatgccattaaaaattagcttttcccctatataccattgttcaaaatttgcacatcctctcatgccactcccgtatgttgaccgttaactctaagtaaaaaagatacatttgcccttctgaatataggatatgtctaacaactcagaagggcaaatacgtttttcttacttgagagttaacggtcaacacacggaaatggcatgagaaggtgcgtaaattttcagtgacatataggagaagagctaatttttagtggcatccctaatcccaatatatcataaatcttttactcctaaactgtaggaaacagtacaacttagatcccatggcagtatatacccccattttctcctattttcgctaactaggaaggtagcccgcgcatacgcgcgggcatgcaccgtacgtaggataaatttgagaaacttataaaggcggtataccagcgaattaatatctgcaatgttttaaaattatgtttttttcccatgaattttcttcgttagaattgcatgacgaatttaattgttatttataaaattatctattggagattaggattggtatcttacggtataaaaaatggtacctaagacatatgactcttgaggttccacagggaaagagagaaaacttaagttataaaagacattacatatacaaccatatataattaatggctctacccattttttagaaaaaaatgataattaatttattatttgacggcaaacattgattggtcatagctatggataattcctcataggaaattgtgattccatagtgaaagagaaaaaacttaagttataaaagacattacatacacaaaccatatataattaatggctctactgatttatatagaaaaattggtaattaatttattaaacataatatatgaccctcgagtttagaccattatttgtaaccattggatatgtagaagatctaacatattgtgtagagtccaactaagcaaattattcgtcttccctcaccatggatggtagacatgttaattcgtgtctccggcagcatgctcacatcatcatacttagaagaaaaaaaagtgcccttcatgtatatacatgtaactacctcatgcccctcttttcattaaagaaaaaaagttctatacccatgcatgcacaccgggatgcaccggttagccctccaatttgttcactccatggacggtatgttcctttgttctagtgattagataatttaataagtacaaataagtatttgaaatcaatttttattagtaaaatatccataaggactgatctgtagacaccctctgttcttcttcttttcttggtgtattagttggatttaagcaacgtgatataggtattttgggatataagttaatgtccaacttccaaaggattaaggtttcccaaccctcagcaccgaacacagcataagatcgtacatttatccttaaaagaagatcatatattttatcagggcattggaattaagtaaatagcatccacatatatgtcgagagatataattaagttggttgtgagtcaataggtccattgatgctataattaaggttaaggttagcggtttataagttattttgattttattaaaaaactaagttggatattttgatttgtaatgagaacatttaggattttttgcgtatggatgtgggtccaaaatataataattttattagcaattaaatatggttggtatagatattaaactattgatttaattaaaaaaacacaatggaattaaatatggttggtatagatattaaactattgatttaattaaaaaaacacaatggttcaaacagatcataaattgaatatataatttaaaatttacagctattgaagattctttatttatttataaaacataccaagatcaatatgtatgagatatattatttatacctatatttgcaagtgtatgcaatctttgaaagtatgataaaattaacttactaatatagaagatattatatacccttaagccttaacttaattaccatcgaaaaaagggaggcgagcaaggaaaaaatcacacagactcttatcatgcgtatggatggaagcatgtatatgtgttgggcggactcgtaccgccagattgatattaagttttttactaaagataaatctaatggtatctgatggtaaaaaaaatattaggtccatcagattaaataaaaccaatggttagatgttctcctttttccatagattttctacgaattaattagagcgttaggtgtcatctttgcactgtttcttggaatctcacgtggcagtttaggagctttttaggatgtttaatggacttttatataatagatagatatatctacgtgggtttgtgaaatttactccataatatatatttccatttttaatattttgtttttatttggttgcattgcaaagaaaaatagtatatattcaaagttaggaaagcgtttttcttatataaagatttgataggttcaccggtttaaaccatctatatacctaaatctaatggttttaatgtttgtttatatttggttttcatgcaaagcacaacgttctatggtaaaatttagggaagtgtttcttttatatatagattaatgggttcaccggtttaaataatcgttaaaatatttttttagggacaatggttaaaatagttggttcaccgaaaggttagatgttttattataatattttttcatgttaaaattttcatctagaaataggaagagaaggattggaagaggggagaaagcatggcattgtattacgtacatacatacttactgaggagagaaggggtgggttgtgggatatttttttttataaagataaatataatagttgaaaatagtgagtctagcaatttattaaacaaatagcggatccaccgatttattagaacgccacgtagcggtttagaaacgttttgtaggatgccacatggtaatttaggagcgttcgtaggaagtttaatgaacttttagtatataatagaagatttttctttctaactaataaagcgtaaaaaatatgagaaggaagagttaatctaggaagagggtggtgtaataataataataatacatgaggtatattattattattttcatatatagtaggtagttgtatatgagatataagtacgtacgctgggtggggttaggtttgggtggttaactttttctataagataaatttaatggttgtaaataatgggtccatcaaatataatgaaatcaacggttatatattggagtggcatgtggcggcttaagagcgtttctaggatgccacgtggcgacttaggagtgttcatagaaagttttatggacttttagttaatatacagatctaataacgacgtaaaataatgtgtccatcgattctagtgaaaaccaatggttggacgtttctctaatttaagagtggcacacaacggttagaaacatttatatgatatttaatggattttaacgcgtttgatgtctatttgtgggggtattcttttctataaagataggttcaattttaattaggattggaaaaagaaaagaaaggaacaaacgaaaaaaaaaagtactaaacagaggtggtggggccggtgggaggtttttggtttttaaaatagatctaacgatgtaaaataatgggtccaccgatttaaatgaaaattgatggtcagatttctctattatattagagtgccacgtggcaatatgagagcgttttgagggagccacatggcagcttgagagcgtttatagggagtttaatggacttttagtatataatagatagatagatagatagataatagatagatgaggcatatgtacgggtccacttatcagcatgatgagtcaccaatgccattctggatgaacaacgcgtggacagcccagcgatcgaacggctccaggagcaacgtaacgagaatgcgagctcggctccaagcgcagaaacggggcttcccgtaggcttaatttgaatcgcgtcggcttgcatcttcctcctctccggtgtatgcacagatacgcgatactggtatgacgatacagggatacggaaatttgcaaaatcatgaatttgtcgatacggtgagtatatatattttgcaaaaatagattatgttttagaaaaaaaaagtaagccatatagtcaatgttttagacaggtttcaaagaccaaacctttctatacttctcaaacatgaattctacagtagttgaaggatggagtatgctgccatggtaagcttggatcatttcatcataaaatcaccataagatctgaaaaaaataactgagtgaaagactaaaaaggtggacggcaacaatgctacagcagtaggcagctccaggccagtggctctcgagaagggactatatattaaaagaaaagagaaaatccatgaaatgccattgacaagcaccctaatcctaaaaatacatcgataaaggcaacttccaaaaatgccattacacaaccctctttctcctaaaaataccatcaccgtcaactccacaccgtcataaccgttatttttttaataataaccattttgcccacagtgcaaaatatacctagttttcactgtcaaagaaagaaaatgaaatttctaaccctaaccctactgctaccaatcccgatccctatccagcgctctccccagcgccgtctcggcgacggcggctcggcggcggtccccggcggtagccctggcaccgctatgccggcggtccacgggggcggcgcggcagggcgcggcgaggaggtccacggcagcggcagtgcggcagggcgcggcgaggaggtccacgatggcgtggcagtcacaggatgcggcgcgggggccgtagacgccggcgaggagagacttgcaggtgtcggcgaggaggtcgaggagaggcccgcagctgctgaggttgtcgtggaggaagatactgcagtcctagcaggtggcgcaactctctgatgttgatttttttcccttttgcttgatttcatttgaagactttgtgttacattatgtgaatcaaattcagttggtggctttgtagatggattgaactagggtgaaggggagcatgaacatgggttgtgatggtaagtactgggaaccctttgttttgtgaaaattcatgttgatcacaattggtactttgtgtgttgattgccctgatgttttagctcagattgatagcaaaaatttctgaaattattggtagtcctgggtgtggtggtctctctgctctgtctcggcactgaaatttgatttcagtgaatttaattatgtaatttgattgatagcaaaataatgatgttggtgaatttataagctaacagaaataaaaattgttctgagcaaacaatgcaaaatgatgttgtgtgagcaaatggttgcctaggggtaagattgtcttttcatgcaacttaacggaaagatgctaacaacagtttgacagtgatagcatttttgggagaaagaggcttgtacaatgacattttggtaagttgcctttgtcgatggcatttatgtgattagggtgcttgtcgatggcatttcatggattttctcattaaaaaaggccgcaagtttttaaggcaaaaactttcaaatctaactatatataattttaatttcattatatctatactataactataatataacttatatataagtattaaataatatatgcaactttatatctaacatatatagagattataatgtagttacagtatagttaaactgtagttacaatataactatagtgtaattatatcgtagttccactacaactatactatagttccactgaaaggttcttttttccaaaaaattgcgacagttagggcttgtttgatagagctccaactcctaaatttagctccaggagttgggtctggaatggagttatggagctgcctaaacctagcttcatctctctagtttattttgtgaaagagcgccatccagcttcgctcccatttttaagtggagctgaaactgtttggctgagctccagctccagaagagatggagctagagctggagctgtgccaaacagtgccaaacagaccctcctctcggggatgcaagcagcggctcctgcgttacaggctgtggtgggcttcctaacgagggtttggttgcgcaccatatcgaacgaagtatcaatgctgtatcgaggccgtatcgctaatttttttattttattttcgctaaagaattagcgatacttcatcgataccatatcaaatgcgtatcccgcatatcgccgtatcggagatatagctgaaaactgcagtatatgtgcatcatgcaccacagcggatatgatgcgtcgagcctcaggctacggtggacaggtctgccagctcttgcttttgggcgtgggtgtggcgcggtcgggggcgctggagtcagtggtgatggcggtgtaggcggaagaaaattgctccctccgttattgacgtttttaatttgatcaaagtcaaacttaaaacagtttgactatgtttatagatagatatagtaatatttataatattaaattagttttatcaaatcaataattgaatatattttcataataaatttgtcttgggttgaaaatattactttttttctataaaattagtcaaacttaaacttaaagtagtttgactttgagcaaagtcaaaacgtgctgtaacctgaaacgaaggaagtacataagtcctgcacttatccgaaggacttcgtccccttatgtgacacgtgtccactacaaatctcaaagcacactgaccctctcttccctctaatctaatacccattgctcttcctccgctcggtgagaagtacgaacttcagagccggccatggaaatttttttatttttagacatttttttaatttattaatagaccattctcaaaagtattttcagatctgaaccttttagccacaccagcttgcctggcgtggccaaacaacgctgtgataaaccttgagctccactcgatacgctcaatggtattgtttgccccgatcttttggtgagttgagataactacaatgacgacccgactacaatcgtactagacgttgcgttgcgccttagcgaccgatacacctcttcgtgggttgttgatcttaccagcgcaaatcaatcttattcctgcaagcaaatcaaagaatcaagcaagaacaagataaaagcaatctgaattgcaaataggaattaggtacaaatgataatttggggttccgaagacaagcacatgaacggtctagctgacacgtgcactgcaagcaagtagcaatggctaaactttaatcaaataaaacccaagaaaccctgaaaggtacctgtgctatttatggaggtgggagggtgacctagtggtccctagggtcgtgctccatgtggtcaaggcacacccccacatggccccacttgggccggagtcccaaataaagttagaagcccaaagacctatggcaggtgatgcagcacattgtttctttatttgtggattactgggatagaatttggaactgaggctggatccgttggaaagaggactccgaaagctttccatcaaatactcatcagccggaaatggaggtcgtatgcagatttggcggccatttaaagtcagcagtatagcaggtggccgaatcggattccagtactaggaggactatcttgatattttcttcatccatgatgtgagcaacggtatccataatagccatggtcacatcacgctgccacgccaaaaggttcagttttcaaaaatactttttggattggtctattaataaaattaaaaaaatcttagaaaaaaattcctggccatgctagcttgttaaaaaaatacgaaaaagtacgaattaacccccccgaactatcgcggtcgtccgaattaccccctgaaccacaaaactggatattcttcacccccaactatgcaaaccggacgaattacccccctcgacccaatccgcggtggttttggcctacgtggcatacacgtggcactccagtcagcattttattttattcttaatggtgggacccacatgtcagacccatttctctcttcccctatctctttatttctctctcttcgtcggtcacgacggtcagcggcagcggcgcgcacgccggcggccgacacgcatggcgcagcgcggggaagggcgatgggcggcggcacgggggcgggttggcggtcggcgcgcggggaggtggaggggatgggggagaggcgggcgccggcgagtcgacgagctcggccggctcaggtggcagcggcagcggcagcgacagcgtccgcggcgggacgtggagcaaggcagcggcggcgacctctttccccaccgtcaggctggcgcggagctcggacacgccggcactacggtggccgcccccttgcccccgcgccaccgtccaccgcagttgccgcactgccgtcaacgcgtagctgatgaccccgtccaccgtggtgttgtaccgtagcccatgcgcccacaggacctcgtgcgctgcctccaccgcagttgccgccgccgccgctgccgctgccccgccccgacctgacgagcgggaacggcctcgtcctcctcttctcccccactcctcctctcccctctcctccctcctgacggcggtggagggctcggccaacagggcaaggtggattaggggcgcaactgtgcggatctgacggcagtggggaggtgcggtggctgtcgcccgtgcggatccgacgacggccgtccccccgtgtggcgctggcggatctggtcgtgggaacggcctcctcctccgccgtcgctgcctccctcttccgcctctcttgctcctcctccgccgtcgctgccttcctctcccccatcccctccacctccccgcgtgccgcttgcgcgccaaccgccggcccgccccgcgccgccgcccatcgcccttccccgcgccgcgccatgcgtgccggccgccggccgtgcgcgcgctgccgctgaccgtcgtgaccgacgaagagagagagaaagagagagaggaagagaaaacgaagggtctgacatgtgggtctcaccattaaaaataaaataaaatactgactggattgccacctgcacgccacataggccaaaaccaccgcggattgggtcgagagggttaagtcgtccggtttgcatagttgggggtaaagaatgttcggatttgtggttcaggggagtaattcggacgaccgcgatagttcgcggggagggggggtaattcgtatttttttaaaaaaaaaacatacgtaggtatctgggtttcgtgttctgttattttctgttaattagtactctccccagtttttgcattagagtctgtttgagtcagctcacgacttgcaagatgtgcggtcctgatcagcgttgtggagtacttcgtcgtgttcgttcttctctctcgcgtcctagctcgttcagtttgcaggtttcgctacagtacaatggctactttcgctaacaatgcctctctcggcgagctgccgagctcgtacaccaggtacatgtacccgctcatggcgcagaagccgtacttggagcttgacgatgttcccgtagcggacgcgcgtcagcaccagctcgttcaattctccaagctcttctcactgatgtcccagcagtcgccggtttactacacgtcgagccgcggcttaacggcgatagagcgccatggtttggaattttcgaaatttcggcccccaacagcaaggtcaaaatcttcctgaaattttcggtgtttgccaaacatttgtaaatttggttaaaatttgtttaaattctgtcaaaatatgttaaaagttaaaaaaattcagccaaaaaaaatccaaaattactgaaattttggtgattttgggtttttggtccccactagtagaaacacaagtttcaaaatcgcaaaccctgtagagcgcccgtcgatcggccagtacgttcggcgttgtacacgctcacgaagctcccttgccgatgcagaacgcgtcgttgaagtgctccggccgtgccgccagaatgtcgcgcatataaggagaacgtcatgtccttgctccatatcgaaacctgcaccgccatcgagctcccgcgcgctcgccgacatgcgacatctccgccttttctaacgacgacgaccgacggctcgatcgcctcgcttaccggggcaccacggatgcaaaccatagagaccatgtggtagcatgcagcagctccaacactaccgctgggctgctgcacgcggctgtcagaaggggaaggagctcgcgaggaggcggtgtgtagggatgaaagcaagctgatcgatccgcaaacctagtttaaataaatggtaatccgcgggtttctacatcttgacccggcttgccacacttagagatgcaagtaggtcaatccataaatctatttatagttcaaattaataggtaacctgcgatcaaatacgcgggttacccactaattttgtttataagcgggttctattaatagtgaaatttggtaagccccgaagtcattatcggtctagagtcagtatcggcttcagagttctagaatcggccgatggaaattattaagtcgccaatagtcggattcttactgtattcagttaagtaaattaatccattaaagaaggttaagtaaattaaacaattaaaggaagtttatccagaaaagaccgagttcaaggaggatgcagcatggtagtttatctattaattaggaagagtttgttagtttcctttttatctttaggaaagtatgtttagtgtccgataagaactttatgtttttcttttatctttaggaaaatttctttcttacccaacaaagctattgtgttcgtcgacttagttcgcgccaacacagtttcggcacaatcagccgagcactgattgttcatcaacatattcgcaagttgatccgcttacaccaactgacaggttgaggcatgtgtggaggggcaggggttggtagggggcaaagaggctgtcagcgtcgacgaggacctcgctgctcctacccaacttgccgtggttaccaacgagatagagaagaagagatgagagagagagaggggggtagagaaggatgttaatgacgtgtgtgcctcatatcacgtgacgtaggtaccacgtcaatcaaatccagcctcaatagtgctttaggatttcttttccaccagcattgcgagttgagaggtgaagatttttcattgcggtttagggatgacaattaaactcagcggaaaaatgaggatggcaactagacttcctttccttctcttgttgctagacatgtatgtatgcttgtgaaggcagaccagagaaatggaggcccacacccgagattgatggtagcaggcctgaagagctggcgtggattctcgactattatatctcggcccattctatcttggaccagaagagaaataacagattgtgttgcaaaatttgctcaagtaaattttgtttttgtgggtacaaaacccggtcatgactcatgagacgtgtcagcttgagatgcttgtacatgccaaataatatttgtcacccaaacaataggttcattttcgacaagtaaaaaaataattttaaggagcggtctagatctatgggtttgacacacgttcacccttagatcggacgactcagatcaccctctttgtcacagccaaatattttcattttcacatccacctcacagcgatgttactatattggtaactaagctgcttatatctttgccgacatctgcagctccctcactcgcatggccggttttgctggattatggcccgaaaatggtgcggaatttggcaatgttggtcggtacgattcataaggaccatggcatagtataacaaggttgtacacgcactaatgtactatgtacctatacatttgtgcagttaatatgtacaactcattgtaatgaagctgcaggatgcgcggtcccctgttacccgatctgaacaagacatccttatatatatagctgcaaatatgggtggtagtaataagtggtggatgaatcgcatttgggatagtcatctccatttagggctcaattggaaaaaaaaaagaggaattatgaaggatttgtatcctatggaacattttcctattgagttctttggaacaaaggattcaggcctacaaatttccattgaaaatcctatggaatattgcaagaaaacaagcataaggtgttagctcgtactttcctttttccgatacctctaaggctcctttggacgtatgaattgaaaatcatacgaataagaaaaacataagaatagaaagtcacgatatatgcaattcatagcattgaaaatacatggaatatgtcaaacaggttgtttggatactccacatgaaattcacattttaggaaaaattccctatgaaaattcttttttttttagaattacacagaacaacgcagacactcacaacgcacgtgcactcacccctatgaacgcacgcacgcaaaccctatccctataagcatcttcgaagactaggccggcaaattcttgagagattaatgaagtcaccataagcgcctcgctgtcgacgggtacatcgcctaccacttaaattataatgccgttaaaatcctggaaaattcactcccatggggagtcgaacccaggacctcagatgctactgaggctcatgtaaccactacgttataggccctttcgccctatgaaaattctattgttccaacaaggagccctaagtacctatgctttttgcgtgtgtcatccaaacgacggttttataactaacctgtgttcctatttgctgcaggaattgaataatgggcatgtcatcctattaaattttccccaatattatggaattaacaatgacatttaggttcacgtacgttgtataggaaaactagatggaacgcgattccctcacgctgggtcacggtacgtattaaatagggtagaaacagcctctaccgtgacgattacaaagggataacaacatatggttacaagagataaggataaaaagataacaacagaaacaggataactaaacttatctatatttcaacaccccacctcaatcacaacttagcccaagttgagattgtgtctaaactgtgctaaactcggcgccggcagggatttagtgaaaccatcagctagcttatctgttgtagatataaatcgtatatcaagtagcttcttcgcaacttgctctctcacaaaatgataataaatctcaatgtgctttgtccttgcatgaaagactggattagctgataaataagtagctcccaaattatcacaccacaattgtgctaccgaaggtcttgcaattctcaattcatccaaaattttccttaaccacataacttctgccgtagcattagctaaggctttatactctgcttcagtactagatctagaaaccgtagcctgttttctagcactccaagaaattaagttaggacccaagaaaactgcaaaacctcctgtagatcttctatcatcagaacaaccagcccagtcagcatcagaaaaagcactaataagcatagaatcagacttaccaaatctaagtccaaattccacagtcccttttatataccttaaaattcgttttactgctgaccaatgcactgtagtaggactatgtagaaattgacagaccttgtttactgagaatgataagtctggtctagtcagagtgagatactgcaaagcccctacaatgcttctataatgactagcatcattttgtcccaagaaatctccatcttcaatagacaatttttcagtagtagataaaggtgtactagctggtttgcaaatagacattccagctctcttgagaatatcagaagcgtacctggcttgtgatagcacaagtccctgactcactttcttgacctcaattccaagaaagtagtgtagatctccaagatctttcaatgcaaaatccttctccaagtccttaagtaaggctgcaacagcttctgaagaagaactggcaacaatgatatcatcaacatacacaagaataaatatagtgcaaccacccttgttataaaagaacaaggaggtgtcagcctttgaagaaataaatccaagttcttgcaatttcgtacttaagcgagagtaccatgcccttggtgcctgtttcaagccatacaaggctttgtctaacttacacaaataattaggctggcctttgttctcaaaacctggaggttgtctcatatatacttcctcttctaaatatccatgcagaaagccattttgaacatcaagttgtctcaaactccaaccttttgagactgcaatagacagaattaggcgaaccgttgcagctttaacaactggactaaaagtgtcctcataatcaataccatacctctgcttgaacccttttgcaactaatctagccttatacatgtctattgacccatcagcttttcttttaatcttatacacccacttgcaatctattatatttttaccttgggttggtggaactagatgccaagttttattactcataagagcatagtattcttgttccatggcaagcctccaattactatttgccatagcctctcggagattttctggctcaccagtagttgtaagacatccatacctaacagtcccatctgtataccgcttgggtttagaaatacctttctgtagtctcgtgactggtctcgtctgatcacttgcctgtgttgtctgctgctccggttcagacagctctgacgctgctgatgatagcaatgtgacttggtcagcatgtgtgccatgcactgctccaccactcggtgcactagtactaggtgatgaagagattggtgcagcatcactgtctgactgcagctctactgacacgtcacgtagcactggtgaaccatcatcatttcctgcgccagctgcaccaatagaaaactgagactgcacaggaccatgcataaaatcatgtggcataaaatcatgcgtttcctccagtaaaatgctttcttctctgctggcgctacccggcgacccggtttctgcttcgctgcttccagtagctgaaccaccaatctgagcaactcctgttcttaaagaattctcaccaatttgattagaaaaattaggaggacaattaaccaacggttggtgcactatttcacccccatgatcagattgagtggtaggagagaaactatcgggaagaaggaggagttcaatacgaagcctagtgccagcattcggatgaagagtagcgaatggatacacagtttcatcgaacacaacatcgcgagagatataaacccgaccggaagcaacatccaagcatttaaaccccttatgaaggaggctatatccaaggaaaacacactgtttagatcgaaaggatagcttatgagcttgataaggacgaagattcggccagcaagcgcaaccaaaggtgcgaagggcagagtaatcaggtttgatgccaaagagatgttctaaaggtgtctcaaagttgattacccggctaggaactcggttaatgagataggcagctgtaacaaaggcttcatcccaaaacttgaggggcattgaggcatgggataggagagttaggcctatttcaatgatatgccggtgtttccgttcagctgagccgttctgttggtgtgtgtgtgggcaagagacaagatgtgctatgccaatctgagaaaagaagctattgagtctttgatattcaccaccccaatcggtttgcatagctttgattttagtattaaatgaatgttcaacaagggtctgaaattcacgaaatttggagaaaacttcagacttgtgtttgagcaaatagacccatgtaaacttactaaaatcatcaatgaaacttacataatagttcttattgcccacagaggagggagctggtccccaaacatccaaaaaaactagctctaaaggagctttagacacactaacagacttaggaaaaggtaattgatgacttttaccctgctaacaagcattacaaacttgattctgagtactctcagaagacacgggtaatttatttgagctaaggactcgatcaatgatagctgacgatgggtggccaagccaattatgccacaacgtcggggaaaccttgaaagcgccaaggacttgctgagcttgtttattgtgaagcgtagatgacggaagtgggcataggccggctctacatctgccgcggagcagcgacatctttgttgcctgatccttgatcaaaaagaaggtaggatgaagttcaatgaaggcatggttgtcaagcatcaagcgataggcagaaattagattttcctttgtattaggaacatgaagaacattattcaaataaagcttgcgagtgggagtgtgaataatggtgcgactaacatggttaatgtccatacctgagccgcttgtcgtgtgcacttgatcgttgccggcatatttgtccttcaccgtcagcttgtaaagttcactggtaatgtggtcagtggcacctgagttgatgtaccagtttgtgtcaaccccgtaggacaaggctgcgacattggcactcttgtcttccccagtgaaagaggcatcaaacctcttccagcttttgtgcacggtgtggccgatcttgctgcagagttggcatgtcggacgattgttgttgttgaaggagccaccgtcacctctgccactgccgcggccaccaccgccacggccgaaaccaccgcgaccaccgcggttggcatctccattgcgttcgccgcctctgccgccgccgccgcaccctcctcgcgacacagcattggcggaggactgagagcctccttgaaggagaccaagacgctgctcgaaactcagcagttgcgcatagacttcaccaaaggaaacagactcagtgcgtcccgtaatcgaggacacaacaggattataatcaaaatccaaatcagcaaggatatgggagatcagatcatcatcatcaagggcttttccagcagatgccatctcgtctgcaagccctttcatctttccaacatactcggcaatactatggttacctttcatagtagatgacagagccatgcgcgtgttgatgatacgtgcacgggactgcgagttgaagatctcctcgatggcatcccaaacgtctgctgcgttggtgaaggttgccacctgagcgaggatatcccttgacagagacgtcaacaagtagctgagaacttgttgttcttgcgcctgccattggagaagcgccggatttgccaccttctcggtggtctccttcccgccttgtccttcgtggcaaggatgattattgctggtggtggttggatcgagcgatccaggaaccccgccatctgcgctcctcgcagggtggcgagaacttgcgccttccaaagaacatggttggccttggtcagcttctcagtcaccgcctgaccatggagagagggagccgccaaggacgacgtcgccatggcgagatgagctagattgatctggagggagagggctctgataccatataagaaaactagatggaacgcgattccctcacgctgggtcgcggtacgtgttaaatagggtagaaacagcctctaccttggcgattacaaagggataacaacatatagttacaagagataaggataaagagataacaacagaaacatgataactaaacttatctatatttcaacacgttagtgcacaacaggttttaaatttgacaattaaattacattttatgatttttaagggccaagttagtaatgcacaacaagatatagagaccaggtaaaataatacctttctcaaaaaaataaaaaaagttagtaatgcatttgggagtaaatgatttttcgggaataaaagtatcatcatatatattttaggtaatccgttgtgaaacaaaccacaccatcacaaggcacactacccacttattctatcttactataaagttgatgtccactaagggtgtgtttagtccacgtcaaaattagaagtttgattgaaattggaacgatgtgacggaaaagttgaaagtttgtgtgtgtaggaaagttttgatatgatgaaaaagttggaagtttgaagaaaaaattaggaactaaaccagacctaactactaaagctcaacatgcaagtgtgtcacgtcatcaccaactagcaattattttctagagtattttaattcacatacaagtatgccacatcattacccactagcaattattatctagaatattttaaatatcatgcgagcatgacatataatttacaattttgttatattttgagaacttaatatgcaagcaatgtcaaaccattatctctacgtcattttcatattatttaaacatatatatctaccatttctataattaatatgtattcatccaaatatcccgcagcaaagcacgggatatcaactagtactaatgaaagctagatgaatacatttgactaaaacaatgtatttacgtgggttttacttttaacacaagaaaaataagaattccaattgtgtgattcaacttttaactcagtaatcaacttccaataaatgattttgacttttcaacaaagaaaaagaaagaatttcaattcaaagatatgtaacaagctatggtcgtggcaacaagccaattaattgcttctaggagcaagctcgctattgtacaggatcgaccagatgttattttgatttgatcttttattttgagtaatctattttttctattgattcagttggtatctgatgaaaattttctgctccaaatttgaaatttttactcctcaaaaccgtctagagtgaagtgcactgctaagttgtttttcttcttaaagtcacttttttggaaaattcttggtgtatatatttgttaactaaccatatgaaggtcaaaagatgataccgggttaggtatagaattttcgctgtttggcgaacacctctatgttagagcagctataaccagtttcaggggaagaccttgcgttgcgttgtggcaaatggcaagccgccataccttagtttctagcatggacaaccctgaacagtgacgacggagccaaggaggaagagagctccgctgtaaaactatcatttgactgccctgactacgagtataggacgtaggcatgtactagtgcattgcagttgccagtttagggccttttaactgactaggtagtctctgacgttaagccacaacgatcagtttccttccatttttctttggttctgaactttatggttaaactactagtctatttaatatgtacaagctaatatactaattaagtgctgttgactacatatgctgggtttctatttgaggatttgagcaaaagtatcattactgattttgagacagtagcagcaaactttttgagaatatattgagtgaatttcattttggacccctttttattaccctagttgcacaatggacaagggatttaacaaaattttcacttaacaccagctagacttgccaaaaacatagcagtagtttggaccagggtattgctctagctgctacggtgctagtgctaccatggctatttctataatccatgggaggaaacatttgcttaagttagggacggaggcatcgattgtttcgctttagttgcagttgcctgaaccatggctatttggctattaataatcatgtcatctgtttgtctatagttgggctggtgtgcgaggatcaaatcagagtagcacatcagattgcaggccaccgtcggtgagcttgagatcgagcatcaccatcctcccattccgtgcttgagaagttgagattgagacctgtacgtgtcggcccacacttgaacccaagcaccgtcgggcgctgactatctcagcctgaagaccaaccctttgcgttgcctccctctctgctgactatctcggcctaaagacccgccttttgcgttgcctccctactcgagctccatcaccagcacctctagtgctgttggctgttcgctcgagctcgagctccttcaatgctgtcgatccatgctcgctgctcctccctccatcgatgctgtcgatccatgctctgctggtcctccctccagattcgatgaccgtgaccggagttccgcgctgcttccgtactctttcctctaagattgggccgccggagttctggacgagacaatcgcccccctactcctgctccactttagatcatgtcacgggagcggtcaccacctcctctgacagcgaggcagatagggggagggacacttgcattggagatgggctgccggacttggagaagatgagggggtggtctagagtgaaaccaatggtagaaatatgtggtccaaagtaaaaaccattgctaggacctagtccaaattgcaacaatggtaaaaatatgtggtccaaactataatttactcgaatatattggaaaattaaaacattggtccagtggctcgccttcaacctccacctataatgatatattccaacaataccacttctctagttctcctaactagaaatcagtcatttctatcattttacttcataattggatagttagatgtgcgcattgcccctttttacatatacattatacattaatgttttttcatgtcattaatttttagatacatgtcacagtattggtgtattacgaatcggtatttgtgtctaataagttcacccacctataattttgtgctgggtcagccactgaccagttctattaactacttttcttataactcttgtagaacatgcagttgttattagccaagccaacagcatgtggtttgggaaaccaaacatggcatacccaacaactactctagactcatggatatgcatcatatgcaattaggatgttgtgcaaacatgcatgtgcctaacccctctctatcgatatcatcttttaactagaaatatgttttaaaaaaactctaaaaattaaagctgcagagtagaggcaagaaaaaaaaactaagtagttgtaaattttagatcactttcgtattaaatgtattttgttatgtattttcatgcttaagatgaaagtataaatctagtgtacatcctggcactacaacaaaaccactgttttaagacgtttcacttaagttattctattagtaaaattaaaatagggacgatgtttgagacgctttattagttgaggacatagtttaagacgctttacaggttagcataaaattaaatcgtttagagaggaatattgagacgttttgaaacgtctcgtgtgtagaaatgagttttgagacgtttttattatatccgtgtcatcattattagataatatataattatttatatagagaaagaagaaaataaacacattgttactaatcgtcatcatcaaataccattataaaaaattagagtatctgctacaggacgcttgtttgcagagttgcaatataaaaaaaactatttatttaccttcaagattgttcacgttaatgacttggttagtgcatgaactttgcaacctgcaggtgctgtgttcgagcccagatgaaagcattaatatcaaatatattaagatgtgcgtggctatataaaagcgtctctatattttgtagagatgcaatttatacgtctctagcaacgtcttaaataatataggtacgctttaaaaagcgtctccataattttgagatggtgtaaacagagacgatcctacgatgctttataaaagcgtctcagttatctgtgggagacgaaataaaatgtctctatcttacaaataaaatgtctccgttgggttgttttgttgtagtgtgggaactagattcacataagtatgagttaagaatatttgagatgttgtacatctttagccatttttgtcaaatctcctgaatgtgtaatatatctggtcgtcgccatcgagtggtttgacggccacatctcaggctaaagttgactggcagcctaaaggcccagcaaagtctccaatattcttctctcgaaacgtcggatatttcattatgtttgtttgatgacttgaattattcacttcatccctcaaatataatggaaggtcaatataaattaaattataaaattaaaattttaccagaataaatttcattatataaaaataaaaaaaattggttggggcttataaactgaatgtacacctatggaaaaattagaacgagactcaacgttctaaactaaagaatttagataaagttgaaaagaacaaagaaaacaattgaacaaacctttcgtcgtttttaactaaatactcactccatttttatgttacttctcattttaactttgtcctaagtcaaatattttctagatttgactatcaatttattaaaattcatatagtttaacaacatactccctccgttcaaaaaaaaaagacaaccctcctaggaggggacgaatggagtatttgtattttctaagtcttgcaaatgaagttaagtttggtcttttttttcataagggttttttttttgaactcaggattttggggtgctactcagatcactgcaaccacaacactaaatgccctttcacagttaagtttggtctagaaaataatgttgcatgagtaaatattatgtctagaaattgaagattttctttcccaaattgtttcttttccctcaaacaatatttcattgggttcatacttcggttaactaaactatgacttatcattggacagcatgtttggctaccaagaacataatttggattggtggttgttggtatttcttacgaccacagataaatccgcaagcgcacggaatatcgctgtaacacttcaccttcgggtgaccccaaaaggatatcgaactcagggaacgtgtgtaatctacctaaggctaagacaatccaaggacaacaattataggtaggctaggtaggctagagaggactttctatgtgttttaattatctatgctaagcaaggtaattccctatctgttgctttggacaccgacccctgctggtctgccagcgtggttccggctatagctctatgatgtatccgaacgtggaggattactaggacgggattcagggctgtcaccacctgccgcctacctctgacaaatccgtcggatatacaacaaacaaaggtaatctctaacctagacaccacgtctaagttattaattactactctaatacttgtacaggaacttccttctctatccagagtcctagtactagagcacttaatacgaatactaaacaatgaacccgcaaagatggaaatatatcttactcagactaagtaattaaataacataagaaaggaatatgaatgcttactttatagaagaagttctctgaacccggagcagagtgtaccgacagctccggtactcctccagaattcctcctaggaagctacactcgtcgagaaagaagtcggatgagcgtcaaacttccgggcactcctccagagcttcccctcactctctacctatttctaatgtacaaatgatacaatagagcctcttataattcaactcaaagttgtgtgtgttggaatgagagtgaagacctccatatataggctccaaatgacggttaggggtatgggaaatgaccaaaacaccctgcaaccgccataggggaggaatccaagctgtccacgttaagccagatggcgggaggcgctaggattggttcggccgaaccaaaaatccctcctcccagcctttcctttgcccggtatgtagcttattgggcccccaacatcttgcacaatgttttggcccaattctaagtggttttggttgacatatggtcctccaatccgtgtaaacgcgtcctgaatgcgcagagatgcattttgtcacatgacggatgtgttttctcctcaaaatacctgcatacacatatttcaccaacactagtggaaatgattagtaacaaaccctaccactaagttggataccatattttatttcattatatgcaagtattgacggtcaaatattatgatttaaggaccgtcaacagtggttatcggtgacaccatgttaacgaccaaatttggtaagatgtgaacgaggttcaacattaggatcgaggcggattcgatgaagagatcgattcgaagaacagagtatgcatcggctgtgaaggtatcagctggagtgtacatcagctgggatggatcgaacagaggatagccgatacagccgattacgatgaagacagtttcgaggcttcttttagaatcgttcaaagtgcttcacagggattgccatgatagagataaagctctcagtttgggcaattgtatctattaattaggatattttatgtaatttctttagagatatgttttggcaaaagtttgctgcaaagacttatggtatcttagagtttgttagagataagtgtcgtgtccggcaaggacatattttgtatctcgggtataaatagagcccgaactcatgtaatcaaacaacagacgttcaatacaatctcagcgcatcgccacccttttactttcgtttactttcgacaagttcttactttcgggttgagctgcatcggtttcgattttcaactagaggtaaagcttgttatggcggcttgtgttctcgggattagtgcttccatctttatgatactcttatcttgtttatgtaattcgtcaagttatcatatattctatataatctttgacaatatcgttatttaaccttcaatcggccagcatctatcatcagaaggcaaccgattaggttaattaccaatgctgatttagattatataggatatccaccaccctatgaaatattcaacggcttgattgtctagatattgtccttcttttcatacttatagctgcatcagttgagtttgaccttataagtcgtgattagaatctaaatctctagcctgcttttggttgctgattagggtttcatcggggtttcagccgatcttacctgatttaactattttatatctcatatgcttgattgatataattaaatctgccctttatgttaagattttgttgcgtttaggtatattaagcttcccgtttgatatatttttgcttgctttaatatctcaatatagagtgatatcggagtactagccgatacatgctagatctgtctgatcggctatgctatgaatgcttataatcttcttgttaatatatattttgatctaagtaatttatactaaaaaacgacatggcgaccgatctatcccaatcacttgatttaagtatatatcgacgaaagcattatataccattgatatctacaaccgattgaatagatttagttctttcttgcctatttatgactgtcgatcgactcaaacatgacatcagctcaaagataaatgatacgtcattggggactggccgatcggctatcgtttatagatttaaccgctattttcctgtctttatttcttgttgattgcaggatcaaatcaactggcacgctcacaaacctaaaggcaagattttttggacctgcgctggagttaagcagatctcccaggcctcgtgtttttcgcatcaacacaccaacaatttacagattgctgtgtaggatcgaatcacaacaactaagccaaccagagggggggtcaatggttggtatacccaaaaaccgaaacttttagcggaaataaaagttaccctcaaattcgacggatcgcggcctaaccgaagtgtatgcgccagtctgaccgcctgatgaacgtcggtctgaccgagattaaactccgatcgaaccgccgagatcgcctgccgctccctgtcgccaccgccggtctgaccgccgtgtgcccaccggtcggaccgccgcgatgccgccagtctgaccactagtgcgccgccggttagaccgtcgaaacccgatgaaacacaaatcgaagaactcttaaaatagatgacgactttattgattctctctgtgtttacaaagtgcaccaacaacactccttacaaaaatttcgactaaactcgaaaccctaactcaactatcaactcaattgctctcaaaagcgataccgggaagtctcacgctccctctctatttatacccaaggtaggcagcctaaagccacgaaccaaactcatactagaactcctaatcaccctaggaaaccctctagtaccagaaacaaactttacataaccaatcataccaaatttggactccttccaaattcaactccacatcacatacgcacacaatacctccatcgtatgccatatggaatcttcaccaaccacgtgtattaaactctagccttagtatcccgcatgatctctgaccatcatggacgtcgtcttatccccaagccgacttccggtccatcaccgcaaaaactctcccggtatctcgagtcacctacacatagaacaaacaaagaaaccatattccgagaccaagctatccccaaattgactcattgttagcaaacaacagtattacatacgcatagtatccatctagaagccataattatgaaacaattacggatatccaaacaaacaacccaaaaccgaaaccgacacagagtcggcatgtcagaccgcgggttgtaccggtctgaccgcgtgatacacgccggtctgaccggcagcacatgtccggtctgaccggtccaacaaacagttgtacctgtagatcacctgtgaaatccaatcatatccaaaaccacttcgcaaataaattctaaataacaaaaccaataatctccaatgctaattgttcatcacagaataataataacacttttgattttacatgctgctctggtagagaggttcgatcagctagtcgagtgcaagcttccttttgttcagctgtcgcgtttctaccttctttcttcttttttatgctttctctcgggtatctcgttcctgttatcgttgacaggcattttcaagctttattgtccaccatgttcgaggatcaaggttccattccttacttttctgcaagtagctggttagcatagcttggttaatcgctctggcaaacactaacttaatacttcgttcgttctccaataattgacaatgatactatttaagtttaagctttaatctcttgtctttttcttgaaaatttatagaacttgaaaatatgttatattggtaaaatgtgcaacgccataaatattactattatacaactatcatcatcataatataattatctaaatatttttgtcaaagtgaggaggtggacgtagtcaacagcgtcaattattcgataacggtgaagtactgtcaaaaaaacacaccaccttaatattataaaattggaagtctatttcacctcaattgttaattaaaactatacaacgcaagggtttgagccaattttacattggtcactcagttttcaaaaaaaaaaaaaaaaacattggtcactccatcactgtagagagatgtacaaagaatgaaccgtacgtgtactacagtagggttatgtggcgaccgaatggtgcattagagagcggtgaatcttagaacatcaaccatttgcgtgatgatactttataaccagtggactccactgtatctctacgtgactacgtgggtcaaaccatttcctctaaaatatgtacctgtggtctttaaggccttgtaatcatttaatttagtttgttgcttatatgatgatttattttgggtctgcacccatctcaccgtctcaattcattcttctcttatccttactcaagtttgtaacaaatgttccatctgtaccatttatatacaatttgacttcaacctcaacttgttttgggataaaaagaaacacattattttactttcataaaactcacacagtaaagcctggcctcaatacaatcatttgtactattcattatacttatattatttaccatatttctttcgatagttactctcaatgtgtatgcccgcatacgggtgagagagggtgagcacccccccaaaaaaaaagttaggtgcctattttttaaagaaaaaaaatcaagatataacatgttttaggactttctcttattttcagccataagttttatattttctccaattctcctcctattatttagttggaatgagcttgtttttgtctgctccaattgtttgattataattatggtcatatttaaaaaactgtacctcaatttagatctgatttgttatgtactttggttaatattgatagtctaaagtgaaattcattcttctctctctttttattttctaaaaatgtgaggcctcactatttttttagcacatattaggtgggctctgtgtattaggtttgagttttaaatttatacctacagatgaaaattaaagggtacatcataaaattttcccggacttctttaatgctgatttggtccctaaaacagcaggactgcacgtgtaaggaggatttgacgtacgtaacgcgtcgccgatacagaggtagtatggtacttgtatatgtagcgttttgtttctagttaggtgagaatccactataggatatactactatgccaaaataaaataaaaaaaaagctctaactacgaatcaagacatatatatatatatacagcagttcaagtttttagttataattgaattttttttaacagagagggtatatcattatgtagttaattatgttgttagttggtatatattactaatacttcctctgggagtactttctctgtcccacttttaagtctagtcgtggatttttgtgttcaatatttaaccgtccgtcttatttgaaatatttataaaaaaaattaaaaaatagtcacatataaaataatatttatattttatcatctaataacaataaaaaatactaatcatattttttaaaataaaatggacgatcaaacatatggcacaaacaacgtaaaactgtattcattttgggacagagtagtatatacagtgtataaaacgcgttagcaacactggtcattaggcttgacttcctccgagatcgatccatatatttattcctccataattaatccataacatatccggtcttacttggcagcacatgtgcatgtgtttacttttttttatgagttggcagcagtctgttattttttttccccttctgcgtaatgcttatagacatgagtatgagctgggcttggaccgggccgggccaggccggtctagggtgacaaaaatcccagtgaagcctatcggaccgatgacttttatatgagaaaaacaacaaaaataaatatattataagtagcggttggttttattcggtttgatttggtgctgcatgcttagccagtgttcgataggaaagtaactcattaatgcatgattaagtaattattagcttaaaaactttaaaaataatgtaacatgatttttttaaagtattttttatttttaattttgcaaaaacacaacatttagaaagtaagaaagcgtgcatgtaaaaaacgaagtagtagaagttatattatttatccattcttctaagatataatttgtcaaaaaactttctttgactatattttacttacttagatcacttattataaattactcccttcatcccaaaatataaccattttagcatagtgacaagtcaaacaattttaactttaactattaatagaaaaaattttaaaagatcaatcatgtaaaattgatgttactagatttattattaaaaaaaactatcataatatgcaaccctttttatttaaaacatcttacttttatatagatattattggttaaagttgcatctcagagaccatgtcagagtccaaaaatgcttatattttgagatagagggagtaacattattatgtttataacatataatatttattctctataatcaagtggatagttcatcaacttttatcctcaaataattaaaaatagtgatactttaatttagtgctgccacaaagcaaagaaccggaaaataacattagactttgttccgcactacactttcttaacttctactctctcatttttccatgtgtacacttttcaaaccactaaatggtgcgtttttcataaagtttttctatagaaaagttatttttgaaatttatcttaatttattttttattttatctaataattaattaatcatccactaatttactactctattttgcgtgctgtttaccaaccccaaatgaactcatctttaggttctcattgatgtaagtggcacatgccacatattttagctagtctacacattatgctatacgagattatctaattcaataataaatgcgatgacaccgtgtagagattctctttatgttttttttgttgttttcctaataatgaaaaaaatagagcatgttcacttgtgcactcatttttgcttttgtgaaaaaaaaaggatgtttgtggtcgacataattatatgttgtgtctttcagatagatagtgagtttgtttctcttgttgtttacgttctctcatacggtacacaaggagaacaaagttacaatcatatccacaaaaggatgatgacgcatcatttcccccgttgttatttagtgtagaaacatggttgcgtacactgttttgggtatagagggttggattttaatccattttctaaataaatatttttatgagtccttttggaacatagcattaagtatttattaaacgatttggttcaaaatagaataaaaatactagttggtccaaaataaaagattcattgaaacaagtatttttaaaaatacactcatgtcctatttggggtgaatatgactaaaatacttgtagctggttgtcagtataagcccattatttatacatagaaagtacttgctaaaattaattttagggtaacattcgatataaaccctctattataaaaatggatagataagatcaaatatagtcactaactcgcattaatagtaccggtagcattatcaacaatatccatccaaaacatgaaaggaggatagtgatatagttcttcctatttggtttcctacccagcaaaaacggaagcagatcctctgacttaactgcacatgcagttgaggcactgacatgtgggtcccactttactatggcccacatgtcagtgactcaaccgcacagtagttaaatcagaggaaccctttccagcaaaaacatactcactcccccatcagcaccacaccactgctcaaactactccacttgctcctgcacactggccagccatacttgtgcagttgtgcccacaaaaaaaaaccctttgcaacactgctccactccatcactagtgctgcaccaccaccatcatcataaccaccaaacccccatatttcctagatccacattcaatcctttccccagcatttcctcccttttgttttttgatgcaaattcccctccttttcttttaaaccaaaatccctcttctcttttcttttttaagcaaaatccacctcctcttttttttaagcatcataaccaccaaacccatatttcctatatccacattcaatccttcccccagcatttcctcccttttgttttggatgcaaattcccctcctctttttttttaaaaaaaaagaaaagcaaaatccctctcctcttttcttttttaagcaaaatctccctcctctttttattttatatttgaaacaaaatccctctcctcctccccaatttactcccctatttactccctccacctccctccatttatgacctctcttccctccacctcctcctcctcctctcttctcccctttcacactctagccatactctctccaccgcattagctcgccattgccaaccagaggagagagagaggtggtgggcagcggccacttgcctcttccgagctgtctcccatgacaccaccgccgccgccggtgtcgcttgctccgtgccaacaaccggtcgagcagctggtgggtggttcttgctagcacgcgcggcgcgagcgccaagatctcaccgtacgcgtgcagcgccgcggcgggcggccatgggtgctcgggtggtgctgttcttggccgtggccgtggtggcggcggtggcgcaggagccgaacacggacgcctacttcgtgtcgaggttcttcgccaagatggggcgggcggcgccggcgtcgggcgcggcggtgtgcgggtggcccggggtggcgtgcgacggcgaggggcgggtggtggagttctcggccgccgggatggggctggagggcgccgtcccggaggacaccgtcgggaagctggcgcggctgcggtcgcttgacctcagcggcaaccgcctcgccgcgctccccaacgacctgtgggaggtgggcgcctcgctgctggagctcaacctctcccgcaacgccatccgcggggacctcccgaacaacatcgtcaacttcgccgccctccaggtgctcgacgtctcccacaacgccttctccggcgcgctgcccccggcgctcggctccatcgccgcgctccgggtgctcgacgccagccacaacctgttccagggccagctcctcggcaccgtcatctctggctggaccaacctctcctccatggatctctccggcaatgcgctggacggcgacttgccggacctctcgccgctactgtcactgtcctacctcaacctgtccgggaacaggctccggggctccgtcatcggagcgttccatgagcagatgaaggtgatagacctcagcaacaacagcttctcggggctaaactttagcagtggatatgcaggctcatctttggcatacctcgatttatcaggcaatgagcttaccggggaattcagtgttggcaacaggtttcagaacctgaagcatttgaatcttgcattcaaccagttgtccgtggcaaatttgctggtgtccatgggtgagatctctggattggagtttgtcaatttgtcgagcaccgggttgcatgggcaaattcctagggagttgtcttcccaattgtctagattgaaggtgctcgatttgtcgcggaacaatatcagtggagtagtgccagacttgagctcgattcgcctgcaggtgctggacttgtcggtgaacaacctcactggggagatccctgtggcattagtgaagaagttggtgtccatggagcggttcaacttctcatacaacaacctcaccgtttgcgcctccgagctctctcccgaggcgtttgccgctgcctttgctaggtccaggaatgattgtccgattgccgtgaatcctgaccgtatccagagaagtgggggcaaacgcaaggggatgaagttggcgttggccattgtgctttcgctcttcttctcggttcttggtctgctctgcgtggcagttgcatgtcggcggcggaggaagaggggtgatgtgctgcctgctgtcaagcaggtgtcattcaaggaggaaccagggatttcaggcccatttgcattccagaccgactcgacaacatgggttgccgatgtgaaggtcgcaacatctgtcccagttgtcatctttgagaagcccttgctgagtttcactttcgccgatctcttggcggcgacgtcaaattttgataggggaactctgctggcagaggggagatttgggccggtgtacaggggatttctccctggtggaattcaggttgctgtgaaggtgttggtccatggttcggcaatggctgaccaagatgctgcaagagagcttgagcggctgggacggatcaaacatcctaatttggttcctttgactggttactgcttagcaggggagcagagaatcgccatctacgagtacatggagaacggcaatctgcacaacctacttcatgacttgcctctaggagtccagaccactgaggattggagcactgacacatgggaagacaacaatggcggtgttgccaccgaaaacatcacaccagagggtaccgcgacatggatgttccggcacaagattgcattaggcgccgcgagggcactggcattcctgcaccatggctgcatccctcagatcgtccaccgtgacgtgaaggcgagcagcatctacttcgactgtgggatggagcctaggctgtctgacttcgggctgtcaatgatcgccgggaccagcacggacaacaacctgctgcaccattccccgggctacgccccaccggagttctccgactcggagaacgccatggcgacagcaaagtccgatgtctacagcttcggcgtcgtgctgttcgagctgatcactggcaagaagccactgggggacgactaccccggccagaaggaagccagcctggtgaactgggctagggcgatggtgaaggcaaacctcgggccgggcatcatcgacccaaagatccgcgacaccgggctggagaggcagatggaggaggccctgaggatcgcctacctctgcaccgccgagctcccctccaagaggccggccatgcagcagatcgttggcctgctcaaggacattgagcctaaggtagcagagcaggactgaaataatattactagtgtttttggggtattgaaaagcaagtgtaggcagtgagctccttagttgttttggcatagtggagcttcactgcattgccatgccctgctctcctctgctgggatatatctttttcttcttttttgtttcttttttgttcttccacttgttgagatgttgcaatacagctttgctacacctgctccttactaacaatgttactactaccattgagtcatgacacatggaagatagctctctctcatcaatgtgcttgttttgcaagagaaatggcaattaagcagcagcagcagtcctggtactttgctgtctctgcccactgttattgaacaatgtagtatacttaagcaaacatggaacacctttaatactgcttcctagtactacatgttcaaataagctgtcaaaaattaacaaaaagaaagacagcaatactactccctcattcattgacatgattgcagctgcaaaaccctgcactgtcctgaaagtgtgctaataatcacctgtttagaagattaaagtgtgttccataccatcattatgttccaacttttttccagtttttatcacccctgctgcacctgcactgccattgcatggcagatggctcttctttactcagctcctttgctagtagtgcttttttttcaccttttttatttttttttcttaataattttggctcttcttctccgggttacgctatctctaagtattaattatgctctcggccatgcctggctgccagtgtgatagccttttgagaggccatcactgaagagaaaattaaaaaaaaaaatcacacacaaatcaaatcgctttcttgaccaaccctgcatcgaaatcgctatcaagcatgcgctccactcctgatcattgtgctttttctgcttgtgtagagcacaagtgagtgactgatccaggcacaaacccacaacttttcagctaaaattcggacaaatttagtgccggaaattgctcgaaaatctcgtctgatgtggtctgaccggtgttgtactagtgttacctggctacaagcaaggagattagggttttttttttttttgcaacaaaaggaagagtaaccgcgtggctgatctcctgtcaacatcataaacctaggcattttgcgcggattagcgtcgtgatttatggggagatgtagtgtccgtccatcctaattaagtgcaatcatgggaagagtatgactagaacagtagtaaaagggcaattatccttaaaaaaagttagtaaaagggcaggcaggaaggcaggaactggccaaattgtgattagttaagccatcaggatcagatcaaagctactcttcgctgggtatagagttgttcaattaattaaaagtggtctcagtagtgtgcttttgtggccaactaaccagtactagtacatatggtacattgcatgttttttgtatcatactacctgtttggcacaacttgcaaattgtttttctttttctttcaccatgagaggtgagagctacttccaacacaatgtgctttcgtgtccaagctgttttggcacaccgcttgtccgtatttgtcactgtcaaccatgaattaattactgttatttatactagtcttgcctttgattattatgacaagaatggatcaaagtggttaggtaactagctaggtactaatccttgtttacaatttccccaggtaccataatccagggagagttgttcaaaaatttctggtggcctaggaactgaacttaatattttggacgtgttcaagccaattgttttaaattttcctttgtccgattcatttttaattacatggagaagatgcgtacacacaacacccggccgccaactcgaagcagccacgagggtaggatggacattttacagtcactttatctgtttaccaaaaagtaattattatagtattaatggatatgattatagtgtagtaatactaatggatatgatgttccattacaaatttgacagatcaggactgtactcctagggtaaataacggaccttgatggtcctttatggctaatgacaaccttgatctctgtcactgacaaactaattaattctacccttaattaattaatttcaaatttcaaattcggagtcattgtcactacgcaaaatgtacgtatactcacaaggtatctggagagcaaggttgtacatggtccagttgttagaatctctgcccctcaggatcccaacatctcaaatcatggcctcctgctacactccaaacatgtcaagacaaaacatgagaataacaagacgatcaaaaggaattaagcatgtctatgtgccggccaaaatctccacagaatttaattaattcaaaaggcaacactggtaaccaccaaattgaaatgtctagttcatagcaaatgagatatgcgtggccattaatttgattctcaactaacccctaggacgcatttcaaatcaatccatatagatagtaatgataatttcattgtactattatctgtacttacaaacgcatctaaccgtgaatataattcgttcctacattgccgcaacgactacggattcattaataaattaggtaatagtaggagatgataggtagacctggtccatacggtagtacaaattatttagttattaattcagatctacaaaagtgactgcttggatagatgttactacaagaaatgaattggtagatgaagctaattcacatacaggttaggtctatttacaatgtatatatttactacttgagtttcattaaattacagctcaaattctgaataaattgtaaaattctagcatcaaacatggacatccaactcctacctctctgatatatgattttttttcttttttaaaaaaataaaaacacagcacaaatacaggcgcttatacccactcttttttatgagcacattttaaagacagaccggtatactttaaaaatgacaaatgctcacttcgcctcatctatgatcactaggctaaggtcaaaaccaactcacttgtgtttttaccaaacataaacttaacgtgtactcatacatattcttttcttttctacttttgcaaatcgatactttacttgattatgctttggcacacacccaagtgcatcagtaatcataccaatgggacaatataattccttgattaacaacactaacaaacttgatggctacacatgctattatgaaagcgggacaaaaggtgtaaatagatttgtactcactagccagtatgaattttttgtgtgcaaatatgttgatataatgtgcactttataaagtaatggcgtgcattgcatatccgttctcagtgattagcctaagatgaaaaaaaaataggaggcacctttagtgtctttttttacttaaatttggttaaaaatatattggagtggtgggaatttttttatgtcatatgggaattaaattgatttattactgtgctcgattattgtttattttcgccatgcgtcgcctccctggcacagtcctcatgtgggcaggctcgagctgcatgcaccgtgcactgccatgtgtcacctcctgagaagtccttgcatgcgtagaccttagctgccccgcgcacgatcacattttggattctaagcgtcctcataatcggcccttagccgcgagcctgcagcccatagccaagcttttagtcccaagcaatccagaattccaggacgattagtgttttccagctaatcccttcatcccataatataaaaggttttagctaaacaatccgtcctttctacatggttcttgttatgtggaactccgtagcagagaggaatgggctggcgccttgtgtctcctagcctaggtgtaattttataagggtattggagcatgtacactatatctgtgaggttgacacctatgttccaaattagccttgttatacaagtgcccgataataaaaattgttgatgaacgtgaggatcacccgtagtaactagccacagaggatgagtccgaaccgacaccgtgctaggccttgacatgcaggtcagcagctccattaatctaaatggcgcttacaagggtaagaaaatggctgtgaccatagcataataagggggcaaaaaaaatactatagcatttgtgggggggaacatttgatggtgcaatggcgcggatgagtaatttatgcctgtccggctcggttggtgtgaatgtctgaaatctttgacctgctgctccttgagtgggcacgtctgcaggactgacaatttgctgccaaaacagagataatgcgtgactattctttcctcgtacggatgattattttctcctgtaagcagcgtatatttaggatctgtttggcttggacacgtttggaatgcaattttatggctatggtttgtaagttgagaacacgtaacccatggaaaaaaactaattttgagacgggactttatttttcgttttacttacaccctgtttagtttccaaacaaaacttttcatcttgtcacatcaaatgtttgggcacatgcataaagtattaaatataaaaaaaatttaattatccagattgcgtgtaaattgcgagacgaatcattatgcctaattgcgccatgatttgacaatgtggtgctacagtaaacatttgctaatgacgaattaattaggcttaataaattcgtctcgcggtttacaggcggaatctgtaatttgttttgttattagactacgtttaaactttaaatgtatgtctgtatatccgatgtgacacgtagaaacttttcacccctgaactaaacatggccttaagtgaattgcagtttctactactctcttcatcctaaaatattttttaagataatctttatcataaaatatagctaattgaaatttaaatgttatctcaaatatatatctagggtatataaaaggtgattttactccactgctaccatagggcccatcacctcaccgaccctcaacaccagcaacccctcccatacattaataagtattttattctcatcggtaccctctaccatgcattaataagtattttagacatttctttccaatccttaatatctctaaaatgcccctctgctatatttgggatagagagagtgcctttattactaaagctttatttgaaccatcctttaatatatatatatccactttatactatgtaagattattttttttgtactttagattatcctattcttttttctagtcatatctacactctcctctagcaaaaggtggcctatgcataagaggaggaagattgctgttgtatgagcatgtgctcgagaaaagatccagtatggtcaaaagtacaacaaatgaaaaataacctattccaatatgaaaaaaaaaatagctaaaagtgtagttcaagatgaaattttggtaataaaatgtaaagaaaatacaattaactcattttacttttgatattcctaataagccaacagtaacaacaataaaagaaaagagtgaatcgcatattgggccacatcttattaccagagtgtcaagttgggttaggggtaagccaatattgtcactttgcactaggtatttttgcacaagttttatattggagtggtgtttcctaattctcttctttatttgcttcattgagttgaggccgatatctattagctcgagcgtggtgcaccaatgccactgatattgtcccatgctcgagagtgatcagatagcatcagcgatgggctgtttgatttgggggaagacgagagggtggtgtaaggtgaaacaaatggcaatattatgtggtccaaagtgaaaaccttggctaagacctagtccaacccacgacaatggtcaaaatatatggcctaaactgtaatttactcaaaattatgttccctgaaactcaaagttggttgagcattataagcagtagctcaaacaagtaagtttacctatataaagtttgatatagtttaaagatttactcatagtgtttttacagtgagttaattataaatttttcacgacatgtttaacagcaatccaagtattgtgtcaaatactttgtacttacagaaaagaattatccatgcacataaatcacgtcctcaaatactttagaagctagataggttgttagggacttagggttaaggtttagttgaagctgtccataaagggagtattttatctcttatatacggcattatggctgagtcaatgaattatacctttttttctaaaatataagtatttttaaagatacatcaaaagaaggtagtggtggcgcggtattgaatcagccaccctacctacttccattataaatttcacaagttaccccttcaactttttaatattaaaaaaatatcaaacgtaaatgggtagccacatataaaattagattaagatgaatattcgctataaaaaagggtaacacattaatatattttttttatccatagcaaagagaagatatttaactagtagtcagaaaagaaatatttatagtttacagtagagggagtacataaaatccatgcatgtttatttaggaaccaaccgaaggtaaaaatttaaaatttaagcttaaatttctagctgatttatggggttttatcgtagtttatttgcattttcttttaaactacgaataatgctaatacaaaagttttactcataaatgattcttagttactttgtatttttatggcttatcagtcgtagtagtagtaccaatcagacacatgagattgcctatatatataggtttacctagccagttgtgagctatgcacaacaagttgaagtgcttatattgaaaaggaaaaagtacgaattacccctctaactatcgcggtcgtccaattcacccccctaaactcgagaaccggatatttaacaccccaaactcttaagaccggacaaattacccccctaacatggttcgaagcggttttcagtctacgtggcacacacgtggcgatacagtcagcaaaaacaaataaaaaaacagtggggcccacttgtcagctttttttctctcctccttctctgcctctctctcagtgagcagagagagcacgcggctacggcgaacacaacgcgctctgccttcgcctccaccgccgaccgcgcgaactcgctgcctccatcgccggtcgcccgagcttgctctgcgttcgctagcggacgtggttggacggccacgatgccgacgaccaggacgacggaccgttcgccgcctccaccgcgtcaacgagagaagcagagaagggaagggggaaacttgccggcttccccgacgacctctgcctcaccggctcacatggcgtgttgtgcgacgacgacgacgacgcgtcccacgtcatcggcatctcgctcggctacgtttccgacttctccgtcaacccgagcagcgtagcgccctccgcctccgcctccgccacgctcctcacgtccggcctcctcccgcctccttcccgcgcctacacagcctcttcgtctacgcgcggccgctcccgccgctcaagtggcggctccctcccacgctccaggacctcgtgctcgtcaacaaccccgcgctctccggccgcctcgccatctccgtcgcctgcctcccgctcctctgcaaacgtggtggtggagggcggagcttggtggcgagtggcggtgcgcatggctaggtcactccggccggcggcgagtagcggtgggcgcgatggccggggagggatgtgtggctccggttgaccgcgatgacggtcgatggggacgacgtggatgggtagcgaactcgtcaccgtagcgcaccacctccaatgccctcctcagcgccgcccaccatgccctccgtgccacgtgcgccgcttggctgcctgcctgagaaagagagagagagagagggggggaggccgtggatcccgttgacctctctccgccgcctccaacaccctcctggcctccttagcgccgcccgttgctgccgcgccctccccgcgttccgccgccggcccacgcgcgccaaccgcctatccgccccagcacaccgccgcccgccgcccatcgccggcccccgcgcgacaactgcccatccacccccgagcgtcgccgctcgccgtgcatatatgctctgagcccgagagagagagaggaaaaggaagaggaagaggggaagataagatatgacaggtgggtcccactatttttaaaaaataaaatgctgactggattgccacgtgtacgccacgtaggacaaaaccgctctagattcggttgagggggggtaatttgtccggtattgaaagttcagggtgagcaatgtttggttttcgagtttaggggcgtaaatcggacgaccatgatagttcaggggggtagttcgtactttttcctattgaaaatgaatatagttataacattgtaaggtttacatttttagcctggtctgatctgtttggatgtgtgctcaaggatgcactgatgagcttttcgcatgcttgtgtgatgcagtgtgtacagtatgtgcatatcttctggtttgttaaaaaaagaagtgctggtgaccacataattgggtgtttaatatagtccaaattttactgcttaaccaataaaactagatcccaacatatcagttataattttgtcaaaaagtagaatgtgattaagcagaaacaaccagacaagcactgaaattattttttctggaacactgttgaagcaacagatatatattaatttgtcatatcttttctccatcaaattagttgcgaaaatcaacagaacttttaggtttgacaatgcaacaattaattgtggtgaagattatcccatgcatgaagccatgaagggaaaacaatgtaatagagcacctaaattatgtgttattagcaatagctgccggtagatttccaggtaattaataattaaataaaaccaggctactaactctatatgataaaaataaggtagagctgtgcacatggcaagtactaataaagttgtactgacaaggatttggtgctacgaaatctagctggaggtgctacttaaaatagtaccacaccagatctcagctccttttgttattcgtataaacatttaatagcacaaataacacaaggaaatgcaacaactatgtgaccccttttggatcattgatatgagatcagcatagaaacttaattctttttttccgtttgatcagcatagaaactcccagatgcagacggatattaattaattgtagttgagattgataatggtgattgaatcaacatcatgcagctcagcaaacatccggcctctgtttccttatttttcttggcgaaatttaaattcaagatttgttcttctgatgctacaattttcttagttttagaatatcagagaatgcaaactgaggatgcatatataactgcattatgagaaccggagatgattagggcaccggcatcattcgtctttttaactagatagaatagtatatatgatacttttagttatcattatagaataaatttcacttcgggatatcttttatcatcaatatttcgctctaaaccaccctttaaccaatactttgaatcggataattttgtctttgttttattttggatcaccccgactcttttctcaaacatgagtacgccagctcctattcgtcaataaattccctcagtcgtatatgctcgtttctttgacgtatgacaaattgaatatggatggataaaattaagagttgatggtggtccaaagtaccacaagtgtaaaattactcggtccaaagtgaaaacgttagttggtgatccaaaatgaaataatgataataaaaggtgactcaaagtaaaattgactctttctactataattaaaaagagctagttttcatataaactgtggccccgttaaaacacatgaatttcacaaaaattcaaccttattttcagcagagtactggtcaaatctctacttcttaaaacggaatagcagtgatgataagtggtaaatctaccaccaaccctaccaactcgtttagtttgcggaaagaaatctatactccaaaatatagtagtggtaataatgagtgataaatctacaccatcacctcttacgattttgaaaagaaaaaaatagcagcgtggagagctagagcgccttgccaacttcactaattccctactttcttgaaaaataaaaggataatgtgagtccagagggccaacgtgccagtaaaaaaatatacataaattaaaaatggtatataagaaagagagaaataacaggttaatgacccgttgcaacaaattcaaggacaatatgctaataaaaaatatgttaaaaagtttgatgccagtcccactaatcacagtagcattagtcaaatatttccgactgtaggtagtatatactcgctccttcaaaaaaaaaatcaagttatggagtttgaattttgtccgataaaaaaccaaattctaccctcccacctattctcatcatgtaaaacgagaagttttattccttcaatacaatttacctacctattactcttactacttttttcaatgtttaaggacagtcattctcactctccactaatttttactctctactaatttctcctatgatgctaggaatggactttgtgggacggaaggagtactatggtgtcctaaatcagtccggtttctcataatgcagctaaccttagttaattagcattctgatattctaaaactagaaaattgtagcatcatcagaacgtacagatcttgaaattaaatttcgcgaacaattttctgcaggagttagatttttttttttgtctctgaacgacacagtacaaaacaattcattgactggcgcaagacacgaaaggtgatgaagtcctagagaaatatgcagggtaaaaaaaaagtactctgacaggagcgaaatcgacgagatgcacagagatccgacaaagcttgggagatcgatgtatatatgtttctttcacgatgcatcgtttcaggttattatcgtattggaagctttggaacagaagctgtaaattacggagaacgaggtcaacgaggtacactcctgtcttaatttgttgggcaacacaaatgcttcttgtttgtttggacttgatttgaatacaaaccagtaatataacaatgaactgttttgtattatgtcggtatcagttaattattgtgcttggacctcgagttagcactagtaattatcataatatttacaatcgaacaacctttatatttatttagtttgacccatgtggtcgtgtacaatcattaattttgtttcgaagcttaggttttaaaaatgattaatttggaccatataccaaggggcaagagccctttgaaaataaagaagttgagaatgcaaatgaattccaaaaatattacaaatgatggaataacatgtattgttcttttcttttgctcgagggatgactagcttgttcagtctaggggcggatccatggcccgacgatccaggtagttgttggatagtctcacattggttgtggaagggtaatggacctaatatataagtgagggagtctcttacctcattagctagcttttggggtgagaaaggctatttacgatattaaatttggtatcagagcctgactaggtcaacatttctgactcgagagacaaagtgtgtgaagctctaatggaccgtaggtgcctgagggacctgagggaccgtagggcgtgaatggttaagagacactaatgtgtgaatggggtgattgttgaatagtctcactattggttgtggaaggacaaataatgacttaatatataagtgggggacccttcacctcattggctagcttgactgtggggataacggtgaaggggcagtgaacggctgagagacaccaatgtgtgagggggagtttgttgaatagtcctatattggttgtggaagggcaagtgacctaatatataagtgaggagcccctcacctcattggctaactttttgagtgggaaataccatttacgatcctacaagaccggcggtaccatggcttttagaccggcaacaccattgcagttagaccgacagcgatgacagtaggaggtggtgacgcgactggttgggccggccgatctacaccggtcagaccaacagtacagggacggtcagaccggcgcataacctgcggttagaccgatctccaccgacttgaggataacttttaattctgctaaaagttccagtttttgggtacttcaatcattcaccctcatttggtggcttggttcttactattcgatcctatagtagtcgcttgggctcgccgacggattgcaccggatagctactaactctatagttcatatctaaaatctttttacacatgtgcttaaccaggctcttaaagatttctacatccaccgccggttcagtccttcatgacttccaaaccaaatagattgaggaaaatataagctttctatttactagcttcaaaagttgtgatcggaggtggttcacaacaaacaattcaataatttaggagagaacgcttctacaaaatcatggagagagttaaaatatgacttgttagattgagcctacgacatgacacctaaaaaatagttcagcgagatttactacgtgcaaaatgataaatcgggaaaaaaatccacattttttccctcagctatatggccttggtaatttttgtttctcaactataaacccggttgctatctatcctttaactcaacagttaacatttcattctttgccttgaaaaaggtagtttctgatgacgtgacatatcctagttaacaaattaaaataaaaaataataatatgtaggatatatgggtataggaggaaatggaggcgaggatgatatgcttgttctatattttgttattattttttattactgatcgatactcttttcatcctataaaaaaccaatctagtaccggataaaaacattctattactataattctagactaatgtatgtctataattctggactaaggaatgtctagatttatagtattaggatgtgtcatatccgataattgattttctaggtacgaaggaagtatgatagtgtcgacactctttatccatgtaagttcattgtagaggttaccttaccaaccacattagcttgaaccaagggatgtaatatgaaccatttaagagttgttggactaatagtgaaaaatggtttggttgtcgaggcaccaaaagctagactaaggatgcgttagaaatagcttattagcctagcttatttgctgtacgtaaaatgagaaagagaactagcgtataactaattaagtagtattaactatttataaattttaaaatgtatttatttgattttttaaataaacttctacataatttttttacgaagagtgcacgtttagctatttaaaagtgtgctcatgaaaaaacgatgaagtcgcacagcggaattgctgattcaaactcagccattaaatgccatagttaagtaagtcttgatttatctctttcaaaaatatccaaattcgtcagcaaaataattcttacttgaatttcatccaacaaactctttaattacgaatcctttttctcctagcttactactgtcatttaaattatacattatgctcattgtattgctacaaaatcttcagcaatgctgaaaaaaaatactttacttttctcgacacttaaggcttgacacatccaatgatccaaacgattttaagatatctttaggagtactattcgttatcttgagaagataagtaaatacatatacataaaattattcataaaaaaccaaatttcaaaactaaaaatcgctttgcggccccatcgtaagccaaacgacatatttacaaacgaaaaataatttgtgaataaaacttttatatacgtattcttagcgatctaaaaggaaagattgaaaaataaattttgataaaaaaaaccctaaaatcaactctaagtttaaggttaaaaaatctaaattttggcaaataagcataagcacaagaaaaaaagagcccttggattataaaaagaggggggtggctagctcgcgcgcacacgcgaggacgttaaggtgcgcgcatacggaccttcgctttagtagcgcttagcgcttttctcgaaagaaaacaatgcgcatgacgctacggtaaagtaaagtgattaacgaaaatgctacagtaatttatcaataaaaaaataaaaacaattgattttgaaattttgagttaaaagttttcaaatattgacttgaaaattttaaaaataagatttgaaagtttttgaattttgagttgaaagtttttgaattttgagttgaaagttttcgattttaatatgaaaagttttcaattttgagttgaaaatttttaaattttgagttgaaagttttcagatctcgagttaaaagtttcaaacctgagtcgaaacttttcaaatctgagtcaaaagttttcaaatctcaagttgaaagttttcaaatcggagttgaaagttttcaaatctgagttgaaagttttcaaatctaagttgaaaattttcaaaatttgacttcaaaatttaaatcttaagtcaaaagttttcaaatgtaatttaaaaattttctatctattagtaaaaaatctcaaagaaaaactttcattaattactatcattatccttaaacaattagttacgttaaacgcgcgctatgaaaaaaagaatctcgatcagcgctggcggcaccacgcatacgggccgtgtgggccggaagtgctcgcccacggcgcgtacgcgcgaattaggaatcctatcttactataaagttatcccccactaactccttaagcttaacatgcaaagatgccacatcatcatccactaacaagatgccacattatcatccactaattaacaagatgccacatcatcatccactaacaatcatcacatttaaacatcatgcaaacaagctatatctttatagtttttataatttaagagcgtttcaaatacaaatatgttaaattatcatccaacataattcacataatatttcaatgtatatctttattatgttttatgatatcctatatacctatatagttcatcctcacttagttagtgtttaaatgattaatctatggtctaaattattttttccttttattcttttaactaagttatatcacatcaattgtttttagcctttagatgattaatctacgatacaaactatctctctacttttcttctttcataaagtcacaccaccttactatttatgtttgaatcaccattctacatactatttaaattatccttaagcttaacatgcaaagatgccacatcatcatccactaacaatcatcacatttaaacatcatgcaaacatgctatatctttatagtttttatattttaagagcttttcaaatataaatatgttaaattattatccaacataattcacataatatttcaatgtatatctttattatgttttatgatatcctatatacttatatagttcatccttacttagttagtgtttaaatgattaatctatggtccaaattatttttccttttattcttctaactaagtcatatcacatcaattgtttttagcctttagatgattaatctacggtacaaactatctccctacttttcttttttcataaagtcataccaccttactatttatgtttgaatcaccattctacatactatttaaatttaaattatcataaaccacattaatttacttaatctgatgttatctagctatcttacatgttattattttattgttatcatactaaatttccgcagcaatgcgcggggtttcacctattcgtgtgaaaagagtgtcaaccactcctatctgcaatctcccaactccgtgggccaaggcctggcccatccaaacgagccttttgtgggccttctcgcagtccagccgggcagccggctaggcccgaatcgacgcgggcccaccaggtcgggcaaccaacggtgggggcccaccgccatccgaccgtttcgacggcttccccgtccgtaaccgctaacgccgttacgtctccgtttccgctccgtcaccccgtttcaccgctctccggacctccggtcaatcgcagtcaaaaggctccccgctcccccgtccccttccccctctcgccctctcctacccaacttctcgaactctccaaaccctagctttttcctcctccccctcctccgcgaatcttccatgcccgacggctatccggcggcgccgcccgggatggagcgccctgccccggaggcggcggctgcggcggcggagccccctggggcgaaggcggaggaggaggaggaggggccgaaggatgtgggggtgaagggtacggggaaggagaaggagacagagaaggttgaggccgagaaggagatggaggggaaggggaaggggaaggagtcgatggaggtggaggaggggaaggagaaggagggtaaggggaaggcgaaggagaaggagaaggagacgaaggtgaaggtgaaggaggagggtggggaagagaaggagaaggggaaggttgaggtggtggaggcaaagcggcggccggctggtgttggcgcggagacacccatcctagcggtgccgatggtggccgtgccatgcttcttggcgtctcctgcatttgcggtgagtggtgccatttctctttgtcactaactaggggcattttgttttaaggcgagggagagatccatgggcggagaatattagggttttgatgggttgggttcacctcggtcaggttatccgtggcatgttagtgatgattttattctggtcactagttagcccatcataactgcagctaaattgtagcgtgatgccatttctatgatacgaatcgctagaaatgggcaggtttgcaatgccgtatcccctctgtctgtttgtgatagattttgggaggccacctgcattggatttaggatattcttgatactctctatctgaagcaagcttagttgatggtaactgtgggaaattatgcactgctattgtggggggatatggtgtaacgttgttttattgaaaaataacttcctacatataattgaacaacatttacaagactgatttccattatatatatatatatatatatatattttttttttcatcatactgcctaatataatgctgtgtgatgtaatggaacatgaaattccattgaattggcataagtttacatgttaaggtatgattgaacaaattaatattgtactagtagctattctgtttatttaacactatgttatgctatctgcatgctatcttgttagtctttagttgaacacagataataaaacttgaatatagtccaatgagaatcccgtcaaatcccgtcaaacttgaatatagtccatatcaacaaagttcagattatctctcttttaactcgacatatgttctgtattttactttggtggttttcttacatgtgtgcaaataatcattatggaaactagggtcacttttcaatgagccatcaagcagctttggcgagtgtgacggctcaggcacaaatacaattgcagtcaccaaccacaccatattcagaagggctgcccagtccatttcctataacacctaaagctgtaatgcccctgcagcgatcaccttcaggaactgaagggagtgttcgcagatcagtgttagagaagtcagcctcatttcagtcaagaccacacaatcatgtgtctgtaaacatggttggtgatggcttcaactggaggaagtatggtcagaagcaagtgaaaagtagtgaaaattccaggagttactatagatgtaccaactctaattgcttggctaaaaagaaggtcgagcattgtcctgatggccgcgtggtggaaatcatttacagaggaacacataatcatgaaccgccacaaaagaccagatttgtgaaagagagagtggctcatattactgcttcctctggagatgatgaaaccttgggacttgtgaacaatgaaattatagaatccccgtcaccgggatgtaaattagagccgggtgctgtctctgaagcttctgaacagcagcttttttgctcaagtgattgtgaaggtgatgctggtaacaaatcagaagatgatcatcctagcacagagcctcagccaaaacgaaggtgaattgtagtactaggctaatttattcatattttgtcattgagttgtccctaactttgttttctacatcttattgttctatcagcagaataattgaaactagcacacctttgactccagttctcagaactgttagagagcaaaagattattgtacaggctggaaagacgagtgatgggtatagatggcgcaaatatggacagaaaattgttaagggaaatccaaaccctaggtatgaattggtatctcgtccaattgatcattcatgctgcatctttttcgttaatttgaatgttgcttctgtttttattatttgagtaccctccaattcaagtacaacagtctagagcaaatttataaattgttcactttgccttcaaataggattaattgcctaaacccacttgccatattgattgtcttgttatttctgaggatcttagcacatattcctccactgaggagtcatacctatttttcacttgctagttttttttggttattatctcctgtgatatgttattattgttattggttttttttctttttgttgttatatagtatattattagtactactagtagaggcatgcgaagaaatttgagaaaatagaaggaaggaaaaaagagaaggaaaaagaaaaggaagaggagaaaaatggaaataataatgcaaagagttaattgcatattggaccggctttctttatcatggttgcaacttgagcaagaaatgctattgttttcactttgggctagtaatttttacaaaatgttgcacttaggacctagtgttcttcttccagctctgctccctcactctctctaccttcagtttgagattcacatgcctggctgtagttggttccggtagagatggagctcaagctccgccagtacagtatatgctcgagctctactcagccttcgccacccctgccacacccacattcattcgtgctcaagatttgatgtgcattgttgattaagtgccctagccccaatcaagctagtgcagccatagatgaacttaggctagaatgggcctattgactagttggtggagcagaagtgtggagtgataaacacatggtgttagaatttcccaccgtgtcaccgtgattcattggatatgcgcttgagctcaagctagagctccgtcgtgcgccgtgtcgagctcaagccggagactaccacacactcaagctcaggcgctaacgtaggtcaagcacgtggatgggaccaaaacagaggaagaagaagagaagagtggtgagcttgaaccaaaacaggggagagagaagagaagaggagatccagaggaagaagaagaccggtccaatatgaaagtttttgcaaagatttcttgttccaacttgcaacaatggtcaataagagtggcccagtatgcaatttactaacgcaaaatacatttccccccttcctgctgcactgtagcgggaagggggttaaatgcattttgctgccacggtgtgctgcagagagccaaatgcaaaatgcttgccagcgtggagggcctcattgcctagtcctacattttggtgtgatgcacgattgcacacgtgcaccaaacaagggcattttggtcataacttccaaacaaatctcacctagttctatatcctacctccatacttgatctcgctagtgtcagtgtcatgcactgagttatcacaacaatgcccagtgcaccagagtgaccattctattgatggaaaaacagtgcgccgccagatctgatcctgtaaaatgtgatcctatatactgctctgcttccaatctatcatctccactcggccctgttcgtttctcctactagtagaggataaaattttggattatcgtggcacgcttttcaaactactaaacgatgcgtttcgtgcgaaaattttctatatgaaagttgttctaaaatatcagattagtccatttttgaagtttgtaataattaaaacttaattaatcacatgttattaccacctcgttttgcgtaaaacacttaatctctatcttcatcttcatcttcaggagattcaaacaccacctgaatgttgttgacaccagtcacaatttcacgctcaccttcatcactttacctgtgttttcataaatagatagccttcatatattttgtgtgttatgaagcattatctttctggacaaattttgctacagccatgctgcaatgaattctacttgcatagcgcaactagttgcacaaatatagtagttacaagataatgaaggtacaggttaataccacttttatctatttacttaagaaattactgtaaaatctctatgcaacaaaacctcgttaagcttgcataaatcaatttaggtctaatgctcacatgaaataaaattgattttttttttggtccttgcatcctattttccaagcttgtcaattctattccagaggtcattctggtttgctcttggatggaacattctgataacagctgatacatgtgtactgtttaataaaataacataagtttattattccaatcatacgtgtttaattgtggatatataatattccaatgaatataagtttaagaatgcatttatattataatttagattttagaagcaagtttaagtgatgcggttattaggttgtgtatttagagtgcttttgagctgaggctggagtgaagatggaatgcgatgtatgctagtcatgtacttggggtgacggcaaagttagagttgcatagtttctaaattttcactcaacgctatgtttgaagcatgtagtcctaggggcattctcatttttgcgatgtctaccagcaaataacacaaattttgagtcatgtagcaaattttgctgcgaaacaaggcaaatggtaactcaaattttggtcggtatcagtatcgccagaatggtgctggaattgataggcttttcttttctgagaaaagatagcctattattttttttaaccagacgtcctgttttgcactgtacaatttctattagtggtaggcttgctgttcttttacactgaaaaagaagttcatttcattcttttttctggtagtgtgtacaacaagttaatatgagtgattaaccaagcaggagctactgcattttttataagttcttattaatttcttttgttctatacaggagctactaccgttgtactcatgatgggtgccctgtccgtaagcatgttgagaaggcaccagacgatgataacaatattgttgtgacctatgaaggtaagcacaaccatgatcaaccgtttagaaacaacagtgagtcgaaggatgggcctgttcctatgatcattccagcagagacaacatctgagcagcccagcacaatgacctcaacatcagaacagaaacagccgatcagtctgctgaaggatggcggcgatgagcccatgaagggcaagacttcagaaatcggtggtgagaaggcagtggagtctgcgcaaacccttatcagcattaaaactaatcccgatgacatgaagaataccctcttgaaagatacttccgcggtagttcctgtccaaaataattgatcctgtgaggttagggttgattcgattaatgtattagtttgtggtatttattggttcggggagctattgttgtgttagattctgtacatgagttgagggccggcattctgtggagcaccattggatagaagcatctaggctcgggaagccatgatacttacagttgtcccccttgtatagatctccaaacccctagtgtgtataggtactgtatcgcttactgaggctaagcaacaaggagacctgagaaacttcatgtgtggggtgctctgcttggattcattgcacatctaagccgatccatgccatgatatgtttattgtatctggtgttatatcataaaaacgtgcaaggtgtatgccatttccattctataaacagagtaacacaggctgcatcgcttgtctgctcggtgagcagtagacaaggtgagtttgggcatttcatgcggttgtatgtggaacatttgtagctgaactgaacgactacaagacacattgaatcagagccaggcaaggagcttttgctgctcacttgctcaggcgagctcactgtaaccgtgcagatctatgtacagtgcaacaagaagatgatggtcttcatcatgtttgagccaatgcaacgcttggggcggccttgaactccttcaccgccttcttgacggcctcgacgtcgatgtcgatcagcttcccggtctccgacgcgacgacggtgcagcccttcttctcctccaagtacggcaggaacagcctcgccttctccttggatgagaagagagccacgctgcaaagattcaggaaaacatcaatgccatgagcagttcatcctctgaaataataaccattccaaaatctggagatgcagatcgcagctcagttgatctaaccatggcttgtccctggcgttggcgagctggacggcggcggtgttggtcgcgacgacgccgacggagtcgttgatgaggcaggtgagcttatcatggatcacaaaaagaaaacactcagtaataaagaattgtaatgttacctgtgaaagatgatctaaggtgttttcagattgcaaagtgattgtaatgaagaagcatcaaagaacctacttggccaggagtggtgatgaacaggatattggtgtccttccccacagtctcctcaacctcttccctgtgcttctgatgagggatcacaaacagaggcttcagaccattgtcttcagagctgccaagacaccaccatttttttggctttagttctaccttctcacaatcggtaccaagctggaaatgtaagtgtaagagcagccgtgcttgagtgagtgagtgaggtgaggtgaaaaacctgatctccttggcgatctcagcccaatgctcgagagggaggaggcagtcatcgtcccccctcgacctcatgttggcgaaggagtcggaggcgatgccgtggacgacgacgaacttgcccttctcgacgccggcacggctatatttgtcctccacgaacgctcggagcttcttggagatggacacccgcaacggcggtaccgggtgctccggcacacccttcgctggccgcccaatccactccaacatgtcctgatacctaatccatccagttgcacactcttcgaaatcagaaagcattttgcaagaattttataggattttgacggtaattggttcaactcttctacaagaataattgagcaagattcctaagttgcaaaagaagagctaggcaatatctgctttactataagggttataactctgcctctgcttgtttgtcttattagccgcaaccaaatattaaattttaaaatttaattttagatttgattttgagttttccttatcatagtttatttctcaatattgacttttgaaccattaagaacagttaaaagttttgccaacaaatcatattcggttgcctagttcattttgttatggcttttcaacctaaatcaaaggcaaaagatgagacagttgcccctatataaattaaatgcaactatacagcacaagaatgccaaagcagtaactttttcggatgaggaaattataacagttatgaaccaaggggaggcgaaaccgcggagaagaggaggatgatgatcttacatgttgtagccgctgtcggcgaggttggtggtcggcggccggaacatctcggtgaggaacagcccggcgccggcgctgttgacgttggggtaaacatagccgaccttgtcgcgggccgacgacatgaagaggaagagcgcgtgccctatcccggccaacttggtcgatatgatcagatcatagtacctgttctgccaacctcaacacaaaatcaagcttcagttggttgaatctttcatgataaatataatctaatcaaaatactgagcatatgtggtggggaagcaacataattaagcaggtttatctgatattattatgtttagagaatcacaataaattttgaacaaattcagcgcatatatcgaaccggctcgagatgtgcaactccaatggtttgtttgaaatttgtcgaaattaatgaaaaaccgattactcactatggctcgaaagtcgaaatctgctgaccattagagaatgtaaacctgggctgggcatgacacttctgaaggagagagaattctaatctctcgagaggatatcttctcgtgtaatttttattttctaaattcaatgtaattggttgtgaaaaattctaaaaaaaaatgacaatgcataataacatctattactccataaaaacatatttaaattcgatctatgctttgaggaaacaaaagacgaattcagacatgacactactcatatgttggatttttttttaattatttctcaatgtgtgagttgaattttgacttgatttttttttgagtactttacacgtacggtgtgtatgttgtcaattttgaaagaattcttaacaattatttagatgaagtttgaataaacgagtggacataatcccttctcgatcgagtttaaaacatatacatccccactttgagtgactatttctgtacgtagcagtgacataatttttggtttaccttgagcacgccgagctggtgggtgtactcggcgggctcgggccagtcgtcgtcggggtcgtagacgtcggcgtacctgacgttcttgcacatctcgtacacctgcttccccctcgccgacgccaccacgtccaccaccaccccggggtacctgtcccgcagcagctgcaccaccgggaagaagagcacgttctcgtacaccccgccggacaccacgcagcacgcccgccgcacgtcgcgccgcaccttggatgccaggctatccagctccgggttgtaccccgccgggaaccgcaggaacccgtacgggttcgccgggtcctccggcggccgcgggtcctcctcctgcttcccccccgagaacgcgccgcggtagtcgaactcgtcgtcgggcccgtcgtcgaacgggtccagccacgggttcttcttcttcgccgacgcccgcgccacgcccgcgccgccgcgccgccctagctgcagcaggtggcagcagcattgcctcgctatcggcagcgacggcggtgaggggagcttcgccggcgtggccatggacgtcgacatggttggcgtctgcatgcttgttgcagagtgagtgtgctgatgagttgctttggatattgctattgtttttatttatttatttctatgttttttgttttttggtgtgtggaggaggggtttggatgtggtgggttagggatgtgtggaggaggaaggataaagtgcacgatgatggtgccaattggtcctgttttcttgtgccaccattcctcgatctcctttaatttggttcatcctttttgttgatgtggcagctggcaaaatccctccgaaaattcttttggagtttggattatacttgtgagtttctacaaggatctttcagaatggagtaattgtagaagatttatctttatgacagctgaactaatcctatcttactataaaattaccccccactaactcatttaagcttaacatgcaaagatgccacatcattatccactaattaaccagatgccacatcatcatccactaacgatcatcacatttaaacatcatgcaaacatgttatattatctataattttatagtttttataatttaagagcttttaaaatacaagcatgttaaattatcatcccacataattcacacaatgtttcaatgtatatctatattttataaaatcctactccatccgtttcacaatgtaagtcattatagcatttcccacattcatattgatgttatgacttacattgtgaaacggaggaagtacatacttatatagttcatcctcacttagttagtgcttaaatgattaatctatggtccaaattatatttctccttttttcctctaattaagtcatatcacatcaattgtttttagcctttaaatgattaatctacggtccaaactaccctacttttcttcttccataaagtcataccaccttactttttacgtttgaatcaccattctacatactatttaaatttaaattatcataaatcacattaatttacttaatttgatgttatctagctatctgtcggagatatgggcccgggggtatgtaaagtgaggggaatttaccttcccatccagctacgtggccctgcagcctggccctacccccgcacctcgcgaatcgcagaagcggccggggggcctcagggtgccacgtcatgcccctcgggccctcgcgctgccctgccccgaggacctcgcccgactgccatgtggcagggggagcgagcggggaggggacccaggctgaaccgctatcaatgcgcgcggcgccccaactgcccctcaccgcatttaatgcggtaggggcagacatgcggtgccgtccgactgacgcacgtcagtcaggactaaccagtctgtcaccggcctgttgccggtcacgtctgactggacgggcggccgtgcccccacgtcgcctttttctccagcggagtggaggtaggtgtgtcctgtcacatcggagcgtcatccggagttctcccgacatgaggaggacggccaaaggtctctgcccatttataagggaatgacagggctgtcccccgtgttaggaagggggcggcgctgggtcccactcaaggacgggccgctgcttagcttccgggtgaaggcacagatcgtggcccggtcaaggtaaagtgggtccccctcccatgaaagagtaggtagaggcgatgcatgtggtatccccttgaactataaaaggaggaccttgcccaccgagaaaagggacgactctcagtaagcctaaactctagaataagaagagcgagagccctctccggagtttaggggcccttgtagcactcaaccataatcccacacacaggagtagggtgttacgctccatagcggcccaaacctgtataatcttggtgcccgcacgcgatttagtagcattcagggcggatacgtgatttctaaaggcgagctctttccctcggccgaactcacaaaaggggatctcacgatctcccgctagagaggatcactcctcgacactatcttacacattattttttcattgttatcatactaaattcctgcagcaatgcgcagggtttcagctagttctttataataatttgccttccaagggattctcactgaagcaagcccattttagaagctaagggaggtaacgtaagccatacaaagataatatagtgcatagctttttggagttaggtgaattctaagagcaaggacaataatatagggcctagtttagttctcaactttttcttcaaacttccaacttttccatcacatcaaaactttcctacatatacgaacttccaactgttccgtcacatcattctaatttcaatcaaacttccaattttggtgtgaactaaacatagatgtctatttatagtaatttttatccaactataaataaccttgtagccaataaacacaacaactaactatactactatggctcacactttgcatgaaaaaatattttaatctcccacgatggtcccttcccaggagcttgatgaaaaaaaggaaggttgggccccatagtgttgcttactttttcttgggacaagcatatagcttgtttctctaacctcgtcttctttctcttccacctaggtaggcaataatttgatgtggagaccactatcatccgctgatataggtttattgtacctgctcttacgtagtatgataatataggatctgttcagttgtctgtgctagattgtttcatactgtggatatagatatagcatgtctagttgttactcagataaaactaacgatatatgcctttcaatattcttaagataataaaaattcattctgatatttgttccaaaaaaagctacaccaaattattatagaggttactagataaaaacgactgcgagttaccaaatcttaacttgattaaaaagaacacttaaaacaccatctcaaagacaaagattttcatatgtggttagtgagaatctatgtaaccatgcgcataaccatagtttcttcacaatggcttatccttgttttcattaaactaaaaatatagtcttcaaaatcagcggccgatcactgtgttaatcaaattgcacacacatcatcatcagtgaactgaaacgaaccaaagtgcaaaataatgttggcccagataattgcaaatcgatccaacaaaaacacatctaccaagcacgccatatcaacatggagcctccgatacgacatctaggacgttttcattgctattctagccttatggaactaagttttcaatcaaagattatacttcgaagcacaaagatgaggaagggggcgtcaacgacattgccttcaatgcaagaagctatgtggcgtccacaggtgtcactgacatcaatgctctcctagtccaagatttgcattgatatgagctcaacctcctcctcagtgttgagcggcaacaacgatagtgagggaggtggttggccatgggaaggaagggggtgaggcatgcactctggtggcaccctgtcacaccatgagagtccgatgaagctattgataagatgaaggcatctcgtagccctagcaacaactctgatggtgacaaaaatagcacggttttatatatagatcaccggaagccaaatccagctagaccccaccactaccttcctcaagggtcaccatttctaacgttccccttcagcgatggtgaggaacgggaatcgccttgcttacatgattggtgacgcagaaggtggtattatttaccaacacacaatttctaacatttcaagtattatttaccaacacacaattctaacatttcaagtctcgtatgaatcaaaccacaataacaacttgattgaataaaagtagatgaaacatgtatgagcaatagtgcctcaaatctcacatattaaatgcactgataatctaagtcaaagcatgggagtgctaagtgctaagataacaaacttagagcaagtttaatagtatagccaactactagctccaatttatctatagccaatctaatagctcatttatataatagttacatactatactattattactccaatttacatgactttggtagtatacaagaaataaataaaaattaaacttaggtgcaccagccactgctgagttgcaaaaactggactcacgtgtcatccagtgaaaacatcaattcgcggactacaccacccccggacgcagtggagcatcgccgatcgccaccgacagatcttagctccatttcctcaagatacgaaacctcctacccttatctcactgactagtgggcccacgcagcatgatggtccacacgtcagtgggtgtgaaaggatacttttcccaccaccgcaacaccatcaccaaccagcctttttttcttcctcctctctgtggccgcgcacctaaccgttctcactgacgtgtgggacatgacgggcttggtggggcccacctgcctgaatttggcatgaacgcaagcaaagccccccacccacgtcgttgcgacgttcccgtctgtcttgctacacacaccaagacaaagtttacccgcaccaaacagccactcactgacatgtgggccgaccggggtgcccctctggtggaccccataggtcagccagatgtaggctctgccggattcgatttacagatgcttggtgcacccactgacacgagggcccgcacgcccgcgaaaaataccggtagaaggaagcatttccagacgcggcacggtacgtgcacagatagttcgccgacgagatgcacaaagaactcactgacatgtgggcccagatagccggtaagctcaaggtggacccacatctcagtgtgcgcgtagtggagtggctcacgtgcgcggagcgaggcgtggtttgacccctctcgtctcgctcgtcgcggccacctctctttctctctctctccattaaaacagcacctcgtcgcaacggaaaagcgcaatctcgtctcgccattctctctctcacacacacacctcgcgtcgcctccctccccgagcgagcgagcgagcgtgcgcgtgcctacgccctcctctctaccgccatggcgatctcgccggtggcggcgatggcgctggccatcgccctcgcggcgctctgcctcgcggggctggccgccgggttctacctcccaggcgtcgcgcccaacaacttcgacaaggtgtgcccactccttcctctactctcccctttatcctctttcacggcatgatctctccgctgcgtttgttttttttttgtcggatctggggttggggtggccagatctacggcccgcgctgttgcgcccgccgcgagatctgggtgtcggtggtggtggcatgtactagggggggggggggtagattaggatgcgagatcgtgcgccaatgcaggtggtgttgggaatgtatgtctggatgctgagaaacccacgctgaaatcatgttccgcgttcagagtgcgttgaatgaaaccgtgtgcgtagggagacgcgctgatcaatgtgcgcggtttgctgcatcaacaaatacctgtaaggtggcatcgtagtatgagcttgttgggtattgatgcttaattgcggttgctatcggtcatggtaggttattaagtgatgtgtagttttggaagatatgattggacattttggggctgtaaacctgggtagtacatgtccaaacaaaacttagtttttcccaattggggtcccaacttgttttaccatgtgacaaacaatagtttaggtcgtatgtttttaattgttcaccttccaaaaaaaatggttatactttttttagttgattccgtttctatgtttgtgctagttattaacatctgactgtctttgtagtagtcatgctcatagatgaaacgaagggtttaacgctttcagtatgcatcaatatgagactaccggacaaattacttgctatttctaactatagtgatatttctttgtttacagaaagatcctcttcaagtgaaagtcaacaaattgacatcaatcaagacccagcttccctactcttatgtcgacagtgctcaaaatctcggtgaagttcttcgtggtgatcgaatcgagaactctccatacacggtttgttactctatcgcgttttctttgattatttcttgatatattggtcctaaggttaatattttaacttctattctttccagtttgaaatgagagagcctcaaatgctgtcaaatagtctgcaagatttctgtcggggagaaagaagcaaagattctcaaggaaaagattgaagatgagtaccgtgtgaacatgcaagctagtgtaacttggtttcttgattctaagagcttattcatggctgccaaatattctaaacattcattttctcaacatgattcttgacaacttacctctagttgttccaattaaaagaatggaccaagaaggtgcatatttctatcagcatgtcttccatgttggagccaaaggacaatatgcaagggtaagtgtaactttgagtattgatcacatgctatgaaaatgcaaagttcttatatcgtgcactttcttccctttttctgtttgtacttggcagagcaaggatgaaaagagcttcattcacaaccatttatcatttactgtgaagtatcacagggatgcccaaaggatgtttctaggatagttgcatttgaagtgaaaccatacagttatgctgcatgtgatttattaaacaagtaggcctttgaagtatttggatgttgactgtccttcctgctgttaaatttacactaaaaactatgacatatgctgcagcgttaaacatgaatacgaaggacagtggaatgacaagaagacccgcctgaccacttgtgatcctcatgcaaaacatataattacatcatctgattctccccaggaggttgaagttggcaaagacataatatttacttatgatgtggatttcaaggtgagatatatgtgcacttttttccgatcgttctgctctaatgaaatgatcgcagtagctagaaattgttcagtgtgcactagatggagtgctaatattttgttaccatctatgcgtccttttgactattctgtcaatttgcaggagagtgatatcaagtgggcatctcgctggctgggatacctatctactgatgacggatgaccaaatccactggttttccattgtgaattccctcatgattatcctcttcctttctggaatggttgcaatgatcatgctccgaaccctttaccgggatatctccaagtataaccagcttgggactcaggaagaagcccaacaagaaacaagatggaagcttgtccatggtgatgttt

SEQ ID NO: 74282 - DNA, 1752 bp, Oryza sativa
aaataaaaaataatataccaccatccgcaggaggtgaaaagcggcaaaccaataccaaccacatagacaccaaactttatttgcaggaacaatataggtttcggcaggagcatcggtcgaaagggagtgccacataccataccacattgtttgcacggtctcggccgaagctcctatctcacccttgcccgtgaggggcttgttggaggtatggcatgaggcccttcgaacaaacctaccgaaaccatacgactagtgaggattcaagcccgagacgtcaaggttagtcaaggcgaagcccccccatggcgaagactatggaacaaggacggcgagaggcggggaatcgcgcgggtacctcgccaagccagaggcctcttgggcaaaggatgtagggcgaagagtatatgccgaagggagacgacttcgctgtagcaagttcagccccgcgaggatcgaagaagccatcctggcccatcaagcctaggggctattgggccgacgatcgcctgacggcccattaggagcccatgaacctcaattacactgtatacccatgtaaatgtccctttcataagggcaaccatataaattcccctggataaccaaagccctagtagtaagaacctgtaatgaggctataaatagtctcatagagccatgtaatacggggggatcataagaaaaattctcaatttaatacactttacttcttttccaactactgttgagtaaccacgtctttcaacgtatgcagttgtcgtttcgataacatacgcaatttcgcagaaggtcatcgatccggatagattagaagcccttcagaatgatgtggtgcaatgtcttgtcagttttgagttgatatttccacctttatttttcaatatataatgacgtatctgctttgtcaccttgtcaaagagatcggtattctcgggcctgtgtatctacacaacatgtttcctttcgagaggtacatgggtgttctgaagaagtatgttcgtaaccgtgctcatccagaggcaagcatcgccaaggggtatggaacagaggagatcattgaattctgcgtacaatttattgaagaccttcgcccaatcgggatacctgaatcacgccatgaagggagactacggggaaaggggactctcggaaggaaagccactacaagaaaaatactttgtagagacatttttctagtactatagagacacttttcaaatgcctttacaatacaatagaggcattttaaaaaatgtctaataagtaccttatggtgaattgtctctacaaacgaagaggcattttatataatgtctataaggtggtagaggcattttctagagacattaaattgtaccacaaccatatgaaaccaatgtaaaaatgagaataaaatattttcccttgtttctgtcaatccttgaattcatgatcttttgaacaaatcattcttatgttcaaggcactaaccaactcaatcccatgtcattcattatatatgtttatgccttaagttacttatatttagccatttagtatacttttattgtaagaagtgtctctacagagtttaaagtgtctcaagcaaatgtctttacatgttagacacattttaaagtgccgaaagaatgcctctacaagataaaatctaataaaatgtgctgaaaatatttctaaagtgtctctagagtaaaaattttctatacaattttgaaagtgtctctacgctataaaactcctgatcttaga

SEQ ID NO: 74283 - DNA, 4068 bp, Oryza sativa
tcatagaagttaagtaaaagtcgatggtatattatagaacgtgacaaagtcagtggcaaatcgtagagctatgacaaactcagtggcatataatggattgtctctttttttaattattgagatgatatataagaaacgagaggatatcaatgtcatctccagtgatgaaaacactttccaaaaaaattgaaggcaaaccaatcttcttcttcttttttaattgcaagcgctagacgatggcttgaaaactccaagcccctaacccaatttcataggcccagttgaagcccgaagacatgattaggtaggaatgatgaacttattccatccaactatccaagcaaatgatggccgacgactcgacaacaaactgctcttcaacaaacgggctgaaatcagttctattgaagtggacttctgtttcgtggtagaaagaattgaacacaaactacttaaaatcagagttatatgtatgccccaagatcacattgcagtcttgcagacacatttacaaattgcctctcatgattcggcaatttgcattactgaagaacaatcttaaactgtcgattctaggacaagattgagagagtttgttgtgacacccagaataccaataagcgaagcggcatatttgcaaactaaaaataatttatgaataaaaccttttatatacgtgttcttagcgatctgaaagtaaaggctgaaaaataaacttcgatggaaaaaaaccataaaattaactccaaatttaagattgaaaattcaaatttttactgataagtataagtataaggaaaagatgaggctcgtaatctcgtactgttttgatgtactttagctgagagaattattaattgatgtacatgcagagtgattttatcgatccccttaagaattattacttgctgtaccagattttgtagtatagaatttagtgactctaatttcaaaataaaaaaaggaatcatatctcttcaaagacaataaaattcctcaagcatataatacgtgacaccaagtaactgaggatgttgcaacaccgtagcatatactgcacgggtgcatcctctttatatgctaaaacactgtatgcatgtgacaacatgtcttattttttcttcgggcaaggcgaagagacgccagccaaatttattagtatcttttaaaaatttcacaaagctacatatattttagtcaaattatcacaaaactacatatttaaggtgtaatattgtaaaactatagattttataacgaagttatcacgaaactatatattttagagtttaaatccttagcactagtgttatatttgagttataaacgtttaagttttgtgattggagactgcacgctatgatcggcaaaaatgcctgcctctagccaaacttttcattctgcggcaatgacccgtatcactttttttttttaaacacatcaactttattaagcaagaacagagttaggggataaaccccattacatatccaagcaaaagagccatccctaagaaaggagggttaactgaactacgaaagcaaccttcctgaaataacctaacatcagaaaaatgacccgtatcactttgtgcgacggttgccatactgccttagaagattccgtcgttcctctccatccacagcatccaaaccactacatatcgtcatcgaaagaacggcggtcagctttgcacatcattttacagcacgtacgagctccaccaaatctaaaagtccaaggcaccggttaggtcaaagatgatacttcctccgtttcacaatataagtcattctagtatttcccatatttatattaatgttaagatagataacatcaatatgaatgtgggaaatgctagaataacatcaatatgaatgtgggaaatgatagaatgacttacattgtgaaacggagacagtactaaatatccttccctttttatatgaagttggctagattaaaattgaactaaccaacgtcatatttggataggagattaggagtagatctccggtaatgacataataacaacatatatatatatatatatatatatatagtaaatttgtttggtgctccatggtgcccgggcaccattgttgaaattgagtatatacccaattcaaatgagtatgaaactttttcaattacctaggtattaacattaactactttactaactagtttaaagcaagtttgaactgaatttgaacttgtttttgttagattttgattctaggtatatagcatccatacatataattagttaggtatgtaatcatgtattgtgaaataaagttaaatttgagttgttttgttgataagtataggtatgaatcaaattattataactaggtatatactcacaatttgaaaattttaaaaaatttgagtgattttgtgcattagataccatggtgccccatatgagtggcctatatatatatatatatatatatcatcgtcatcattattatgggcatcatatcatcatcatcattgttatcctcatcatcttattatgcaatcttgctatactgtttcagcagttaatttcataatttgctgtgctgctgaaacattattttaatttgtggtgattaaacaaattaggttttagatgtagccgccattgacacgaatgacttggccgttgatccacccggcggcgtcggtgcagaggaagcccaccaccggcgccacgtccatcggctcgccgatccgccccatcgggcactcgccggcgacggcagcgacgcgctcctcgctcttgccggcgtagaacatcggcgtcgcgaccggccccggcgccacgctgttcgccgtgatccccgtcccggcgagctccttggccagcaccttcgtcatcgcctccaccgccgccttcgtcgccacgtacgcgccgtacccgggccggagggaccccacgttggacgacgagaaggtgacgacgcgcccgccgccgccgcgcgccagccgccgcgccgcctcgcggcagcacaggaacgtgccgcgcgcgttcacggcgaacgcgcggtcccactgctccggcgacgtgtccgcgatgcgcgggtacgcgccgtcctgcacgccggcggcggccaccaggacgtgcaggtccgggccgaacgcctcccgcgccgcgtcgaacaggcgcgacacctgcgcgtggtccgacacgtccgcggccaccgcgacggcgcgcggcgccgtcgcggagtcgttgagcgacgcgacgagctgctcggcgggggctgggtcgccgacgtagccgaccacgacgcgggctccgagggacacgaggtgcgcggtgaccgcggcgccaatgccgccggcgccgcccgtgacgatagctacccggcggtgaagcggccgatggccgggaaaattgggggaggagccattgacgccggtgaacggtggtggcacctgtgggtttctcaccagagagttccaatcacttcccatggctttcacatgcactaataatcactacaaacaatcgattagcctctatcacttgttatatatatacttcttccgtttcacaatataaatacatacagtatataaaagaacaaaaactactgtcgatagaaaatagtgagaaaatttccgatttttcagtcatcggatgccctttgagattcatgctcgtgcagattctttttccaagttgttgaatgtactttgagatccattgctagcacaaagagagaaaaggagcattaaactcgtgtgtttttttaaaaaaaaatacagtacatgcagatgcagatttttttttgaagttattgaatgtactttgagattcattctagcacgaagacaggaaataagcatcaaactatagtacatgctcgtgagattttttttttcagatgttgaatgtactttgagattcatgctagcacgacgacaagaaaggagcatcaaactcgtgacgagtttttttaaaaaatatatatatagcacatgctcgtgcagattttttttcagatgttgaatgtactttgagattcatgctagcatgacgacaggaaaggagcaccaaactcgtgacga

SEQ ID NO: 74284 - DNA, 5039 bp, Oryza sativa
atatatatatatatatatatgtatatatatatacatgtatatatatatatatatacatgtatatatatatatatatatatatatatatatatatgttacttcgcatttatcctaatacattttttttatcttgtagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttaacatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaaaacaagggcacgcggagatcatgagagctttgtcccagattctgagaaagagatgctgtggaccacaatgctcgagacattcaccctttctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcacgatgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttgaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctcttccggcaccttcaaagtcaagggcccccccagctccaccgcttgcccacataagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctacagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctagaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggtttttgaacttatagacaggtaccgtcataagttcctttgttaattaagaaaatcttgttatgttaattgctactacgaatcatagctttaaactccatgtagggcttggtatcggttctgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtaaattctactacgacggaaacacaattcaccggtccttagcttctgagctagcagcgagtactactacgtcgaaaccgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatatgtatgcatatatatgtattgaaacatatatatgcatggtttatatatatatatatatatatatatatatatatataatatatatatatatatataaaccatgctgcaacaggggcatgcaaaaaaaaaaggtcagctctatttttagtccccgattggtactcccggtttggaaaccggactaaaggggggtgacgaactgggactacaaagggtttctccaccagtgtggacaggaggggaggggtatacgggctctcttttcaatttttttaatccttt

SEQ ID NO: 74285 - DNA, 14449 bp, Oryza sativa
taaaattttgacagatataattatagtgcaattatagtgtaattacactgtaacttatatgtaattacactgtaacttgcatgtaactacagtgtaacttatatgtaagtttcacataattttgaatcgttagatctattacaagatttgttttagtgaggaagaaaacaaatcatagcacacacatatgtgaaagaatttgttcccacgacctccaatttaccgaaataacatgttacggagagatttttgaaagttacatacaagttacattatagttacagtgtaattacatgcaagttacagtgtaattacactatgattgtactgtaattacatctatcaaatttttgggggaaaatttgtcgacaaatatatagaaaaatcgttggttggtgggatggggaggaatgcttggcagaaatccaaggggtccagggaccacccggagcacctcttgaagtcgtccctgattactcgaaaagatgtcttcttatttttcatgttctttataaagtcactaaaaaaatttagaaatatatatgtatatgatatgttactgtacaaaattcaacttatataagtataaaaaacattaaatttaacgtgtaattcgcggtcaaaattattgtttttgtttttaattgtacaggtcgaatgcgaacttgcctattaattgagagaataacatatcacatattgatttatcttactaaatatttttaaatgttttaatgaatttttagataatatggacaaaaggagaggggacatcctctagaagggggtaagaaataaaatccatctcactcttcttcctcgaacgtgctgtccgacacggcgccaccgttaccagaacatgcatgcatgcatgcatgcgaaaggacgaccctcaacaacattggactgtgatgactgatgtaatagcagtcatggaggttgggacgtatgaggaacaccatcgttgattggtaagatccaaacaagcacttggccagtgcttgataggagcaatccaactatccaagagatgaggtggtggtactgtattatgcatgaaacagccaagtgacacctcaacaacaagataccttatccattatcttatctaaaaaaaatctcgcttgtcggtttgttaaccagcgacgaacgaattgtgagaaaaagtagtgctacacgtgcgtgcatgcttgtttttcttcttagacatgcatgtctttttcttccttcttataaagttttctctcaaattaattacttatccgatatacaattcgattctaccaatgtgttcgttacaattaaatcttcacaacaagatcttacatgattatattacaataaaaaatatttatatttgtaaattacttttattatatacgtaagttacttttatcatatatatatatatatatatatatatatatatatatatatatatatatatatgttacttttagatttaactaagttacttcttatacatgtaaaagtaaatttaataaagtctaaaaggtatttacatgtattataaaagtatcttaaaacaaaacggaagtaactttgtcatgacattagaagtaaattcattaaagttactttctttttgttataattaagttacttctataatatatgtaaattaattttaagctttattgaatttacttttatatgtcgaagaaataatttagtgaaatctaaaagtaatttagatttattataaaagtaatttataatttttcatcaaaatatcatgtgagatcttgttataaagatttaattgttacaaacacaacgatgtaatcggatcatagaccggatgagtaatttaagagaactttatttgaaatataggtggatagagtctcttataggtggagtggtagctggtttagacaaactagctaccactagctgtgtagtcacgtcctatataagtgttgggcatatttcatgttttggttttccaacagacacaattatatacgtgtagtcttttttgctgcttagggacgtgtagtgaacagtcgttgttagccttatcaacgtgaatcgatctactgctagatccagcaaatttgatgaggaggcacgcaagtgataaaagtctcctactacttgaagagaagtaggggaggtcggcgaattttttctagaaataatacgattttaatggaaaatcgcaaaatataggtcggttaggtgaaatcgtaagtttagcactctgtcgaacaactatggttcgacagggtagttggtccactaaaaaaaataaaaaaagtacatgaacagtgttgcgcagtggtaatgttcgatatgtccgcatgaacagtgctattctcttttttttaaatttttttatcaccctgtcgagctgcgattgttcgatagggtggtaaacttgcgattttgcctaaccgacctatatttttacgattttccattaaaattgtattgtttctaaaaaaatttcaaaggtcggcgagggaaaagggggtggaatcagggggagagagaaagagtatgtatgtatgtacacatttttcaagaattttagttaaatttattagtttccaagcacaacatgcattggaaaattgtatgcataggagacagtctcataaatttcaagtacacactatatatacatgaaaattatgataaaaattaattgcaagaaggctagccaacgggatcttgtccagatgggatataagtggataatcttatccgttcccccttgcttccatctctctctctctctccccgtccatctcttcatcccctgccgctcctctcttctatcgccctccgtctgaaggtggattctaaacactcgaatggatgtccgctcattaagtgcatgccaactaaataatcatgaaaaaatttcaaaaacatttacaagatagattgatatatatatatatatatatatatatatatatatatatatatatatatatatatatatatatatatatatatatatatatataactaaaaattcaacttttataagttgtaacaaaaataacaaatttagctgcaaatatacatatactaatcagagtttgatttattatttttgttacaactttgtagaagtcgaatttgaacttgcatgtttgtgggggtgatatgttacatatgaatctatcttgtcaaattttttgaattttttcatacctatttagttgacatgcaataaatggatgggtgtccacctaggtgattaaaagtgtttcccccctcggcctccactcttctctccctctctaacgcattgcttcattcctagcagggttggagtgagagcatgccccatggcgaggtggctctgaaggctcgagtcattcctctctatggtggagttgtccgcaagagccctcacggtaaggccgggtggtgtccgcgctcgttcgcgctgtcggtggtgaccatagggctctcacgtgctagaggcttgggaagagctgcgggacttgtttgggggagtttaagattctgagaagcagctgctaagaagctcgctggtgagaatctggagaagctgggaaacccagcttctgacttctagttcatttctagattttacaactacagagtctcagaatctgggtaagaagctagactgtttgggggagcttctggcaactgtagattctaggagaagccacagctgctagaagctcctccaaacagagccgtgaagagttcaagctgggaggtgagttgaggtgttcgtcttgccgccgcacacgatgtccccaaccatcatgctcacatgtgtgtcgaggatgacatcaaggaggaatggcgtccctccatctcccatgaagtggtagccatcttatctccattcttgctttgcctcctttcccttctcatagctctagtcgtcgtgaaggtctggtacccaagaatcatgcctgatacccacatatacctgacgtctaaatatcaagtctctaatacttgggtatcaagtaattgatacctcgattgttcaggccaatacccacaagtaccacacatgatacttgggtattgggtatgcatgcaaatacctaggtattaggtgaagtgggtgtgttgtgtctctcacgaggtatgtctcttagagcacccgcaatggtaaagtaaggtgctatctataaaacatgtacatctcagcaatagactagattaatagtaaaccacctcaatagtatgtctacatgggtatctatagctctctcatatattgcctcgtttttctctatagactatatctaagttagtagatagctttgctctctcttaatttaatatcttccatgtaggaaaatatgctgacatggatctcttgtaaagagcatatagacaaccattgtgggtgcccttacgaggagacgtgcactggcgcgtggaccacatggagctaagtgatcgtaatgagtggttctcttgtcctaaggacaggaacatgtacggtagtcgtcatcaaacaattctctactattataaaaattaaagatgtttttgccgatattttggtacgtcatccgtatttgagtcgggttttaagttcattcgtttttgaaaataggatccgtgtttgagttagattttaagcttgttttcttctggaagtataggagtcgtataagaaatctttgaaaaaaaaactcgcatgttaacttgagatgaaataaagactcctaattacagttcatgattttctaaaaagaatatccaagcaaatttccacagtgaatttaaccctagctaaaccatataacaataataaaattaaaatagtatttatccgtcgcaacgcacgggtattttttttctagtaattacctatgtgaaaaaaggagactggagagaaacatacttacgtacgtttacaataaacaatagagattaacaatctcaccaggaaaaaaaattaaaagagtgacagaaatcaatatttttttttcgggaaaaatcaatatatttttaacaaaatcgttataaattcggcttaattaaaaaaaaagttggtgttgagctcgaatggagctaacacttgagctcctcatagaacacatccttgaacttggcaaggctctcggggtccatggccacgacgacgtcgagccggccgtcgccgtcgtctcggcctggcacgaggtagacgaggccgctgaactggaggcacgcacgccccatgaacgccggccgcccccagccgaagtcggcgtcgtagagcggcagcccctgccagctgatcacccacaggtcactctccggcatcacccactcccccttgcggagccccgccgcgccgccgctcgccgccgccgccgtctgctccaggtggtccagcagcgaccggacgtagccgtcgtcgagccgcgcggtggcggcggacaccttctccgcgacggcgccgagcggcccggcggcgacgatgtcgctcaccttggacaccgccgacgcgcggaagatggcgttgccgaggtagccgcgcgggagcggcgggtgcaggcgggtgcgcgcgtcggcggtcatgtacagcctcgtcgccgcctccgttccggcgacggcgagcccgcgcgccttgcacgcgcaccgccacacgtgcgcgaccaccgccgtaaaagtggacagcctcttgccggcgccggcgccggcgcccttgagcgcgttgagctggttcttggacatggggaggatggccgagtcgaacggcagctttgaaccgccgccgcggcgacgggagtactcggcgtggtcgaagcgcacggcgggaggggagcgcgcgcggaggagcgtgcggtcgagccacggccgctgcaccgccgccgccgccgcctcgccgtcgccggcgacgtccctcgcaatggcggcccacgtgttgacgaagtccagcgccgcgaggccgtccgccgccgtgtgatggatcgccgcgcccaggcacacccctccacacctaaagaacgtcacctggaacatggccaagatgctggcagcggcgacatcggccgccgggacaagcatccgccggagctcgtccgacggggcgaggtcgcccaggtcgtcaatggtggcgccactccgcgccgtgacgaagagcacgccctcgccggtgcagctgatctccggcctgccggcgctgtcctgagcgaggcggccggcgagggggtagaaggggacgagcaccttggacagggcggccttgaggacgtccggcgagaaaaacgccgcgtcggagtcggggccagttcgccggtagacgtagacggtgggggtgtggctcctggccaccagcaggtcgaggttggagagccatatcctgtgctccggcgtcgcctcgccggccgtcaccatggaggacttgacgatctccactgccatggatgcgagaagatgcttttctctactactccactctacttgtcacgtgttttgcaaaatgcaaaatgcgagaagatgcagtaatatactccctcggtctcaaaattactccttccgtttcatattacataagtcgttcgatttttttttctaatcatactttgttaaatttgattaaatttataaaaaaaagttagcaatatctaaaatatcaaatcaattacattaaatctaacattaaatatatttcgataatatgcttgttttgtgtcgatgatactgctatatctttttataaatttgatcaaatgacttataatatgataaatcggaggaagtaagagaatttgatggatcgtatacatcatacacaagtacacatccaattaaaatcgaaagtcctaacgggcgatcgatcgctgggcacgatcagtccccctccccacatcgatcacccccttcttcatgtgattttcttttttggcaccgtattactttcctattttaataaatttatacacctaaagtttgtgcacctcaagtttacacatctcaagtttaacagagaccccaaatttataagtcaaaagtttatatatccgattcaaatttgaatctgaattcaaatattttttatatatagtatttctatacatctaaatattatacacctaaagtttatagacccaaagtttatatatccgatttaaatttgaatttcaatttgaatttaaatattttttaatatataattttttctaacgtttgttttttttatttgtttaaaaatttatggtgtagtaggaagagaagtaggggaggaggaaggggagaggagtgtgtttagggggatggggggtgacacccgcgcattagtactacccaattaaaatccctttatgttatgaatccaattaaaggaggctgcaggtaacaggttacgtagagtgggccagcaacaaatattgggcctggcccagtggcagctcagctccaaatccacaagcgcctagccggagcagcccgaccgccatggcactcctcgccgccgccgccgccgcccgccgcttctctcgcagcctccgccgcttcagctcctatgccgcgtctggaggagaagaagcaggaggagtgcccgcgggcgtggtggagcccgagtcccccgtccgcgcgccgccggacgagcagttcgctgcgtgggtcgcgcggctccggccgggcttcacggcgggggacctggccgaggcgatctcctccgagcgcgacccggacctcgcgctcgcgctcttccggtgggcggcgctccgcccggggttccgccacgcgcccgcgtcctacctcgcggcgctgaccgcggcctcctccggccgccgccccgccgccgcggagaacctcgtctacgacgtcctcgccggggcgtgcggccccgacctccggctcttcaacgcctgcctccgcttctgctgcgcccgccgccgcctcttcccgctcgccttcgacatgttcaacaagatgcggtcgctcccggcatccgccgcctgccgcccggacgtcgagacctacacgctcctcctcacctccgtcgtgcgccgcgtccgccgcccgccggcgtccatggtctacctccacgccgtccggtccctctcccgccagatgaaggcctccggcgtggtcccggacaccttcctcctcaacctaatcatcaaggcctatgcccggtgccttgaggtagacgatgcactcaaggtgttccgtgaaatgccgctatacggctgtgaggccaatgagttcacctatggctacattgtcaaggccatgttccagaagggcaggactgacaaaggaatggtgtactttcgggaggcgagggagaagggatttgtgccgactggtggcgtgtacatgacggccgtgtcagcgctagcgttggagtggagatttgaggaatcaagaaatgttcttatagatatgctggattgcaagaggaagccagatatgatcacctacaggacactgatggaggagatgtgcagggctgggcgcgcagaggatgcgttcgagctgctggaggagctgaaggagaggaagcgagggccgttagaccagaggatgtactcagaattgcttgatgggttgcactggatttctcaaccacatcaggatagggtttctccctgtgacaagcgttctgatgactgaaatgctttgatcaatggattgatttgcattgtatgatggtgatcataggcataaaaagatcgaattgatggctgcctgagaagactgcatacctctgcttgaatattcaagatgaattgatgcagaggagctactctgggattaactgattgactccaatttgcacaagcaaatgtgggtatggctgattcaaagccaaggggttggagaaatctgcaaatgtcttgcaggtgggatcaaaattccgtgcgagcgtatggcaactattgttgattggtgtctagtgatagctgataaacacggctaaaagggcaatttctagagtaaatcatgcagagaaagttgtttcaggtatcatatatgatatgagcagctacgcaacaaatttttagcaagtcagtacatttttagttgttttttctcacaatgttcaatacctaagtgatgaatattttatgccaaagagcaattgttcattatacagatataaattgatattacatatatatctacaacaatcatgtgcccttttcatgtttcagaatgctcccgtgtatagtacaactcttatgtgaggatacaactaaaagttcagtttctccttcatatcaggattttgagtgtccaaaccctaacattgactctgcaactgcaagtaggaaactaccccctggacaagcaaattgtgggctggatatatactaaggatcattcatgctaaactatacttacagatagactatgtgatggaagcaacttcacagtccgacattagcaaaacgactttttttttttaactgtatcaagattaatgattttgtttttaaacagcaatagaagcagcaaactaatcagtgagtgaagccaggttatatcctctcttatctatggattaatacatataacatatttcttcagagatagtaccagttgtgacagaggtgccagttgcagtaccaacctaacttttgtctgaaaacaattgttgcccttggtctacgatacttgaggcgccaatctgttgttaatcagctgtgtcagtatgttatcatcctaatcgaagtgaatcagcataaaatccaatatattgctgagcatgtgccatcacagtatcccaccgagtttttacgtatgcccgttgtttgtaaatttgtatggcaatgaatctaacctgcgttacatggacacaatggatcatgtgtgcatctgaaagaaagaaaattaaacctccatttctcccacatgccaatcggcagagcctgcaatgaagctgcaatttctattttacaatccattaactcgaatggttcacattcgattgaaaaaaaaaattgtaccttccagttgcttgtgcgcagtgtacaccattttgattgaacgctagatcctgacccctagaggtaagatggttttcgctaatttttggtcaaacctactgtttcaaatttgaatatctgaaaatatatgaaatttcacttgaaatttgcttaatttccgtgtcgaaacctcaaaattttacagttttcgatcggctctcgtcgttcctgttgcacgttgttccgctctctctctctctccccccaattttgcagctttctttgaagctggcaaaccaagaaaccttcgacgctaagcagacgtcgtggcaagctgcgtcccgtcgatccgtcaacggccaatctaatatttttatttccgcgtggtgtgatcaaaactagtacccacccacgaaggaagatagcggtaggattttttttttttcgtttatttgttttccgcgaaacgcacggcgtcacgagtccagcaaacagcaagagaagagaagagaagagaagagaacgcgtcccgcttccgactccggcgagagcgagaccgagagcgcgcggcggcggcggcggccggaggaggagaagacgatgggttgctgctgccggtgcctggagatcctctgcgccatcctcctcccaccgctcggcgtctgcctccgccatggctgctgcaccgtccgtaccctaatccgatcccctcctctcctctcctctgccctagctgattaattatttattaattcctctgatgatttctttcttttctcttggcgttgttgggagggagcagatggagttctggattagcgtgctgctcaccatcctcgggtacctccccggcgtcctctacgccgtctacgtcatcgtctccgtcgaccccgaccgcgaacgccgccgccgcgtcgaccccgacgaatacatctacgtcgcctgaccatctgtggagtacttagtaggtgattaatttagctcctggaaagcatatccttgttcctagtcctattacctatatctgctcctgttccacccttcaatttgtaaactggtactagcacatctgcagcctttggacaagtcgaatcgggtcggaatttgttaccgtagttcaactgtgttactgtgaccgtttgattgctggatcaattgctctcaagtctcaacttgtgttgttcttcagttgctgaatttattgacagcctgaaatgaggatttggcatgctaagagaattgagtgtaactagtactcctatctgataacctgcctttttttagccctagagttcttcgacagagataagaatcttccctttcagtgatcaatcaattttgcaatcatccggatcgaacattagcccaaatttaatttttcaagggaaagaaacattttcttcaatctctttttcaatgactaatgataagctagatgatcagagtttatgttccctaccagctatcgatgtaaaattgcagctgatctaacgtgtctagtacatctgctcaaggggagttagcagaaaaactagaccatcagagtatgttaacctagaatcacatgttagatgccttggcaaatcgtgagaatcttgagaatttgtcatccacaagaacctctgggtttccttcttcaacctaaatttggagaaaaaatgagttagataatgtcatgttaaggagcatttcaagaaagcacaatcatgctgcagaggaatgatatttgccgtgatggtaactactccatccaggcaatatttgaggctgatgccgctaatcgcagcagtgctgggcgtcaaatatttccgattggaggtagttggaagtgcatatttttgaaccatatttttgaacctcccttctcgtttatattatcgcttggttcttgtagtgaagagttattatggcatctatgttaatataatgttatgaacttatgactcctgtgttagcctctcccctaagaaattaaaaatctccttgatcatttaatggtggcacttaccaattttccttgatcaagaactagaatactgtccatcttcatcactgttgaaattcgatgtgctatcgtcagaactgtcatgcctttgcattcagcagaaatagtattttgcaacaaggaggctgtctgattgtcaacattagctgtgcattcatcaaggcagagtatctgtaaaatagtgacaactttaacttcattgagcaaaagtgacacattcatcaacacgaaacttaaaatctgatacaagttttgctgctcataaaaactgataaaacatccaaaataacatggtaatacaagcaatgttcaaattgtaaagtagtataccttggatgatttaaggatagcacgggcaagacacaggagttgtctctgacctactgaaaaagacgcaccactttctttcacatggatgtcaagtccacctatagattcaatctctgtcttcatatgacacttatcaagagcttcccatatcctgagatctgttgttctattaaaagggtctagattttccctatcatgaacatttgtcattagaaaagttaaagagttttgagtataggtgtgtctatgtttcgctcagtctttccaggcatgaaaattgactgaggcatgagaagctggtaataagggagactagtagttacctcaaagacccatcgaacaaaaacgggctctgtgggactactgcaaaatgtccacgaagatctcggacagcaagtttggccacatcaaagtcatctactaagatgcggccattacagattggagctaaacgaagaagtgcattcagtatactggatttgcctgctccagtcctccctattattccaacctaattcataaaccagggagtaaatatattcagtatagtggatttgcctgctcaattgcccagttagtccaaactgataagccagggggcagatttattgatgactccataaaaaagattcaacaagaatgcattggtaccgtcatacctgcatgcctgatgaaataaagaacgaaacatcattcaaagccgggggtaaatcctccttgtaccttagagtaacacgctcaaactcaatgttcccctctgttggccagccactgtgaggggattccgatccatgaagttcttcttgaggtatgccaacatactgctaacaacactgaattattagagcaaaagatgataacacactgaaagtaagttcaggttctacttttacctcaacaactctctcaacagaaatcatttccttttctgtctctgtaaaggtggttaagaagccattcaacaatggtacaacgggtgcggcatatgacagcgccaggccgacctgcagtatatatttatacttattctctagatacttggaacatatctagatagcgataatcatgaaatcagtgtgtgtataaacctaccagtccaggtgtaccaaaattaataacagatttactattgaagccaacaatggccataatggcgatgaacagaattataaaacctgccaacaactgaagtagtttgctggtcagtgcagtgtttgtgatatatgcttaactgatgtagaaaaattcttgattccatggtagacgatggatgttagtcatctgacaagagtgatacctggagtctcaatgagagccacagaccagcaaccagttcacaataggatgttttctggtatagtgtcacatgttggatgaatctttctaagaagaatccctatatgttatactaccacggtcagtatcccaaacaaaccatgccagcgattgccactagcgaacaatgttctaacagtcaattttgtatgtaaatgttcgggtaaatttagtatcatttcagaaaaagtctagatgcagttgacatacttctttttgaaatgctcttattgttgatgaaccatcaagtgtctctgtaaaagatgaatatattggtgaacgagcaacactgtcaagtcgtcgtacttcacgtgatgtagacctataatagaactgcactgatcattagtttgttactccaaaagtagaacgtaaaaacgtatatagtgtgataaatcattatcagcagacatcaaagaggaatgctagagtctttgatcaaaagagcaaaacagcagagcacctagtggcagacatcaaagaggaagtagcagtttggagagctgcgggggtatttgaaagttgtgaggagtagccctagcattaccgcagtttttctttctttgcttcccctccccactcctgtttccaggggtcttaacctctggaccgacagtataatgtcgtgtaaaatatgtacttattccccctttcaatcttaatgaaatttggtcggctccttcgccgacccggcaaaaaaaaaataataaatcattatcaactatagtcaaaataagaatcagacactgcactgtaaatgaattctggttcagaagatcaagatacaacactcgtgcagcactgcacattagcttcctgcaatatcttattagttaatgttatgcaacagaacttgttatcgtcagagctg

SEQ ID NO: 74286 - DNA, 10834 bp, Oryza sativa
attcctgccaggtaattgtcagcatggtctagtactctgtacccttgtcatatcaataattcaatcttgattcattctgggactgtttggttctcgaaaatgaaatttttcagtatcacatcagacgtttaatcgggtattgaaaatggtttttgaacacgaataaaaaaactaattttataactcgcctcgaaaccgcgagacgaatcttttgtgcctaattaatccgtcattagtacatgtgggttactgtagcacttgtggctaattatggactaattaggctcaaaagattcgtctcgcgatttctcccctaactgtgcaattagtttttaaatttacctatatttaatactccatgcatgtgtccaaatattcgatgtgatgtttttgggaaaaagattttgggaactgaatagggcctgatttgtaagtctgttcgaatttactctggataagaaacttactacttcctctatcctataatataaggcgtgcacacattttaatattcaactttaaaaacatttgatcaataattattataaaataaaataaattttatttgttaaaattaatattattggattgatatttaaatttactttaagatggttataaatttgttacaacaaaccttattgtatatgagaaattttaagtcaaagattagttttgaagactgtaccaagtttgactatatcttgtattatgggatgaagggagtaactattttaaggagctttctgattccgagagaatctaaagtggccaaaaaaaactcctccaatcagacattcggaaagcttgacaagcagctggacaccggggctgagacaagagcatgacgagagcatgataagagcaacaatggatttatggtcacaagagatgaagggagcagcgtctacagcggctgatgccttgtgctcctggttctatttgcccttaattttgcatccattagtgttcagcggcagcggcagcagcagcaagctacggcaactccacgggccatcacagacgcgtttgtattgttcaataaattaactgcaagacaacaaatgacttgacctgcttgttttgtttgtaccaaatggtcaatgatttagttaatccagcctgtctttgttttttttttgttctttccacaaacctgactcttccttcaatgcatgcctaacaaggttgatctcatcttgttcgctgccatttggtaattactagaattttggtaacacgacaactgctgaactcgcttcgtcttaaaatattactttctctgtcctaaaatataaatatttttacctacaaatatgggtatatgtatttctagttatgaatctggatatatatatatatatctagatttatattttttatataagatgggttaactatgaatctagatatagtcttaaattcaatatttaatattttgagacaaagagagtagatggtaaaagaaaaatcagaattaacctactagctaagactgcatttctagctatcaacgtgcaccacagtacatgtttaggttcatagctataattgaatttttcgtgggatggatgcagtactacttttttttcctctacctatgatgggtttaaccaaatcttaattaaatgattaactaatataaaaaattttgaatttgatatcagaaaaatgatattggtatatttgttgtgaaaaaaactttgatacaaaatatactattagtcatttttacacaaatatatatgggttaattttatccatgccattacaactttgctaatttagaaaaatgctattactattcgtgatatctgctgggtgtcactaaaattttgcaaaatgaaattgtggtttgacgggcatgtgtcaggctgaagttgactggcatgctgagtccgaacaatatctcctttgcccattattcggcattgcggattttatatcgaatagtgtcaaattgtgatcatgggcacattgaggtatgagtggctatttatgcgtgtatggatcccactcatccaaaattatgtggtggtcacaaattgcactggatgatataatgtttgggtgcccacagaaattgtgtcatcgctgtcacattttccgtcccttccgtcttctttcttctctccgtttcgtctccttcccgtcggccgaccgtgcctgctggtcctcaatgaactgccgccacgccttcagctccttccttcaccttccggcatgctcacaagccaatgccgccatcttcaactcctcgcgtgagctctaggaaggccggatcaacgcatgcgtgctccctagccggtgtcaccaccatcatcacaacctcctcattgcgcgagctctagggaggccggatccaagcctcctcctcgcgagagctccgaggaggccgcatccaggtgcgcgttgtctgcgagcagcgtcacctccatcttcaccacctcctcctcgtgcaagctctggggaggccggatccaagcgccggccaccatattcacctcctcctctttgcacaagctccaaggaggtcggatctaggctccgccgccatgtgctagatccaggtgctactctcatcttcacctcctactcctcaccgtggatggagaggtgatggtggtcgcagctggcgtcaattgctgctccacctccgtgttcttcatgtgcgtcggctgttgccctcatcacttgatgctccgccgtcctcaccgcgtcatccctctctgccattgacctcactccctccctgggctttggcgccggtagcctcacccgcttcgccggagcttgctagtcggcctctgacctctctcgctgactcgctccctagcctttggtgccaccagcctctctcgcttcgtgggagctcgctggttggcatccttgcagccaaccccttgatggggagaagaaggaataagatggaatggatggaaaatgtaacggcgatcgcatggtttcaattttggaaaatttcagtggcacccaaccgatatcacaaatagttctaaatcggcaaagttacaatggcatggatcaaattaacccaatacatatagttagaaggaatgaagtgcatgtgaagtgcacggatggtctctaaacttgtacagatgtgtcatatagggcttgttcagattgtagccaaaataaaccttaccaaattatggcattgccaaaattttggcaggatttcttatgtatttaccaatttggcaacaaactaaatgtagacattttttagcaactttaccaaaaaaataatatggttgataatgacatcaatctaagcagccccgtagtttcctaaacttctaaaatttatttttaggttcttgaacttatcttgggtatcatacggcatcatacagattcaaacgggctgtatgtaactcacagtgtccgctgatgttgtatgccaacctatatgtcagtcacacagaaaaaaattaaattaaaaacatattttctcctcttaggtttctcctctctatcttaaatttttttaaattttatcttttctcttctccacctaagaggagaaaagatgttattaattcatttttttccatgtgactgatacatcggtttcattgacacttatgtgcaagtatgacatgccgtgtaagcgcatggagcgggttggagactgattgaacctgtatagttttcaatgttagtttagagacccaaaaatacgttttgagatagatctagatgattcatccttataagtttttagagaccgcttgtatacttcacgcttagaaaaggtagcgatgagacatacatattggtggacatggagaacttcctccgtccgaaaataagtgacttagatacccttgtcaaatgaggttatttttacgattaagatggtggttgagagaagataagaaggaatttgaataagaggtgagtaatgacataagtagtactttaaacttgttacttattttcagataatttttaaatcaaagtggtcacttgttttggaacggaggaagtggtatcaagttttttaaaacctacgttccaaaaatgaagtgtttttttatggatggagcactaagttttgttaatgcctaggaattttggtaacaccaaatagtattttgttttattaattcggtataatcgtggtgaaagtgggtcataaaaactgaggtcaatactcagtactaagagcaagtttaatagtatagccaactactagctccaaatcatctatagccaatgtaatagccaattcatacaatagttgcttactatactattaatacttggtcccacctgtcatacacacattatgtcttagagtccgtgctgcagctggctacagatctgtagcccgctactcttctttatcttcctttatctttttaaaattgtttatagctggcttatatcctgctattttacctgttctaacacgtcgagccaaagaaaaacaaatcaattcaggtgcacattgttgctgcattaactattacgagctgctaccagtgcaaggccagtgacgcattcgcattaactattactctctgtcggcagctctcgtgctcatccagccatccagggaatacatatatcggaccaaaaccctcgcatatgcctccaagtcttttcctagctagccagcaacatcttcagatcgatccccccaccaagcctgcatttcattgcgggtgcacgcagagatcgaggagagacgatcaccaccatggccggagagatcattccagacggcggcggcggcggcgcggtgttggcggcggagagcgtgatgctgccggcgagcatggtgctggtgcagctcttctccgtcgtgctggtgctgctgtccaagctcgccctcagcaccggcatgcggccgttcgccctcctcgcctaccggaacctcgtcggcgccgtcgccgtcgcgcctctcgccttcatctttgagaggttaattattcgtcgcttattcgtcatctgcaatggcgacttggccagcttgtattattccttgctttctgcattgaacatatatggtagttcttgttggattggaatcatctgcttccaaagctaccatacctatttgtcactgactggtggacatatatggttcatcggactcatatgtcagtaacatctgataaagatacatatctttgaaggtaggggagcctaatccgttcttgtttggttcacaacgctgttgtttctctgcgcatgtacacaagtataatttgaggtttagagcatacatccttgtatgacgttggaagtacatagaaaatattactccaaatgttgtccccaacgtcatgcactagccacggggtatatttttgtctgcatgcgtgcaccattactccggcccagcccggccatctcacaaagtcttcacttgtctttctttatttgtctcaaaaactacatcttgaagatcaccaattgctttgaagttcgagaaagtgcatacaaatatattagatttttcagtcagagacaaattgactagagtttttaaaactagctagaaggcatagtcttaaggagtagtagcattgtattggtaggtgtgaggtagatcaaagtaaatgttattttaggacgaagttaattagtactcctctcagtccacgagtatatatgtagtattattttatcatacattaatcatcaattaacactggtactaccaactaacatgaataatctcgtactagtacataggccctgtttgaatcgggagggctattaaatagtccttcagaatcttgctatttaagagtattaaacgtagattactaacaaaatccattctataatccttaggctattttgcgagacgaatctaacgaggtatattaatccatgatttgctatagtgatgctacagtaatcagccgctaattatagattaatatacatcattagattcgtctcgcaaaatagcttaggggttatggaatcggttttgtcggtaatctaagtttaataatcctaaatagcaatattccggaggactatttaatagtccggaggatccaaacaagaccatagaatctcgtaccaactttaagtaggggttgactgacctttactttattggtagtggaaatataaatggacctcagcggaagcacccttgcttgtcttcttttaagatctttattgccttcctgatttttgatctttttgtatgttccaggaaaaataggaaaatcccgagcattgtggagtggtgctggatttcgcttaatgctacatttgggttggtattttttttccagattaatcaaagggactctcacttatatgtttgccagtcaaatattactctctctccgtttctaaatatttgacgccgttgacttttttaaatatgtttgaccgttcgttttattaaaaaaataactaattattaattcttttcatatcatttgatttattattaaatatacttatatggatacatatagttttacatatttcacaaaaatttttgaataagacgaacggtcaaacatgtgctaaaaagttaacggtgttaaatatttagaaacggatggagtaatatactagcatacattgtgtaacttggaagtagctataatataaaggaaaatgtatgtagctttccaaaacgcatcgggggttgttggatgtaacccctcacccatgcacgcgctttgattttttttcctttcccgcttgtatgtatgtaattacactataataaaatatactccctccgtcccataatataagggattttgacattttgcttccactgtttgaccactcatcttatttaaaaaatttgtgtaaatataaaaaacgaaaagttatgcttaaagtactttggataataaagtaagtaaaaaaattaaatataaattccaaatttttttgaataagacgaatggttaaatagtgcaagtaaaatgtcaaaatcttttatatcagaggacggatggagtatttacattgacagatgcttataggaaaatttttaattaaatactctttttactttgtaaagaaaatccacaatttttagtcacaatatgctttacaagctcaatgaatccattatctaaaaaaatatgtttcactaaaaaaaaaggaaaaaacacaatgcatcctaatatactcatatcgcttcaatgtgtacataaaaactttgaccatgttgactgctagaattttttttttgcaagaatataatatctatctagtccaactgtgatttcacaaaagtacaagaatcctaatgtagggtaatcctatcaatggggctgtactactatggactgcgaagcacctccgccacatattcagtcatatttctgaacctgattcctattgtcacgtccatcattgcaatcatattcgggtattcgcacttctcattaataagtttttacacttagttacaaaacattacaactaacaacctctctctatgtttacaaatttcatcagggcagagaagttggtgtttacagactggcctggcaagataaagctcttcggtatcataacatgtgtgggaggaacaatggtagtgagcttgtacaaagggaaactgctgcatcacccttggccttcccacctgttgaaattccacacgcagaaagcatcaggctatgcctatcatcacaatttgttagccggtacattgttcttgtgtggcagctgccttagctacgccttttggttcatcatacaggtaccaaatcaagtctttcaagttgaaacctgccaatttcaggtttatgcttgtagttacttctcagggagttgtagtgcaatgtatggttcatgcgaatcgactttctgaagcgttgctactttcagattgtaatttttttctgcaaatgcaactacaggttaggcttgcgagcgtcttcccgtacaggtattgggcaactacgctgacatgtctttctggaagcctgcaagcctttgtgattggcattctgatcagccctacaaaatctgcctggaccctcaaatgggacatgcagcttctgacagtggtttattcagtaagaacattaccatccaaacaataactatgatgttttgtgtagtctaggtactacttcatcctacctgtttggtttgaaatatgaaattatatgttgatgtgctgattctaccagggggtgttcaacactggtatctcatttgtcctgatgtcattggcggtcaagcatcgtggaccgatctacccatccatgttcaactcgttatcgctgatcgtgatggtgatcatggactcagtgttacttggtacaagtatcttcttaggaaggtgagttcctgttcttgagcagggatataaatttcactttctttggaactacatacttagttctgtagcaaatacgacaaaatgggaatgttctctgaatatattatgggactgtttactgtcatgatctgcagcattctggggacagcattcatcattgtggggctgaatgcgtttctatgggggaaaggcaaggagctgaagcaagctgtggcgcagcacaccagccacaagcagaacacagaccacaacgagcaggttggagatgagatagcatagcatatcagcactatgattgaatgaaagatgatgcttggcaaatttgcgatgatgacgataaaaatgtctagatagataagggattagcatggtagtttgtaactagtttccggtgcaaacaaaaatatggtacaaatgaagttatgaaaagtttgccaccaactcctcgtccttcttttaattgacacattacaactggataacaattttcgtttatatatctatggctgattacccaaaacaggctgtctctaagggcgtacggccggagcgcccacacaggacccccaattttcacgggtcccctaagccccaaactttaacactagatatacagcccaacaagaaaattgtagcccaactaattctaaaaattgtcattttttccacattgttttggcttcgatcgcgcgttcgcgctacttcggcctccgggctgcggcctcaccaatcgccaatcataacaaacgagaggagtaaatgaattgtatgtgtagttgatttttctccaaagttttattcccaaagagaagtgggccctgttcaaaatcttgaagtttctgaagcgacatgattgttttcccaatgcaactattgcatatagagttttgttgatcattcccctaacttttgcatcggtggaatggagtttttctaaattgaagctattgaagtcaatacttgtgatctacaatgccaccagaaagacttattggattagctataattgcacttgtgggtggtatgttggggaagaatcaatatgaagctatcatcgaagattttatatcaaaatatactaaaaaaatgtcgcttttctaaggaatattatgcacaggtatatcgttttagaacatttcacattgctatgaaatattacggagtataattttttatcatattgtaccatgagttaagtttttattctttgttacgactttgcacagggcccccaaattttaagtggcggccctgcaaaacactgtaggggtagcaccaaaacaaggtaggggaggcagccacaatgttaaagctttactaatataagattaaaacaattacaaaagataaacttaagaacaaaagactgctctctcagaaggatttaacatatgcaaaagtaaaagatcaccctttaagagtgatctccaagactatatagagtgaacaatattctaaacatttgagccattacgctgtttccatatacgccaagctccatatatgatgtctacaaaacatgaagaactttatgagttgtgatactgctgcaacatgtttccaaaagacaaggaggtaacccatgttatctacaacagattccaacatgccagagccgccaaactaaattggcattggaaaaattgatgcaaaaaagtctctcttcctcatccagaacatagaacatcgagcgcgctcatgttatctcaccatcttcaggcatacattgttttctatccaacatgtccctttttgtctgtcaattaggagcaaacacccaaagaccctaactttcatgatgcacgtgtgctattccgtatccaatttaggtgacagggaggttgaatatacttgtaaaattgatagcatatattttctgtgaaaataatgaagcattaccccatatataagaccatttatcagtttatgatgagttatacagagttatatagagtttgtactgtgattcaacttttttttttcacaaattctcactggtggagaaatcatctttggtcggtcgacccaaatccacaatagtcccgactccattaaaaaccgggactaaaaacgatttttaatcccggtttataagcgtaacaggactagatgatctttattcgcggttgaggttaccatctttagtctcggttggtaacaccaaccgggactaaagatcaggactaaagataatctttagtcccggttgtttatatgtcagaccatgtcaggcggctaggatcttaacaccaaccgggactaaagatctaactttattcccggttggagttactaaccaggaataaaaatcaacacgtactatataatccctattacttatcctcttttctcgtccacacaacgaactctttctctatctctttttttcctctctaactccctatccttatcctttcttcttccttcttccttagttcttcttccttagcccgcttggatcggagcgagagaggccagccgcttggagcgagagcgggcggggatcctctagaa

SEQ ID NO: 74287 - DNA, 677 bp, Oryza sativa
ctgttgttgtttttttttaagaatttgtgatttattgcagtatcatgtgatgaatttgatttgtgtgtgatgtgaacttgtgatgtatttgtgatgaattttgtagaaacttgtgatgtaatttgatttgtgtgtattttttttaggatttgtgatgtaattttttagaactttaaaatttgtaatgtggacttgggatcttacttcgatttgggatatgcataccacccatattagggagaaaataaaaaaaaggatatgcataccacccagattagggagaaaataaaaaaggaaaaaaaacctggctatcctctttagtcgcggttggtaacaacaaccgggactaaagatactctatctttagtcccggttggtccatctttagtcccagttggtaccaaccgggactaaagatgggcatctttagtcccggattgctactcccggttggaaacccgggactaaagggattcccaaccgggagtaaaaagggtttctctaccagtgtctcaacaaaacttgataaagattgggtaagttttgacgtattttagagaaaaaaatattcacttacaaactcagaactgaagttcgatatactccttaaatataaatatgcttactagttataatccagattcctaaatgaaatatgcgcacatatcgtgattaga

SEQ ID NO: 74288 - DNA, 1474 bp, Oryza sativa
ctgcctgtgagtggagccgtctgcgccgtttattttattttccgctgcttaaatttttaattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctccttgaccctaggttatgccaaatggttacccatagaagccttctaaaaatattggaaaagtagaactgttctcctccctttctcttttaattaaccaaactaatggcacatgcacttcataatcttttttaatggttctcattaaaaatttattccagtgttattagtactgtacatccattactgtactaatggctcattttaccagcaaaagttttacaatgttgttttatttaatcttgctgcaataaaataaatttagcatgttgattttataactttcttttatttcttttggaacctgttattcaaaagcacaaaacttgtgaccttatttccaactgtttcaacttatcttgcaagcttggtttactttatttacttacctttttactttgatttctaaactttattcaaattaatccaaaaacttgtgctattaattggataaatgtcttaactccctcctttcacttgtctttagatgccgcgctacaagcctgagtacttgtttggtgttgagggttttgtccaagagttgcgtacgatatcctttgtcattggatttgggactgcccctttttatgcccagattcctcatgatcgtcatgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcgatcgttatagtgatcagttggccgacactgagtatcgctaccatcctcgtcaaccccagggaagtgaccgtggcagttaccttgagactgaaggaattgagaatgatgctaccacaaggcatttggtcgagatgctgtgggctatggatgaaagtcgtgcggagactgtgttagcggctcaagatcgtgaagaccggaatcgtggtaagatttgcaagttagaagacaaggtggatcgtttggagaaggaattagccgcgttgaagggagaagcaccaccgcagaaggccaggattcgtcttaccgcaaggaagagagctctatttgtccctcgctatcaattggcgccaaaggttcgtgtggtggagaaagaagttgccccaaccctagcagatcctccggtcatcatcataagtgatgatgaagaagaagaatccaagcgcaccattccaagttgagtgggtagcaactcaagatga

SEQ ID NO: 74289 - DNA, 1535 bp, Oryza sativa
taagtaaccaaagatcattgccattacgagatgcttgcattaagaacacacttagacatatcagaaaagcaattgaccatcccgcgaatgctgcatactttctgcaaagcataaacaccattttggattgcatgtagtactaagactatgtaacttctattattcaacctcagttaaaataacttctattattcaatgcaataaataaccagttacacaaaatcactcacttgtacacactaagctctaccatgccttctttcctggcctctacagaattctgctctctttgttcctcgtgatcaactactgagtcattgtcaatcaggccattagtctcggattcatgggcgacgctcactcctttgtttttctcagaaaatgttgatgagataacccttgaactctctggcttagacagtgtcgagtatggagttgctaagaaagagtccaacgtcccaaaccacttaacaagcccattagccatgaccactatcatatctgctgcggaaattgcctgaagaacaagggaatggtgttgttcttttgatggacctaactttgtttgggcgtgattaaataaatattacctgaagattgtgggtgcttaatattcgtgtttttctcttcattttgggccccataatggctttttccaagatatacgaagcaacttgtgagtcaactgaactaagtacatcgtcaaacaagtaaacatcagagtcatgatacaaagccctgcaagggtaaagatcatagcgttagaacatacttttggactttcccatgtcaattgcacaacattgttaacatataaccttgctaattcctttaaaaaaaaaatctgaccttgctaaggctaaacgggctctttgtccaccagataagttaagacctttctctccaatatgtgacatatctcccccaaccattgctgagatatcaacatcaagggtacaagcatgtatcacttcttcgtacctgtatgaacattgacacgcaatactgattaaaaatgcaaaacaataaacaccggtcgacggtcgtttcaggttttggaaaacataaccttaacaaaacaaagtgatcaaaacgagtaaaggtacctccttggatcaaattcttctccaagcaaaatattatctcgcaatgaaccagacagtatccaaggcacctgcacaacatccgcgacatgctttaccaagttgaactacaaaactgaagaaatttctaaatcaagaagtacaacctgtggtacatatgcaattgaaccataggaggtaatggaaccactggtaacatgaatttctccgatgatagagttcagcaaagatgatttgccacaaccaacctgcaagtgggcataatgtaattcctcaattaactgagaactgcagtggccactgacaagtatttacaaaagagagtttatttctatcccttatgcaaaactaaggtgcctaaaactcgaggttgtaaatgtttcgcgacattgatgaagttaagctcatggaatggtattagaagaatagtaa

SEQ ID NO: 74290 - DNA, 2469 bp, Oryza sativa
ttgttaccctgattgcatgtgtccaaacatatcatcaggatattgttttaccgtggcagcatccagcgagtggcccattatagcaaatatggaaaaggtgaaaagagagaacaatgttggtgtggttgcccagaaatagacacaccaagcgtccagatatttgcgagtcttattaggaaagaggagacacttgtgagtttcacatataaatgtaactaattaaaggaaaattgataatgagaagttgcacaccgcaagatgcttcacttctaattctcttctttccaccaaacgttgagtgaataatctctcccagctgtacatcttcactgttctaatatgtgctaacagttctcctgcacaacttatcctgttcatggaaaaatatcgattgtgcctaattagtcagtattgcataaatccatcaaatttcgtgattctattcttatttttcattttcttacaataatttgtgagtatatatatctcatcgtgatatgccaatagaaagaagagaacactgcaacataacagataagctccccaaaaacaaacttagacggatttttggtctcacctctcatctttatgtttcatcatcttttctgtcgcgtgagctattcttgtagagatccatttgttcactgtgcatgtacagcattggttacaagaaaaggacaagaaatacggatatgttaggaacttagaataatattctgaataaaaaatgagcataatcttgaactattgattatatcaaggagtaccataattcgtgtactaaaaagtaaccagagtagctttaatattcatacatacatgtatttcatttagcataggatcatgtacccctaatgtattgcaaacaaaagagatgaatgaagcaagggaccaaagaatgatatgtgcataaagttgcaatgcatgacctggcaaacctcttgaaatatacagaagaaccatggaaaatcaagcagtacctggcattagtatgactgttattgccaatccagataaaaatgcatagttcacttgagtatacaatagatagagagcaactcctatctgcaatggcaagctaagaagatgccaaaccacacaactcatcaaataatgtggcacgagtcaattccttaataggcaaacattagataaagaaaaaggatacctccaagcatcatgaaggctgttacataagtttattgtgcggtcagaatcaacagacatgaaggtctgaatctctcttcagaaaacctacaacgctcagatagactgagacataggcactgttttttaaggtccatacataataagtaacgcaaaaattatgcttgaagtttagtatggaaggtgttaaaaaattcgagcctccagcgttgaactggcagaacaagaggacatatacaggaatcataaaagatatgctaccgcagttatacactataaaataacgatgcataactgcatatgcattatttttaggagtgcaattagatactacattgtggtattatcaaagaacaagatcagccatgcttaagaaagtccaacaagtttgtactcttagtgttgctagagcacccttcagactttttctcctctccctataatttcagtgtttgtaccagatgttgcctgtttgatacctcttcttaatgcaaaaatatgtgtgaaatttttgcacattgactaaaggggtaattattgtacaacgcaaatagacaggacatgtttgaattgcttgactttttctttaaaaaaatatataggataacacttacaggtaaagaataggaatggtcataccttccgataaattattcccatgatgcttgatcgtaacatcaactttagcttagctagacgaaaggagtactgactatctaaaaacgacctagtgaatgtgaacaagaatgtaaaaaaacatatgataataaatgaggtgatacataactgagtgacagagcttttcattaaaaaaaactgttcattgaaaaggtaaaaacaattcatttgtgtcaacatttggcatgcccaactcaacgaggatttgaacataccttgtaaaagtggaattcgcagaaaaatttaaaagtggaatttgcagaaaaattaaagtggaatttgcaaaaaaaaaaaatgaagattagtttttccaaaaaaaaaaaataaagttcagatttaccagagacaaaatttcaatacctaaaactgatcagaactagagttgaagcatcaacataaacactcttaatggataatattgttgaagtttcagttaaacctcataagttaccagtgtatattatatctaataggttcagatactatctctatacattcaaaactaaaggagttaaaaagagatgtttagaagtatctaagttttagggtgcacaaaaatcatgcacaaatttacaatacatggatatggggaagccaaacttatttctggtaacaagacatact

SEQ ID NO: 74291 - DNA, 5762 bp, Oryza sativa
  unsure (1)..(5762): unsure at all n locations
tatcgctgtagaggaaatagggctcaatgtatgtgtccgcttgccaattccaccatttccccacttttggtgtaggttctatgtatgtaacactaccgacaaatttatggggatttcctttcctattgcagcttatatgggaatgtgggataagtccggtgagcccgacacggtgagggataggatactgctggagctcgagcatgagttccttgaggtctacacgacannaattgacaaggtgaaccagagccgggtgcagctgaggcaggccattgccgaggccgagcagagcttgctgacatctgttcgtccatgggtgaaaccgcccatgcacgttagactggtttgtttctacctccaccaggtaaaggaggtactgtacgattagatcaaacaatgtaagttgagttcttgtggaacaatgctgataggcgaaggaagaaaaggagatttagtagagaactagaacctacaatttctgttgtaagatgatagtaataatgcgtgcatagttgttcttatggagccaaaccgtttggaactccattagcagttaatatttttacaaactgtttgtttattaccattgtgtcaatatattaagggagagtgttggtataccaatatattaccattgtaaacttactgcaattttgagtcgagtggctgcaatgatgtcaagtatagtgtagtctcttctgttaatgcatgcatatatgttgttggagtgttggtgtatgtgttcaacgtgttacctgcagtgataattgtaatatgtatgtatacttaggttgtggatgctaataaaagcaatacatcggcatgagcttatggaattacttctggtcatcatgaattagaagcaaatgaagctattcacaaacttctctgaagattttcgtgtcctgcaacataacaattttctccaaggatattttgtgtgctgtaacataacaatctttccccgttgcaacgcacgggcacctaactttgctaaatattctacttatttcaaatgaagtcattacaaccagtttatcattgtttataatggtcgaattgctcacatacattatttaatacctcagattttcaattgcataatcctcatatttgcttccaatttccaatttaagattgtttgttctgcaatggataacaatggtgggagttctgtgccaacatcgtcaacaagatcaggtgacattttcatccatctagctaatgttatatttatcgctcaattgatatattattgcttgctaatatgaggatcactcctccctcaggtccttttgcagatataactaatgtaattgatgccaatttgacgaacaaccatcccgctgctaataaaaatggaactaatgtgccaaaagatcatgagaattgccagcacaacaacttggactctacaggttgggcgtagcactatattatatattttgtttctttttaaggcttttgtattaagcacagtttttgtgtgcatgcactcttcaagatgttacaaaactaagtgcgactgaactaaaaaggaagcgtgctagggagtggtatgcatcattgaccaaagagcaaaaggaagatagaaacaagaaggcacgatatatcaggaagcggaggaactttgaatcacaaggtttaaatctctactgcagcatatctaaactctctgaacagaaaactttattattaaattaattgaactttcagataatgggtctcaagctgcgacatcaaaaaaaattactactacggcctcatctgtttcaggttgagttgtcatatggtcactgctaaaaatatgtttgtaaatttgtgccaaaaacattttttaatatgtttgcatttcaatagcagctccgtttggtgatattaaaattgcaagcactgaagatcaatcagtagggggccggttggatgttaatgatgcaggcactgaaaatgtgggttctattgtaacgcctgtgcgtctaccatttactaacagttctgatatgtcctacagcttcaaacaatactaaagaaggatgagccatggagtaagccactgcaatgcattgtatacacaatcgtaattcatatatgcattaacttattttctttgattgacaggaaaatatgggtacaaagttcaaggccgcactatattagcttgagtctcaaacagcttcaaacaatactaaagaaggatgagccattggaaagtgattgcttcaacatggctattcgtaagttcatgtatgaaaaaatcgagatgattcataaaactaaagaagcaatatcgaatcattgcttggacttgcaattttgggtaagtttttaaattctaatgctcatgtcattctctattgctcatgttattacctataatcgcaatatcgaatatattgatttatctattgcttatgtaattgaaccattttttaaatcatgtagagtgctactggctttggtaaagacccggtccaccatgacaacataaatcttgcagagaccgtcggtagttggtcggaaattcattacaaactttcacagtgcaaagcggtaagatcgctaagataccatcctatatggccgtgttttatatattatcttgaaggttgatcttttgtagattcttataccagtacgccatgctcgaagttttatcgtgcttgtagtggaccaagaaagtcaaacgctctatgtgttagacccaaatccacttatgccagaatataaaaataacccaaatatgagatacaccagaaaactgataactatttgtgatcacttcaacaaagctatgagaaaggcatgccctggctctaggtggaatgaagacatcaacttgtggaggcaagtaattgtcaataatccggtttacagcaggtaagttatcttcttaaaaactcgttcaaaccaacaaatttaactgtgtagagaaagggaagctaactcttcaatttccttaggagtttatcgggttttcttgttcatctcttcatgtgtacatggaataataaagaaccacatttgccggcaattaatgtaagtcttgacaggcattaattattcatatattacattattatatatttaccaaaatttaacttattaaatacatgtgcaggatggtgacgagctaaggaaactttttttgctaaatctactgatgtaccaacaaaatgagtgtgaaagcaacatccctaacggcgtacaagattttctaaagtgtataaagaattcacaacattagggtagttatttaactatatggaacaacattagggtttaactataatatggagtgatttaatttgaggtgatcatccattagaaatgccgtatctacaaatgctggatgttctatattttttgtttgtgctttatttgtatgatatcatcaaattttcatagatgtcttctatctatgttactttttataatttatgtagtaaacgccatgagattgtttcattacgatgccatatttgtcttttcaatgccagatcttatccccgtgatcaacaaaattccccgtagcaacgcacgggcaccctactagtaaacaaaaaaaaataccgaaagggaagctcgcagaggaaaagaagagcacaaaccccaattcccaacacctccgcgacgcgagcgagcgaagcacgaggaaaaaaaaaaatccccgaatccgcgacgagcgaggcggcgagctcgctgcttcgatcgatccggagagggaggtagggaggagtgagcttgctcgctgttgccgcggaggcggaggcggaggcggatcggggcgccgcggctgctcggctcggcggcggcatgatggatccggagatgatgcggctggcgcaggagcagatgagcaagatgtcccccgctgacctcgccaggatgcagcagcaggtcagatccgcgcccatcgagatcgatcgtttcgttggagatggcgatctggattaggttttggtgtcgttcgtttagatcgggaggtaatcgcgtttaattcggtccggtttcgcgtttgcgtcgaatcaggatcgtgtgccaagttcaagttcggccgggatcgcgtttagggccaaagcaaaatcgtgtcacaaacgcacgtacagatgtggagttcagtttggttgagtttgcgtcgaggcgaaatcaggatcgtgccatgatgagatcacagggttaaattgttcttagtagttgatagtattattactccttttaagtcaaaatagtgatgcaattatacatataataaagaaaatggtgtttactcttctagtcttcaagttttcaagtcaattagacagtgagttgtgggttccaggttgggtttgatttggtcagttaattgattggtgatgacaatctgcgaatgtttttctttctgttgctatcaacaactgcatgattgtataaactataagcaataggagcgttgttgctgggtcttttacacattagtttatgacttttgcttcaactgctggtgttttcgcatgtccttacatccgtttagactttgtcagcgttgtcccatacaagcacaaccatgccaaatggtgatcatggcatattttgtaccacaagcctgcttttggtgcttgtattgaactagaggcctttcgtattgatcttgttgttgcttgacattgctggttattttctgaggagccatgcatgacatgagattgacattttccttgttatgattcgtattgtttcagcttctgtcaaatcctaacctagtaaagttagcatctgagagcatgaagaatatgagagctgatgacttcagacgagctgcacagcagatgaatcaaacaagaccagatgaaatgcttgatatggccgaaaaacttgccaatgctaatcccgaggaggttgctgctatgaaggttcaagcagagcaacagatgtcatatgtgatatctggtgccaagatgttgaagcagcaggtatgtatagcagtccaacttcactttttactatcatattctgttggaattcggttatagtaaggctgagttcggtacccatgtttcccacctcactcccctcattttccgcgcgcacgtttttcgaactactgaacggtgcgtttcttgaacttttttttttcattttttcaatctagaactagaatagagcttcatgttacactttttggcaaggacaaatgagtaataaaatttaaattcacaaaaaaattggcgaatgctgtatgtgctatgaggttcataccattacaggtttggatcaccctgagttaactagtggaatgctggaaaatatacatatgaacttcatgctgacgtgaacactaaagagcatttgatgagcctccttttttccttttaccaaagaactacatctactgatgcattagtcaggctgagccagatacatgtactgttttgtgacaaatgtttactgaacctatgcacctttaccaatattatcttgtttaagaaaactctgcacctctttaattgtttaactattttgaacttgcaaacttccaagttttaaactatttttgtaatattgatatttgtaattcccataatatcacccttatttgtttcattttttttaaatttcagggaaatgaacttcataggtgtgagcagtatagtgaagctgctgccaagtacaagcttgtatgttttgaacgtcaaaccttcattttgtaagtaaatttgaatgtgatgtatgttaaatcaatgcattcctttcctgaccaggccaaggataacttaaag

SEQ ID NO: 74292 - DNA, 59938 bp, Oryza sativa
gagtggacggggatgcagtgctgcgacagcagcgcgaagtaggcgttcgcggcgtcgtccaccagcgcggcggcgagcaggcggcgcgccgcggcgatcagcgtcgcgtcggcgcgcttcgtcggccccgccgccacgaaccgccccttgaacgacctcgtcggcggcatcatcagccgcgccgccgggtcggcgtgcacgtacacgttcagcctctcgccatgcccctcgaagaacctctcccacagcggcgcgaacgtgagctccgagttggtgaggaacaagaacgccaccttaggctccgccaccgccatcgccgccgccccctcgccgccgtccagcgtggctcgccggaacagcgcgagatcaccatcctccccacctccacccaccccatcacccaccacaggcggcgacggcgtcgccgtcgccggcggcgacgaggagcgcggggcaagaaccaccagccaggtcagcgacgcaaacaagaggacagtaagcaccaacggcgacgacgacatcgccaattccggcgaaaggaccaccgatcttgctctccgcggatcgaatcgccggaatccggggtcagatcatgctcccggcggccggaatcgatcggggaatggaagcgaggaggcgaggagtgaggtgaggtgagctcgcggctctcgctttcgctctcttttcctcttccactctcgagcttatataaaaggaaaaatcacggggctcgtgtccatgacacgtggggcccacggttgagtggggcccggtggcagtggtgtggaggggtggtggacggtcgtgggtgggagtggtaagggtatggatggatttgcgccgtcggatgcggggtgtacgtggcaggggaaggtggtggacacgtggcgagtatatcgctttgtctactctgctggctttcggttgtgttcggtgcatagggctggggggaaccggcacgctaaatcatgcggtgaattaacgtatgtttaattaaagattagcttaataaaatttggaaattgattactatgattttaaaaagcaattgtcctataaaatattaccaattaacaggttgagaaagtgtgagaaagaacacatacatgagctttgtacatagatcacctcaatttctgttaacatgttttaacactgatgacttatttgatctttgatgtgtaacttatgccaatatttttctactatgatataacaaaattgcaaaattataatgatgtaaaaatatttataaagaaaaatctacccatatgattttcttttattatattaaagagctattgatggtgaaagttttaaagtttgaccgactatagtcaacaatatcatacatttaaacaaatgaagaagataaaaactatcatttgtatgatagaagaattcgataaataaaatagagaaaacatgatgtgatacattatttttattttccttcaaaagggttctaaacatgttactttatcgtagcgtccatccaagcactcaaggtgccttcctcacagggattttattctggaattaattaatttgcccacatgaaattgctgacatttccaaataagctttgaagtccaaactaaggaaaaccaaaattcacagttctattttcttataaatgatgcattaagcagctccaggaagaaaatcattctgaagtctgaactgaaaaaaccaggacgttaacctgaacgaccaccatttccaatcacaaaaacactttccagtgatgaaattttctgaagcaaccatcatacagaaaaggaagttaaataagttaccgtcaaggaactaaaacacatacgagttgttcttcaaattcacaatcctaagttgtccaaaaaccaaaaccaaactaatcagggctgacttagctgctccaaactccaaagtcgtccaaattgtgtagagcttgactggcatgaacaataccttcagagtggctcaaatcttaatcaggaagaggaattggccttacgggtaaggcgaacacaatctggataaaccagctcacaaaccgagagcgtttcgacctcctcgcgacgaatttcagaaacatcgacaacattgttgtggtcttctctgcagagatattcaatggcgacctcatacccatcaagatactgaaacccttccaagggtgacagcatcgatatacaaggaagggcgaagagcggcttggggtcgaccttcatcgccctgatcatggcggaatttctgagaatgtgcagtgacagctccaattggtctttcatgccgatgaatccacttatgtgtacaagcctgagatgggcatgaggctgcggtggaagactccgtagctcgccatgagcttcttcgcgataccgttgatggtgaaggggcatccacatctagaaaaaaaatgataaatgagaaacgtccaggggtcttccggatagctccacaaggttgtgggcgtaagtctcaccccttctaattatttgattttaggtcattccctaatattcgcgtctttttagaaaaatgataaatatcagcataaaaaatgataaatatcagcattgtgggaaacatggtggtgttattataggtatatctacatgaatatagagaacagaaagcatataggcaaggcaggccatttaactcaggccagcactactgatttggtggtttaattgtatatataggatggggctttttttcagactagctagaatattaacgattagctcatttctcactgtaattgcaagttacatgcatgccactctagatctatacaaaagtaaaaaagtgttgcataataagagagttaaaagctctatcagaactatattattttgttgctcagaagaatgttcatagtatggactttagtccaaaacaggattaggttgtgtggttgtgtttcagttgaaactgaagtcagagtcaagcaagtaaaggaaatgtccaagcagatataatctaacataatataaaagcagttctgctagaaacagaaaatagtgttcaataaacaatataaagtgagtgaccatctgtacccacataacgaaaaaaatctcatgtaaaagccactaagacagtattcagtttgaagaagattgatcggtttacataagtgaattgcgtaatccaaatctccaaaagacagacttacatgtaattcaaacttttgcagtaaaggagcagcttccagtaggcaggcaaagtcaagaagatcaatcttcttttccgtcacagggtgtctcaattgcaacctcaaatgctttagatacataaatttgatatgattttctggcaaaatagccctctgatacgcacaagaagagaagagacataacacaatcaatctcacatagggaatgatgagcaagaatatttgaatgcagaagaactgagttcatgaccaaacctcgagttctgaacattgcaaactcagcgtctcgagatggagcagcgtgcttggaagattggtgaagatatatccaagagaggaacgagcgtgttgcagcttcatgcagacattcgttagcagcaatggcccaggaggtgacaacggtatcagtgtgcccttgtacccaagtttcgtcaggccaagattcaactctatctctttaagcagatggcagctctcgacatgcaaatgtttaagctggttccaaaggtgcgatgtcgacaatcttgtgagcttcccacaatcaacgataccaagaaactccaaggcattgcagttggagatcaaaatctgcatgttttcatcagtaatatttgtgtgttctaacttgagccttttaaggttcagaaaggctttgaaatccacaggcgggttcagagaaacagcactaagcctcatggacagcaaatatgaactgtccatagcaccgaaaaacttaaaagggaaatcatagggcccctctctaggataccgggatttgaaatcaaaagtaagatctttcgttttagtagcactaacaaagctgagccatctgtttatgtggtctgcatgttcattatccaacttaccttggattgctattttctgaacacttagaccactgtgttgcgcaaagacttgactgactctctcgatgaacattttcatcctaagccgtgcatcatgtgaggtcgaagctaatcttggcgacatcgagtagaaggagaattccaagtttacatgggaacaccagatttttttccagtggcttgataatatactcgtccttgccgcctcttttatcggcagccgggatatgataccaatcaatatatcctgcaacgaggagaacaatggtgtcaactgtacaaacaaatcagcatgttgttgatgaatgaattatcaattgatcataccgtaggtaggtcattgaaacgaatcactggtcttttccttttggtcgtagtagcatcatccatgtcttcttcttttttggttgtattagttccaatccgtttcaagcttcgttttgtctttctcgtagccaccaaactgctgcccacagcagcaacaccaacacgttgacctagctagtaacaaaattaatggcttgaatcttaggaactactatgaggcttgttcgccggaaaccaaataacagtcggatgtaagcaagaaaaagaaagcgcatctgatgcagggatcgattgattgccctgttctagatcgatcgggtactgtctctggaagatgcaaattccctgtacgggcaaaagaagaaattttgaaggggttgggaggggggggggggtgaatacctgagatttggtcgatcggcaggattcgtacccgcggcagaggaagatgcagagcacggaagcggcggcgcagccgtttggatgaagaagaagatgatgatttgtatatatatatatatatatatatatattagaagatgatgagcaccgacttgacctccaactctaatccgaaacgaacactgaaccgatagtcaactttcagcaagaggcaggcatagcgccgccggcaacggacagccggatcggtggcgtggggctaggtcgccggccgccgcctggggctcgtctgctcagggatagggcagtcatcactcaatgattcccccccccccccccctctcagagagggagggtgaaaccgtggagaagtgaggttggagaggaggggcttaccagatcttgatgactgtcgtcgcccctgcccgccgtcgccagcgcctactgccgccaccgcttagaggtggccaaatgggccgggccaaacgggcggcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcgggccggcacggcacggcacggctactgtagcgggccggcacggcacggcacgccggcggcccgtcaggcgcggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgcccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcacaggtttgaagagctcgcggttggaaagatgtaagtattattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagatggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttaggcaattgtccaaaaattttaccaatttctagaaactttttatgattgtactctaactttgtcacaagtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttacaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaattattactttttttaaacattttatttccatttttaattttttttttccttatacatttcctttgcttttttttaaaaaaaaaacactgtgcactgcaggctggcggcctgccttcacgggccgccgtgccccgaacgacccgtgggccgcgggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggacacctataccaccgcttgagttgcgtcgtgtgctggttgattttcagggccgtgtgccgatttgcctgattttcttctcgtttcttttttaataggcagatggcgctgcatagcaattaacgtgagaaaaaaaaataaagcatatggcaatttatttgttcaaataatagcccttaaacaataatacatacattttatatggttagttagaagataatagtaaaaaaatatagaaggatgtagtatggatgatctgttaaagtaaaaaaagatatagagagaattttttttttaccatttagtaggtatatgaaagataaaatttggatgagctgttgggatgctcttatactaccttggatagactactttgacttcttgaaagcaaaataaccctaccacgactagagaccggcatgattctaattttgtaaaatgttaatgacacggttataaatagatgaattataatgatattttttaaatagtcaaattaccttttttttgtttttttaaggtgacgaaatgattatacttgcgcaggggtatatttgttattacttttgaaccgtggtcaaactagtgagtcggcgaattcaccagttcaataacattgatctcattggatggtctaatcagccaaagaaaaaaacaaatttttaaatttttaaatttaattttaagattgatttaagatatttttaatgtagtttctttttcagcattggcttttaattcaccaagaacatatatatatatatatatatatatatatatatatatatatagaaaaattattctacacccgggtatagaatagtcccaaggtccaaacccacctcccaccttagtcaaaggtcagtcaaagcacccccacgtcggtcaaagcctggtcaaactgcctaccaactcccccaccacccacctcttctcaactctcgtcttgcgaaacagtgcagtaacgcgacagccatcgtgcagtaacgttgtgtcttacgtgcagtaacaacattcaaatttagttgaaatatagtcatgacagatctacttttgataagcactttttttctaacatcatggtgtaaacggtttaaaaaaatcatatatcacatgagagatattgttattcgaagcttgggtttttttggatcttaactctccacaagtagtaatactagatagcattactactcgttactaccatctgtcatgcgttactataatctcatcgcgacgttactgtaagtgtgcagtaaagaccataagttttatagtaacaatgcgtcttactgcaatttttgaatagtgttactgcataaacatgtggtaacgtgtacctgctatgtagtaacacttccactttgtgcggtaacaagtatatttagcatgtgagacttttaacccatatttttcttttgatttctggtttactataatttcaccacgatgttactaccaatggtgcagtaacgatctatttgttttacagtaacaaagtttttactgcagttcttgatagtgttactgcataaatatgcggtaatgtgtaaatgttaggtggtaacgtgtatctgccgtgcagtaacacttttacttttgtgcagtaacaaatatacggttagcatttgagactttgtacccatatatttttgtttcaattcctgatttactgcaattcaccacaatattactgccaaaagtgtagtaacatcatatacatgcatgcagtaacactatattagagggagaagaccggttttcttaagaagagggaggaagaacggtttcttgagtagaggagtatgtagatgcattttgaagttctatcctccacatgtagtaacactttagtatcattgtgaaaatggttttagaaaataatacatatcttgtgagatattgcttttcaaatattggcattttgaactttaacactcctaacagaatatgtaatttgcagtaacatgggtatatacatgcagtaacatagttttaccaaatgcataaaattgttcaaaacactcctacatcaatcagacctcactcaaagccacctacagactttacctatagcccacctattcgatcttcatctcataaaaatgacgtagtaaaactacgattatcgtgtagtaacatagctacttggaagtggtaacatgcatctattatgtagtaacattcttacttttgtacattaacaagtatatggttagtatgtgaggctttaacccatatatttttgtttagattcctggtctactacaattttactacgacgttactgccaaaagtgcagtaatgtcctatgtgttctacagtaacgtgacgtgttactgtacttttacaacaatattactacatccttctatatttttttactattattgtacataatacaaactatattgagcattaagcatttttcttatgttattatacttttaaactttagtacgggaatttctatgaactttctgagatcctgaaagcagaaacagaagacggaaggaaccaaattcagtgaagttcgagaagaaaaaattggtcgcccaattccggaaaataaactagttgaggatacagacgccaaaactaaaccaaagcttccaaaagacattttaaccggagtaagtttgcagccttaatcagatttagattctgatttatccaccaatgctttgacttgatttatcgtattgcaggtattcggtggtccatcgtgaactcatgattgatttccacccccttgccttggattggagtatatcaaactaaatggagttgcgctgagataatcgtgttcttcatccgttcattttttagattgggtcatgctcagagcaacttactctttccgtcaaaaaaaaaaaatcaacctaggaggacaatgtatgtggacacccctatgtccacatacatcaacttaggaggagtcatattctttatgggacggagggagtaggttcctacttcctaccttgagagtaccttttcgtatctatgctgtgttagggaaggtttcggaacctgacgatgaatgcatgattgggctattgtcagcatcatattatgcacccctgttttgtcagcaatcatggctgtaatactgaaacagaagtacaccgttctagcttgaaatacaaaatacaaaagtataagatatacaaccatgcctgcctaaggtgctttaagtgatatttacagaatcatccaaaattttatataaaagtactccctccattttttaatagatgacgccgttgactttttctcacatgtttgaccacttgtcttattcaaaaaatttacgtaattataatttattttgttatgagttgttttatcactcatagtactttaagtgtgatttatattttatacattcgcataaaatttttgaataagacgaatggtcaaacatgtaagaaaaatcaacggcgtcatctattaaaaaacagaggtagtataagatataaccatgcctgcctgcctaaggtactttaagtgatatttacataatcatccaaaattttatacaaaagtataagatataaccatgcctgcctaaggtactttaagtgataaaacaacttagaaaataaattagaaattatgtattttcttaatgaaacgacgcctaataaaaaagttaccgacgacatctatttaaaaaatggataattctaccagtgttcgtttcggattacagtattgacactgctcggagatgtccatgaagaaggggattcaggtcaagtccggtgctcatcatcttcttcctcctccaaacgtctgcatctacctctgccgcgggtgcgaatcctgccgatcgaccacatctcaggtattcacccctccaatccccatgtgtaagtgaatcacccccatgttcttgccataaattgttcagacacgatcttccttgatgcattttgccaaccaattatctacttgactacttttgataattccaggtgatgcaaatcaatcggtcacaattttgttgctgatgagggtctgaaggcctatatctaccggatattttgatattttgagggtaatttggctgatatctcttatcctggatccctgcgcgacaaccgacttaatgatacgttattctccaaccggctctccaagcgcctttcttgagatgcagccagaaatccatagtatgatgccgttgctggcccatctcatttcagaaagtgtacgcagatatttcttctgcatggcaactatccatttaaccatgcatttctttcatgttgtagtttgtagaggaggcccctgaagaaattgtttgtggagttagcgagaaagcattagaagcagaagaatcggctcgcttttctagttaactgtttccagtgaaatataggacactctagtcaccattggttcatcacttggttctgcagttgtattagggaatccgagctgttgataagttgccctgtaaattactccatccacgtacaagtgttttttttcttcttcccccgatagtcctacaccatggtttacgatgccggttgactgggtaaaaaacacaaaccgctcggttgtttggtgaatctttttttaaaaagaaaatcaaactttattttaaatttgtcacaggatctgttcagatttcattggttcattaatggtttttgtgaaatccgaagatatcgctcatgagtgggtaagcggttcttgatcttagtctcatgattatgaaccttgtgcacataattccagtggtatatatcatgtattgttgcctctttccaaagtgtatccgattgtcagctctctttgctatatcctgagctcattttggagtctgatgcaacaatggtcccgactataacactgtgatatgttgtgatatgttaggaaacgataagcgaacaaatgataaataacaatagatcaatcacagaagacacgagatttaacgtggaaaaccctcccaaagtaggagagaaaaaaccacgggcgccagccagcaaaatatcttcactatatctggggtgaggttacgacgccgcacggcggcttacaaaaggtatatatatagtggaacccaagcctcccggcgatgggcctccgctccactacggtagaagctggcatttattaagtgcaaatgaatttggatcacaactcaacatgatatgggaactgaagcatttgttgtcttcaaattttatctctttctgggttaattataagccaagagaaggaaatagagtagcccatacacttgctgagctgggatcgttgtgcttgacagattctgagccggtgcttgtttctatgccatcttgtattacaaatttggttgccgaggatatctcagctaatggagtaatgaaagttcgggtttgtttcaaaaagaaaaaacagtaggtgatttcaagattggaaattatgcgagtgatcacgttttttttacaacaaacacttccttgtattacctctactggtacacgtgttgtgttgcgtggtgcctatttgttacacaaggcctgtatgggcctcaacgaccgcccatacttgtacgaggaataagttcatctgaggtctcttaacttgtaaacgaatccgattttcgtccctcaaccgaaaaaccagatacaatgtgtcccttaactatcaaaaccggtgcagattaggtccctcgacggttttgagggtggttttggctaacgtgacgcctacatggctaatttgactcggtcttcatctggcgtggcattgacatggcgcctacgtggcaattcgatcgaaaaaaataataaaacccatgggacccacatgccagtttcacacacaaattaataaaaaatggtggggcccacgtgggccccacatttcatcctcacccctcctcttcttcctcatctctccccatctcccctctcttcatctctctctcctctcttttctctccaggcgacggagggaggccgacgagcgcgcgtggaggccgacgagcaggacagcacctcggcagcgaggcgtggacgagcgggcagagcgggctagcggagcagaggaggagcggcggcgggcgagctcctcgccctcgcagggcttcatcgtcgaggagaggtcgcaatccttcgtcttcgcagggcgtcgcgcggcgaggcggccggtcgcagcagcgccgaggagcggccgcaggggaaggggtcgtggcgtggagtagctagaaggaggcgaacggatggtcggcgacgaagtccaccaacttcagcggcggcgagtagtaatcgttgcacagcgtgaacccgagatcatcgtcgaactcctgcccacggcggcggagctagaggtcgttgtgggtgtcgccgctcgttgccgccttctacggcaggtggagcaccttgaagccgtcgtggcaggcgacgtggtggtagctccccgccagccgctgcatgaaggagaccacgacggagttgtcagcaaacacacgcgatttcagtcgctatcctagcttgtctgacgaaaaacgacaatgcagaaaaccagagaataacaacgttttggtgctgcaaaactgcgcagcttttctgagttctcttcttccttttattcttctccacacaggaggttgttacatgcgcgatcttgccagatcaaggactaaccatgccatcccacgatccgatccctgctcgatctcttctactaccgaaacagaaaaaacgataactaatccctgctccagcgcgatgtcgtcgatggcttccacccggaccagctcccggtccacctccacggagcgctcggcgacgccggactccgcctcctcgttgccagccacgctcgtggtccgtccggtcctctccatgtctcggcgtcgaagtggagctcctgcacggggacggaaaggaggccaccaatgcactgcgcgaacccgtcctggaccgatagacttgggcctacccatcggtggattagtccaccatggaccgtgtgtgcacgtggagaaggaataagttcacctgacattcctcaattttacgtctgatccccaatccccccagtaaggccttgttcggttgggccgttcccggccgggatcgggtcccaatccccgtggatcaccccggcgaggaaaaaaatcccggcccatgcgaaattgtgcgttcggttaagcactgccgctgattttagcccggcccaccacggggtttccctcttctctaggcccgggaataaatcatctcctgaggcggcgtggaagttttcctcgaggaggcggcggtgcagcgaagacgcgacggcgggggcggcgcgacccggaggcgatggcgacggcacggcgctctcctccggccgccatattatctccggtgagcacgctgcctttctacctctcgcctcctcttccaaagctagggttagggttttcttctcttctccctttcccgtcgttgccaccatctctcgtctcgccgtgattcgatctagtgtgtgagcgctcagcgattcgtcgtcgtcctcctcgtatcctgctcgatctggtgagttcttgatttgggcgtggagcttttttttcttggttgggtggggatgagttcttgatttgccgccgccgccgcaccgcccaactctagttcttgatttgagttcttgattcacggtggctttgaggcaccagatggcgagagtgagagctgtacggtggctatggaaacatgtttgccttgattagttttgcttagtgtgactgatgttgtgatcgatgcttgcctgagcatgtcttgtaaaattgactatacaagtttttacagtgaagtactcggatcttggtgcttccggtgtcccaacttgtggtggttggttatatttctgtttggaaattacaagggttgggtgtcctgattttgaggattgtagagatatggaggtactttgtaattagtttaacatttctgaattgtaaactaaatctgtcgtcattgtttcacaagcaaactaacaacaaaatgcagtggtatatacagtaatgtatacttaactgatttattttaaactaacaacagtagcttttagtctcattagactaacagatttgttttcctcaacatgatacttgtataaaaacatgtttatcgtagctattcaagcactaatatgtctagtgttaaatgagctgattaggtgattaattctgtacccatgttatactgtatttgatgatgagatccttctatttgattgaaaaacaacagatccttctatttgattgaaaaacaacagctcctactttgatggtagctagctctagttctgggttttatgtaactctagctctagttccggatatataatcttggatcctgaatttgaattgtcagtgatgtgtataaattgtgtttgttttgtagattgcacgtgcacctcctccttcctgggaccttgtaccctctccttcctaggatagtgctgtgcttcaggaagatggcaaagaagaagaacccaattgtctttatggatatttcgataggtgatgaacctgaggccattcccaacccaatgactaggatggtgtctatagcattaaataagctgccacctaggatgaaaaatgatgtggcaagtgaataaatgaggaaatagaaggaaaccatgtcttgcatgagacatggtttctacacaacatccaagacatcatgtgagataagtaacattaaatttaagtatagaatagttgtgtttgcattggaagattagtgtttagtactagtttcttgatgatgtggagtctatggaaactatgtctagtgtcatgggttgggaatgacctgatgaaagaatgttttttgaggtgccatgtggctctagctatgtgcttcattattcctgtgttttgtcaaggctgaattgtgcttccatacattctaattttcaaagagagaaactagaagaaggttgaggtggtcattcttttctacattcaccatatatctgtctatccactatatatgatttctgcatcctcttaaaattcaggcaactcaagattcacatatgttatacacttgagtttggaactttgcgcattataatgttcattgcattatgtctggtagaagaaaaaagaataattggatggttgtagttttgtttcttctctatttctgagataggtaaactgatgtctactaattgattttccttgtaggctccttgaaattgactggtaggatgttccatagaatttttttgatggtagcagttttctgatggtgtcatttagactaattaaccatccaatgaatggtctactgatgtgtcattttggggatgttgggagaagtttggattttgatgtgcatttggactaattaatcatccaagttgtcggcagatggattcaacttgctgagtgtaagggaatggaatcagaacaatcttcttattatactgtataaatatctcctgtacttttggctggcactgcattggcatcaactttcttgatcaggaagttgtaacaagcatgtatatgttttctaattttctcttaaatggaccgatggtatttttgatcttgctcctgtgctgctgtcacagggtactagcagtactgctttcaggtaaacagtggtaactaaatgtactaatagtactaatactagtagatcataaagtgagctagcaatatgctgctatattcgctgccaatagccagtatattccctgtcaaaacgaacacagggtttctaagagagggattggaagaaacaagggatttactccccatagggtttgagtgacatgggactcaatccctccctggtttgcttccccttggggatttaatccttagtaaccgaacaaggcctaatagaaaccctcaactattcaaatccgttcaaagttgatcccaaagtagtatggactaattttttttttggaataagttcatctgaggttccacgaatccgattttcgttcttcaaccgaaaaaagatacaacggatcccttaccggttttgacatcggttttactaacgtggcgtcttcatggctaatttgacttggtcttcatctggtgtggcattgacgtgcgcttacttggtaattcgatctggaaaataataaacttcgtgggacccacatgtcagtttacacataaattaataaaaagggtggagcccacgtggacccgcatgtcagtaaaaagaataaagatggtgggaccacgtgggccccacaagtccatctcggctctccaatctccatcgccgccgtccccagagaacctcaatcccctcgattcaatctgatccgacgagagagagagagagagagagggagagaggagcgggagcggcggtgggcgagtgcgggtgcggagctcgtgccgcctgtacttcgtgcgcaccgacggcggcggccgctccccgccggtccacacgttcggcttcgacaaggaccacgacgcggcggcgaacgaggcggccatccaggacgggttcgcgcagtgcatcgttggcctcctctccgtcgccgacgaggagagaagcttcctgctgttcatcgtcgtcccgagagcccccgcctgggatgacgtcacccacctgttcgaagtgagctgctcttaccgagacatggagaccggacgtaccacgagcgtggccggcgaggaggaggcggtggtacgtgctcatcaggccgtcactggcggagtccggcgtcgccgagcgctccgtggaggtgggccgggtggaagccatcgacgacatcgcgctggagcgcgagttccgccgcctcgacgacgggagctccgtcgaggtgtccttcatgcagcggccggcggggtgctaccaccacgtcgcgtgccacgacggcttcaaggtgctccgcctgccgtacaaggcggcgacacccacaacgacctcaagctccgcgacagcctcccgtcgttcgccatgctcgtcttcctccccgacgaccgcgacggccggtctatcggacctgctcgacaggatcacctcctcgccggagttcgtcgacgaccacctcccgccggagtgcgtccccgtgggcaggagtccgacgatgatctcgggttctcgctgtacgatggttactacccgccgccgctgaagctggtggacttcgttgccgaccatctgttcgccttcttcatcgtcgaggagaggttgcaatccatcgtcttcgcaggacatgtgctcgatccttccgaggaagtctagtgtatatttacagggaaagtgatcgatctaatatttattactctcttctttcctaaatatttgacgccgttgacttttttttaaatattttttaccgtttatcttattaaaaaaattttgtgaaatgtgtaaaactatatatgtatacataaaagtatatttaacaataaatcaaatgattagaaaataattaataattacttaaatttttaaataagacgaacggtcaaacatttttaaaaaagtacgggtcgatggagggacatgtaaattatctttgattttgcatttcacttcaaaggtggcacgctgcatcagcatgtgccagcagcagcgggacagggagatgagaagaagctacagatgaacacctccccgtgcgccatgtcacctatttttaatatttcccaaatcaaattaccacctaagcatcacgtaatgtgaacactgagtcaaagtagccacctagacaccatgtcagcgaaaaccgctgtccaaaccgccatgggacctatattgtgtcagcaaaaaccaccgtccaaaccgccatgggacctatattgtaccggctttgacagttgagtgaccgttgtatctagttttccggttgaaggatgaaaatcggatttgttgacaagttaagagacctcagatgaatttattctaactttttcttggtttcgctgatgtggtatagtcggggcccatatgttcatgcgcctgtcgaagaggtctctcgcgaggctccgttacgccttggaacgccgacatctcgtcacccggcttccacccacacgacgaccttatgtggaaagccaaaggcataaggtcagagagcggcgagcaagtggccatgccggttggcaaaatgctcgcggagctcgacgggccatgattacgacaatttgactctttgcaaaaattaattttacaaataaaccgtgactaaaacttattttagaaatgacacttttgttcagcaccaaattgtatggcgctgaacttagatacctcagcgtcacgtcaactgacgctgaataccgtgccactgcggatgggaggctgagtcggcgtgccaacgtgcattcagcgccgtgctatttgacgctgaggtgtctaaattcagcgtcatacgatttaacgctaaatagaagggtcattttttaaataagttttggccacggtttaattgtaaaattagtttttacaaagagtcaaattatcaaaatttgtgccatgattaactaatctagaatatgcagctggttgggatgcaggctgcagcttgttacagcaaattgtgcacacataatgatatttaccactccctcccaccgtccctagatatttaacgccgttgattttttaaatatgtttgactgctcgtcttattaaaaacttttatgaaatatataaaactatatgtatacataaaagtatatttaacaatgaatcaaatgattggaaaataattaataattacttaaattttttgaataagacaaacggttaaatatgttaaaaaaaatcaacggtatcaaatatttatggacggagggagtatgccgtcctattgtgcacggattaaagctcaagttacagcaaatgctttttgtaggcaaaaccgcacaagttacgtgctgacatgactgaagattatccagaccagcttcatactggaggggtacgtagcttcagatcatttgtggatcgaatctccaatctgaacaatgaagtttgcagtagcggtcaggtcaacaagaaattcaatcgtactccctccggcccacaatataaggattttaagtttttacttgcaacgtttgatcactcgtcttatttaaattttttttgcaaatgtaaaaaatgaaaagttgtgcttaaaatactgtagataataaagtaaatcacaaataaaataaataataatttcaaagaattttgaataagacgagtggtcaaatgttgaaagcaaaaactcaaaatcccttatattatgggacggaggaagtatcgtcttgctgtaccaggagagccttctccgtctaataacgtctcactggtacactgacatgtggggcctgacatataccacatcagtgaaaccaagaaaaattttaatgtttactgtcttgggactaactttggacggttttaaataattaaggggtagagatttatggtattgggaattggggatcttaacagacttgatgtaaacgtgagggatgtcaggtgaacttatcgcggaggagtgaattacactttgcactgggtgttctattttgcattgggtttactatgtattttcagtttgacttctctctttttcgatttacacacctaggggtcaatgaaaaggcactcttacgctgttttccttaaaaaaatactccacccatctacttttgatagtcatatttcatcttgacatacagaccaaggataagtaattctacttatcatccatttaaatatgctactagttatttctcgtaaaccagcgatccattaatatttacatttcccgatgcccatctagccaatcttatgtggaagaatgaagagtcacgcattaaatccgataaacatccgataaagtcattaaaatgataggttgttagattgaaatatgcctatcaaaaataaatttttcagatttggaaatatagctatcaaaagtagatggagggagtagtatatatttttgtcgacgggagatacccgtagaccggatatagagggtattgggatacgctgatatgaggatctacgtagtacgacatcaagcaaacagggaacaaggattatactggttcaggccccttaataggtaatagccctaatctagttgatatgagattatataatggaaaccacatattacaaagggaatagcagaactcgatgataccgacgagaccgtagtcgagttggttcgactagatcacccggcgacttggctcctgtaggctccgacttcgtaggctgtggtggatgtgttgactgtgagattcgatgccttaggtcctctcggggggtcccttttataccgcaggtcaattggttttaagtagaactcagagacatcggacctcacacgatacagtaacgacccagctctgtccgagtaggactccttccatccgtggactccgtttctgttacatgatgaatttccttaacgtatataggaaacatccgtatacgtgcaggcataccatatcagtatacaacatacatccaagggtagagggtataccttacccatgaccctgacaattttcactttgtatcaggacatatcaaaataattttcaatttgcactagattgtgtcatataactaaagcaaaatcttataaatcatgagtgaaccttacgatttttttaaaaaaataaagaccatgttttcacaaagtttcatccatatcttataaaatttgattttatgaaatttctatagatttgatgatgtatatcctggttctaagcgaaacttatttgaaggcaacatgtatacgctaaacctattgtaaagtgaaactaagcgtgctttatcgggtgcaaagtgcaatttactcttagcaaaatctagagcaaagtcagaactctttttgcacttgccataaatttgaaatttagagcaaagaaagaatttctttccactgccggtgatcatgataaattcctcgctagatagaaagagtattagattaacaaaaaaattgaggtttagggagcaaagtcaagaatgtatttttactgagatgagcaacgaccatgcataaattcctcgtcaaaaaaaaatgaaatttagagagcaaagtcaagaatgtttttccagaattttattcccattgtcgtttgactgaatgactgttggcccgtttgactaatgttctggttatctgatactctctccgtcccaaaaagactaaattcctaggttttggtgttcaacgtttgatcacctgtcttatatgaaatttttttatgattaatattttcattattgttagatgataaaacatgaataacactttatgcatgacttatctttttaaattttttcataactttttcaaataagacgaacagtcaaacgttagacacggaaaccagtactataaaagatactccctccatctacttttgatagtcatatttcatcttgacacacagaccaaggataagtgattctacttattatccatttaaatactccctccattctaaattgatctatatatagttttttttaggttatttctaaatgatctactcgttttttagtacatatttgtgtttattcattaggtctattcgttatttgtgcattggagtaaattgacattgatgcatgcatcacaagcatttataatccacatgcaatatcttgatttgctattagctaggaaatagtggggatggtgcatgcattgagtttgttgctagagtaaatatagtatgagagagttattagcttttcttggtcttagtgtacctatgaaatatgtagatcaatttggaatactccctccgttcccttttgatcatcgtattgaaaaaaatgataattccattttgatattcgcattacggtggagaggcgatgaaaatcctgtgaaggacgttaatgacacttcctaacgaacactgcatgcatctgattggtcaggctatgcggcatgcaaaactaattaggagccgctgcatgcatggatttaatacgctcacaactgattggccagcaatacagtatgcaaaattgatggcgctacattcacggatacgaaacgctaatgcatgttttcgatgctgattaagtgctccgcaggattgtcttggtattgatgcacaaatcatatatgaagatcaattagaaatggagagagtactggtcattcctcgtaaacaagcgattcattaatatttacatttctcgatgcccatgtagccaatcttgtttggaagaatgaagagtcacgcattaaatctaagaaagccattaagatgataagttgttggattgaaatatgactatcaaaaataaaaatttcagatttgaaaatatgactatcaaaagtaaatggagggagtactgcggaatggatggttaattatcaattaaatacagctgaatggatggttaaacatatgatcaattggccttgtttttattcagttttaacagccctgaaagaatcctgtctagtgattcaacttcagcttttccttggaacgcgctacatgtatttcacagatccacttcatattccaacaaaagatatatattgttcaaatcttaaccaaaaggtctaaaaaaacaagcaaaataagcgggattactcaactgagtgatgtgaaaatctttactacctaatcgagaaacttgcacagtgaaaaaaaaggaaatatgtacgtactttaacatagcgtatgttttgccattacaaaccgctctgcagttcaactacttcaagataagaggcattattggcagtcatcactcaaaaataaactcaaactagcatttctgtgaagggtaataagatgggacgaaaaatgcttccagaactaacaatcccagtttttttataagtagcagcatatatattgaccacttctgatattttaaatcttgttctatgagttttaaatcttaatacttattaagtgcatgcagcgcatacactacttaatctttgttacatacagaataagttaatttctatttgatctttgtgtcaaaagtaatacatttaacacttttgaattgagagagtaaatgcagcttactagaggaagaaggttttgcaaaattcaaaacctcacaaataggaggcgcggccggcggcggtggaggttggtttggcacgaggagacgcggccggcgacgggagaccggcttggtgtggtgaggcgcggccagcggtggacgaggctggcttggcgcagtgatgcgcaaccggcagcgaggaggctggcacggcgcgacgaggcgtggccggcggtgacggaggcgggcacaatgcgaggaggaggagctgccggcgggtgcggtgcggactacggcgcacgaaggctggccggcggggggcaccggtgcagtggtcccatatgtcagcagaggttggatagtggtagagcatcggggcgccagcatggattcgcaggtggtgagcggcgtgtgaaaatccagcccggcctcagccgggccggcaatgatgacgcttgaagcgtcattcccctcctgatggcgttgtcgtgcagtctcatccctcttgtgtagatgccgggcgaaagctcagtcttggctctcttttagaccttgacggacggcggcggcagtgctttccgtcgcttctctacttggagacgtcgtttaggcatcccctagccgaaaccacccaaccaattggtgtaagctcactgtagatttcatcctcttgtggcggcgtcctagtctctacaagttagccacgtcagaggcctaaggggaagaggagtttcattcttctctctcaccctctttccctaactcctgaagacttggatagagcgggactttgtgttgattgtaagggttgggttttgggcgatcccggctgtgttttctttgttggcctagcggcagtcggtcacgcttagtggcggcctgtcccgtgctagccttctcctggttcaatgttttggcgttgtcggtgtatgggtggtggtatattttttcctttttcctggttacaacctgtaatcttgtattttttcttctgttctatcaatataacttcgcaccgtcttatgcgagtcgttcaaaaccgcgcaaataatgtcgctggatgaattaagagagggtccactatatgtcattaaaagtttacactagctcagagatttgttatggactttttatcccttctctgtaacatactccctccgttccataatataaggcataactatttttctttggatgttccataatataaggcatgcatgcatgcatataattaattaggacatcttctccattaaattattgcttttttaaatcatccatcctcaagatttctaattctattggatgcatgcattacatttattagggtgatctaaactagaagataataataattgtttcttggtctttgggttaatggtagttgtgccttatattttggaagggggactactaccgaagtaccgaaaactgatttcattactcgtgtgccgacccacgcccatctggacccgccaatatgacctgacttccgttgaatctcctctgctaactgctactaactgattttactgtgatttgatttatcatcaaatattatttatgtatggtttaaatattattagtttgtaaaaaaaataataagatgaatgattaaatgtttataaaaaaattaacggtatcctatattaaaaaaaacaaaaggtagtatgcccgaaccctattttaaacgtctaagagctgaaggagcatttagccatttaagaactatacgagggtaattacgctcgtatgtgtcttgagtctctcttgacctcttaacacacgctttgaactagatttacgtatgaagacaactcatcatttgaccccgaactaaaaacaccacgctataccacatgcgtttccgtgtcttcctttcttgcactccttcccaatcatattccgttgtgtgtatatatttttgaaacgattcgcaccaacacgaatttatatatatcgtcgtgtatatattttttatccctcgagaaaatattcactcatttacttaaaaaaaaccattcaaacggtaaaaaattctggaaaaaaattgaaaaacacttatacaacatatatctactccctctgtttcacaatgtaagccattctagcatttttcatattcatatttatgttaatgaatctagacatatatatctatctagattcattaacatcactatgaatatgggaaatgttagaatgacttacattgtaaaacggcggaagtataaaacttcacaaaatcttaggtccaaacttaacccatacgttgagatataaaaaaaaaatccagcatatgaatagtgtatattgtttacgtttaaatttatcttcttttttttttctcaatgttgtgtagatcaaacttgaacttaatgtttgatggaccgatagatatatatcattacatcattgtcaacttttttcaaaatctttcgtaacatttgtttgaattttttaaaaaaaatacacgagggacatccgcaaatccgctcaacggattagaatacaccccaccgtgtatatatatgtatagtagcgagcagatcaatgaccaagcctcagctagcttgcttacgtagaagtgcatacgtcacgtcacgtcaatcgattccgactccgaggagccaattaatgggcgccggcgccggcgactggcccgtcttcgtcgacggaggaggctcatcgtacaaaacaagctggtccggcgccgccgccgtcatcgtctgcctctgcgccgtcgccgccgtcttcctgatcatggccggcatcacgcagctctgcaaacgcgtcttccctgcggcgccgcccgcgccgccgcctcaacgccggcgcgacgacgacgacgacgatggcattgtggtcgccgtcggcatcgacgaggcgacgctgcaggcgctgccgctggtgctgtacggcgaggcgaggacggcgcagacgagctgcgccgtctgcctggagagctacggcggcggcgacgtgctccgggcgctgccggagtgcggccacctgttccaccgggactgcatcttcacgtggctccggcgccgcccgacgtgcccggtctgccgggcgccgccatcgccggcgccgcccgccgacgttcttggtctgcagctctctgtttaaattttatggttaatctttctttctttccattcattaatttatttgttacaccacaattaattaatgtcactggctagaagtagaagatggaacgaaattgcttcaatggatgtaaatttgggttccttgtgtaattataggttgaatggtggtcaagtgaagaagagtaaattccctgtgtacccctgaaaactcactcaatccctttcatacccctaaaatttacccgatcccttctatacctctgaaatttcaatttgattccttccatgcccctaccgttacattttccatcattttactgttacgtttggttgcaaatgtcttttttgcccttgatgctttaggtttaaatataagcttcaaaaataattgaaaattttgtttgagtgcacatcgtgtgcattttataaaactaatgagactaaataattagtgcagaaaattttgacataaattttgaaaataaaataaatgtaaaaaattaaaatttttatttgaaattttaataggacaatggatttttttatcaggagcattcataaaaaaaatgttgtgaacattggtatacctatctttatatgaatgctcctcatttttatgaccttttttttaaaaaataaatacgtattttttttatttcattatctaaaaatatttttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaacggtcaactgacgggaggggtatgcaagggatcaaaatcaaattttgggggtatataaggaagtaagcaaaattcaggggtatagaagggattagaaaaaatttcaggggtatataagggattttctcagtgaggaaacttgatcactagctataattctctcttttgtacataaatgttttatgagtctcaacaaaatttgcttaaattaaagttgtcattaatattggaataatgttcttgagatgatagaaatacgtagtactccctcctttctaaattgatcataatataatggaatttaaaatttctcaaattgatcatcatataaccgaatggacacgaatttcatcagaatacaattaatacagcatgggagaatgtgtgcgtgctaaaatgtaattgacatgatgttttaatcgatacatacattgtaaaagattcaagagaaaaaataatttgaattttcgatctattgaataggcttgctaaacctgactgcatgcaccatgcaatgtcggtaatgttccctcgggctcatccatttttttttcttccatttgatggcaagcatttctcttaaggccttgtttagttggggaaattttttaggtttgattgtcacattggatatacggacatacatttgaagtattaaacgtagtctaataacaaaacaaaattacagattctgtcaggaaaccgcgaaacaaatttattaaacctaattaatccgtcattatcaaatgcttattgtagcaccacattgtcaaatcatgacgcaattagacttaaaagatttgtctcgtaatttacacacaagctgtgtaattgatattttttttcatatttaatactttatacatgtgtccaaacgttaaatgtgatggggtgatgggggaaaagttttgttttagaactaagcgaggccttacttaccgtagggaaaaaacgcgaatattaagaaatgatctaatataaataattagaaagggtgaggcttcgaactcagatcgtctagcccaccaccttgtggatcgagctagccgaaagaccctggtatttctcaacttaccgtaggaaaacatcggggagttcataggagggataagagcgcgtagcgggaaagccaggcttggcgccaagaaaaatggcggtaaaaaggaaatggcgggagtccgtgctgctcctccggttaatctcgctttcatacacctctctatgcatctgggccccacttggcaggctgctctctctccctctcactgccggtaggacccagtctggctgttgatctgtgtgggcactgtgctgtatagccaacgtccaagccatatttttttcagcgtatttatcagattattgaaatgttagtttatttatcgaattatttgctctaggattaaaaaatgtgttttctaaaaaaagacttatactgcattacttaacccatttgttttaagatatttgtcaagtttatttctaaaaatatttaatttatatgtataattaagtacataataataaacagtgataatcctctcaataataaaattcaaacagggtcactcaccagaacagctaacaagcgttcatccaacaggttacacacagtacaatgatgattggtaaaatagcagaaatcctgcagcatcaaattacagatgcatgaactgcagaactggcaagcttaactgcagaactgcagcactcttattccacttgcctcaccccacaaacaaacggatacttctgaggggcaaggaaaggcaattacatcacaagataaaaatagactcaatatcaactctcaaacatacagagatactggtatagacacaaattttcaaaagcaatgaacaatcagaaacacatgcttggtgttggtgcagcaacgccaccagaagcccgtccagccatcttcatcgcgagcggatcccatgccttgccctcagtgtcactgcaattgccagacttgtttggatacatgtcagccacggtggtggaatcggcgtcgccctttgcagccaatgccttcagacgaatgcgctcggccctcgacccgattgtctggccaataatggaggctgctatggtgaatgccatggcagtcttgggcatgttcacagatttcctcagcattccgatgaatggaacagcggcatggacagctgcaaaccactgcggggagaatttcttggtgtgctcacgccacaccccgagagggatgtttgctgccattccaagcaacgcaatggctaccatctttgcaggcaggggctggggacggagagacttcacaagttcagtccgtgcaagggctgcacgtatagcgaccacagcaggcgggcacttcagcttcacacctgctggtggttgtaaagcctttgcaacaaggggcagaatgccactcattgctcggtaagaccgggcaagtgggcactgcccattttccatccattcgttgctcattgcctcgtgcgatgatgagttacctcctttctgctgaaaatggttcaaaacgtaacatgagaaaactgatcggattgatgaaaatcctagctatgcaactatggctgtccgatcaagaacattagcacttggatacatgaaaagtaacatatagccaaacatccaaggaaatgccaaaatgcctacttgtgaaccaaagtcacaatcattaacttcaactgaacaaattctggatcagttcgttataacaaaatggtaaaaaagttagtagggaacattcttactttgaataatagacaaaattaagatagataattgaggcttgcattgttattaggacttgattgcgagaaaccagataggatttcacaaacatagccccataagaaaaaagaaacaaaataaaaggaaggaatgaggacaaactttcatggaattctggttcggattgctgggcttcttgtttgactgatttagattgttgggcttcttgttctgccttttccccttgccattaaagaagttaaaaccaaatggcccaaatgcagatagacttattgtggcagctctagcagccaatgggttaaacagcagagcaggttcaggattggcatcaatgctctcactgttgctctcatcaggtaaatatgactttcctgaaagcggaactattccatcccatccatggaaaagtttaaatgctgaatcaaagcctggtccgtcctcaaaaattggaccatttcctcctcgggcctgcacaatagcacagattaaggatccaatgcacttttgatattgatattgtcatcaccagaggtcatgtaaagaagatcttacagctactggcaaagcagaagaaaatgaatatgttgtagctccattgatgtttctcaggaatgggcatctctcgacatttggatgaccaaagaggttctctgatgatgccgattcattaagaaagctgctgaagaacatttccatcctggagaaaccatgccaaatgaacataaatcatattatggtaaatgtagttcaataaagcataaatgaggattgtgaaagcaacagacttgagcatgaggaaataaataatatcgtcatgataattgaacatactcagatcaccttcgaacaaacagcatgtatgcgcatgtgagagcaaaagacaagcctagtaagttcaagcaatgcattgagacatagaggccattaatttagttagttctgtgattctacagtaccctaaatgaattacaaggccaatagagtatagtactttcaggagtgtttgctttacaaagagagaaatataacagaacacacttagtgccatgccagatcaatcatttttgttctactcaaaacagcacacataccttttaacaaactatattttctaaaagggcagagaaacagtgcataaccatattatgcatcagaaggaataaaacctcttacaaagtcaagctatataagtacatcctgggaaaaaacgagatgctgccattgcagcattgcccctgctaatacatgcatgacattgtatatctacgttggtggccaacggcgcaccaagcgacacccaacttcttgtatggtcaaggccgccacttggttgcagagccaagaagacgggtcttagagaaatggctcattgaaggtcaagattttgccataaatggctgaaacatgatgtgcacttttaggaacgatttgtgctaactcagagttggtcgggctcagtgaaggtcaagatgttaccataaagggctgaaacatgatgtgcacttttaggaatgatttgtgctaactcaggagttggtcgcgccgtatattcctattgtggatagattctgttgtcttgtgtgttctagtagctgttattggcccatggcatcattgtagttacgagtactagttagacaagattacatgataagacattgaccaaagtcgtctcggttatctttcacctcacagattcctcacggacctgacgacttggttcatgaggactcatggacctcaacaactagaaagaactaggatcagtttgctcgcgccaatacagcaaccttcgttcaatccccacaaagtggggcggcattccattttcacccaggccttaacggcgcaactagagcaaacgcacaactacaaagcactaggattggtttgcaagcgccaatacagcaatcatctttcattccccacaaagtggggcagcattccattttcacaactagagcaaacgcacaaaaactaattgaatggggcgtgtgccatacaaattttgtctgatgcactttttgcacaccaggccaccacccaattctgaagaattgggtggagtaactgggaggggaagcagaccgaaaccaatgactaacacacaaattggacaccaagtccagtcgattgtatcagacagaattggggtcaatccgtctcgacgaggaggctaaagatcccgtccacagcgatcaccgccagatccacctaaacccaccacacccacaccacaccactcgcaccaaaccaaaagtagaggaaccaagagcaaattaaaccccatgccgccgcgcgatcgagcggggcggggtggatgatcgatagtggaagctaacgaaaccctaaaagccttaagagaggcggattaattcattcaacgatgggggaggagatggaaacgacgaagagagagagctcacctcgccgatctgccggacggtcggacgaacacgacgggagggggggatcgtgtggagggcacgcacaggcaccgcggatgcgggaagggagcgcagctaccacgcgacgcgacgcgacacacctccccctacccacctaccgcgacgcgacgggcggcgcgggccggatttagcgagacaaatgcgattgatctaccgccgccgccgccgctgccgctgcctccgccgagggatccaggggacgccgccgccgccgccgccgccgccagcgctgatgaggtgggaggggaggaagggtggggatcggatggcttcgtctggtctcgcgccggcaactcttcttctttttttttttcttttctttctcgccttcctctccgagttaatttttttccaaatatttccattgacatgtaaataacgagtgctaactaatgatgtactccctccgtttcacaatgtaaatcattctagcatttctcacatttatagtaatgttaataaatctaaacatatatatttatgtaaattcattaatagcaatatgaatgtggaaaatgttagaatgatttacattgtaaaatggaggaagtaacagactttgatcataaggctagctcagcccctgaaattagtctctgagtgaccatgcctaagaattcttacctccgctatactcgctcagtccctaaatacctttttaaacatatttgatcgtttattttattaaaaaaaataagtaattattaattattttcttatcatttgattcatggttaaatatactactaaagttaaagtctttgaataatattcacaaaagtttttaaataagacgaacggtcaaacatattaaaaagccaacggcgtcaaatatttagagatggagggagtatttgccattctatgttgttctaggttgtttagtataaattaaagtttaagtagagagaattatagcactttaaaaatagtacctctcattaaataatattatatatgttttttaatatatgaagtcattgactttttaacaaatatttaactattcattttatttaaattttttatataaatataaaaattttaagtcacgcttaaaaacatttgacgataaatcaaatcacaataaaataaataataattacataaatcttttaaataaaacaaatggtaactatagcatagaaaatcagcaacgccatatattaaaaaacaaaataagagtatatgattgaaagtaggagggtgaatgagaataaagtagaaaaatatatttaaatgagaggtcaatgatgggacatatggtactgtatagtgatgtgtatagtgatgactattttaagatgaaattttaatttgggacggaggtatagtaattggaatcttgctaaacattggcgtatataccccgcaaccaagttggtaccaactaaaaatgatgaatgttaatccgatgactgtagctaatcacaaggaaccacctagaagaccttatggacttctacacatatgttgtcgtcagggttagagaaaagacatggaaagaaacgaacaaaaacatgtcaaaacttaattaacctggcgtgttagcacacaactaagcagaaatctagccacatctagaattcaagatcctagatattaagtacagacaaacaattgaatccaacccaagctagcaaacagtcgtaattatttatttttcttgcacattcgtaattaattaattaattaagtaagcaattaatccaactcattgaccttgagctgcaactaaacacgccacgctaccacctgcgtctccgtttccttctcctcctccattggagaccatagcttgcttcttgctgcctcaccatggtcgacctcagctagagcttgcttgcttgcttgcttgcttgcgttagctaggcaatgagcgcggggagcccatcgccgggtggcggcgatggcggcggcggcggcgggagtatatttgggtcgggtggcatcggcgggttcggctacggcgtcggcgcctccgtcggcgtgctcctcgtcgtctccaccgtcgcgctcgccatctacttctgcagccgcacgtccatgccggtggccgccgccgccgccggccgcccgccatctccgcctcgaccacgcgacgacggcgacgtcgagaccggcaccggcatcgacgacgcgacgctggaggcgttcccggaggtggtctacggcgaggcgaggaaggctcgcggcggcgcggcggcgacgcagacgtgctgccccgtgtgcctggagaactacggcgacggcgacgtgctccgcgcgctgccggactgcggccacctgttccaccgcgagtgcgtggacccgtggctccggcagcggccgacgtgccccgtctgccggacgtcgccgctgccgagccccatgccgacgccgctcgccgaggtgacgccgctggctctcgtcaggccgtcgtgacgtgacgtcatcaggtgagccgtgtgttcttggtctgatgctctctgtttatttttcttttctttttttcgtttgtaatacatcagaaaatatcactagaagtagacaaaaaatgaagcaaatttgtttgtttccacggatgtaaatttgttcatttgggaatttgacgactagagttagataaagattaagatttttatggtacgcttttcaaactgttaaacggttcgtttcgtgcgaaaattttctatatgaaagttgctctaaaatatcatattaatctattttcaagtttgtaataattaaaactcaatcaatcatacgctaataccacctcgttttgcgttaaaaacttaatcttaatcttcatcttcatcttcaggagaaaataacaccacctaattctatatttttgtactactttgtacatataaatgttggatgagtttcaacaaaatttcctcaaaagttgacacaaatggtctgaacagtaatagaataaaaagggattaattgagggtaagaacattcttcgcatgctgtacagctcaaaataaattttgagtgtctgtccttggatgtgaattgattgagaacaggaacaggaaccaggaagtcaatcaatatactggatgtacaaatctcccctgtgatacagaatgcattgaatttgtcctgaatcccagattcacaagcattttcactagataagtaccagcatttttgaatgtattgtctattgagttcacatcagaaatttccatgccatgttcatattcaacatacacaaatttcatttgctgtaattcctctatggacatgaaaaataatgctaatgatacacaagaagaaaattctctctacaagtaaaggagacagagaaagtaagattatttcagagatcaagatggagcaattttaactgctccctacacagataattcacaaatgttttcactttcacacccaagatttgccaccttcccttgcaaataccgaagaatgagcggaatcgaaaccattgcatcatttccaggccttgtgcacaacctagcaatgatcacaaggttccgaagctccttggagtcatagatattgccaagatctgcatctaccattttgtacattgtgcaggcaaatccaggctcctgcacccactgcacgagctcgccttcgccgcccggcgattgcccggtcactagctcaaggatcagcacaccatactggaacaccaggtcccttctcctctgctgaatttcatctgaagatcacatatatggaatgctgtcagtgtcagttcctgccaatgttccacacaaggtgatatagaagagacaaatctggagttgtttctgttgtttgggtggtaactagaccttcaaaagatgcagcattggattccaccgttcgtttcgggtcgtaaccgatgacactgatatctgataactgaaaatggtacaagcttcagttggtcgatcgatgtgcttcagacatgtatgaacaatggttactgtgaatcttacctttgcgacaaaattggcatccatcatcacattgcttgagttgaccgacacatggaacaccggaggatcacagaagtagtacaggtattcctgcatcaccacacaacaaagaacaatgtgatgtgatgtcactcactatacaagttcagaaaccaaatctggcatcagatgactttaaattgcattttcctgccagtttgtgtaacatgttgagagcaatgtagtatggagatttatagtaccaatgctgctgcaacatctatggcgacctgcaacctggtcctccagttcagaggcgtcctgagaggatctgccaagaaattaaccatcatcacaaacttgactgacaaaaccacacaatttctgaagaattctgccacaaaatgcgcaagcaaatttaccatggagacattctttcaggctcctgttctccatctggtcgaacaccagaaacctgaaacatcaaacagaaaaaattaacaaacactgtaaccaacaattcaacaccaaacaaacaaacgaaaaacaaaaagattcagatgaattcaggacagtgatgaactgaacctcacctggagtggccgtcagagtagccatggagcctgacgatgtggcggtggttgaggcgggcgagcagctgcagctcgcggtagaaggcctctctgtcctggtcgccgtcgccgccggctcgccgcaccgtcgcgacgaggccgtcggcgaaccgggccctgtacgccgcgcggccgccggggccggcctccaggatcgcgctgaacccgttcgtcgccgcctcgatctccttgtgcttgaatttccttaggaatggcaacccacctgccaagaaaaatatgagaaaattcagcgaaaattcaggctgaaaatgtggaaaattcttctgcagggtgtgcgcaaaagactgaagaaaccaaatgatatcaccaaaattcccttgctttaaacaactggttccaaaagaacaaaaaagagaaaaatctcaagaaaactaatgcattactgcaacaaaaccaaaggcaagaatggccacaaggcatcaaatcaagaaccaaatatttcttcagaaagcagctacaaagaagaggagaagaagaagagggccgtacggttgccgccgaggcagagctgatgccggctcaggcagcccatcctcgtcggcgccggcgcaagagcacactcgtcacctccaatgggggattggattgcagcagccagtgactgaccaaccgactgactgacagacagacagactgacgagtggatggaaggatgaaatactgtttggcagtatggttgcctgcagcctgcagctgcaggattggcttcttcttgctgctgctgctgctgctgctacttgccttgttgatggagtcatgcaggtacagaaaacctacggacgattgatggcgtcgccaaatgccaagattactggtaatcgagtatgctacagtactgtgcttgagattgttgttgtttgttgttgcctttgtgtcggtccccttccagcctagcctgcttttggttcccccagcttcgtctactccgttcacaaatataagggatttatacacagagtttagaatatctgattatcggtacgatggttatcgaagaagtaccaattttccagttcattttatttattgctgtagttgcaccgctagacgtaatatttcttaatcagatagttttagctcaatctagaactctgctaaactgtcagggttttcttatatttgtggacggagattgatattttacattgtgttacagtgtgagtgatgattccgtggcttttgggagggtccctctcttcaaagttgttaccctcgccgtttctctaatttaaagttgtcgtttaagtacgattagttatattatcaccttttatcaatctattaaagataaaataataactacacgttagtatttctcattataatgaaaagaatttgtgttggcctccttacttccagcataaagccctgaactagggccagtgctgttcttttctgaaagatggccgatcagaattcttgtttagttgcatggaaatacttgttagattagttatctgtcaggaaggtattaaactgtttgggttaatctctttttccttgcccaacctgagggaaagcactaacactgttgacatttttatccagccattgagtaaccacatccaaatgtgccagctcttggatttcttttttttttcttttttaccttttttcacttttatgctgctgggaatcttttcacatcatgggaaggggatattccaacaatcttggacacaggaagagaaaaaaaagggggggggggggatggaaaaaaagagagagagaaacattggagaaattgcagaagtgtcatgcttccttgctttcagtttcagccaggatttgcagatgtgacattgttttcagagcctttcatctcaagtgatcctcccaaaagaagagaagagaagaaagggagatgcatgtacacttggctgcttgcaaaaaatgtttggttttcttttgtcaattcagttgttcggtgcaaaattaccctgccgtttgatccctcatcttttttttttaaaaaaaaaataaatacttaaaaggtatgccatactattaattaaagtaccatattgtatcctaaacattccgtttatttaaaatttcctaataatcaaaatcgtagcagaaatgattaatgatgataagtaaatgaaaatagaggggtagggagatggtttaaaatgttaatggtagtagctttttttcgcgaacacgcaaaagagttaacgctaaaatattagaagaaagtagagtttaagttacacaacaaaaaggttaaaaatagcattgccgaaggaaaaagaaaaggaaaagactgaaaagattgctaagattaaactacgaaaataaagttggtagagagagatccgccaccactagccaccgcctcctaaacactaacagtcggatccaccgtctcctagccgtttaccccgccacgaacgtaggcccaccgccctcctctatctccgcggctttggtgccaccgccgacacctcgctgcccgtctgtgtccaccgcccaccgccgagccggcgcctctcatggacatccctctaaacccagcgattcccccctcttccccctcccccacccccatcctagcccaggaccctaaaccattctactgttttcgtcggggtcgctagagttggagaaggtgttgccggagctggaggggaagagctaaggttaccggagcacaatcgtgaagtaaatctcaatgtcagtaatctgcatgattttaacataaaaatcattcgctagccatttagccattttgatcaaatattcagattgattgacgcatatattctccggacattttgatcgagcaacaacagatcaattaattaatcacctgcaagtcaaacacaatttttttttatctcttggttaacgcagagatctagtctagttgtagtagtgtggcactgtggcgtccttggcacgtgtggtgggcgcgcgtggcgcacgtacgaacgtgtgctgcgcgacaccccacgtgccgcacgatccaacgcaatacgcaggtggctacactccaaaagaaaatgtacgtgtatatatactcgatctgtgcaaaaaccctcacgtacgactaataaatactgtacacgagtactcggcagcatgtgacagtgcgtagtaccagtacattgtgtgaaattaatcctgcacgcttgggtagttcattactttggtttctcagttgccatcttcttcctttgtttttttttcatgcccataacttttgaagacgttttactattcattttattaaaaaaatataattatcgtttacttggttatgatttgttctactacacttatatttttatatatttgaaaaaaaatatttttacacttatattgctaactttgttgcttatactagtattatataatcaatgaacttttctcaactcaattatcttatttccgtcatgggcaactttgtctatgaagtagggttcctcctatcgttttcgacgcggttaccgaaccccgcggtaaccacgagacatagtgtgattaccttataaccgccacacggttttgtaaaccttgctataaaaaaggaagcttgccgtgatctttctaccttcttgatagcaacaaatttatgacacaactacaatcattttcaataagggaagcagtgtccactgaaggacgtgagagatgctttccatgtatgcaagcatatatttgattctaaggcatatcactacagtgatctatcgactggccaggaatattggagagcatgaccgtcccacagtatcatgttgatacccaccctgacagtatctctgatctatctaccttcgtgatacccagcaatatctctggtaatggtgctctgactaaccaaaaggataatctgatttttggaaatcgacaatggatggtgtcttcaccgtcaaatccttttataaagctctgaaattgcaatgagtcccttacacttcttaaagacttttgaagttgaaaattcctctaaaaatcgaagtttttaccaggttcctcttaaggagtagtatcttgagaaaggataatttgcttaagagaagttgtaaaggaaaagaagtttcaattatgtgttgaagatgaaaccattgaccatacttttttgaaatgtgtcgtatggcaaaactctcatatgaagtgcaatttttttttggtggatggttaatgcaatttgatatgaagacgggaaacctgatttgcagttggagtatcagctgtgatttggcctatttggggagcaagaaatgcggctggaggaaaacgaatgaagacttcaacaggggcggggcgcggctactaaggtcccgttcatttaagtggtaggggagggcaactcagtagtttttccgttactgacacgtttttcaatatgctaaacgatgtgttttatataaaagttttctatataaaaaagcgtaaagaaatcaaataaatcattttcaagtttacaacaattaatattcgattaaccaagcgctaattgatgcggacatcactgtctcggatacacgtaacaatcctccaacggtcattcaaggaccgataacaagagctcgtgcgcgacaattaaatttagaggtgagttcattcctatgttcttctttgtatgaattcaagaatagattgctacctaataattatattgtgattaggaacaatggaggggacaaggagacacttggagaaggacttagagccatggaggatcatcggggacgtccaagtcaaggtggaggcctaaaccaagtcgacgtcgggtgtaattcggagtccaggaccagtctgcactaaaatggacgcccaggtcgcatacgtgctcggattggggcgttctttatatggatgaaaagctaagaagataacctttccaatggttttggtcccacgtccaaattctttccgagtcaacgggaattgaccgaacaagttgacatccagaatctgttccggtgctgcgtcaccgtatttgggcttttggcccgtgtatcgtgttggaacccattagggttacgtcaagaggggtttgcacgaccctaaactctatatatcagtacccgccgccgtctttaggtttttgggttttgcttagattaatctatcaagaacagtttcgccgctagatcggtttgtaagaccccaactcgtgagcttaatcattcatctgcaattttggttgtttttctatctcgttcttgtttgtgttcttcgattggcaaacaggaattagccttctcggcgaggtcatccgcgtttcgacacgggtgataaccagaggagacgtggtgctgcgattgcggggctcaagagcgtgcgcgttcaagaagccggatcgatttgtgtcgcgactccgtccaaatcattgtttatcagaacctttcagaagatcaggaaccctagtgcacatcactaatggattgtctcgttttaatacacacagcaaatgtgagatgtatagtgcagggcatggtggaggtttcacgctggaccgatgggaagaaaaaagacctctgaaccatccgatggtggaggtttcatgttttgactagaattatagctagcatttttatatatacccaataccttctaagattcttatcatcaaatttgcaaacataagttggagtataccacttcccgcagcaacacgtaaggaatcatctagtatacatatacatatgtattgggatgcaattcttttaagagtaaattgcattagtgatacacaaacttgttaggtgggattaattcagtacataaacttataaaatactagtttggtgcacgaacttgtctaattcgtgcaaaccaggaccacaatggcttgacaaggttaattttaccacgctaatgttgattagaatgtgacgtgcatatgtatagtgagtatacataagatgtgctatatttataaatgaggaatttcatatatttcttacccttttcatatatgtctatgctatcactatatctcattttatcttttcattgaagaggtgtatgtctaaatataaatcttctcagatatgtgtttatcctaactagtacctaaatcaacaggattagccatatagtgttcttttagccttggtccaaacgcaccggacaagttcatgtaacataacgagcattttacaagttagtgcactagattgcacctacttaacaagaagttcgtgtactgctaatacaatttactcttcttttaattattatgtaggtacttattcgatcatgagatgttgggtgcgagaataattagccgtttaatatgtatcgtttacgcaagttctcctaatatagcttacacaatcctccatattttttgcgccttacacgtagggcccctttgaatcacaggaatgaaaaaaatagagaaataggaaaaacatatgattctaacaggaataagtgtgaaacagaggattacaaaacaaaaaaaacataggaataaccgtttgattgagccacaggaaaaacataggaatttgaggagagataaagattcaaaggattcttaacatgaggtagaacctcatgttaaatttcctccaaaacttacatgggaaaaggtatttcataggaattttataggattcattcctttgattcaaagagctatatagggaaaaatcctataggaatgaaatcctttaaaattcctatgaatttcctttgaatcaaagggggccgtaaggttcgtttcaaatttttcacacccaaattatagtcatacaagaaagttagtgtttctcaatgtcaaatttcatgtgatataacaatcatatatataactagcctatatgaatttaagttatttaagttctagatttaacatagttattcgcatttacgactaattattttttcagtaagagatgacatatctcttgataacagacacgtatatatcagcctaattttacggagatgtatatagtgtaggatgtacgtgtgtgcgcgtaggtgtaagtgtgcgtgtgtcgtgagcaccggcatttcagccgtatttctaaaaggaaaaaagtttaaaattttgcagcttttatatcccgatttggacgtggattaatttccagctcaaaagtcaaaaaccaaagagtccacagccaccggtctcatcgctaaccaccaacacctaatcgtcattatccgagactgttagatccccgggcccacacgtcagtctcaccccgcgaaataatctaatcctttaaacagaaagtcaaaagcgaacgcgaagaaaccgaacagatccctttcttcctcacgactcctggatttttataaattacacccccgaaagatttcttctctcacaatccagtcctcgaactcgaacccagccatggcgaccaagcagagcctcctcctcctcctcgccctcctcgccgccgccgcggccgtcgcctccgccgtcaccgacgtcgagtactgcagtgagtgtccctcccgctcgcccccccaaaaccccctttcttccgcggttctgagggggcgaaggttacgcgaagattggatgatttggggttcttgatgatgttgctgttgcttttgcgtgcagataagggcaagaagtacccggtgaaggtgagcggcgtggagatcgtgcccgatccggtcgcccgcggcgagcccgcaaccttcaagatctccgcttccactggtataataaaccaacctctcccgtttcccccttttgcaaatattactcttcgtgatgcagttggggtacttgttccgccatgaattttagtgtactagcaccggctctgaagtcaattggcagtataattgcgagaattaagctctgtactagtggaattttaaggtggtggtagaatttcgcttgctgtttggcctggagaaggaaaaaaagatgaataataattttgcttgctgctgaatgctgaccagaattttcttgtgattgtacggtgaggttaggattggcatacgcagatacactattatctgtggcgattgatggcttgtgttttgcagttttgtttggggatgagtctacactgtgtagctatatgcctatggtgtattaacagcaagtgacagtgcgtgccatggagagtctccttttagaggtgttagggtgtgtacaattagagtttaatttagtggttgagagaaattgcagttatgtttagtaaattctttagacatcggtggcgctgttcgcaagtgcgctccttattatgctcgccctgtagtatttatgtttggcggtaatggccatgtagaacgctgcagagccctagttgatttgtgatttgctgatcacaacctagagatttaggcgtaacatggcattgatttcttgtaagcctttatcagaaatatcactttccctatgtaacggcttaggaatttagggccagtcaagtactcagccataatgaaaacattttttgaagattgtcataccaccttttatgttatgaatggccttctctaggttaggtagcatatattttagaggcaggactgctggctcatttcccctgcttgcctatgagaagcggtctgggtcgctggcgttgccagaaaaacaggagtatggttctgaagatgatgcaatcatgtgtatagtgtgcatcctgttagtaggacaaatcatgcctttgacattttctgcttatcagttcatgtaggcgagtaaataagggaactttagttcctgtcttttttttttgaattaatgttttggttcttaactttctgtataatgcgcatttaacatatctgcacaataaatctataattgtgtacatttaaggaagttgactaataagaatctttatcggcttaattacacctgagaagcagcatccatttgcctattattatgtaaaaggaagctaaaactgaatagcaagcagtgctttttctaatattcaaaatctgtgggcttgatcagtaaatccaccagattgagtcatctccatgttgcctgcagcctaccctattttttacagggcatagcaaattatgtatggacatgattaaattcagtgtatgcacgttgtggtgacaatgatcatttagtaatttgtcctttgggacaccaaagcagagtccatcttattgcatcattagtttccgcatcagtatactgtcatggtaggaataggcacctctgtaagtgaaccatccaaaactttttgttagaaaaaagggtgaagcatccaaagcattggaaatggcactgtgcctcagactcagtcatgcccactgtacccaattttttttttagtttttcctttttcttgaaacgtagtgcttaaaaccttgcaagttatagccttataggtaggtgatagatgtatgtgaggccattttgcatgtggtgtagcatcacagttggcaaaacccgtgacctttttctttcaaccaaatctaaaaaaacaaccttagtgatttgttttaccatatgagtgagtcgaatgtagctatgagtacatttcattataaaccctgatggtttctagatccaatccttagtatatatattatgcttgtcaggactcaggaatctagtttaggatcacaagaattgtttatttctttctgccatactgacaattaatttataatgaatctcgatgacctgctgcagataaaactatcggtaaagggaagctggttattgatgtgaaatacttcttcttctatgtccactcggaaactcgtgagctctgtgatgtgacttcctgcccggcaagtggtgacttcttggtagctcatcagcaaaccctgccatcatacactccaccagtaagtccgaaatttcgcttctaagtctgaaatgtatgctcttacacgataaattcagctcaaataccactgctaataccaaattgtgttttgtgatcatcttacttcggttcatgcttgatgacacttgcttcttcttcagggctcttacaccatcaccatgaagatgctgggtgataacgatgaggagctgagctgcatctcgttcgggttcagcatcggtttcgctgcatcagaagccaccatctgaatgcatccagaggcagaattcagaaatatcacaccatggatgtaattacaaaagcacctatgtatcttagatcatagaactcaaatacaatgcgcatctgccaacacattgtgttcaactaagacgttttatccagagttgaacatacaataaaaacatcactcactagtgtacctaactccgtttagctgttgaaatgtgttgcattgcatgttgaattgagcctggatgcatcttgatcttgagaaaaaattcctgaacttttgaggtgtgaagcttgtgcaagcaatctgggtggttggtgctgtacttaaccactagccacatgggaaaaccatgttatgttgacagcttagggtactagtatttggagtttgcgtgtcaacatcagtaaggatgggctaattattctctcaagttcactctgcttcgttatttgggttaatgtgatcgagattaggtagggaaagcataggatttctgccgctcgaaaacgagagactgtatataaaaaaaacgaaattgggattgctacttttacctgccatgctaacatacattcagtttaattcgcattaacaccagttgttaccacttacgaccagacgttaatttaatttgcaggacacaagttgttagcaaacgttaatttaatttggagcgatgcaaagtgtggatccaacgatttggttaataaagaatccatgattaattttaacggatttaatcatgtgcacttagtgtcaacttttcgtgtaataccttttaaggcaccgaagcaagatcatttaaccaagcaaactcatttaatcaagcaaaccttacgttcaacttttttttaaaaaaaaatccgttcaaaaatctaatcaagcaaaccctgtttaataaacccatttaatttgcaaaccctgtttggaacgcagtaatcccacttaatttcgtcatggctgtatcaattttcgtagtaattccacacaaaatggatcaatttcagcattgatacaaatttttttaccgcgttccaaacaaaacctaaaaattatagtatcattaggcgttgatcacctgaattaatgcttaattaatcttcttccatccctctgtggctctgtgctagaggaggttaatcaagctatttaagcaagcaaaccctgtttggaacgcagtaaaattccatttaattttgccatagctgtatcaatttccgtagtaattccacataaaataggtcaatttccgtatgaaaataaaaaatctccctccttccaaagaaagcctaaaaatatactactactccagtaagtatgattagtcccttgatcacctggattaactcttaatcttcctcatccatccctatatgctagaggaggttaagcaataattaagcaaccattagccatgaaaaagacttgactaatgactagtacaaaattcaattcaaccttgttgtcaaaaaggcggttaaaaaggaagcaaccccaacccccctctccctccctccatccctcttcttcttcattccttcctcctccctcctcttcaaccatcaccaaatccacacgcttcccaaaaatccaaacccaaattgcaaccccccaatctccattgccgtcgccgccatgatcatcaagacgctcaaggcgcggatcctgtgcgcgctcaagtcctcgcttccggccgccgcgtccccgccgccgtcgccgaccaagccggggcgagccgccgcggcggtggtggtggtcgcgggtgacgcgttctccgacgacgcgtccttctttgacgcccacgagaccccgaccaagaacggggcggagccgatcgatgattgggagctcgtcgacgaggagggtcgggttggggttgccgcggcggcggcggaggaggaggaggaacagctcagggagttcccggcgaggtgcccgccgggaggggagggggcggtggtgctctacaccaccacgctccgcggcatccgcaagacgttcgaggactgcaacggcgtgcgcgcgctgctggagaacctcgacgtcgcgttccaggagcgggacgtgtccatggacaggggcctccgggacgagctctggtccgtcacgggggagaaggccgtgcccccgcgcctgttcgtccgcggccgcgacgtcggcggcgccgcccaggtgctcgccctccacgaggacggccgcctcctcgccctcctctcgccgggcagcaacaaaaacaggagcgccgccgccgccgccgccaagtgcgacgcctgcggggggctcaggttcgtggtgtgcggcgagtgcgacggcagccgcaaggtgttcgacggcgagcgcggtcgcggcgtgcggtgccgcggctgcaacgagaacggcctcgtcatgtgcgcgctttgcttgtagtagcaaagtaaaaattaattagcggttaattgtcaattaccacctcccttttcactcactctaatctgcttatatctttttagtagtaattaattacccctcttgatggttttgagtgtgtgtctggacttagtggttggcctgtcatgtacataaactaccactactgctactagtacttgcttcagttaaactacatatgtgaatgtgatgtatatatgcttagtttagatgtcaatttcacaaccttaatttgcatcattgcatgcatcaatcaatcagtttcctttctgatgaaacttggtggtttcatgaaaaaagactttgacaaatggcaatcagctccaaattaaactgctggatttcatcatcttttggtgtggatttcagaatgtttcctgacataattcagcagcttagcgcatttctgatttctgacagaagcaacttaggattctcttgctgtggtggtcctgtatatatagagagattattattacagattagaagagcaagcaattgcagctttacacttttgctgtttgtgcatagccttttggattaaaagaaagctggtgtgttaatgtcttagcagctttgcatcattgcatgtcaccactcaagtttctgaagattttgatgcactgaatcaatcaattcccaagtcccaactactttatgatgtatcacattcagcaaacacaatgcatcacagtagcaaaaaaccatttgcagaggtgttacaaatgcttgcagccaaatggagaggcaattaggggactgcatacataaaccaatctgatcaaagatttgcaatagcagcaaaaagtagagcttgagtacttacacttgatattatcaattatcatgatgtgagatggtacatcagcatcaacattgtcaacatcacttttcatttttagggagcactagagattgcacctcaaatgaacagagcaaagagataaggaggatacttataggggggattaattattgatgattgaacatcacttgatttgatagttgacaccagcagtgcacatgtgagcattgcaggggaccatgatgaagccatggctgaggttgatgagcccatatgttcatcttggctaagtccaatgggcctgagctagcttggagaaaagtggctccttgcaacacaacaccaagcaatggtccaaggattgtctacccatctgtaagcatctcaatagttgtggccatgtagttgtgggtcacatttgctcatttgcattcctatctgttagcatctcattagtgatagtttagaaggaaggaatattgcataaatgttttaggaaataggacgctccccacattgttttgtatgaaattcaagtgttttttttatgagttctgctatacgtacgactagagccgtacaacccacatccgaccaacaatcaatacgttcaacatctctttatgtaggcctaggtatgtagcagccctacactagtcggatacaagtcgtacacactagtcgtgtgtatagacattttttttatagatgatgctatgtcaatatgtacttatgaattcactcttacctctacttatctgtttacgaggaatgcaatacatgaaaactcttagcttcgatattatgcccaaattaattagttatgtaaaattaattggccaagggtaaggaacatgtgtaaattattttatttcctatagaatttgaatgttttacagatgatgctatgttgatagacttacaaaatcgctattatctctatttacctattgacaaaaacttagcacatgtgaaaaatcatgtactctgtaaatatgcccaaattaattggtcatctaaaattaagaggctatgactggatagtaactataacacatgaaaattcgtttattttcatggctggacacgaaagctcaatacgtattcatttagggcctcattgtttggcatatttatatgcttatcatccaaaatttgaattttcaacgttaaatttggagctgattttggggttttttcatcgaagtttatttttcagcctttgcttttagatcgctaagaacacatatataaaagttttattcacaaattgattctcgtttgcaaatatgccatttggcatattcagaaaatatgacaaacgatgaggctgttagatagaagtatgaaatcggaaacctaagggacaaaactagggcgtaaaataacacattgatctataagcaaaacaaactttatatgacaagtgtgtaagactcaaagtaagactaaaatccataggcatgagccgtttacatcaaaatacaagtgtgtaagactcaaagtaacataacctctatattactaatccaatcgtgatacgaggtaagctcatacaagaccagtgaccaatctagctcccgggctagtcaagcagccaccaagaccccgccgccggcaactccactgttaattagtgaaaatgcttgcaaaatattgctaaggactaacaaggaaatcgctatgcaaacgacccagctgtccgacacacgtacgaccgaatttaatcaactatttgcaaacgaccgcagtgcacatgaacatactctccttgattgatatacggccatatatctctacttgtacatgagttttataactagattgtatgcataacaatactcagactaacaaaaacactccatattatctataaaaagaaacaagtacactccatctttcgctgctgcgggctccccccccatggctaacactctcacaagtcacaaccaccaaagtgcctttaaaaaaaacaattaatactaatcctccacgcccagccaaaaccgcaacagaaatccaaatccccaatacgcaagccacatctccacagccacgcggcggcagccatccacccacaccacaccgctgctcgcgccgcttggctggcagcaaccacagcaagcaaagcaagcagtcaaagaaacggctacccagccagccaagcacagcagcagcagcatcacatatacccaagccccgacgagtcgacgccccaaattcctccccggaaaattttacaaatcccagcgatcaaacgaagcgaagccacaacacacagctcacttcccgcacgcatcctcgccccccagatcccatctcgccctcgcctccgggcgatggccaccgccgccaccgcccaggcctccgcctcctcctccaccgcctccacccgcggctcccccgccgcctcctcctcctcccactccgccgtctgcctcgtccccttcaggtatatgttactcatcatcttcgctgtgttttggttgtggtttggttttggttttggttttgatggggcaatgtgggtttcgcaggtggtgggcgagggtgagggaggaggcgccgccggaaggcggggtgaggtacgcggcgaccgcggcggcgtcgccctcgtcgtactacgggcttcgcttgctccacagcttcctccacccggatctcgtgcttcgcctcgagcgcgggggttgccgcggcacgggtgccggcgccggggggcggagctacgcgctcgtgccggccgacgagctctcgcgtgtgctcgcgaggtgagagactcgctaatggcacttccgttttccatttttttgggctactcggaggggggggggatattggtggatgctagtgagcgcaaaatcgaatttagttcaatcatgtggctaagggggatgatctccattacttccgttttttcatttttggctactcggtgaggggtattgatggatgctagtgagcgcaatagaatttagttcaatcatgtggctaagtggaatgatctggtacatgcattcctgattcctatgggtacatacatgacctttgacctggttgattcagcattgagatctaattagtttctaatgtattgtgagttccatgattttttgaacttcaataagcttgaattctagttaggggaagtgtatttagcaatccctgaaactcgggaatgctccatggcttggtatgtgacctcgaaaggatgaattcagcatttcaagctagattagtgcctcgtttgtaacgtgagggtggcaatcatctatccatactagagccacaacgtgatgctgagggcagggcttgtaggttgtaccagaccatttgctaggtggtgaacttgtttcttgcattgcttgatggttaaatatgttgtcccctttcagtctagacacatatgttttagcccattttagctctatgcctttgctatagattctttcctccaacttttgaacctctaacatagcaatactggcaatttggcatggacagttgcaaacgcaacggacttttaaaactgtagcgtttcatgcagcttcacttctgatttgtgggaagccaggataaattactcttaaagaaatttctctataagctgaagttctcaacataatataattgcatgtaaaataaataaaactgtaagtcatgatatagttacatacttacatttcatgcagggctatgctaacattgttcgcatctccatgttgcgcaaacttggagggtgcagttaggattttttttttgtttggctttcttaggaagcaaatcaaacctgtctcaaaatgattgcttttaataatgcataaattttgcattcattatctagtgagagtttagtgtctcaacagcaatgctgatgggttcatcttcctttctgcacttaagtttgtgctgtgttttcttacttgaattattgctttccaaagtaaggtttctgcaatatgcttgtcaataaaatcatgcatgcatatgatgtgtgttgctctgttctgcatctttttgcaaataggatttactgagtgagcacataccaagtgttgaggctcaactgtttagtccagtagaccccattggttgataggtgcaattttttataaatacatttttgtttcttgacaaaagacgataataaatacacatgtgcacatttttgactttcgtggaaaatatagggccttctggtctgtaggatttattcaattattgagagggaaagcaattcaatatgggttccctttaatcctaggctggccctgcttttatgacaggggcttttgttgggtttgattttatagattattttggtatcacagaagcatccatgaatatcatctcatgttttgcattttggtaacctagactttcattttagaaaacaatgtgcaacctagccactatttatctctcttctcactatgttgagtagcaagttttggtcaaacagtaagcataatcatcaattctaattgtgattgaaattattcgtctatgttcagttagtaatacccctatatgtgagacatgagtaggattatattctgaacctccatattcttgcacctttaatccagcttcttaggctatagctctccctgaaacgagtttcttgggaccctaattttaatcttcaggagttctatttggttttaaatattccttacaagtaacgaagaagaagacttggtaacgaaggtaaacttgttttgctgaagttaggctagaaaatgtttcatatagaataatataaactttctattgttacatgcgattcctatttcctctcaagtctggacttatatttcaataacaaagaatctgcagtctagaggattgatgattaattgaataggataactagaaagaagctgctgttctatatattatcgttttctctgtcgctggcaagtacctaaatgtattctcagtagatcccaatgttagctaaatatgacattattttcttggtatattttaataccattcaagctccactttgtcactatgtttaccattatgcctgtctttgttatactattgtgcattttgagcacttttggacaatatacttttggaccatgtggtgatatctgtgtgctgatagcatcctctccttgcttagcacatttcatcaatgtgctcagttcttgccttccaccaatcacagcagattacatcttccttttcagctcagctctcagctgttcactgcagcgtgcacttagctttccggcctcaccatatttcctgtgcatgtgcacgtgctgcttgcagcatgaggtgtggtcagcactcacacttacatgagtagctctttccttgtctgggtcagctaagccaagtgagagagagcagaggattaattttcagttctaggaatatatatattctgcagtgctgtaatgtcgtccaattgttttgtaccttgatgccaaagatgtttcttcagaatatcaattttcatgaaatcttgtctgtgttatttttttatttgcctaataggttcaatttacagcttccatcttgccgcatctatttctgctgactttatttctgttttcttctccaggcaaaattctagtttggcattgcataataaacattcatttgctgaggatagtgctggtgcgtaccctttggtgcttaggatatctgttcgagaaacaagcattttgactgtgaagatcagcaaaaaggtaatgctatcctatttgacagatgatatatggctctatcaaatttttttctcatgcccatccttacaatttctattctatttcaggacaatccagttgagaactataaacgggcatacaagatttttaatattgattctcaaccagtatgtcgctgtttgtctgcatttcaagttcagcaatatactcccacttgttcagtttacttaatgtttctttatccaggttcatgtttgggatttttcaggccagacaaacctaatattaatgaatgagtggaataggtcaaatcatgactgctgccactcagagctagaggtattatcagttgatactcccctgcttgatacccttgtttttctgtttcagaatcaggcataaaatttccttcctagatccatattcttatcattttttttggcatgtgcagaatattcttgaagtgcaagtctatgcaatgtctgactccttaacttccaagattggtggaaccagcaaagagtatacagaacaatcttctgcagatgttaatgatatggatgttgatttgtcctatggaagctttggaagatctagctcgcatgggctaattggattggaaaatcttgggaatacttgctttatgaacagttcaattcaatgtttggcccacacatcaaagcttgttgattatttcctaggagattatgacagggatataaatcggactaacccactaggactgaatgtatgtatagtttgtcatgagtttactgtttgtttcctttgaatatatcggctaaattcactgatgttttcattacttagggggaacttgctttggcatttggagaattattgaggagattatggaacaccgagagaaaaccagtttcaccacatcactttaaggcaaagattgcttgttttgcccctcagttcagtggcttcaatcagcatgattcacaggagcttcttgctttcttattggatggcctccatgaagatcttaaccaggtcaagtgcaagccatatgaagaagctaaggatgcaagtgggcgccctgacaaagaagtggctgatgagtactggagtaatcatttagctcgaaatgactctgtaatagttgatacttaccatgtaagttctttaaatttttcatgtgttaaagcaattacactattattttctcctgcttctcctgccattgacccttttctgacatctacttgcaggggcagtacaaatctacattaacttgccctacttgcagtaaaacatctgtcacttttgacccatttatgtacttgtctttgcctgtaccttccacggcaaagaggacaatgactgttacagttttcagcactgatggtagtatagagccaatctcatatgatgtcactgtgccacaatttgggagtcttaatgatcttgttcaggct

SEQ ID NO: 74293 - DNA, 6369 bp, Oryza sativa
actagattgtaccatctggtcctagattgttatatgatagaatgaagagaatatattcttgtgacggatcctgagctactcttaatttcttaactaaacgattatacacataatttgttgtactatgaaatgtatcatccaattttatattgctatattatgggacaaagggagtatattcttgactaaactaatacaagtactatttgctagaacaatgctatacgtacgacgtgtttgtccgaccaacgtacgatcaaacggtaaaacaactccatacatggctgagtaaggtgacaacatggcttagtccaacagagattaacgtcatgaactcaggacattaagttcgttccaaagtcgaacaagtttagtcgtatatatagcattttcctacatactattgttccacccttatctagagccttgaagaacatattcaatccaatggtgagttagttgccacagttatcatccaatggtttgttttaatctaatgacgtggcatgcctaatctctttttagcaaaatatccaacggtgagtagactagaaaatcggcgtgccaaggcatgcctgttattgtataacttgcagcttatgttgtttagtaatgcttattccgtttaatgacttctataattttgtgtttgcataaggttggtgaaaaaaaaagttggtaaagctttatgttttgatgcggattgtttaatatcagaatgaaggtgcttgatattaccagtcaaaaaggcaattaccatactatattccctcagtaaccatctcgacgtgttacctatttatgctactccttatttaatatatgggcgtgtgttcatgaaaaaaaaggtgtgcgtttgtttacttgcactagtgcagaattgatcttttaccgtgatacccaaaacacaaatatcttggttagatttagaactggtactgaagatatttttaattccggttctaaaattccaagtctcaaaaacatctttagtttcggttagtgttactaaccagtactaaaaatatatctttagcatcggttggtgacaccaaccgtgtaagcgtcaggaggtgagcccatggcctgacgcgtacacgtgtcaagaaaattacggggcataggtggaccaatcaaactctagcacaacggctagcttgagaaggttagattccgctccatgatagacaaatgagctagttgagtggtggcctattttaattaggaaaaagtccaaataaccccctaaactttgggtggaagtccgtctagcaccctgaactttgaaactggacattcaaccccctaaactttacaataccgtttatataaccctctaagttgattttgcatagtggtttttactaatttgtatataagttggatgagtttgatcacatgtcatacactttggacatatatatatattaaagttttgacttaaatatttctttttgctccttattagctctcactcacaaataagtaccaacgtaataatagcatgttatcattgtataagaatagattgatgatttataactgatcatatgcaaatatattatattagttattcaaaattattcgtttaaacttccaaaatatgcaaaaccatcttttaaaaccaccttagggggtaacatggatggtatggtaaagttcatggggttggatgtccggttttaaagttcaggacgctagacggacttccatctaaagtttagggatgtatttggactttttccttttaattacttggatcctgcgactctcctgcaaacttacaaagagatatataagggggaaatttcataggacataaaagaacactaaaattcaacatcaaaggaattgaaaaaaaaataaatttattgacagaactaaaagatgacaaaatttaatgacaaaccataggagaaagatatacccaaaaccacaagtgttactcccctactaacatcaactgagctcacggagctgagcacaacatcgccctaacatgagtacgcgacaattgagctcagttgcccgcaaatggcccttgctttacgctaggcgtgcccatgggtgtacctatgggccatagcacggcggcacgaaccgctgacgaacaagctagggttgagcggtccgccgtatcctaggtgtttgtctgtttgagcctttgacatgtaaactatacgaactataacgcagttgtaataacactagtgagttctgtataatggttgattatctttaagtcagttcgaggcgtatatttttttatgagaatagctttattatcatctaaaaaatagcaaaatcatgtttttttacacgttttagttatttgagaggatatggcccaaatcgcaccagccaaagtgcaacccacactgggcgtatgacccagtggagcacccacctaggagtgggtgtttggtttccttgggtgtttcggtttggtttcttcagtgttctactagatcgatttgcaacaaatccaaaccgaagtgttcaccaaaagaaaaaaaaaccgcgccaagacagccgaacttctttggttctgttggtcggttttccgatcaagccgaggaaactcatctggcatgttgcgactctgtagcctgcgagcaacgtgccagtagttaaatgggctggataggttacaggcgataggaattggtgagaggtgatggaattaatgggcttttccactagcgaaagggcatggactgggatcgtacataattgattagttatgcgggttcctcggtttccagagatgagaaaccaaggggaaagccaaagaccgaacatagggagaaataaaaccaaataaaaaacggaataccaaaaaaagacacttcggcttggtttggtgtggtcggttcggcttttgattttcgatgattttatgcccacccctacgtgcaccggacatgcgcatgtacacgtcaggaggtgaggccacagctagagagcgacacgcactggtggagaaaccctttgtagtcccggttcgtaacccccctttagtcccggtttctaaaccgggagtaccaatccgggactaaagatcgctatctttagtcctgggtgaaataaccgggactaaagatagagctgacctttttttttttttgcatgcccctgttgctgcatggtttatatatatatatatatatatatataaaccatgcatatatatgtttcaatacatatatatgcatacatatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaagaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgtgacgtttactttccgagggtcgatgaatccagtatcgaaaaccctccgccgtcgggccctttgaatctcaattctacaacgataaaagggagtatattattttctatggtctacttatatacgaggacctaattaattaaaggagacgtatagtaagaaatctaactgaacgatatacttacaaaatccagcaactcataatagagacgtcgagggcgtccagctggtatagttcgttgattcccctgaaattgatccagagaatgtcatctccttgcaagaagtccgtgtccctgatcctcgctccgatcatctctctaccagtggcgctcatctccatgtacagctgatggaacttgtacatttgtgtgggtagggactgtagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctacgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcctccactgcatctgttagtcgtcgcgcagcctcttgtatctgatagccgaagaccagtgagccatcagctgggttgagcgttccaccatgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttg

SEQ ID NO: 74294 - DNA, 12780 bp, Oryza sativa
acatttgattccactattaccaccatgccatcacaaatgtacattctatgcaaaaatttgtaacctgtcagctttacgattgtaatttccagaaattggtgcttagcatttgcagttaaacatgcctgccgtgcaacacacaaataacattctacagacgtattaaaaataatgtatttcctagggcaagaagctcacatttacttcagacagttagataagattaatgtaggaccaacgctaaccaacataaacattatgatctgggtagaatggtttgattgtacacagaaacccaaatagctcatgacaaaaataacataccaagttggtcacttcagcctcagctttttcatcatctggaacaaggggatcttcaatagagttcatttctctaaaatagcatggatttaaaagcagctttagagaaattgtgaggaacaggatcattaaccattagatatgtaacgaagaaaacaaaagagtagctaggttgttgttcccgtaataactaagtctgatatgcctaggttaaagggaaggacatgaacaaatgcatcaggattcatggctccaaaagaaataacttcgtctatagttaactttgcctcattgcatcaacttcacatgcacgatacaacatggcacatgagcttactaataatacctactaatcaaaagttgcataccctacatattcatgacttagctagagttgacaaacaatatgtatagctcccaagtataacttaaaacccaggatatgttcggttaacgtttaaccggctacctctgcataaacagcagaatttacacttcgagttacatatgattgaccaaagctcaaattgacagttggcaattgacatctgacaattgggagcattacttttgcagttgctaaagataacagaatcgtgcagaagaataatttaaaaggattacttatttgctgatgaacttttgagaaatctactgtaactcagtaccatggcgggccgtgaccccacagcccgcatgtcattgagaaaatgagtggcatattaggatcaaaccaaataccttttattgtgtggttggtccactacagtagacacaactacaaagaggccaaatacaattgccatagagaatgagatgatctccttaaaatataacactgcctgtaaagagttccaaataaaagaatagattagatgtctattttgaacacctgttccttgccaatttgcatgcaacagttgtcaagttaaacactacaatgaacacgaagaatatcataaaacagaagaaattgtataaatatgtcataattcatatcaaaacggaacaatatgtaaagggaaaggaagaaatattgtaaaataacaaaatacctttaatactgtgagcttgtactgcaaatgaggtatctcaagaagaatcttcaaaatccagcagaaacacatgattgggttgtagaatacgaaccaaggtccatggactgagacaagacctacaaccatctattcaatggcaccaactataacagtttgttttcaataatttgtatgactggaaaggtagagcacaatcttcacagactcacagtaatgaagttcttacccacacaagaaactgggaggacctgaagaacgactcgtagttcacaacatctttcccctcaattttgttctttataagcataactatttcaagaaaagaaaggcaggctgcaaaaccaggcacaccgaaaacaaaccacttctccagaaaacccatcctgacattctaaagcaataggcaaaattaatatattagaatatttcagtaaaagataataaacaacataaagcaaaaattgatgctaattatcaagcttaagtaacatggtttgagtgcttcattttatctttcatttataataaattaatagttggaccttcttggtcctactgttcttttcaagaaaaagaacgttcaagtattgtttctacaaaaacatagaatacgaactagattgctgaaactaattatgataagattttcttgagtcaaagcaaacccaatggtttcaaagtccaaataagttacttcctccgtttcatattataagactctagcattgcccacatttatatatatattaatgaatctagacatatatgtgtgtctagattcattaacatctatatgaatgtggacaatgctagaaagtcttataacttgaaacggaggtagtattcaataaaaggatctcggcctctatttaatttagtagaagtatagtgaatgacccctgtttttgccacttcgtgcacaaaaacatcattatgcttgaagttcacgctatcctaagttcctaacaactcataccatcagttgtgaatataaatagctttagcttccactatcccgtttataatctcaaccatatctgttactgaacaccgtcattccaaaaacagaaacaatcagcaatgcaaccataaaagcttcatctatatgaaataccaattcacatccaacatgcgagacatgctgatacaatgtttttttttactctggatacgatgttatcttagctatgaaacaaacatttgtatgactagttcacacttcagatacctaacaaaagaaattgcagcaaacatgtgaacaatttgttggaaattaagccaatgccccgctaacgctagtgatcacttcctacacctttgtactcctgaagtttgatttccatagacattgtgaattcaaaaaccgattatccatttccttcctacgactttgtagtttgtactcgtgaattttgctgacaaagggcaataaacagagcagatctactacctcagttctccgcgcgttcctcctggagatgaagagcacaacggcagcaccagccgcaaccacatttccgctcaatcccaacaccgtagaatgttaaggcctaaacaacacaataaaccacgcaaacacaaacgcgccgaagccgaagcgcgatcaaccgccatcgcagagaccacgaacaccaccaaatttctcgaacgaaaccaaaggatataaatcggagaaacacggggtgaatcgcctcccgtcccacgcctgcacccaaaaaaaaaacatcacttcaaatgaaaacaaaaccaaaaaaaaaaactctcatgatcgctgctccagcattcgactccgacgaggaggaaggggattgggagggttttaggagaagctcaccgcgggatcgccggggcagacgaaatccatctccccggcgccgccgccgcgcctcctcgcccactcactcgctcacccgagcgcgtcgcgtcgtcgctctcgtctcctctcgactctcgtcgtctccgctcctctgagttctgacaccctcgactcgctcaacgcgccgtgcattgcaactcctcctcgaatatgagccactgatccgtgggacccacggtacatgggccccacgcaccaacgtccacgtgtgcagcggggtagggttcggcctaggtgagaaaagtatcgaaggagaaaaggtgcttttcggccttgggcgaaaagccgcgcaaccgcactcgcgggccgtacgcgaaggattggccaatgacaaggtgggccccgctgacgtcgggcccacaggtcagtgtctcaggacggaatcttccgagctcggatcgcaccgggaagtggagttgattttttggcgctagcttttttgggcttttggactgttcactaacgtgacacgcacgtaggggaggaaagaaacgaagcgccacgtggcccagatgcactgactgagatgggccggattgatgctaggtttgggccgagagatttactgtcttacgggggcccatcaaaggcggtttctgagacgtagttctttgctgggcctggtccacgggttggcattgggaggttgggctaggcgaggactttgctgtggtggcattgtgtcattgtggtgactttgctgtggtggcattgtgtcatggaataagttcactttaggtccctctatttgtcgcccagtctgattttcttccctaaaccgcaaaaccgggtatgacccatcccccaacttacgaaaatcgggcaaacgaggtccctcgacggttttgatagtggttttgggtgacatggcgcctacgtggctaatttgactcggttttcatctgacgtggcgcttacgtggcaaatccggaaaaataataaaactcgtgggccccacatgtcagtttcacaaacaaaataattaaaaaatggtgggacccacgtgggccccatatgccatcctcactcttctctcttctctatcctctctctcccctcttctctctatcccttccctctctccggccgatggagtagggcgagcggcggccgtcccggggcagcgcctgcacgagctgcgactcgaggcggcgcatgaggcgggagttgcgccgcgtgactgctgcgtacgcgtcgccgccgccggcgtcggcgtcgttgcaggacgcgctcttgggaagcatgccggcttgttgcaggtgcgcctcgacgccgtacgactgctcaactgcagcgatgaccctccgaaggttgtccagcgcctgcagcaggtccctctggaacaccgggtccgtcaacggcgacctcgccgcgccggatgattcgtacaatgacgacgacgatgcctcggacggttggtatcccgacgaccccatcgacgacgacgatagttcttgggcaataagctgcttgtgcaatatgctgccgagctacatcacataataattctattatatgactgtaagaatcacagattatccagagagggttcaaaatgaatttgtatttactctcttatttatgtatttcaggctgaaattgggaggcagacagcatcagaacgtcaatgggaggtctacagattcctccagttcttgggagctcagaggcgacgcccggcggcggtagctcgcggcagcagacgtcggcacgtcgttgtctaaaccatagctcgatccatcatccctgaacacacccatgtcgccgctcatcggccgcctggttatccgcgacatcggccggagttcgctgatgcggctgtgcatcggcgagccacctctctcttcgcccgattgctcgccgcttcttgaaccagtcctaatgctgccccgatcaaatgctgtgtagggagccgagctggtccgcaccggcggctactcgccgccgccgccgctcgccgcagcaaggggagggagtagagagagggcgcaccgcagtgtgcgccttgccgacccgccttcgccgctcgccgcagcaaggggagggaggagagagagggcgcgccgccgtcgcgccttgccggccggccgccgccgctcgctgcagtaggggagggaggagagagagaggggggacagggatttaggaagagagagtagagagagattgagaggatagagagaagagggaggagtgaggatgacattggggcccacgtgggtcccaccatttttattattttgtgtatgaaactgacatgtgggtcccacatgttttattatttttccggatcgaattgccacttaagcgccacgtcattgccacgtcagatgaagaccgagtcaaattagccacgtagacgccacgtcagccaaaaccgttatcaaaacagccgagagacctcgtttactcggttttcgtaagttgggggatgggttatacctggttttgcagtttagggacgaaaatcagactgggtgacaaatagagggacctaaagtgaacttattccttgtgtcattgtgggttatgttcactttgggaaaaaaaattagataatagaaacaattttgctatatatttgtcgataaattttcttctaaattttgacagatataattacagtacaatcatttaattatactgtaacttggatgtaattacactgtaacttgtatgtaactataatattatttgcatgtaacttttacatgattttgaacagttagatttgtttcaaaatttgtacaagcgaagaaaaaaaaattgtttcaaaatttatacaagtgaagaaagaaaaaagccattgtgcgcatatatgtgagaggattcgttcccatgacctccgttttcactgaaatagtatgttacaaagaaaattttgaaagttacatatatgttacagtgtaattaaatcacgattatactataattacatctataaaatttttaggataaaatttgtggacaaatgtataggtgatctgtgagactatgtaaaactaatattagaaaaaatctcggttcaatgaaaagatacatttaatatataccgtgtttcttttcattcgtgatatagaaacgatcaagctggtttgattcttttttcaccaccgaaacgtctacggtgacttcgtaaacctttagataagttcactcggtctttggaggtgctcattttggggcgcgggggggagggggggtgtacagtgtacagatttatatttttaggggtaagtgtccgcgcgtttatatgagtgcctatgtttcaccaaggaaaatactccatgtgactttattaatcttaaaatatcctagtctagagatagtatatacgtgcatatcaatttatgaaaggtgagtgtacacgtattatataagcgtatgcatatgtacatccacgctacaggcatgtacatgtaaatgcttcttaattctctattcaacacgtactttagggatgggtaaaacagataaattcgtaacatgacgtagaaatatagaattaacgattgtttaggtgagaccatcaaatgttcaaaacaatcctcttggagacgacgaggctagttagcttttgtgtggctatgaatttatcgatcacgtttggaaatttgcaaggataactcgtagagttggctgcgttcgtagccttttcccggagccgacaaggcaaagctccggttggatacaccctacaccaaagcctcaaaggctatatggaatgtttatgctacctacaactctataagtagtggtaatatattgtaaatcgtccattttacgagtatgtttcaatatattatatatatatattatttcctttatatatatataggtaaattaactagtgctacatggagtatgggctccaaaatttaaattgagtatatatccaatttaaatgagtataaattttttttaaatgtttagatatgaacattaacttctttactaacaagttcaaacaagtttgaactgagattgaactttttttttcgttagattttggttctaggtatataacatccaaacatataattcgttaggtatgtaataatgaattgtgaaataaagttgagtttgagttgttttgttattaagtatttgtatgaatcgaattcatatacctaggtatatactcacaatttgaaaattttaaaaaatttgagaaaatttgtgtgttttataccttggagcccgggtaccatggagtcccatatgtgtatcatataaatatatatatatatatatatatatatatatatatatatatatatatatatatatatatatatatatatatatatatatatatatattaataatcaaaatttacacagaatataagtatttctggacactgatttcaatgcatcgaatctaagaattttttagccaattaagtgattatgagggaatctaagcgattaaaaattcaaaaattgatcgttggagtgaatgcagggatatctttttaactcttattcttcgctaaacaacaaaaatacgaatattttcgagtggagagggtggaacttttaatatccactccttgttccacgaaaattaccttattggcttattcgtatgtgtagcgtgtgcgactgtgcgctctttttataaataaagagaaaaatatcacgaaataaaacgatctcaacaccatcaaacaatgtcatcaccatgtcgctacacatgcatgtaaaggtttagttttttttgctggaggaggcaagacagtaagaacatgcatcctccaatccattattttctttctgatgcagtcattctaaaaagacgaacaagttccaagatttcaagtgcattcaaatcaccaaactttccgatcgatctccaccatcatcttctagtcatatttttcatcgatcccacaatgatatatcaccacgtgcatcgtttcccacaatgcatatgaatgattttggagcagcggaaatcgtgcagaaggaatacacggctccgtcagcggtttcagctgttagtgagttctggcatgtgctgtgtaactgttcagccagtccgtggttggtttttcttttcttataacccgtctagttttttacttctgcttattaaaaatataattggcagctctcctgccggtttagtttaaaaaaagaatgtgtggctttgcataaaaatcgcagaaattcaaacggatttgctataaatgtgtcgccagattttctaagaaaaaacagtcgaattgttgcccgtacgatattcatcgagattcgcgccagtgcaaaggaaaaaaattcaggcgcagtggtggggagtcgaactctggtctcttcggtcttagacagagtgactaaccaactcagcataataggattaatgatttcaatgccaaaattaagttaaaattcattcacgaggtacttacagtacttactccatacttacatatcacttacataccacttacaccacacttacatatcacttacataccacttacaccacacttacaacgtaattacataccacatacactacagttacaatgtaattatataccacttacactataattacataccacttacattactagttatagaataattacattgtaatttttatgtgtttttaatcatatggtttaaaaaataaaatacgtactagtccctaattaatcataaaagggtgtacgtagttggaggtccactgagtcgttaggtatggattagcagtagagaaaaatccgactgcgtttgggttcgttttatggcgaatgatttgtagatagtcccaattcaaatagaaacagaaagacatattttccgatacctttctttacgaaaggtgccaaacgaacatctctgaaccttcttttgtttttcctttgaatggcatctctgaaccttttgtgttagcttaaacaaatcatcatcatcatcatcttgatcaaatgtttggcagagaacaaagtacatatcacacgccaataaggtcgaatccacaaagggatttttggatattgttgacatggaaagacgagttaggagcacaatcacacacaacattcagaggagtacgaaaactttttccaaagggaaaaaacatccacaagaaaccaaaagaaaagagagaaagtagaatgcaattgaccaacaaaactacaacagcacaccaagagaaaaaaaaaaggaagaagaaagtagcacacacagatggtttcagcaaaagagttttggtgaaatcctagaggttggcgctgctgcagcgtcagcagcaggaggaggtgctgctttggagaagccaacttggctgggtaggccaaggtagagcattctttttgtctcttgttagagtggcatcccctgcacttatgcaccccaaagggggagaagaaaaggcaggcctagcagtggctgaaaaattgggtaaatgcatagctatctatatttttaaactctttatttgaaattttggaaatgaaccaaattctaattggttggcttcgttcggaacggtttttttgttggtgggcttataccggcatgcgaaataagatgggtcattagcatgtgattcattcagaaactattataaatgtggatatttttgttttatttgaatttttatggaacttctatataaaaagtttttgtacaaatacaccgtttagtagtttgggtcttcaggaaacgtactcacggacaatgatggagtagcctagccgagaatccaatcaaaatgcagcctttgttgataaatctttagttaattcaatgttttagagctcctctgttgtcaaacaaaatcactgcataactcaaaccatatatcttagtatgtcttttatttttgccaattacatttttctctaatttatactgcttccttagtgtagttttggtcacatactgactttggttttgaacccaactataaaaatgtgagaaggataaggacaatgttcagcttgtatgcaggaattccgctgacaatagtcatacaaaaatttatcatcatggatggagatttaattagcgataggatttcgtgaataatgttttttcatcctgtgttagttggttcttgtcttcacattgaatgtgggatgtagttgttggtgctgcaaactttatagtaataattacttatttcttttgttaaaataaagatcaggtttttccatcatctagagagagaaccctagtgaacattttgtaatgttgttgtctcatcacaatacaatcatatatcgctctttatatgttactactactaagggttgcttgcttgatagacacaatttatctaagtttaccatagcttaagttagataaattgatcaagatagacacacgtttgatttgtagccacatttatgataaatttccttttttcgtcccatatgcaattgaaaagagagagagagagagaaggcaaacttgcctaaaactaactaaagtatggattcagttttgttagccaagccctttggcaggtcagtcaaaacaaattatgacaagcttagacaaattaaggtcttgtttagtttccaaacaaaaaattttcaccatgtcacatcgaatgtttggacacatgcaaggagtattatatatggaaaattaataatttcacggattgcgtgtaaattgcgagatgaatattttaagcataattgcgccatgatttgataatgtggtgctacagaaaacatttgctaatgacagattaattatgcttaataaatttgtctcacagtttataggtggaatatgtaatttgttttgttattagtctacgtttaatactacaaatgtgtgtccgtatatccaatgtgacacgccaaaaaatttcgttcgcgaactaaacaggccctaaggtggtcagccaaatagccctgcaactttcacagccatcgcaaatgtaccccttgggtatgatttgggcgaattttggagcctgaagtgtggcctgtttggtacagctccaactcctcaatttagctctaggagttgagtctggagtggagttgtggagctgtctaaacccagctccataactctagtttattttgtgagagagctccacacagctccactcccagttttggtggagctgaaactgtttggctgagcttcagctctacgaggggtggagctggaactggagctatgccaaacaggcccatactatgccttttgtttggtcaatcggtctcacgcgatgcatcgtcacactcacaaatggacttagcttgcagtatggtcagccattgtctatcagtcaacatgtaaagctgtagcttcccattctctgaaagactgaaactgaaagcgcttgctttgcttgagatggatgcactttcatgctgtaataatacattgatagtaaaaccatagaccgcgcagataccacctgctttcagccagccatcaactgatcaactacctagccccattcagatcaaattggaaaccggaattgagctgtttcctgcgaaattcatgtacatcttcccttacaaagggttattttggaacaaaggattttcatatgaaatttgtaggattaaaatcttatggagctatttgatttgaaggatttggctaaaaatctcacagaagtccttaatttcctccctttttttttgaaggatttcaaacataagctcgaatcttatggtatttttacctttcctctcaactctatattaataatattttccatatgaggtatgcaaacaaactgtttcacaaaaattctcgtgtgtttcaattccttaggattgtatatattaggagcgatattctggtgctctctaatgatagtattatactattgataaaataatctgaatcgtttgttattaaggataaattagtattttaccaatacagtgattaggggtaactttgtcatttatgtttgttttcctagctagatcgatttgtgatcatccattacattggcatcactcatattccataaaaaaagctaaaaagaagaaaaaaaaggtctagccacagctaaatgacgattatacctctccatatatattttttataataatatctctacgtttctattatcgttagatgaggtggtagtgtaattagttctgaacccttcaaccaaacatatcaatggttaagattgctttctactagtcttgactagtagatagagcatcgtaatggggctcatatatgttttgactttttctttctacgtttttttccttattttttggatttccagttcctgtgttttaaagtagctataagagccagtgaaatttcacccgttgataccgcatctcactgtgtgtaataaaccagcaaacgtactccctcctccaaaaaaaaaaaagacaaaccctagtttccgtgtccaatgtttgaccgtccgtcttatttgaaaaaattatgaaaaaaattaaaaagacaagtcatgtataaaatattaatcatgttttatcatctaacaataatgaaaatacgaattataaaaaaatttcatataagacggacagtcaaa

SEQ ID NO: 74295 - DNA, 1152 bp, Oryza sativa
tccaccttttcactttgtcctctgtacccccacaaagggtgaatgtctcgagcattgtagtccacagcatttctttctccgaatcttggacaaagctctcatgatctccgcgtgcccttgttcttcgccagtacaccgtactgacaggcacgttatcccgcacaacccaaccgctgtgacgtacatagttcttggcggcttcggccggggcactaagacgtccatcttcttccacttccgttatgatgtgccgaccctcaagcttcttcgctgcacctcgttgcccgcgtgccctcttctatccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtc

SEQ ID NO: 74296 - DNA, 985 bp, Oryza sativa
tgagcaaagtccggaatattgtcgtcttccacttcatcttcttccatttcaacaccttgctctccgggggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccgatcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatatataggggtgggactttagtcccggttggtagcaccaaccggggctaaagatcaccgggatcattagtcccggttggtattaccaaccgggactaaagttaagatctttagtctcggttggtagcaccaaccggggctaaagatcaccgggatcttta

SEQ ID NO: 74297 - DNA, 10770 bp, Oryza sativa
ttgtctgtggaggggaactttcaacaaatctctcctgatcatgtgagcgagtctctacttgtactataaatctttgtataatacagtagcatcgtgtatgtgtgatctgattttctttataatggataaatatctggcccctatatccacttgtgatctgaatactgcagtatatattggtagtaaatcttgttgtaatttatgaactgtctttttcctggacgatcgattgattccaaaatcgtgggatttgagtaccagtatctgactcaagcgatctgaatgagtggtggtttagcgttagttgggagaaaattatcaagcacggagcaacagcgacccattgaaagttgtagctcaactagtaatcctggtggcttattggaggcctaggtggttaggacttgggagatcgcactcagacgagtatactcgtggcagttctgtctgtataaatcagaatcactggtctgtatgtgacgcactgtcattttctagtagaccaatggagcagaaacaacggacattgttgctagaacaccaaactagcatactagcattcacgcgtaaatcggctgaaaggatggatttcgcaatcagacggcaataccgtagtgggtcgtgatgatgatgagatattgagatccatccaacattctccaaaccacttaatcacctaagactagagtagtagactgaagaggcttaagctcagctaatgctcgagtcgtcagaaaagaaaatcaggagtgaacagaatgaaagcttggttgataatgcaggttggcgttggtccacccactcaactagaagtgacagcttcttagggtgaaaatccaccaggcccacccaataaggccaccagcccaatattattaggaataagttcactttagatccctcaattgccgagtctaaaatttatccctaaaccgcaaaaccagacgtgcccctcaacgttaaaaaccagtgcgaatttcagactagtacctggtattggaagctgagggacgcgctatatctgtattgcggctgaggatgaatttcagacttgacgacaaaggacttaatcggttgtgctggctgcagccagcaagccattcacagctgccgctctttcgtttggattggggctgactggctgcagttgctgcagccagcacttccgattagggccaaattgagggatccaaagtgaacttatccatattattatacccagccgcgcgcagcctatactaattgggccggaacggcccatccctctggaccacagtattgggccggaaagggatcgtggtgtatgcgtggcctatgaatattgggccggaacgggatcgtggggtatgtgaggcccatgtgagttcggctcgaacgtgtttgttgggccgagagtacggcaggttggaaaaccatggcaatgcgtcgctgctgacagcggttggtgagtctacttcaggggatcagcattccggaaccttcgaaaagagcgcctcaccttgttcgccgtcatcggatggctacttcctacctaagaattgagcttggaacgcaaatgctggtgcgctgatccatttcgccaatggaagcacgaaccgacaaggcggcaatacatgatgcggatgcatgctctcaagtctgaatctgatgaaccaatcaagttttcctagccatgttaatttggagagatctacatctactccaggtgactgacagacagatagcaagcagcaatatatactccagaacggtaaaatctatgggcaaagcagtgaaatcacgtgtatatttatgaccttactgtactttacttgcaaaatgtattgtagtagtagttctttaaaaacaacatgcagcctcgggattctacaggtaaagccccacttaaatcaactagctagtcgtcttcgaatcaggtctaccctcgtccctcgtccagtggttgttctgtagaagaaaccactgctttgtttctttacggcagacgtgatctgaaactggcaagaaacagtgccaacgcccgtccaacgataacgagatacacgcaacagaagcgtataaccaacaatttctggaatcattttggaaggatacccgacacagtaatggtctaccggttttcatccaaatggcagagcagaacgaacagtcgaaacacccgacccgacagaacggcaaaaaacgggcctgaatgccagcctgaaccggcaccgcgccaccgccacgtcgtcatcgtctcgattggcagctgccctctcacttccccaccaatgctagggcctgtttgttggaacttttacctgctacagtttttctcaaaatcagaaacttcccccaaacaatctagctttgatttgtataatctagaaaataaactataacccaaaacttaaaaaacctagcttctttaattctcataagctagctaccaacaacttctcggaatgcatgccctagatctcctgcgctgccatgccgcatcagcttagctagcgccttcacgtgcgcatgtgctcgctatattatccaaatcgcaaaaccatccaaggcgcgcggcctcaccaaccaccacgcaaacccattgttaattaattagcggcacactgtcacggcgcattatttgctagctccagtgacagctcactcctcttcttgctgctgagggcttagctagccagtccacctcgtcggtgtgtgtcggtgtagtctagcagctgcggcgggaggaggagttgccggccggagatggcagcggcggcgcagcggcttgtcgccgctgtcgtcgtcttggtggcctgcctggcgttgccggcggcgcgggggctgaacatcacggcgatgctgaacgggtacccggactacaagatgttcaacaagtacctgtcggagacgaaggtgtgcgacgagatcaacgcgagggagtcgatcacgctgctcgtcctcggcgacgggccaatgtcgacgctcgtcctcgacgccgaccagtcgctggcgggcatcaagaacgcgctccgcctccacgccatcctcgactacttcgacccgaagaagatccgtggcctccccgacgccgacacgatgaccgacacgctctaccaggccggtggggacgccgccggcaagatgggcaacgtcaagatctccaccctggacaccggcaagatcgccttcgcgtccgccaacccggggggaaagtacgaggccaccatggtcaaggccatcaagcagatgccgtacaagctctccatcatggagatctcggcgcccatcgagttcgacggcctgttcgacacgccgtcggcgaccaacctgacgaggctgctggagaaggccgggtgcaagcggttcgcgtcgctcatcaccagcaccggcgtgctcaagacgttcgaggatgccatggacaaggggctcaccctgttcgcgcccaacgacgacgcgttcgacgccaagggcgcccccgacgtcaagaagatgcccagcgccgacctcgtcacgctcctcaagtaccacgcgctgccgtcgtacaaccccaagccgacgctcaagacggtgtcgcgcgccatgcgcacgctggcgtccaccgcgtcggggaagtacaacatcacggtggacacgcggggcgacgccgtgacgctcaacacgggcgtcgacaagtcccgcgtggcggccaccgtcatcgacgacacgccggtgtgcgtgctcacggtggacaacctcctcatgccggtcgagctcttcggcgacgcgccggcggcggccccgagcccggacgacgcggcgcccgccccgtcgccgtcggtcgcggacgcgtctccgccggcgccgccgccggccgacgcgccgtcgaagccggcggatcacaaggaaatgaaggcgtcgtccgccgtcgcgttgcggtcagtagtgctcggcgcattagccgcggccgtgtgttccttcgtgctgctttaagcacaagtttttttttccctttcttccatgtccagtgccggtgattgtgattgcacgagctgcattgccaattattcctctgtataatgcgagcaaactgtgtacattttgttctaattctgatatccttttctccgaatcgtctgcgccatttcggtgcggtgaatttggaagaattcatgtcgcgttgagctgtacaactgtagatcatgtgagttcttgtcctttgagcgcgtcgtcatgcaggcccaccacagcaaatgcgggtgtgttgatgtgatcttgaaaaaacagattcgggcgagagagctagtgcggctgccgctgcctccttgtgctggcattggcagctcctacggatttcgatcaattcgccgtttcaggaccaccggtgccagtaatgcccgttggccgtgggttatttgataactctatctagtctttaaatatttttagacaaaaataatagaaatttaggtcatcctattttgaacgcgattctcaaatttaatagactaaaaaattaaagtcccttaccacctaggacaaccacaatgcagaaatacaaggggtattaaggggctgtttggttgagcgccaacctttgctacagttgtgacaattaaatttagtgtttggttcatgccacaggtgagttataccacttttttttttagcaagctagcccacttgtcattgagtaatttttttaccataacttgccacaattgtggcaaataaattttagccatataatgtgccaaatattttgtggtaaactatgaaagttatgaaagtcatccaaactatggaagcctctaaagtggtccttatacattgtaggagtagttcatatatatataatgcctagccataagaataaaataacaatactttcttttctctctcacataacatacaattgagtgggaccagtaagatctatgctaatgcctcatcttatcatagcatattgtagcaactaccataattaatatcaggtcccatcttattacccaagtagacattatacattaagcatgccctaagggcatcagcatcagcaatgtttattcccaaaccaagcaataagggtgggcccgttgtcagggaaaatatctagcaatgtgtgtatgtaacagagggggggaggaataagattggtccaccttcaaccaacctatcacaaagccttgttctgacttataaaagtgaggtgggacccatcatattcccttactaccggcaataaacttgtaacctggtagtaactatttactactgtcacaatgtttattacttgataacaaacccctatttaatgcttattacctgctctagcactacattgtggatgcagttgtgagcactgtgtagttaatccacggaagagtaaattacacttctagggctcgaacttgcatggcagagaaaggagtacaataatttggaaacgctttttctgctcaacttgttcatgcgaaccaagaattcaattgaaatgcgggatgcacgggtatagccgttcagcgatattagtacagatttaactatttatctgtggagaataatacaaatttatacacatgaactccataaaagtaattaagaactaatgtcctgaaccctgatcattgctaaaggtcgtataaacaaatacggtatttacacacggaattgacatgctggcgtttcttacacactacactatccaattatacatcttatgttacaagtaagaggatatatttcactgtttgagcgaagttgtaactacaatagatacaatatgccctgtggaatatttacaacatacatacgccaaaatacttaaatcttgaagaccacaagcacaaaatgggtagagaagatcagtccttgttgcgagaggaccgctcccgctccttcttctgaccaccaagaatccgagagatttgcagtcctctactgaacgcttgattaaatagcatccgtgtctgaaactcggacacaaagggaaaccatgccaaaatagtaattggtgtaaagagaagaactcccataattatctcgtatgcccgagcaagggcacgaacagatccccatagccctgctcgccgagcaagaggcttgcaagcttgtgcaatctgaaagagattgagcaacaatgagaaatcaactaaagcataaatgaagttaatgagcagaacaagtaggagaaagacaaaccagcaatattccccatccggaaggtaagaatgccagaaagcacacaaatatatctcgtaaggtcatatgaagtattgctatcagtacaatcaagatggcgatgaacgaaacaaatatcataaacttaatcagacggaaaaatagctgaaaatccgcactaaatctccgccttccgacagatacagtctgaaaacagtataaacaatttaggtaagcaaaattatagataagatgctatggacagcaaatagtgttgttaacgtggccaccaacccgccaacagttgtatgatcctttttttttcttgagaaattaattctcaccttcataacaagcaataccaccaaaatcacgagccacgaaattaaatatacctggaaagaacaaagtagcaaaaaatgttacaaccaccccatcacttgttcaataaaaatgtagctctaacgatctttcaaaaaatgcagctttaacagaacaataaaattaacatggagggcataccaatatacttttgtcgcctgtgatatttaagtggtaaacaaggccatactggtatatgaaaaacctcagggacaaaattatctcaacaaaaagtccaattgtcccagaatatttcaaatgctctagctcgatctcccaccaggattcccaactcttgtctggtgacaccccaatgccaccacgattgctgatccacttattccaatcagaccaatcatccacaattttcgtccactcaaatcccgatggattgaacaggaagggtgcaaaaagccatgtcaacactaggaaccacatagagaatgtaacaaaaatataggcaatggttgagcggtaagattgaccaaatagttggtaaatgatgagcagaatcaacaactcaatgcctttaacaaagtgactgcgagaataaagcctgtaattctctgcaaacttagcatgaaagacaacaaagcccctaccagtagctctgtactgagcacctccatggagcaacattcgtccatagtagtgagtcttagtgccaagtgaaaacgtaaagaacacagctgccaattgcaagttcatcatgataaattcacttagtgcttgaccaaatcctttttcaaggccaatttccatcatcatgggcagggccatcagaaaacctagctgaaccagagattgtgaggcaagagcaacctgaagggggtggttatgaatgtatctcctttgtgttaaaagcccttcttcaagtccactgagagcaagataaaggcgtccatacagaaatacataaactgtgacaactgtcagctgtagaaaaagtgaaaagtattaaaaacatagttaactgtgctggcgtactcaaaacaattgcaaatacaagttattttagcttagggcattaggaattaaggcctcaatcaacaagggataataggaagatgtgagaccaatgtggctcagttgtacagtgaccaatcttcagggagtggtcgacgcaaagcagacataccagagtactgaaataaaatcccacagtagtgaagtagcatgaaagcattctgaagaaatcgaagcggtgtccaagccggtagatatcacggctaagagtctgctctccatttccattggccaccttacctcaaacttagagatctggtttaaccctacatctcttcctttaccaacttgcacatattcatgatgtgttatatttcctccacggagagttgaattatagcctgtaacataaaagacaagaggagcattaccccagttcctgaatatccagttacatctggaaagaaattaacatacagggcattcgtattgaagcaatggagatatataattactgccaaagaccatgataattgatcttagccacttcattaatcagcaaattgaaactttcaggaaacaaacctgcaaaaatatcttcgctcaagttgatactccttgatgccttactgacaccacctcttgttagatgaaaaatcctatcaaatacgtcaggatggccatagtggaatcgaaccctagaataaagaaagtaatagctttagatgcaatccaaaaagggaaattctgtacgttttattataaaattcttatgtagaactagttatcggaaagtgcactataaaatggcttgctcaatatgtttataagctagcaaatgacatggcttagttcatcacatgcaatttcagatttagagaatataatatatgatcacttagcctttttcttgtgattgatgaaaataatgtattatgtatccattcaaatgtatagtaacacacatgtgaggaggaaataatcagataggagaagatctcacttcagagggtttgcaagcagccgttgcccaatagtcacaaaactatgctcctgattggacataaaccatgcgagagaagagacactgcataattgaagagaaaggtgcatgaatgaattactaacagaacctgaaaactcaattgagcaacagaacaaagaaatagcagaatgtgaaaactagattgagcaactcttatcaacctgccagtaaaaatatgttccctaactccaagtatagatgggcgccgaactccatgttctgtaaggaactcttgaagcaaatttctcattttaagtgcttcttccatatagttatcctacaaaattaaaggtgtgcacaagtaaatatgagtttgaatggaagcataagtgctgcacctcctttggagaaaatgacagcataaagtacgattctacaaacctggttcatgtctatggtttgcaggccttcaccacgggtgaagattattgcatgattttgattttcaggctttccttctcccaacattgcaggtcctggaagttttatccggtagataaccttgaaaacaaaaaaatgcaaatgttgcagcttcacaggatcacagaaagaactttcacacttgatccacttctataaaagaagcccataacttccagcatttatcagtaaaagaagtttcaagaacagcagttgtgcaggaggttcctaaaagtgtgtacacgtccacttgaacctttaaagttaacttcttgagcatctatcagttagagagagtggaaaggaattgtggcactgctaagcaagtcccgaaggaactcaggacacacttatcactctcattgcctgggaattatgaaaccatcggtgtgattatgttttgaagttttcaataggacagcagcattcatgtggtcctgagatccatttctcatgaacatgaaggctttcgttggtgcttggctgggcaaaaggacttgcgaatttgcaatactagctggccattccaggccattactacttggtggcttggtcgttcatgagtggtgtgtgctgcgtgtgtaaatatgtttagtgtgtgtgagttggtttttgggtcagaacgtccttcttgacctttttgtactgtgttttctccttattgaaatgacatgcagctctcctgcgtggttgaataaaagaagagagagtgaaaaaatctcactgcaaaattagattgttgaggatacctcttcaaatctaaatagtgttgtttggtctatggtttgtatcacttgttttagaattaggctgggaatcctttgatccttctattaatagtgtttttgttttgtgcctaacatgatttgccaaaatttatgccccactacctaatcaggtagaagtacggttacctgataagattttttttgacaaggaattacctgatcaagattttgaactggatctgtagattcagaatccttagttagagcaacctttaccaaagttgagtaataagctggctccattttcttttcttccactctatcttcgacctgatcgatatatgctacacgaagagaagggtacctgcaagaaatttatcgctaacaattagaacttgagacagaaggaatgacctacattatccaatcatggaaaacactgtactatcatgtctacaattgtgcaaattctgcagcaaagctttggaaaaaaatccattggttgatgtgtgtgaaagagtgtgatataactgcaaaacattaaatatcatgatcaaacatgatagcatcagggagaaatgaaatataaatttaaataccaacaattaaacagtgtattggcattcttctttcatatctctctctatttcttccaatacaatccaatcatgcaatttttgtggtcaaaataatatcttctatatgcccagtagtattgtcagctatttggaaacttgcacacgaagttcatacgagttagattgtatctctagtgtacacctaatgtggctccaaaatttaaatccagaatgatatgcagcattgaatggattacttatagtattataaatattgaaatcactacagctactacaatatgatgagtacttaactaatctctacatctacagtattcaggtaaatgcaatatccttatttacgttctcatcagctgtaatatgtcttgggcattaggaagagcagcacgcttgtcatttccatattgctggcatgataccacataggtaaacttcatatcagccactgcttcacattgcgcaaacaaggaccgctgtaacttccattgttcat

SEQ ID NO: 74298 - DNA, 4667 bp, Oryza sativa
cgtgttcgtgttcgtgttcgtgtcgtgtgtgcgcgccttgtcgcgagcgttcgtgggaaaaccggaagaggagcgctcgtgggcagaggcgaaactttgccgcgcgccacgtttgcttcgactgcggatgcccgctgtacggctgcagccgccgggcccttacgccgctagtggcctgtgtcagggtcattgtcattctcgtcatcaagccttcacatttatttctacacttttactcatcgctgtacttccagtaatgttgaacccagtagttgtctttttaagagtttaagtctgcattggtttagggcctaccgaacaacattggtttagtggggttaatttcggtaaacgaaagctttgtaaccgcctaaccggccaaaggattcatgtagtagtaagattttatcgaaacgaaccctgcatcttcacgaaccttaatgacacctgatggccacccctacggtctctcggcccatgcacaagacacgaatcgtgtaaggtgaccgatcgacccctcttatttatagcaattgtcatctcgctcctgttcgtcagcgtgtgtagccactagaaacgaatatatgatagacagtggccttcaacagttcaaacgtccaggctgctcacagcacccatcagaaatgtgctgctagatctgccagcaggttttgtttggttccgggcaacaccctgggccaccatctacagttacgtggtctactactactaccttcattttgtacctacagtgacctttctctctaagctaggcctggattgtcgtgcctccctacacccatgatgcatacgactgtatacacctaaagcaacagtactaggctccatgcacgttagaaaacggatcactgctgaaacatgtgcgtaaaatattctagtatatatatatatatatataaaaagctactccctccgtttataatataaatatttttaggtttaatgagagagaataattgtttttttccatgtcacttcatcgatcaaattttgaattatttggattttccttcatatacacttgattggctggaaatgtttgaattctcgtgcattaaaatcagtgttctagaaattaatatttatactatgtaacaatttgaatcataaaagttattaatattttaaaacagagagaaattgaggttctaatgttgaactagaaggaataagtgtgcatgctgccctgagagagagagaaaaaaaaagaataagtgtgctagtactataccgcaatacgtactaggattttctaattacttttaaactttttaatttttttaaatatcaactttttgacatgacattttgccatgccacgagacaagtggcacattggcatagcagtattgtcatgttatggcaaggattttaaccatgccagttactatgacacccacactcatagcgtggtagtgttataatgtcacgttatgtgtggtggatggaaggtatggctttaaagttgagattaactaagtttttagagtctttattttaaaattttttaaaaagcttaaaataataaattaaaattctatgtactaccaccactttttagctaaccagtaatcgtgcacgtgcaatgcatgttatgcaatatatatgatagaaaatgtataatacatcaaaaatctgaaaacatatgtagggtaaatttgtaacatatacatattgaagctgttagtctatttgagacaataaaaaaaatgtagacatcatccattacatggcacgctacaggtgtacagcatcaacctagcttgctcaatgaggtgccatgtcactttctcgggtctcttctgacctcctgcccttcgtcctcctcacataatcacatagatctatcagcttgtcaccaactgatataccaaattattattatagtcatatgatagctttagctttttcagagtttctatccttgacaagcaaccaaagataattgttaagttaaatatgtgtacagtggagtatgtgtaattcatataaattttgctttaaaaaaagaacgatgtagtttaaacctttccatcgatgaaactcaaaatgcgaagacccagaaatcaaccctttgaggatgccatagagcagtttgttagcatttcacttgcattgcatcaattaggtgttggttgtttagatatcacttgctttgtattgaatctgcaagcagaacacatgcttgagcttgttgcttggaggacatacatgtcgtcggtttcacagagcaaggaaaaaaaatctgttaccatgtgagtgtctagttacctgaaccataaaatggacagtccatatatagcttcatgagcgatgtcccagaaggtggcaatgtcacaacatcatctctgtacaatagatataatcatcacatatcagtgattgcagctgttgccccccaaatccataattaattttgaacataaacggggcctgatagagtgataggtaggctaagtgggcaaagaaaaagagaaattagccatcatatcaacttatgataaattggcagcaagcaacagaaagtcacgcagaatgtccaatttaatttatttgaaaaggcaaagtattccttctgtttggctcccattaattgtatttgagtcattttgtgcatgtggaacccatgtccatgtgactggacataatattgagattaactttcaagcttcagctaaatttacaaatcactggaatatttgttaagtgaaaaatccactcatcatggatatgatcacacgctgctttatacatacaacacctagtttcttgtaaaaactgtggtggagttcattgagcatttataatatatgaaaaatgaatagaaaagcaaaacacttacaaaatatcttgttcctgcaatttctgaactttcttgctgaatccatgatttttttcatcaacaataaacctacagacacaaacatatcaagagaaaatgataaatctaagaatataagtagctcacttaatggtagctttctttcttttaaataaaattttcttgcagtggtgtaacaaaagattgttagcatgtaatcctgatatcaattttgacagaaagagataaccaaacctacaaagtaatcggtgctctgtcatatgcatttttctttcaaaaatagattactattgtcctgaagaagaacaaaagtacagcacacattcttttaatcagttcattgtctagtttttgattcatgcacgataatatcagatattcatgctaatcctcccaaaacacaaacaaaattgtatttatgccatacaacttccttatcaagtcattgattgttatttgcagatttaaaataaattaacaaatgaatgtgtgattcttgtcctacgaattattggattggaagcatgcatgaagaaaccatagttcaattatataaccaagttaaacattgtaggcagctacaagatatttcagacagtaatgcttctcaatctgagagcttcgagtacaccttatgagagtatcaactataaagcatgatgtttacagaactaacctcgatgactggcctccacaccatgcggcatgctacattgattcaacatcaatataatcgtgttcaccctggtcctaccacttgttggcaccatctattgagagcttaatcacaggacttcaacttgacctatatatgcaccaataatgtagtcgaggaataaacctcatcgatgtacatgcatcaagatatggcatgggattagttaaccatcattcaataagcatgaagaaaattctcccctgtgcaacaatatagatcatcagatgacaattcagtaaatccaagtccttcattttttttaactaaaatctaggtcattcatttttcaataaaaataagatgcacttaatccctcaaaataaaaacaaagagtgcttatatcagtgtaaaagagtgtaaaagaaagtacagtggaatctgtcaataacatgatctggcagatatcaatgttagttttatgtaatttagaatgtagaagaaaatacaatgacttcaactacactaaatattcaaggtaaaagttagtaattagtgcatgaagaaagctaaaagacgaatcactgtatgcgtgtttaccaccatgatgatttaagcaccataacgattccctataaaccaaattcaaattctaattagcgattgaattgaaaaaaataggatgatttatttacaggagattaatgtttaacactggtggagaagtgctttttagtcccggttcgtaacccccttatagtcccagttttcaacccgggactaccaatccgggactaaagatcgctatctttagtcccgggtaaaaaaccgggactaaaaatcgatctttagtcccggttggtaacaccaaccgggagtaaagatagggatctttactcccggttggtgttaccaaccgggattaaagagagggtagcggcagtctagctggtccttttttttctttttttcttttctgctttttttttattttctcccgaatcgagtggtatgcatatcgtcaaattgaaccccaaatccacatcacaactccacatcacaattcacagattcatcacaaattcattcacatattcgttcacaacatcacaaatatattcacaatattgattcacaggttcattgaca

SEQ ID NO: 74299 - DNA, 5792 bp, Oryza sativa
tggtaacaccaaccgggactaaggatccgggggggcctgacaaggcctgataggtttagaaccgggactaaagattatttttagtcccggttgataacggcaaccgggactaaagatcaaatatgcccgctgtagccatcaaccgggactaaagatgatctttagtcccggtttttagtggaaccgagactattgtggatttcggccgaccgaccaaagatggtttctccaccagtgtaaaaaaacaagattatccctataaaccaaatctaaattctaattagcaatttaattaaaaagaaataggaatgatttatttattggagattaatgtttaaaaaagaagattataagatctgcaatatttgatagccatcctaagctcttaccatcccatcccgagccactgattcaaatgggattgatagggtgaacttgcatgaaaaatataatgctcctcccgagccgctgattcaaatggtattgataaggtgaacttacatgaaaaatataatattcatctgttcccactattttctaattatctactgctttttaattatttaataaaaaagataaccattaggagtaacatttacaatgagtataaaaaagatctgaaattccactcaatgtatttggtcagtacttacacattagaggactattcaaaatagaaaaaaaatactatttatgattagatattccaaacaagattgaatacaaaatacagaaatttatcacatgggaatttaatggagcagaggaggaaattgtggtggaggtgataagatgagagatgatgatttcacctgtaggattgctaggcacaactcttccttttttatattagtatagactaaccgtgagtaaactccgggatctaatctgtggccgaaatatcggtgctgactagatgatagagtacccagccgctaacgtatgtatgccagccactgatttatcctatgaggatgaacatgagtcgcatactcgcatcgcatgcatctcatgcacatatgtaaaataggttaatagcaaggagcttatagtcatccgttcacccagaaaccacgggagatgtatggaccacatctcgagatatcacaaacacgcatccatataacaacccagtcccataaaaaaccaaacaatgtaacacattctattactataggatatatctttatccaaattcgttatagtaatatgaatttggacatatctctgtacatattcgttgtattaatatatgtgacgtccaattttagattcgttttttaacaaagctaagggagtacagacgaacaattaaaacacacattaattgattattgacgtgttctcacaaacacaaatgttctaaaaaaaatgataattgacctattcactccgaacatcgagttggactcgcgagcatcaaggtgcagggaccagagcaacactgcaagtctgcaacaaccatctccctaaaaatatctactttgacttttaccggcaaacaattaggatcgatggtgtaatatccggctccgtacttccgtcggacggcgaatgaaccgaagaaaaaaactaccatgaacggaagaaaaactaccactagcatgcatatgcatatgcatgcagacggtacggtgtcccgcatgacaggcacgccgcgcgctccgctctcccatgcatgcggaccggaccgaccgagatcaggcgctagctgatgattttgtcaacgggacgggagagcctggaagcgcgcgcggccccgatctggcgaatcatgcatggtagtaagatcgatccgcgcgcggtgcgcatctctgaccttggtgtggacgacgtgtgcagcgtgcggtacagacctgagagtacagtggagaaggaccgggggcgacagggacgcgtgtacgtggacacgacggcgtcgtcgaatgcatcgcacggttgctcttcttactggacagaccgtcgtcggcacagtcgtgcagtctgcggaaactcagctgggctgtacacgctgggctggctgtactgtactcaatgctggccgagttagaacgattaaattgaggacgactctaaattgacacagtacaatataagactggaatctatagatcaggagatgagcacagattaattacggcaggcacggtagtatagtagtactgtagaacttaggagtacagtagtgagatgtgttgccggtggaataagtccactttgactcccttaaaagtcacccgaatctaatatgtaacccttaacttcaaaaccggatagaacaacttcccgaactattgaaaccagtgcaatttaactcactcagcagttttgctgatgtggcactgacgtgacgatgttgacctattcttcgtctcacatgacgcttatgtggcattcgaattaaaaatatatatgtgggacccatctgtcatttacacacaaaaaatataatatgggacccactaacatgtgagcccatacgtcatcctctctctctttctcttcccttcaccggtctgcaggggcggcagtgggcaaccgacggtagggtgtggcagtcgaggaagtagtcggtggcgggccagtgtgacaatggtcgttggtcagctgtggccgaggaggccttcgccctcttgacgtctctctgttgtcgccggttgccaggttctccatggtgctgcaccgtgaggtggagcacgtgcgtgaatggcacaatgccgaagaacttagcgaggaagcggccgtcgttgatgctgacgacgccgaagagcttggcgaggaggcagtagtcgttgatgccgacgccgtcgtcgcgcttgtggagcgcaagggagcagtgggtgtcgacgaactcggcggcgccggtcaccagcaccaatgtccccgagtcggccgacgacctgagaggcctccttggcacggtggacgcatggatctggccacactacaagaaacttgttaatccgtgatggattctccgtgacggatttacggatcgtcgctgacagacatactccgtgacgatattttgtttttcgtcacagatgagcccagtggatattcacagcccacgaactcgtgacggttttatcaggaccgtcacaatgtatgattttaaattcgtcatactctagttagcctagaaaaataaaaaacaatgtatgattttaaattcgtcatactctagttagcctagaaaaataaaaaaattgtagcgcaaagaaaaacaaaaaatatgattgcaagaagaatcaaaatatttgttaaatttgaacataatatttttgttgatttgttacgtgtatataatggtttgttaaatttgaacaaaataatgttattaatttgttacatgtgtatgatgcataatatggcaaactaaaaaaatattgtgcgcatgcggaaaaaatcaaaatatttttgttaatttgttacatgtatatgatgatttgttaaatttgaacaaaataattttgttaatttgttacatgtatatgatgcataatatggcaaactaaaaaaatatggtgcgcatgggggaaaaatccacagcatgtgggatttgaacccacattgagcaggaaggtaggaaatatgttaccaattgaaccacttgttgtagatgtccacttctgcacttatatatttttatttatttattattggcccagcatccctgttggcgtggcccattaatgccattcactcgagttgagttggtccaggatgttgcccacagcgtggcccagcagctggagttggcatttcgaaaatggggcccagcagccggagttggcatttcgaaaagaaaaaaagaactcgaatttgtaaaatagaagaaaaaaatgcaaccaacgagaatcaaacccatgacctactagtagaaggcgccccatcctaccactgcgctagttggtttgatgtgttattgtaggattctgtactctttttgacctgtgtatgtatggaggagtaaggtttcctcaaccccgactcagttattcagttcgacacccagccgcaaccaatctaagacaccgccgccgccgacggcgaaatttggcaggagcggcgttgccgctgcccaccactgccgcgtcgttcagcaacgccgcctccttgcctaccgtgccatcgcgcatcaccgctgcacaccagccgaacagcgacatcaggcaccaccgccgccctacaacgccatcctgtagatctgcagcaccgccgccctccattgccgcaccaacgagcgatgccgagtgcggccatgcgtccacctggtgacaaattcaactgttgaccggactcctgaagcctcttctcccatctgcctcaacagccagccaaggtaatatcttcttcttcttcttcttcttcttcttcttcttcttcgatttagttggatgtagcatttgaattggtgcagcttgctcattgtggtttatctacaatgtttgattagatggatagaagttgggtgcacagtagactattttcccctgaatacattgacggcgtcaaagaatttatgagtttcattcaggggaaattcaatgagaatgttgaaattctatgcccatgtagcagatgccttaatcagaagtaccaaagacaggctgttgtgaagaagcacatactgatgaatggtatggaaactacttatactcggtggattcatcatggagagagcttagatgtcaatgttattgagcatcctattgatatgaatgaaaataatgatggttccacaactatggtgacagaggatgacaactatggtaatcgtttggaaggaattttaggagacctacagactgcagcggcacaagcaagaccggatgtagaaaatcaagttggtgctgaagaacctcgtgataaagagtcatttttgaatattgtcatgagagaggcaaagcgtcaactttatcctggttgtaccaaattttcaaggttctcatttgtggtaaggcttcttcatatgaagtcattatataggatcagcaattctgctttttctgcacacatgaagctattggctgatgctttcccagaatgcaatacactcccaaaatcatatgatgaagcaaaagtcattctaaaggaaatgggtcttggttatgaatcaatacatgtgtgctacaataattgtgtgctgttcagaaaggaatatgagaagcatgacaattgctcggtttgtggtctctcgagatggaaagatgcagaaagaaagaagattccacaaaaagtgttgcggcattttccattggcacctaggctaaagaggatgttttcgaccaaagaagcatcagaagcggcacagtggcacaagttaaagcgacagcccgttgagaataatatgagccacccagctgatggcgaggcatggcaagattttgaccgtgaatatcctagttttgcaaaggatgcaagaaaccttagacttggcctagctactgatgggttcaatccttttcagaaaagaacacaaaatatagcatgtggcctgtgtttgttgtgccctacaacctagcactgtgggagtgcatggaggaatcaaactttatgatggctttgcttattccaggtccgaaatcacctgggaaggactttgatgtatttttacagcctcttgtagaggatttacttgagctttgggcaggtgttgatacttatgatgctattactggcaaatcatttaaacttcgtgcagcggttttgtggtgcatccatgattacccagctttgagcactctctcagggcgtacaacaaggggctattttgcttgtctccattg

SEQ ID NO: 74300 - DNA, 62866 bp, Oryza sativa
acggagggaatagcaattaggcttaaaagattcttctcgcaatttacacgcaatttgtgtaaattagttattttttcgtttatatttaatactccatgtatgtgtccaaacattcgatgtgatagggtgaaaaattttgctaggggatctaaacagggccttggtaaaagggatacaagttacaaccgattcgatatgactattttgcttggtgtcctactggaaatgagcttcggttttaacttttaagttgctccaaaccccacgcagccaaaaaaaaaaaaaggttaaagtcatggcgcgcttcatttaaaaaaaataatgataagctaattatagaagtggcatgacaaggagaaaaaaaaatactgctcttatgcagttatgcttgtatccatgttatgtgattattctgttcctttactgtagctaaaatggaaaagagaaagaggatagcctcaaaagaagacctgcatggacaaatgatgaagaggaagaaatggagacttcagttgagcaacctacccgaggtatgaaatatcgatctcgaatttagcatcttggtcctcctcacaagatgatgttgtatttgttcgctgttcggcctaatctttcagtcgacccggcaaaaagatatttagtatcttggtcctcacaagatgatgttgtatttgttcggcctaatctttcagccgacccggcaaaaagatgatgcaaaatgcctttagtagaagaacctctccgtatctctattcgctaatctgtatatttaatctatttgtatttactgcaggatattctctgcactatcgtgtcaaaattaccgttaagagaagctgctagaacgagcatattatctagccaatggaaccgcacttggtgcagccacacaaacctaaaccttagttatcgatcaataatgtcaaggcgctacatcgaaagagacataagacctgaaggcaggaagctaaatgctgaagagtttatcaggagggtggacgcaatcttgcagcagcacaacggtggaggcgttgagaaaatcgaagttataggacttttagaaaatgaaaatgcgtatcacatcaatggatgggtgaacttcgccatcaaatcgaagacaaagcaacttgttcttgatttcagatctttccactggcccatagatgagccatataactttgcatttcagatttttgatgctgctaacatggaaaatttgcagtctttgaaacttggttccatttctctgaagccacctgcagattttaagggttttcagaaccttaaaaggcttaagctactagatgtgggcattactgatgaagatctacaacttttgttgtccaattgcaactgtttggagtttcttggaatatattgctgtaaattgattacaagcttacggactactcatctttcaacccagcttaagcatttgtatgtctatgaatgcccatgtctcaaagagatagagttaaactctggcctgacaacactcgagtacattggtccattgatacctttagcacctcctggaatttatgtgcttacaaatttacgcataaagtcattggacatttctgattctcttcagtatattttcaccgaacttcccagcactcttccacgtctcgagatgctgactttgcaatgtcgtgaacttgaggttgcagacacatcacttctttatattcccaatttacttgtagacttccatcttacaggttaactcaagttacactatttttgttcattgttatttgtgtgcatgtttcagaggattactttgccagacaaaccaatcaaatttatttatctaaaacatctgagattggaattggcattttctggcccaaggaaatgggatgctgacattctagattttgcctgcatcttggaggctgctcccttgatggaaaagcttgaatttcatgtaagtttcaagtcttaaattatgtattttgccgacaaattgtcagtgaacttataaatgcttttcattagttgtcattaaggatgctgaaatgaacagctccattgaattatgaattacctttacatatactgattattgagcaattggcaatgcatctaatttgatcctgatattggcctgaccatcatataatcatatatcatgctcgtgtgtttaatttataacatgctgctcttacaaggtctattttttttggtctgtatttatagatgtggatgaattgtcgtgatcacctccggtatcgcaaagctcatggtaaactaagaactcttcctccatgcccccactaccatctcaaggaggtcaatatcgcaggattttacggtcagaaagaccagctggagttggcacatcatattctcaggaactctgtcgtgctccaagccatgaacatagatccgaggcctatagcagcctgtgatccttcgagaatggcaattcttgaggcgttcaactttgtggatggatctaaagttgccatgaaatatctctgcaaggcagaccaccgtaacgtcgttcatgtttcagatgtgtcacgtaaggatgtcgaaaatgtaccagcttaccggctggtatctccattttggattgagtttgataagaccaaacgttccggcttgttaattaggtgatcttgacatctgggattaaagctccattgaggcgaaatggttcgttttgagtttgtttcactttgacgttgaaatggaccttgaaggaagcttgcggtggaagaatacacataatttccagtttattgagattttttcatgtgtaaattaattgtgtagaaaaaattgcggtttatcattggaggagtaactatctttgttgtccagaatgttatgttatttcaaatctccgtgcaactgcatatctttttaaaaaacaaatccaaactaagagcatacccatatacccaatatagctcccaatgcaaatattttgagcctccaagtaaaaattaggctccaacaatttctctaaacaggtgcctaaaattggatcccccaactccgggtaaatcacttcacaaggtagcgctcccaatctgccgtcccaaatattgtttgattcaatttggaagttgttgattgatgaacaattgtattttcctgaaatattgaactcccagatatcagaattgagcagaataacaatggctatctgtgacatgtttgcaccctccttccagtaaacatgaagaattgaaaagtttgttttctctttcgagttgtttattctctacaagttcttgaagttaatgccagttgtgcagcttgaacagttgaacatgtatgtagatattggctcttctgtacacttcaattttctgtagatattgtctggggttttatcatatcgttcaaatttgcagtgaaaaattttctgtagatattgtctgggggttttatcatatcgttcaaatttgcagtgaaagtaggaacaaatgcattgtgacttagataaaataagagacaattacattggtactagataaactgaaggactattgcctttggatttgatatagtggagggtattctagtcctttagtttgtttattggtatatatgggacggaaaagctaattctcacgcgcgccgccgcggcgcgtgttttaggcccacggccgcatacgcatttctggaccaccagctataggcgattcctattccgtccgatgagccaacaagctgccacgtgcatgcgtttacaacgggatttgaaaagatcatgatttttttggggggaatgccattcggctagctttattgataggatagatcatgattagtttaattaagtagtagttactaaattaagataacctttccttttttattggcgggagatttttcttttttctttaataaaaaaattgaaaatctatacaaaattttcttaactttcaaattaaatataaaacttcctaaaaaaaattaaaattcattaaaaatgtaaaactttcaactcgaaatttgaaaaaaattcaagtcaaatttgaaaactttcaacttaaaatttgaaattttcaatttgaatattggaaacttccaagtcataattcgaaaactttcaaccaaaattcaaaaaccttcaacttaaaattcaaaaactttcaacccaaaaattaaaacttttaatttgaatttttgaaatttcaagttgaaatttcaaaaatttcaatctgaatcttaaaacaaatgtacctaaatttttgaaaattttcaactcaattgtttatttattatttcattataaaggactacttaattctaattgttactccttgttagcgctaacattagctctacggcactaggctgtgcggttgccagcctgccacgcgtgtatgagccgaaaagttacggagtcgaactaggctaggaatacaacaaaagaaaaaagtgcgctcgacctacccttcttgcgcgtctgcgcgaggtaggcatcccctatatgggatggatgaaaaaattgagttattttgtgaaggcggtggtataagcaaagaaagaaggttgagagctaatgttgttttcacctctgtactgtttgaaaattttaaatttgtatttgaattgttgtgtttgaaattgtgaatttggattcaattgaaatgtatgtattagaaatattcatatttgaaatgttatgtggtgttaaactagccatagacatacaatgcatgttaaaatataagagaaaaacgaatagggctaagagatactccctccgtcccaaaaaaacccaatgtgttcaggttcaaattcagaattgggttttttttttttgatggagggagtagtggttattgctgaagtcagagatacctttaagagaaaaagaaaagaaaagatatatgtgtgttttgtgtgtttgacaaaaaatgaaaaaaaagaaaagaaaagatatgtgtgtgtttgacaaaaaatgaaaaaaaattacaaaaatgcgtttgccgggagtcgaacccgggtctattgcttggaaggcaattatcctaaccgttggactacaaacgccttttattcaaaagtcatactactaatttctagtgcttgttttgaaggagggcacgtggtccaacgatgccgtgccaccctccaccacaagacgacgtccacggccacgcagatggatcacgtgcccacccacccacgcgcgcccccatacatacctctcatcatcactcgcgaactctcgcctcgctctcgcccccacttcctccgccgccatggccaccgccgccgccgcgctcctccgcctctcccgctcccgccgcccgctcctccccctctcctccctccgcctcccgccttccgacccgtaccaccaccactcccactcccaaaccccaccctcctcctcctcctcccacgcccgcctccccgccttcctctccttcctcgccgccgccgccgccgccggaggaacgaccgtcgccctctgcgactccggcatcgaccaccggtgctcgcccgcccgcccgcccgcccccacaccgatcgctcagtcgatcccgcggttgcgtattgacgcgttgcttttgttctgcagggtcgggggcaaggagagcaccgagctggtggtgcgcggggagcggaagcgcgtgcccaacgagttcatcgacgagctcgcttccttcctcggggtgatgagctcgtggccttttcagtgaggatgctttcgccgttgaggtgagctgagctgagctgactgctaagtgtccgtcctcgcaggagaacctgacggtggactacgaggagaggcactaccatggcacgccgcagaacagcttccacaaggcagtcaatgtgcccgatgtcgtcgtcttcccgaggtataacctgatctaacagtagtactgattactgaatagtgatagatactgattgataccaaagttcgtcttgtggggttatgtgttgaccttgtccttctctcagagattgtaatgccggcccaaatcaaattttgcaggtcccaggatgaggtacagaagattgtgatggcttgtaacaagtacaaggtatgtctcattaatgcaaacacggtgcgaatcttttgcatttttctttagaaagagccgcatcagttatccgtctgctagactttactacatttgattgtgtgaattgtgaaaatccactttctatcacactatgctgagctagatttttatatttcagatttcagactaattttattggttgttttagtttacatgaccttggtactgctgctaatcacgtgtgatgtaacgaatctttctggcttctcgtttttctcgtctgactcttgtactttgttacacgtgccatttaaaatctgtttagaaaattggaaatcaattttcaccttgagaatgccatattctcagtaaaggaattctttaccttcatttgctgtctccagcaatagtctataaaaggagcagacagtgtggatgtctcccaatgttttcatgatggctaattacttgtatgagggttccactatagaactgaatgatgatgcctttttcttcgagacaggtgccaattgtaccatatggtggggctacatcaattgagggtcacacgttggcacctcatggtggtgtttgcattaacatgtctttgatgaaggtaaacattgataaatgtaactagagaccatatagttgtaggcactaataatttcgtggaaattaaatctttctgaattaattacccttgtttctaatccttaaaaggtgcttcagtatatgttccatcaatttctttttaccatggtttgattgtttgatactacttccatatgccaaacagacaaaactgttactagcagtgagctcttgatgcaggatagatgagacgatacaaagctgtttctctgttaatttcactttcttctaatttgtagtttgctttaaatcgttcacagaaaatcaaatccctgcatgttgaggatatggatgtagttgttgaaccaggagttggatggattgagctgaatgagtacctgaaaccatatggcctctttttccctcttgacccaggcaagtccattgtttattgtttacgtgaaacataatctgtccactaactttgacataaaacagtatgaatttgtactggatgtcatttggttgctgctaactaaatttagtttctgataattttgtttaactttcttgcatcgtctagacatttgggtgatatgtacatctttgtgcctgtgataacatgacatgcagcatattcgtccaacttcacccatccttttgggcatttggtaacatgatatgaagcataattttgtgctagatcggtggtttagctcaagtattcttatctgatttgcagggcctggggccactattggaggaatgtgtgctactcgctgttctggttcactagctgtgaggtaattctccttatatttctcagggtactttcgagcttttatagtgaaacggtccaccccatcgaaaaataatgtacaactgtaatccacgtgatggtgcattcttttatggttatctttatgatttactgttaaatggctttgatgatttgcttattagtttgtaggtacggaacaatgcgggacaatgtgattaacctccaggttcttttggctatccttgagtgagctattttcaattgactttcacatacaaatagtaaaattttctcagtactgcaggctgttctacctaatggtgatgttgtcaagacgggttctcgagcccgaaagagtgcagctgggtatgcaagatcccctcccgaataagtttctttttatgtatcttgggagtgaatcattatttcactggttcctatgcccattaatgtgttaaatacatgtgggatttacatgtattcttggcatcaatgatgggttttttgttctcttctgttgaatgtcagatacgatcttgctcgtttgatcattggaagtgaaggaactttaggggtaattacagaagtgactgtacgtcttcaaaagcttccatctcattccgtggtaggtcttctatttcatctagacactgtccaaacaatgttttgcttacagtgtgtactggacttgaatgccgtcaactctctgcatattggtgtgtgcagttgttgtgttagcatatacactattatggctttatgtagtacaccaattactttcatttgctcatagatctttctttttggagaaatcctttataatcatgctatggcacatagctattatcttgcatattgggaaatggggaacatttgtgagtctgaacaaataaaagcttctcttctaagcacctgctgtgtgctctgaactggaaaaataacatggtctgaagcctatcggtgtgatctactccctaaatttctaaacctaatactgttgaaagatctacgcacacacacacacactggatttctatgttcattttgctgtacgaactattttgtactacctgtctattttgttccttattttactggtgaagacactcctaggtgctctgctatttcaggttgcaatgtgcaattttcaaacaattaaggatgctgctgatgttgctattgcaacaatgctttctggtatacaggtttgtctttttttcttctgattttagttagttacaggtttgtcttttttctgctgatgaagctcatatatgaaattgtcacacctccactttgtaatccatcatttcgatcaatgaaatggctataaggtagctctaccttcttacatcaaaaaatatatgagattgttacacctctgtttcagattgagcaaatccgcttgtctccataggcaagtgttaggttaactaactagggaaatttggttctatgaactataaatattgaaatgctttcatagaacttctgcaggtgtttcagtaagcaatttaaaaaggttgtaggttatgactacttgtatgttttctgcttgaccaggtctcaagagtggaattgttggatgaggttcagataagggcaattaacatggcaaatggtaaaaacttacctgaagtaccaaccttgatgttcgaattcatagggacaggtaacctaatttttatttgaatagttaacacttcacactgaactttgacaaaaaagtctactttatactgtattgtgcatctatgtttggcagtactgagtcctctagagttaagtgttcaaataataaataaaagatggaacaggaaccaataggcatagaatatcttagttttctctagatatgttgacactataattgacaaatgcaactccacagttttatacttttaccgtcaattagtgtttatgaatttggttgatgatcaacggtagtgagtaaagaactctcgaataaaactaaatttactgtgcacactgtttctgtcaagataactttttgaatagtacgtattaaatagcagtcggtatgtagtcaagtttggtttcaaagagtgacatacaagtctgggcttgtgatcttcctgtcttagggacaaaaccagcacatttcgagtaatataatacctgggttttgttatccacttttgagcagttccactcgaaactcaaagttccttctcattaaaaaacttcttaagatgcaactatttttttcagcttgaataccacaatctatttttttatttgctaatatatttccatcgtgaatacccagaagcctatgctcttgaacaaacactattggttcaaaagattgccacagaacaccatggatctgattttgtttttgtagaagagctggatgctaaagaggagttatggaaggtcagccaattttttcatctgaacttgtgtagatttcctagtactcatctgaatattgtagacttcctagtaaataaagtagtctttattctgcataatcttacacatgcctgaatatggtatcaaactatcaatttgcatccacctatatctgggtaacagtggcagtggcagtactgaagtatgtgtttctccttttgctgaaacatatttatgatagcattttattcttatatgtgcagattaggaaggaagcactttgggccggttttgccatgaaacctgatcatgaggctatgataacggtctgtttacttataacttgtcaacatatatttttttgaacaaaaaaatatattgatcaagcatagtcggtgtactttgatgttacacatcatgctacctgatgtttgattatgtagttgtgaatctcagcatcttccttcgtagttatcatcctcttcataaatgtgagaacaattatgatctcaaaataagtgctgcattcaggaggacaattggcaaccaaacatgcttacggctatgtaaatatgattggtcttgtatctcaactctttctttgaatcaagataggacttctccattagcaagctggtctatttaaatcttgtgagcaccatatttataggataaatccataatatgctactcactgtgaggatgacatgtggctcccgtatcatgtgcgtctatagattggacaactcaatggcataaaatggatcccccctcccccttctgatttttttttatctcatatgcttatatagatcgtccaaaggtcgtcacaatcatcatacccttacaagctttcaattttcagtggactgactctatcaagtcatctaatgccacatatatgtttatttatgcaggatgtttgtgttcctttgtctagacttgcagaatgcatatctgtctcaaaggaaaagcttgatgcatcaccattgacttggtacacgttctctcttattatgcaaagccactgtgtaaaattatgttctcatttatatctaatacaaggcatagtcatgtgctccattatctaatatttgaagtatgcataaagtagcatcaagcatgttattatctcgcaatggctccaataagacatcatgccatctttttttaatcatgaattccttacctctgatttttgtacgttcctagtttggttatcgctcatgctggtgatggaaacttccacacaataatcctatttgaccctagtcaagaagaccaacgacgtgaagcggagaggctaaaccatttcatggttcatactgctctctctatggaaggtacaatgaaaaactgaccaagccagcatgtaaaagctgcctgaaaagattaatattgactctgatgatgaacaggtacctgtacaggagagcatggtgtaggtacagggaaaatgaaggcaagtgtctatcacctgttttcttttattatgttctgcacttctgctagcagatacaagagccatctttgctgatacgattctcaaagtgatggcacaaccgccaagtgccaatcactaaccattctcttaagataggaaaattgcaagaggctataccagtacattcatgatggttgaacagattaaaagttcatgagtatctggcccagaacgtaccttcaaaacttcaatttcccttgctgcctattgtaaatttgttaccctacgggttatcaagatgtactttatttttgaatttcctgataggacctcctattgtcttgctcatggctgtcatcacccccattactgacttttattttttctatgcattttggcagtacctagagaaagagctgggcatcgagtcgctaaggacgatgaaaagaataaaggctgcgttggatcccaacaatatcatgaatccagggaaactgattccacctcaagtctgcatttgatgatacagacgttcccaagttgctggctgactcactggctggttcagtgacttccactcaactcccagtccagcaaggcaagtcgtggcgttaccactgaatgcgcattgaacggcgaagactcaggactgttatacacgagttgaatgcaaaaataaacgtgaacgctagaactgttactctgagccattcatataccgggaataaatgagcaaaacttcgttccagttgctatatgaaatatgagtgattctatgataggcttggtgatagaaaattctaagctatttcaaatatttggagctaaacaacgtagtagtagatgtttggtgaattgaagatttgccacgttagagctgataatatgatttgtcactcatgtgtctatgatatactagaccagtgagtgttgcgtgagttacttggagtagggtaaaaaatgttatggatttttctgtccggctatcgttttccttttatacccaccttttgttttgttttcgaattgtctggaaatggaatcgaatggtaggggatctttattgactgctttagcagcataccgttttcatttgaaagttttgtagaaatcacctgttgatgctataatattatttgaaccattcagttagagatatttagaactcattaatatcatatgcatgtcatatagagaccattccatatatcagctgagacgcaaaaaaaaaaactgtaaacattggtaattaactaaattgtttttcttatattatccttcctctctttcccctacccgtagtaaaatcactctcctttcatgtttctgtcttctcgctctcctccccacaccagtaaatttgtttagctgtcagttttacgggccacttattacatatttctctctcctcacttccttctttccacatcagtaaatttgtctagctctggtaattttatgggtcagccccaacccccaaatgacaagcggtaaatcatgaattacacacaggcacacagccatgcagtgcagaacgccgatttggtaagcatcacatgtgccagtctgccagacatagtggtgaaaaatcatgaaggaggtcaaaaccaataccctagcagaagggaaacgactcccagaattcatctttagctttggtttttcttatacagtttttttcatacttatacacaccttttacttctactatgtttaatgaaattggtacactctaagcgtcggtaattcgttagaaaaaaaacagatgttggcgtcgaaaatcgccaacacgcggttcgtcaagaacaaattttgataacaagataaccattacgctttcgcggcaatgagcgaccgattttcaagctaatcggcaaagaaaattgaattgatctacttctaagaagaaaaagcaaaaaagaagaacgtaaaaaagaactataatgaatttattgattgggttggagaggggaatctctccaatcggccttaaccatatgtagggcgcctggtctttggcatgttccacgtttactgggagtaaattaagcgtcattattttaaccgattgaaggtaggaaacacaattatctaatgacggtaggcaatccagcggatttctgttggaagcttttcttgcctgctgcattctgaatatagtgtgcaccgagatcttctgtgcctacttcgcatcatacctcgcccttttaaccttcactgctaccagataatccctaatatatatcttcaatattggttagcttcggctaaattgcttcatctaatttaattaatgacaaatataattagctctctatccaggtcaatactaactaattttctcctaccgctatttgcttgattaacagccgaatcataccatataaacttttattatcatatatgccaaatttgactatcaacaacaggtgccagacagaccgaccgtacatgcaacgaaagaactcctggaacggtttttgtacccttgtgccggccgagacggcaccacgcctttctcgtctcgtctcgtctcgtctcatctcataccgcaaccacctccaccactccacgcgcctatatcaccacacgtcacgcttccacctccacctccacctcactgtcgatctcctcccgcttcgatccatccatccatcgccatggcggcggagcgcgtggtggtcgacgagtgccgcggtgtgctgttcgtgtacagcgacggcgccgtggagcgcagggccgcgcccgggttcgcgacgccggtgcgggacgacgggagcgtggagtggaaggacgcggtgttcgacgcggcgcgcgggctcggcgtccgcctgtaccggccgcgggagcgcggcggcgggcggctgccggtgttcttctactaccacggcggcgggttctgcatcgggtcgcgcacctggcccaactgccagaactactgcctccggttggcggccgagctgggcgccgtcgtcgtcgcgcccgactaccgcctcgctcccgagcaccgcctccccgcggcgttcgaggacgccgagaacgcgctcctctggctcgcctcgcaggcgcgccccggcggcgacacgtgggtcgccgaggcggccgacttcgggcgggtgttcgtctccggcgactcggccggcggcaccatcgcgcaccacctcgccgtgcggttcggctccgcctccgggcgcgccgagctggcgcccgcgcgcgtcgccggctacgtccagctcatgccgttcttcggcggcgtggagcggacgccgtcggaggcggcgtgccccgacgacgcgttcctcaaccgcgacctcaacgaccgctactggcggctctccctgccggcgggcggcgccacggcggaccacccgttctccaacccgttcgggccggcgagccccgacctcgccgcggcggagttcgcgccgacgctggtggtggtcggcgggcgcgacctcctccgcgaccgcgcgctggactacgcggcgaggctggcggcgatggggaagcccgtggaggcgctggagttcgaggggcagcagcatggcttcttcaccatcgacccctggtccgccgcctccggcgacctcatgcacgccgtcaagctcttcgttgacaccgacggcggcggcggcgcccgcctcgacggctgatcagccgccgcgtgctcctctctcgtgtgtgccttgtcggcaataataaatcgattcggatttcaaaatgctagaaaattcatttatcaaatgttcaaagttcagaagggggtatatgatccattgccagccatttgcgtatattgcagcttgatttgcgagaggctcctctaactgatgggtgtccctgacatgagtctacgagagtgactcctatctgttaaagattcatgtccctctaaaaattagagaacttattctgctttatttggtaacgctatctattaaggatctatgtccctctgaaagttagcgaaactttctttaatcgaatcagtataagatggtgctatttcattaaatatagcgagagaaaagtacgaccccaatagggaaatagaaaaaaaaatgctatacataactatacgtgtgaagaaagaaactctctaagtttttttttctttagccagaacccaagttcttgcttattcctttattttggccaacggtttagggtctacagtctccttatgttctgagacacgctgatttctctccttttagatctcacaaacaaccagaagaagaattagggtacacaagtctttcttagagacatcttttttattggatatcatttcacaccaagtatggacgtcttggcacggctctaattgaggcagatctatcggtggataaatactgtagcaaatactgtagcgatttactattctgattttactgtgccgaatcttttttggccgttagattcagacatagatggttcagattgtgtacagcagttaatgtgcagtcctagtagcaactgcatttgatctcgttcgctgacggtcttatcgtaggcaaatttactcgcctcggtagtcctccaacgcctgtcacctgcggcacggccccgcgtggatcaaaccgagcacctccagtgtaacacgagccacgccgccacgcatccatctgcacaaattccagcaccggcttgatcaccctcctgtgcacaactccatttgcatttgtgtaccctgcaaaacaaccgcctcgcaaactaatgcagccagctgccagtaaaatcaccatgcaaacattgatctcagtcgccaaatctcactctcctatgctactgctgcatgcatgtgaccagcccaagccaactaaacggctgccgctccccagcatcttacacagatcagccgagcaatgcatgataagttcctgcacatatatacttcgaacttcgaagtactctcaagcagaccacatgataattccagcaacctattctaaataatttggcctgcccaaatatactaactaaatgccaaattatgatgcaaacacatatgtgtcagatagagaaggaatgagatataagtcccactattatttttaaaagtttttttactgacttagcatagaccattgtctaaaccattaatggagctgagctaatttgcaccgattttttaagttgagagaagcattatacctggttttgggttgagatatgccatttgatcatagacaaaacaggagataggtagaatagacttattccttcccctcaagtatacaacccatatatgtcagttcggccagctttctgtagcccaattaaatttgcacacataaagcaagaaaataatcattttctttacatagctagattcaatcttcattgtcagtccgagcgagcgaacggcgactgaatcgtgccgaactaaaccgatacgacaacagaaacaaatcggacgacgtacaaaattttcaagcaaaaacactttaaacttttaatagtagagaagagaagagatagagatgtgtgtgtgtttgccatgtaatggaaaaaatgttagtagtgttaagtccgaaacggtaaagaacatcagagtgggctacgatgggctgatatgttggcccggcacgttggcccacacttatcggcctgatcatgagcatcgaaccaaggccaaggctcaatggttggttccgtatccacctcaaattgtgatttcagatttggttagtcctctgataaaactaatctttgctttctgaagaaagagagtagtaagaaagtcccttgtataggacaaaatttgctatagtacacttgaacggaaatggtttttgggccagcgtcatgaatcccaaccagacccgagctacattctatgccgatgacaatcccccctctccaaaaccctagcgataccaactaagccacccccctcctaatccaatctacaaaaccatagaaattggagatagtggcaatggcatccacgacggcggcgacgagctatgggtattgatctgctctctcctaacatgctcaccctctctctcaaaaaccttagcaagtagcgggttcagacatactttgcttcacacctctcatcgctgcttctgtcgctgcttgccgtgggcatctccaatttctagggttctaaataggggatctagggagggaaagtggcttgggtctggtccaagttaaacccagttaggttagaagttgttggtccgagggataaacttgtcctttctaattgtttctctttatatggcgcataaataataaaataatgacgatgatgtacttcatcaaattaccgggtttttaggtgtccattttaagtgttatgcagtaaattttcttgtaatagtagtctatttctaatatgtaatcgtcccttttttttctgcgaggaatatgtaatcgtccctgagtattcaaatatgatgtttgaggcttacaagattctgaatccaggtttttcttttccatcattgtgatctcctttttgccctaccattgcttgtgtttatcgatgaagactctagagtggttaagagggtgtgacatggtgtcatactctccaaatttccaactcactgttctctttttcagatttttgttctcccttcacccaaaaagattgtgttattgtcacacatggcttcaaatctttttctgaccaatggggcttctggctgtcaaaatctcagtgaaatttaaatcgtacgagaagaaaccttatcttatttggttttcttttctcctgaagatgaagattaagtttttttttatacaaaacgaggtggtattaacgtatgattgattgagttttaattattacaaacttaaaaaatatattaatatgatattttagagcaactttcatatagaaagttttcacacgaaacgtaccgtttagctgtttgaaaagcgtgccacgaaaatctttatcttcatccaactcttgttagagaaaagaacggaacctgacaatctttttcgttctgatatctggatttggacatcacagcagatatattctacctgatggtccctgatccatctccaagctaggattcatatttcttcgccttttttttttcggttttgtgatcatctcttgatccatcaccatttctatctatctatctcttggataagttcatgacgtttcttctaccttccatcactgtcagctgtaataagagcaacaggaccagtccagcctttgatattagatgatgcagacgtgtggaagaacggtcgctctgaactgttcttcttagttaattagctagtcccataattcaagattttttttaagtatgaaagtaatctttttcagtgtgccatcatgcatgaattgatcttccagtagttgtgtttgatgcaatctttaataattcgaagtcttaatccattcaattttccaaggcttctccttcagatagatataattttgtcagctgtcgcccggattttcatgaaagatttggctcttttgtcattaattattaattaagaaagagatgcctctgcctatccgagattactctgacgaccatcttttttctgtgacggaatttctactctgaccaaactttgcaatgttatctttttttcagtagaacatttggcttctttctgaatttttcaagatcaggttggaactgaacattcagtcgcctgtgccacattcatcagagctgctgacagttgtcgcttgcttgaaacagttgcaggggtatcatctctaaaagtatctcctaatttgtctttgatgtttacaactgaactaaaattttgtgatatttcaactcaatttgtagtcgtttaatgtgctgacctactatagcatgcagtagcacggtgccatgctttgaattgtttttctcatcatataaacgcaccaccatttcttgtttttaatggagatgtcactataatgtaaaagaagtcaaaggattgtttaataatcctttggtttcaatacgctcaaatttttaagggagtatatagcacttcaacttaactttgttaatattacggttcacaagcttgctctgaagtctagtaatataaagactaaaaaagaggcaacaatggcctataaattgacattatgattggagatagcatgcatgtccatgttggatggataaatccagtgactgtgagtaatgacaataagcaaaaaaaaaaagttaaaaagttatcgagctgaggtcaagagttcagttaacctgctaccacatcacaaattaccacagactccactatatttaattacatcaaagctaaagatgaagtgatataatgctatacaactatcgattaaaagtgcttagttacttacatgatcagtccactaatggtggccactaaattcaccaatgtcagtgtgtgtgtgcgcgccactagtaacactccagctgccatggactgactcaactccaatgtgtctgcaactcaacgttgctatcaaactaaagaggttttgtacatatatgtttgcatacataatgcgttgtgatctcatggacatgatgcaattcgccaaattcagccaactcataaggccatgacacaagttggacattgttaaaccaaaataagcaaaaggtgatgggggccatagcctctgattgatcaattcgatactcaattaattaatcaattatgctgacaaaaacaactaaaaaaggactcatcaccacaaaatcctagcaaataatagtcactttcatcgatatatttgagtacacattttgagaggatggttcagttaggccctatttagatcccacacaaaaatttacaccatatcacattaaacgtctgaacacctacatgaaatattaaatatagtaaaaaaataactacttgcacatattataactaatttgcgagacgaatcttttgagcctaattgcttcatatgatttgacaatgtggtgctataataaacatttgctaatgacagattaattaggcttaataaattcatcttacggtttactgaaggattatgtaattagtttttttttgttagtgcccgaacatccaatgcgacaccctatataatatccgatgtgacacactaaaactttaccatgtatctaaacaccctcttagtgtgctccaatgattcaggtacagtgctagtttcttgtgctggttattgagcaattactctttcggttacaaaagaatgtctttatatatcttttctaattaagtaaaaagggcacaactttggttgctcaattaccctgcataaattctgaaataattatatgtgtaatattatgaaaacatctattataacaagcttggttacatattttttaatggctcaaactctaaaacaatatatagatcaaaattcacaccgattttggcctactatatctttgaaaaaacatcttttggttgaataaatatacattacaaaccttcatttggacaacctagaaggacaccttgacttgtaccaccatctgatgtgactatgaccaatcaaactatctaatgtttgtatattatgtttaagaattaagtgaagtattggtcttttcctcatcatcctaatctttgaggtaaatggaaattgctatgatgagactgatacaattttattactctctccgggttgataatacttatcacttttgacacgagcacggtcttcaaaaactaactttgaccattatttatcattataatatgtataaaagtgttaacaaatatatgattttattaaagtacttatatatatatatacataaaatgattatgaatcattttaaaatattcatctttcaaatacagtgactatatatatatagtcactgtatttgaaagatgaatactttaaaatgattcataattaaagattctaaagtttgacctcactcttgtctaaaacgacaagtattatcatcctggtgggagtacgacactaccttccatgattgtcgattgggttgaaacatcccgagccccatatttgccgcacacacaagagaataagtatcatacgctctgaccataagaaattttatcgtatgtatagcagtatttttggtaaattggctgatgcacacgtaactcagaatattaattggccttgtgcttctttttttttaataatgaagatgaagttttcgcagaggctttctctagatacttgacagtgctttaaatataagaaatgcaccattgttttaaggtttgggagttttcaccacggctgctataaaacacacctatgcatcatgcttgatagactctccggtatatgaaagttcaccattttttgaagttttgggtgacagcatcaccctgaagtgtaattaagaatattccaccttttatcactcaaaccactttaactttgatgggttggttaagatttaacttgcataagtcacccttgactatcaagtactaaccactactaccttttaatttggacacttatgggaaaaacataacaaagctggaaggttttatttgtttggatgaaaggcatttgaaggcattggcatacgtgagcaacgattttaatttcacgagtacaattggatgcaatttatctttctgtagaagcgatatcatttcttacagtttacgattctagctacatatataaaatttaatttttgtaatttctatcaatgtcatattgaagtcgtcactgaatagttaaattgataataaatataaaatttctaacctaccaagaaacattttttcacccctagatgcacatcgcatatcacctatccatcaggctggatcatctctgtttgtacagcggcaacaaggcgtccagattgcaattatttatttttttacgtgcacgtgtgtagattgcaacagattgcaactccctgttcagcaagctgcaaaatttttgactctactgttgatgttgataccgctgttgatctgagcaacgggtgttacgttgtcgaccaccggcgtcgaacttgaccgtgcactgcgaaaatacaatatacagtaacgaaacgatctttcggtgcaattaaagtaaaccgggtgacttttaatgttacaaaaattaaggtcccgttctaatcttgcttacagggagctacttttttatttattgtaaacatgatttttaaactgttaaacggtatacttttatttataaaaaaaatcaaagctttcttaattgttcggctaagccaaacacctaaaacgaacgcagcctaaaaacaaaatctaaaccaattttatctaaatacatccctaatgaaaagagatgtaaattaacttaatccaattaggagcaggtacattgtgtggctatataagcgaggtggctatgcagtgtgattttaggtgattactactccattcttgcttagctcaagagtgtcgcaacagcttgtggacacaaacatgccaaccatgccggccgtcgtgtccgccgccggcgccgccgcgccgtgctccaacgtcgtcgaggacctcgtcggcttcctccgcgtcctcagcgacggcaccatcctccggtcgccggggccggtgttctgcccttccaccttccccgacgagcacccctccgtggaatggaaggaggccgtctacgacaagcccaagaacctccatgtccgcatgtacaagccgtcgccggcgagcggcggcgtcggcgccggcggtggcgggaagctaccggtgctcgtctacttccacggcggcgggttctgcctcggctcgtgcacgtgggccaacgtccactccttctgcctccgcctcgccgcggacgccggcgccgtcgtgctctccgccgggtaccgcctcgcccccgagcaccgcctccccgccgcggtcgacgacgcggcgggcttcctccactggctccgggaacgcgccgtcgacggcgacggcgacggcgacggatggtggctcgccgaggccgccgacttcggccgcgtgttcgtcaccggggactcggccggcggcaccatagcgcaccacctcgccgtgcgcgccggctcggcggcggcggcggcgcccgacgacccggtcgcgatccgaggctacgtcctgctaatgccgttcttcggcggcgtcagccggacgccgtcggaggcggggtgcccggcggaggtgttcctcaacctggacctgttcgaccggttctggcggctgtcgctgccgccgggcgccacgagggaccacccgatggcgaacccgttcggcccggacagccccgccatggacggcgtcgagctccccccggtcctcgtcgtcgccggcggcctcgacatgctgcgcgaccgcgccgtcgactacgccgagcggctgtccgccatgggcaagccggtggagctcgccgagttcgccggcgagcaccacgggttcttcacgctcggccccggctccgacgccgccggcgagctgatcgccgccgtggcgcgcttcgtcgacgtggcagcgccgccaccgaagtagggtagtgcatcgagattcgtgcagtccatgtttttttttcactctccttttggtcgagggcgacatgtgcaggagagacgggtgtttgtcacgtgtcaatgatgtgatgtgatgtgtgttgtcatgagacatcagcggagtaaaatgaaccggatgtccaagtgtgatttgcatgcagtatctttgcttttagccagtcctgtaaaatatcggtgatttatatctttgccaaaaaaaattttgggtaaatttggatgtttgggtttttaagtacagtactgtacgtagaatgtaaaatactagggtgccagattgtaagggtattatgtaaggcagtagaaccaaagatgttgtgaactctattgatgttaccatctgataaggataaggataacaaaccaaacacattttacaaaacttttcggctttgttgaaattagcagcatcaccacattaaacccaaagggcaaaggctaatgggcaaatgcgcgtgctctctctttcaccaagcaaacggcatgcattttgtttttttatattgtatttctctttctgatttctggtaattttatatatggaaatgactccagcttggacgcccgatgggaggggttaaaatcgggcgttgatgtcagcatgacgtcagcgccacgtatacgtgtaaaaccattttaaattgatttttctcttaaattacttatctaaatcatgattcgattgcaccattaaattcgttgcaattaaatcttcaaaacaagaccacacatggatatatttcgacgaaaaaaaattagcttattattgaatttatttttaaatgttgcacgatgttccactaggtatatcggaattgtttcactaagtagatcgaaaatgtttcactcgtttaaatagggtgttgtttcaccttatataaaaacaatatttcagcaaatagcgaaagaatgtttcagttcactacaacattagatctatatatagtgaaacattgtgagtacaataggtgaaacattttttgtggaacaaaagataaaacgaattcccttaatagagggtttttaaaatatgtaggtgatttgttgcaatagagtatttctgttcactataacattagatctatacatagtgaaacatttgattgcactagatgaaacatttttggtggaacaaaaaataaaccaaattcccttaatagagggtttccaaaatatgtgggtaatttgttgcaatggagtatatggtggagataagtggcaggtgagggcagagacgtggtggggcccagaggcaggcagcgcgcgtcgtgggggggggggggagggagcgcccgatacttctccctccccgagcgaccgatccggggcattcccttatatatcaatggtttatactttatattccttgtcctatttagtattattcttttattcctatttagaatcaaagtttctatctagaaactttctataccagaaagttttgtattcttaaaatttatagacatgtgtctcttggtaggctggcatgtggcctaggcatgtgaatgttcgcccattaaacctacctcgctaagccaacaagaacatttgaaaaagaaaattaaattgcagcaaatgaataactcttggacctcggatttctacggaactttatgaatttatatgaagttcaggtgtcaaaagtgaccttagggagaagaaaaaaatataaccggaggggaaaaaagaagtagtaaataaaaacaagagatagaaaagcaaacaagttaaggcacatgaaagaaagctactcaaaaggcctgtgctccactgaagcttcttcctttttggatttgatagaacacctaccggactaaaagttttaactttccccagtaaaataacatttctttcttgtaagaaagtgtaattaaatgaaatatgcttctgatctccccacatttttaatgatgtgaacagtggaacttttagtagtccttatctagtccatagacttcgacaagatgggggcaaaaggatcgaagccatttagcgactggcatttaggaaaaaaaaagcatatatttaaataatcgcagttattacctgaaattaattacaggtaagagtgatgacctcaaccatgtaaggcacagttacacatgttaagaactcaaatcctctacagcactgctcctgtatcagggtcatttacatgtactccatctgtcctaaaatataataaattttgattggatagaatacatcataataatgtaaatctagatatgctttttatctagattagtagtactaaaatatgtcacacccaatcaaagttctttatattttgagataaaaggagtaggtccttgaataagtagggctcatatgtacatattgaccttgtttactcctgtaatttgtggtgctgagtgcaacatactttgacatttccatgcaactcacttggaaggaattaaattggttaatgccaagagtgttgcagtaagggcgaatctttgcaagtggctctgcagtgagttgaatctttgcaatccatgccatatccaatgggaccatgcaccttcatgtcatgttgctaagaaaaaagatcaacaagacaagatacaagatcatcatgggagctagattacaaattctttggagaagatgtgtatccatatatgaaaccataataatccggcctgctgctagatctaccttatctgggcatgtgatgtgtgcatatctaccagtgcccgaatgtttatagtcctgagggacatatttatcatatataatctaatttatgtttactattttgatgaatgtatttacagttgcagcttaatttagagttttagtagtttagtcatactttaggattgattcaatataaaggttagggctgagcttatcaactgcacgtaaaataagacaagtgattatcttgagtattacttttgaaataatagatttatttgaatttttaaagagacttttataaagaaagtttatgtaaataacacattgtttaatagattgggagttactatattctaatatgctcatgataaataagaatgcagtaactctaaatagaagcaaattgcatgtacaaaggtagagtctaatatgagctctttatattaattaatatcactagagattatccttctacaatgatagtaaagacaataagatttctaaaccattaatgtactaaatatctttttttattatacttctttccttttctacaccctcatgcaacaaacttttcgttaataaatgctaagagtcgactctaagctgttatcatgcgtagcaacgatgtttctcattcattccatctctttcttccacgtcaccaaatttacttgcatgataacgaagagagcctgttattagacaccattgtatactcttaacacacactctcctctctctctctctgataatctgattgttggatcattatcacacaagaccaaaaactgacaactcatatctgttaggtactatagccgaatacaatgtctctcctcctcatttgatctggtccaagaaaatcacaagtgattagcatgatgatgtgtacagtaacagtacatcgtaccttcgtacaataacagctacatgcacaaactgtcaaactgtatacctgcacacgtgaaactgtaaatttcggctttatatgcaggtcgacctactgtgctactgttttttttttctcctgatacattatccgaagcctatcaattagtctgcattagaacagactgaataacagactatagccgactataaacatattttaaatagataaaaaagaagatataaaagtagcggggcaacaggctacagatttatagccagctgcagtataaactttaagatacatgtgtgtatgataggtgggaccaaacattaattatgtagtacatgtttatagataactattgtacgaattagctattaaattaactatatatgatttgaagccaataggacatagccatggtttgaatcaatattgtcaagctagccaatcaatcaggtgaagagaagtaatctaactttattattattgttattttcataagagacaaagtcatgatcttcttcctcgctgtagcggcgccccctatttgaccatttcgagtcgcttccacgatggtcaatatggtgaaggatattgccttatgcatcgtgcaaaacctctcaaaagtagctccagaacacacggtaatgggttgtttgattagcgaccaaaggttgtcatgtcaaaactttggctgccattatcccatatccctgccctagcgtccaacgtcacctccacctttgtctctttacatatgtacactctaatcaatctcgtcgatattaatttgcgataagaagatgctattagaccgttgataagcttgaaatttaattataagtataaaagtgatcttttgcaataaaaaatgttagagatatggaggaaactcaatggtccatacgaaccaaacataactatctattgtaattaatatatactcttgtcaaacatgctgcggagtgcatgggcaatggaccgatggttgcatgaagggaggaactctattatgttgttcacttgatgaatggaggaactcattgtatccagccattttccctttactttgattgttactactagtgcatgctggcttggtcaaaacactgaatagttcagccttatcttctcatcctaatgttcaacttcagcagcaaagcagggcaatttggcacgtgaagaagctgacgtggcacaaccatgcacacacgatagtcaactatacttgccacgtggctagatatctgcccccaaagtcaatggacaaatggatcactgccacttgggcccggatatcgagacaatgggtcactgactcgtgggcccggatatctagttctattgataccgcacgtctcaactgcgcttagctttagtactatttatagacgtcacccgtacagttgtgctgagacaactaagctaagtgggcagtgggcaccaccatgtcgtcgtcgtcttcctcgccggcgccgccgcacgtcgtcgaggactgcctcggcatcgtgcagctactcagcgacggcacggtgacgcgttccggcgactactccagcatctcgctcatgcgcgacgtcccgatcgacctgcccgtccagtggaaagacgtcgtctacgacgccggccgcggcctccgcctccgcatgtacgcgccggcgaaccacggcggcgaggaggggaagcttccggtgctcgtctacttccacggcggcggcttctgcatcgccagcttcgagctgcccaacttccacgccggtgcgctccgcctcgccggcgagctcccggccgtcgtgctctccgccgactaccgcctcgcccccgagcaccgcctccccgccgcgtacgaggacgccgtggccgtcctctcgtggctccgcggccaggccgccgccgccgccgacccgtggctcgccgcgtcggccgacttcgagagggtgttcgtctgcggcgactcgtgcggcggcaacatcgcgcaccacctcaccgtcggctgcggctccggcgacatcgcgctcgacgcggcgaggctcgccgggtgcgtgatgctctggccatacttcggcggcgaggagaggatgccatccgaggcgccgccgccgccgccggagggcgacgcgtcgccgtcggcgatgggcatcacgctgttcgaccagatgtggcggctggcgctgccggcgggggcgacgagggaccacccggcggcgaacccgttcgggccggagagcccgccgctcgacggcgtcgcgttcccgccggtgctcatcgtggaccccgagctggacgtgctccgcgaccgcgtcgccgactacgcggcgaggctgcaggccatggggaagcgcgtcgagctcgtcaagttcgaagggcagggccatggcttcttcgtgctcgaccccatgagcgaggcctccggcgagctcgtccgcgtcgtcaggcgcttcgtgcacgccggctaggtgatcgtccgaagtaaaccaagatatggaactcggatgacttgtgtactactccagtgttctagcgcgggagatttgcagcttgatcctttcgtcttcatcttgtcatccgtagccaatatttcaattttataaattgtttttatagttgattttgatgttttcttatcgtagtttattttttaaaatattggttttaagtcgttaaaaacacgtgtacacaaattttgatccttaattagtttttaatatcgctaataaatgttatggtataatcctcattttagatgttaggatctaccaactacttttcacttttaagcgctgtttgggttaaaaaaaataattaaagcgaaatggtttgtagcctaatggttacaatagcctccctaacaccttaggtttttggttcgactctccatgggagctgtattttgatctgtgttctctacaagtttgcaactctacttgctaacagttatgcatttgaaaatataaatgaaatcgtgcagagacaagcgacgatatatattggacacaattgttcttttcatttatttattttcttgttgatttatactcgtgatatgatatacacggttggaaaatccgagttttttctctctttttttttttttgctctctacaagtttgcaactccacttgctaacagttatgcatttgaaaatataaatgaaatcgtgcagagacaagcgacgatatatattggatacaattgttcttttcatttatttattttcttgttgatttatactggtgatatgatatacactgttggaaaatccgagtttttttttttggtgaaagatagatcagtcgacaactcgacataaatacaagtccttttcgtattgagacgtatactggcccagcaatcagcaaatgggttgttgatggtccgtggcccgtggtcctcccttcccttacatcggccgcaccgacagcccagaataagttaagcccatttaaacattttctcgcccaaaaatttaattaaacttcggtggcatgtcatcatcttcaaactcatcttttttttgacacagtaatattctcgaattatctccccggatttattaaattaaaaataaaagtaatccattttttgagaagaaagtgaaataatttttttttcaatgatatgctcgaattacctccaccgattttttaaataaaaaataaaagtaatcacatttttttccgacgaaagtgaaataacatttttttttcaaagtgcatgccgtcctacgacaactacaagacaaccaatggcggagctagaaaattttcattgtccgggcaaatctaactacaagtatttactataaaaattttgtgttcaattctatattatatcaaattttggaataagatttcaaaattttacttatatcaaccccctcaatacggtattatttcggccaaattttttaattttttcatgaattttagtaatatttatttaaattagactaaattttgttcaaaattttgaaaataccgtcatatcagcccacttgatacaaatactgaaaacgaaagattgaacccctgaccggaccactgctactttggtatagggatgaaaacggtcgaaaatggtctgaaacgatattattattttattattttttcgaaaacaaatggaaatggccagaaaattttcatatttatgaattcatctatttaatgtaaacttcaatgccacgctaatagaaattaaaaaaaagtaaattttaaaaacagtaaccatcggtaaaaatattattgttatattagttttacgaaaacggtacagatgcggttctactttggtcgccgggcggtggctccgcgaccgaaggctacaacgaaacgttttggtttttagcttttagcctcatcaatcggatcgtggatgcgctcagctagttagataagcatattgagcttcgttcgcagccaagcaaacgctcgcgcgcgcagccggcaatggcgtcgttgtctgacccgaactcgccgccgccgcacgtcgtcgaggactgccgcggcgcgctgcagctgctcagcgacggcacggttgtccgcgccgccgcgccgccgccgccgttctacgtacgcttggacatcgacgacggccgcgtcgagtggaaggacgtcgtgtacgacgccgcccacggcctcggcgtccgcatgtacaggccggcggcgacggggggagcggaggagaagctgccggtggtggtgtacttccatggcggcggcttctgcatcggctcctgcacctggcccaacttccacgccggctgcctccgcctcgccgccgagctccccgccgtggtgctctccttcgactaccgcctcgcgccggagcaccgcctgcccgccgcgcacgaggacgcggcggcggcgctcatctggctccgcgaccagctcctctccgacccgtggctcgccgacgcggccgacgcgcgcaaggtgttcgtctcgggggaatccgccggcggcaacttcgcgcaccacctcgccgtgcggttcggcgcggcggggctggacccggtgagggtcgccgggtacgtcctcctcatgccggcgttcatctcggagaggccgacgccgtcggagctggcggcgccggccaccgcgttcctgacgcgcgacatgtgcgaccgctactgccgcctcgcgctgcccgccggcgccgacaaggaccacccgctcgtcaacccgttcgggccggcgagccggagcctggaggcggtggacgtcggccgcgtgctggtggtcgccgccgacggcgacctcctcagggacaagaacgtcgagtacgcggagcggatgaaggcgatggggaaggacgtggagctggtggtgttcgccggcgaggagcacgcgttcttcggcgtgaagccaatgtcggcggccaccggcgagctcgtcgaggtcatcaggcggttcatcgccggcgccgccgcgtaagtgatcgtgatcgagcgaacgccggcgacggcgaggtggtttgcctcgtgcgccacgtgttcgtaggcttattccacagatgcgacatggtggcaggcactgtgtccttgcaacaataattgagacaagcttaattacttcgtactacatttgtgttttttttttttgtggttacaaattgggcacaatggcaagcaacaaaggtcgacaaatttatgtcattgttgtgaaatagtggtcgcagtttatatggctgcgaaggaagtgtgacagtgaccgtaagcagaggtaataaagtcagcgtgcatttattattattttctgaggaacaaaaggaatatagtgtttccattcaaaaatataaaaatttagaccaaataagatattttctaagactacgaatctgacttgggacagattgagtacatttttttttcttccctgtggtatgtccttattcagtgcgaacatttaggatgagggagtcaaatagaaattagagtgaaatgagctcgaaagaaaatgaaaaaattggcaagcttccctctccaacacagtactatataggcttttcacgttacttgtgattaatcctagacaaatcttcctgtttcgtttattacccaaacgaaacgaatcacaccaaagagaacagtgatcgtaattttttttagataatagaaatggattacatcttcggcttctgtcataagacacacaactataaatttaatagtaataaaaatgtaagataaaagtaaatcaaaatgagaaataaagtgatgggacaaatccccaactcccctttattattgactagcgttaaaccacataaaatattttagctagcaattcttatggaattacgccacccatagtggaataagagacccttagctaccgattccaagagtgtagcaacattgtgcatagtatcctgctactcctgtggtagcattgtagactaaaagtggagccagtagaaagacatgaagataacctgcatagggttagatagttgtttaccattaaaaactttatcattgcgacaacgccaaattgaccaacatacagcactaacttcaattagaatcatcttcttaatggacctagatacccttctaagccaattaccgaaaatgtttttggcgttacggggtgggggatattaaaagcaaaaaacacatatctccaaacaaactgagcgacatgacacaaagaaaagatgttggattgtctcttgtgcatagcagaaagaacaatgtttgtctcccccattttcttttagctaggttatctttcgttagaattactttcttgtaaagaaattacataaagaccttgatctttagtggaatttttaagtcccagagaattctctttttatccgaacattacagtttatgatcgtggcatacagtgatcgtaatgtgatcatacaattactgaattgatgccaaaagcttggcaatgctctctaaaagaatactactccagcttagtagtgctaatatgttgatggaaaggccaaataagagattgtggtaaccgtggtaaaattttgacggcaaactagacattaaaatttttcgattttttttttgcaacacctgtatttgagttcatcaacaggttagtaaggtttacatcgattacaatacacacccccttcaactttgatcatcctgacaaaaaaaattacatctatatcctcgctttcttttttttttctgcatctatagatatatgcattattctgcttagtttgcagaccagtgatccactcatttgacctaaacttggtccgagtgaattttagggaatattattttcttcctttagcgtgcatgctcttttataacattttgaatgattatacattatattaacatactttttttttgaagataacatgaacaactttattcaacaagacagaatttaggggatataccccagtacatcgcacaaggatacaacttaagccaagaaaccatctctaacaaggtagagagtaaccactctaaggaagcaaactttctgatgaaacaaaacaacagtagggaattagatcgacagagttctgcggcaaagccacgacgattgaatcctttggcctccattgacatgcacaccgcttgacagactggaaggctactacagctgtcaccacggaaacggcacagatcagaggtttgttgtcgagccgtagattttggtgtaggtatcaccggactcagcagattggttccatagagtctttcattagatatgaggagcagagattgctcaacccgaatgatagaccctgcatggatactgctgttttgaagcaaaaggaagcaagattcaggagaacaggtagtccacatgacatgagaaatcagatggttgcgataaaacttctgtctttgtagaaggccgaggattgctgcaggattgtagaactgaagcggaccacaacaaatgaaaaggagcaagctcccaacgaagaagtaaccttcagattggagaaataagatgccacacccacacaatgttttcaccgttgcagaaaagcagcagctcaaggtatcaccagcgcacggagcagtagtacgaagagctccaaggctatcacaagaagcaacagcacctggagtttgaagactaccacacagagcagcaacacttgggctgccaaggttgtcgctcggagcaacatcgccagaaatttcaagaccgttgccaccacacagagcaccggcacccagagatccagggccgccaccgccgctgtacgaagcagcgccatccagagatccaaggcaaccgccgtctgcacacggcgcagaccaacgagttcagcaccagcataagaagaagattctgtccttcaagtcgcagctccaactccggcaatcatcaccaccagcaaccagggctcttcgcttgaacgtaaccaaatgagacatagccacaggaacaggaaaaacctgacaaagaaactacaacctagctacactgtactaataggagaggtggccggacccctcctccaaccctcaccggcggtgaaccaccggaatttggggggcaagaggggccggagaagaagaaggagctactgtagcaaaggggaaagttgggaggagaggagatggggaaagttgaccatccaaccagagctattaacatacttttaaaataagttaatcggtaactgatgttgacaatatccttttgacagtaggtttctctgttcgactagctttcggtgggggccaatttcttcctgattcacatatgttctcatggttacctcttacaccatttctaagttgcaatctacaaaacacatatactccatgccatagacgaatatatatactccataacatggatgacaggttgaactgcatgccttggtgagcacctcacaagtcacaaccatgctcagctactccctccgtctcaaaaaaaaaagacaaaccctgatttccgtgtccaacgtttgaccgtccgtcttatttgaaagaattatgaaaaaattaaaaagataagttacgcataaaatattaatcatgttttatcatctaacaacaatgaaaatactacctataaaaaaatttcatataaaacggacattcaaacgttggcacgaaaattcatggattgcctttttttttaaatggagggagtacttgtcatgtgatgtgacttcattttttccatagaaccgttgactcctctaccctaatgggtaataaaataaatcactttagtggctataggtacttgattattaactctaattcaataaagtcaactaaaacatatttcctgatttaatattaaacaggacgcgtgataaccccaacgggcccacaaattaactcttttgcatttcagtcctttgatcgtgattaagcccctacactacattttaatttgtacttctgtccaaactttacaataaggaccacgttataggaaaatatatctcataatacccgttgacccactcggcaacctaaataaatgctacaaactgcatctctttactctgaaaaacaaatattcatctctttcctccttaacatagagatggtgtcgtcgctatgaaagcccgaattcgatggcgtctccataggaatgtcgtattctgtattcaacacctatctttagggaagctcagattcgaggttgtcttccttatgtaatgcggtttagatcgaggcggagtgggccaattaaagttggccaaaaggcccgcagcccaacagcctggtccatggcacgaagttttggcccggcctaggcacggcccgacccgaccgttgggccatgcctagacctccttctcgacaggacgtgccagcccggcacgacacgaccagcgctcccgtaggccatagcccggaggtggcccacccaaatagatgagggaggcaaaatagacttattgtagccatataaggcacaaccgaaggaaatgagggagagaaaaaagacttatttcagctatataacgcgtgactcaaagagatgagggaggcaaaatatacttattccaaggacaagcacgataggttgctttggaccgacatggcacaacccgagttttattgggacgtgcctgagccgtaggtacagcccatgggcgggcatggcacaacacaactagtcgtgcccaggtgcgggccgtgccgaatggagctacatggtgacagggctacaatggctaaaggatgaacttgggatggcttttcctgatcgctagcaaaggcgtttcgctaaccttatttcgggtgtgtttagttcacatcaaaattggaagtttgattgaaattggaacgatgtgacggaaaagtttgaagtttatatgtgtaggaaagttttgatgtgatggaaaagttagaagtttgaagaaaaagttgagaactaaaccaggccttcttcttttctcacgacaggcgtggagctaactagtactccctccgtcgcataatataagggattttgagtttttgcttgcaacgtttgaccactcgtcttattcaaaaaattctgaaattattaattattttatttgtgacttactctattatctacagtactttaagcacaactttttcgttttttatatttgcaaaaaaaattaaataagatgagtggtcaaacgttgcaagaaaaaaaactaaaaatcgcttatattatagcctgtgggacggagggagtacgtgaacagaggcagcatcgaggagacgggggatggtgatggccgccgccgccgtagcttggcgcgttgggtgctgacatcaagatggagagggcaaacaagcagtgcacgtgaggtgcttctcgtagtacttggatttgccatatgcttcctggagcatcgccatttcttgttgtccggctgccagcatcaccctggcttaaggtcatccaccctccgcttatactgcgtcgtagcacccccactactctctcgctaacctctatcttttcttcccaagctaccgggccctctgcaggtagtgctaacaccctacaagggcactccttcccttcatagtggattccaaggctatgtggatgtttgagcatagaactgaggccacgcattgtacattacaagggcacttctttccttcacgagagtggttagttggaaactctctcaaaagaactcagttctaatgacccattagggccgctgggcttatcccatttttcttatttttgtcttatttcaactaggggcgattctacattatgtttttttttggggcctacgacacctaataaaatctagaacttcaatattactacctccatattttaatgtatgacgtcattgactttttatctagtgtttgatcattcattttattcaaaaaatttatatagttatcatttattttattttgacttgattcatcatcaaatgttctttaagcatgacataaatattttcatatttgcacaagagatttgaataaaacgaatggtcaaatgttaattaaaaagtcaacggcgtcatacattaaaattaaaatacggagggagtaattcataataataagagtataagaatatgatactagtacatgttttaataagtatgcacgggacactggataattatttttttagattctcactgattttaaccccaaagggcaaaggcccagacctaggggtgaaaacggtacggaaatttccgaaaattccggctaccgtttctagtttgcaccgaccgtttcagtcggtattggtaattgtcggtatcggaaatggaaacggtaatctcttccgaaaatggtagcggaaatgatatagggtgttttccgaccgttttgtcggtaaccgtttttttatcggtaatttccgtcaaatttccgacaaaattccgaagaaggaagccggctgggccttgctagcaggagcagcccattaggcatttaggtcggaaagaaaaaccctagggcgtcagccggcgtgtcgcttctccttctcatcctctccctgtcttatgactctcgcgctatcgcacagctcttcgccacgccgccgccgccacaaccacatgtccatgccgccacaccgccgcttgctagtcctagccgtcgcatcctcgcgcctcgccgcgtcccttgccggagaagcaagatggcacctgccggaggaaaacgccgcatcctagcttctggatctatccgacggcaacaacagagaaatgagcattgagttcgccaccgttgcgtttgccaggtccactaggtataggcgtatagcttgaatgcttgagcatgatttttttacatgtacagatgaatgcctgagccttaatgttttttagcacgattttctgttgatgtgcgagcgtgatttttgcagatgtacagcttaatccttgagcatgtttttttaagatgtatagcttgagccttgtgttaatcgttaatcacttcctctttttttaaatctcaatctgctgcatctggaagtgcaagtggaagtcatcatgtgggtgtgactgcatcatcatcctattgtatgctatagccacattgatgttgaagtatcgttgaactttgtttatattgtttgtcgaccttattgtcaacttattaatcatcatataacggtgttgtgtggcagcgtgatcatgcaagggtgaaattataaggtcatcttcatacatagttaaatgtgggatgataccacggttcgctgtttccgacatgaattttcgacttccgaccgataacagtagattcccgttccgatggttccgtttccgatataccgacattaccgatatcgttaccgtttccgagtataccgttccgattccattttcgaaaaaacaaaataaaaatggaaatggtagagggtttttccgaccgtttcctagcgttttcatccctacccagacctaccacgtggaaaaatatgagtgcttctagaagacaagaaaacgcctttgcttaccgcaagcgcagcagaaccacgcgacgtcatcgaatgcgtctcccacgggcagtacggccacggccacaccctgcacgagcccaacaaaagccagggccctgggtctacgtccattcgtcagtcaagttaattatcagctgaccgtccagaaggacaataacagtgttgacatattcagaatattctgaacaaagtgaaaataccatgataatccatgcttacaactctagtttaattcaattataaattcgcataatatatagttgccatcacgtttctgtttgtttcagctatgatttataagccgcatccaatttataatttagaattaatttatgtgtttttcttgagaacaccctacaaatgtaaatactcataaagcatgcagactcacctctataaacacatatgcacactctacctacgtcattacgagtagttgttgagattgatgaagtcaccataaacgtctcgctttcaagggtatgtcgtctaccactaaataattagcagtaaatgggagtaccagtgtcaagtctaagggttgattttggatgggctagttccaccacaaataacctaaacaattgagctacgctcatttcacgtgtgttttttcattgttttttttaatataatttggtctctaaacctttaaaccggtaataagaatagaaatgtaaaagctttatcctaagactacttttctatttttgcaagttgcaacgtttatgtttgccattggattataagccgtggtccgtggaaaagaagaagaatcttctaaacttatttgccatttttctcacgtctctgcttttggactagaagagtaaaagcttccctattctagaaggcatctcgttctcttccaagttccctatataatgggctccacgtctcgctctcacaccgcaccgacgcatcagctaccttctacgcattaacgcaaacatctgcacgacacgacacaagcaatggcgccggcggcggagccgtacgtggtggaggactgccgcggcgcggtgcagctgatgagcgacggcacggtgcggcgcagcgccgagccggcgttccacgtcgacctgcccgacgacgccgacgccgccgtcgagtggaaggacgtgacgtacgacgccgaacacgacctgaacgcgcggctgtaccggccgcgccacctcggtgccgccaacgacgcgcgcgtccccgtcgtcgcctacttccacggcggcggcttctgcatcggctccggccggtggcccaacttccacgcctggtgcctccgcctcgccgcggagctccccgccgtcgtgctgtcgttcgactaccgcctcgccccggagcaccgcctccccgccgcgcaggaggacggcgccacggccatggcgtgggtgcgcgacagcgccgcgcgcgacccgtggctcgccgacgccgccgacttctcccgggtgttcgtcgccggcgactcggcgggcgggaacatcacccaccacatggcggtgcggttcgggaaggccgggctcggcccgcaggtccggctgcgcgggcacgttctcctcatgccggccatggcgggggagacgcggacgcgcgccgagctggagtgccgccccggcgcgttcctcaccgccgagatgagcgacaggtacgcgcgcctcatcctgccgggcggcgcgacgagggactacccggtgctgaaccccgccgggccggaggcgccggggctggaggcggtggcgatggcgccgtcgctcgtcgtggcggcggagcacgacatcctcagggaccggaacgagcactacgcgcggcggatgagggaggagtgggggaaggaggtggcgttcgtcgagttcgccggcgagcagcacggcttcttcgaggtggatccgtggtcggagcgcgccgacgagctcgtccgcctcatccgcagcttcgtcgtcgagcacatggactcggagtagcaaagcactagctagctacatgatcaaagattagtcaattattaaaagtgatttagactttttctacataattgatgagttgagagcgatttgtatttgttaggtgtgttttgatcttatcttagttattattgatatgtttcttggtaatttgagaatgaatcaataatggaatgccacatggatggcaatgcttcttgatcaaatttattcgagtgaagacagaagaacaatatttctttttcttttaaagaaaaactgagcatccggctttgtggagtggtaattgttttgtcggggcactaactagtggacttatacataaagttgttcaaacatgatttcaccgaggcatgtaattaaacaataaggggatgccgattaggtattagcaatgggtagtcctaggtcgtgcccctagcgatggccgttcgcttttccatcggcgccgtcccgtccccctgcgatggaacgcgtccctctgctgggggacgcggctctctctggtcctcgccagcttttcgtggggagacgcagccaggcgtcgcgttgagtgtgtgtggagctcgtgggcacggcatcgtccccccaaatttctctttgcacactcgcctcactctcgctctcctctcggtctcgtcgcgccgcgcctaccacggttccacgccttagagggagagagagagaagagagaggcgacgaagacgacggatccgcgacggcaacaaccggatccggccaccgcgcgtcgtggcagccgtcggccgccagccggcgacgggcggagaaggcttggcgcgcccatgctcgccgccgaggagcacgaggacgacgtcgtggtggtggtcgttgcactcgggaacgacggcgacgcgacccggccaccgcgcgccttgcccgccaccgccggcgccgcggggggccagatccgcccactacggcgccggatttggcacccccgactggccacggcgcgaggcggaggatgccagggaggacgccgatgggagagaggggcggcggtggacgccggaaatattcctccatatttgacgatttattgcaaatatccctcccccctcctacttcatcttggtttgagattcccccaattgctattacttgcccattttcattgccgcaaaccccacatgataacacgactatggagacgtggtcaccactcatatcggccaggcatggtaacatgattgtgaaatctcggctcaatcgctcatgatgtttagcatttccttggacgggtcataagttttcgctcttagacatcgaggttgttgaaagatgaactgttatgcttgtcttatagggttcagcagtggcttgtttctttaacagatttaaagatgagctcggtatgacactgtatccttgagaaaaaaaaatgtgtatatccatcaaggaatgtgctaagtcatataacacaagcaaaaaacaggcaaaaaaaaaagaacagcagcaattgctaattggggaggaacagcggcaaacacacagaaagaggtaaattagagggggtatttgcaacaaacattttatagggggtaatcttaaaggtgacatttggagtggtttttgtaatttttcctaaatagaatggcctgccacattcaattttcttgagttcctctgtttgtttagaaaaaccagtagtagcctgtctgaagccggtagtaattagttgtcggaacaaacggccggaatactttaaaagtttatttaaatttcaaatttataataattttgataatttctcatagaagcattttggcaaccggtagtcttcttgttctatgtcatgtaacaagtttttgaaagaggtacacataaatgaccagtgtggcatgatctgattagaacattgaacccaaaaaaaatccaagcagaagcaggctgggattacctctttctgtgtcattatccttattttttttagataattgtcattatccttatactgccatcgatcgttgagaaacttcccaaaaaaacaccggagcatcagtttccagagatgacatagcagcataatacgtgtaatgatagtatactactgaacataaggaattctttttctatatataatttaacttaaccattggtacatgagggcaaagaagcttcaaagaaaaaaaatcgtataggagctcaagaaatcatgaaaatttccagtattaatagtgatggcgccattgctctctctccctgccattctttattttatttttcttactagtactagcaaattagctggccaaaccaacaagcccaaccgagtcaacacgctcatgcatcttttactccggtgaaattaacatctggagtcattttcatcagatgatgatgcattcatgcatactagtactaagatctacaacctacgaaggataaattaagacataacatcacgacttaggccgtgtttagattcaaaattttttattcaaacttccaacttttccattgcatcaaatgtttggatatatgcatggagcattaaatgtggataaaaaaatcaattgtacactttgcatgtaaatcgcgagacgaatcttttgagcctaattacgccatgatttgacaatatgatgctacagtaagcatttcctaatgacggattaattaagcttaataaatccgtctcgcggtttatagacgaaatctataatttattttgttattagtctacgtttaatacttcaaatgtgtgtccgtatacttaaaaaagaaatttgacacacgaactaaacatagccttatatagagttatactatctcatattgcatcaattgcacagtttatatatgcatgcaaagttgcgaatgcatcttcttactccaagttctgacgttattcaaatacaaggtactagtatgaactactcaacatgggctacagaatgtcaagatgctcaatacctgatttgcctgattcagaattgatccttacccccaaaaaaaaaatcagtgatgcataaacaacctttgttgctgatgctagagagcaaaatagccggctcttattactgaaaccagaatacaggaaacagctcgtctggcgtggtaagcgtaaaggcatagctaaagacaaatttcagtgagcacagaactgaggacgtacaaaaacagtacacaagagttccatgctgcaagggattatactcaatttaaaaatcatcttccaattgcattacattcataaaggccatctcacatttgtaatctactgaaaagtatatgataactttagtagatttttatagctaatttagctttgatgatattgaccattgttggtgcgacacacagattgactaccgcttgcacttggcttttgccattttcttcctcttcttcttctcagcctttgggatcttatctttgcgagcttctctcttttctgcttttactttcttcttgttttccttccgagcagccttcctttcctcaggtcccaccttcaaaatctcatgccatgaaccgtcttcatcggaactagtgcaagattcactatgttccgaggagcacttattttgcagatccaaaggttcttctgattgtacttgctggtttttggtaggctcgtttttattccgcacaaatcctagcaatggttggttgtaaagcttatccgctgttggttcattcgcgaaggatgggcgttgcatcaatgacatgttgacaatatctgcttcgcattgcttcacataatccagcgtctatgaaatagaattaacaatcaagcatcagtaattcaaacatacgccatcatacagcatgcagcacaaacattacaaacgaaacaaaatgaacacaacgtaattacaaaatagtgtaagtcatagatctagcaaagatcacggcctatatatactgtagagcaaaagcatgtagaaccaacaaaataaatgtagagttaaatattgaattatccatgattgatgagtaacataatgtttagtaaatagagattttttggcaaactgtgcaaacaatgatattaacttattcattatcttacctgaaccaagactgttggggtgatttcatcgtcgtttgcaaccatatctccattttccaacatcttttgctgaatctaacatcacaacaaaattgttaatccatcagacattctgcccatcataaagcaacatgatcagggcacatctagaactcagtggctatagaaagactgaaaggtgacattgagaaaataccttttccaggtaatgatcaacatcttcatcagcaatattttgatcaatcacaaaattaaatagttctgttactgacatgacagcaacaccacgttttttaaagaagtcctgcaaatagcatcacacacatttgaatatcacaacctacgaatgtctatgcagtgtcaattcaacttctactcacagtaacatgcaagcaatcttccttcaagaattccaacgctgaaggatgatcaaggtcaacggactgcgaaacatcaatgatatacaagtgtccctgcacaaggagaataaatggtgggaatcagagccattgatctgaaaaaaaaaatgatgttaaaaaatataataaacagagttcaactacctcgaaataaagaatgttgtattcactcagatcaccatggaccagtttgcatttttggtagagtgtccgcattgtcgtaattaactgaaaaagaagttgcatatgggaaaactgaaggtgttatacacataaaaaatacactaaacagttcccttacgaaaaaacaataagtgcatattgcaggagtacttatgctcccattgttctagaggcaacaccttaatctgccgaacttttctgaatacttgacagtaaagatacaatagtgtccatgggcatgagcaaatgaaggatatatgctactgcttggatatcaggggaaaaactatgcaaaagagttttcatgcatgaacattatcaccacacattttgcatgatagcacatcaaaatgaagtgggcatttaattaggttcaaacccaaaaaacaatgctgaacatgttgctaatagagactctcctagatccacggccctactacccacttaaacctttccagatttctaggaactgaggaaaatacggccttgtcttcagctgtcacattgcattcacattagtgcgtatttattatctgtaaatagatacaaacaatcctttctacatgacattatgataggatgtgaagaattcaatgtcaatgcgtcatcagacacaattgatgacagccactgcgtgttgtacatggatacagcaagttttctatcctgggtaagaagcaatgtaatatagagcagatggatctattacagatttacaattaatatgaactacaatattatctttatcttcacaagatacgtcatgtacctcaaaataactttcacgcaacttatcatcagataaagcagcatccttgagacgaggagcagcccaacctccttttcctgaaggaaaaccaaatcgaattacaagatgtactgaattattgataattccatagaattgacaaatgttaacaagcatccaaattttaccctttttatagatagagaagttgacaagcatccaattgacaaatgttaaaacacaagttttacctataaattccatcaccagtacatgaagcctcaggagcaatggttttgggcatcggattccagctgctccaactctgaaacaatggtaacaataagcatatgaaattcaaataatcaactattgtatttgcataggattgttcctgttgaacaattgaaaacatttggctaaaccaaaacagaaataagtttgtctctaattgcatccctttataacacaaaaaataattcaggcaacagaagaatcccgttgaaagaagaaaatttactgagtaaagcatgaatgatgcaaaaatgagaagaatctcaccgtaaaagatttctcatttccttttcagcccaggtcttcaccattttccgaggattatgcttgcagtaaccatgtctaaagcggtaatctccatggacatatcggtctctatccctgcaagaagagaataatgtagtttgttcacatgcaagttatttttagaacaagttgttttagtaaaactagaaaacacagaacatatccataatcaacatatctgcagtagctgtcaaaaagtaccctgttacaaaagaatacgtagatagatctatgccttacttaaaaacaaggacagatgttttatagactttgatcgctaactcctggccatcagcctttgatgcatgatagacatttgcctgcatagagaaaagaaaattgcacttgcagtccaggccagattctgtatcttttgtatacagctaaagtgctctatactatgtatatattctcaacatgctttcttatccacatacgaaagtaaattgcaaatagcagaaagcaatgtcaataagatatgcagttgaactaaaaaaatacctctttccctgtagaaatgcacccatttatggtattaaaaaccccccggtttaacatcttgaacagaaccatgcgtgttcttggatcaatagcctgcatgtgaacaaacaaaatcccgtctagttgtcaaaaatcatttcacaaaaatatcatcaatcatataagtcaaaacatgttatcacttttctagaagatcataactttctctagataggatacaagagatagatgctgcagctataaccactgaaaatttcattgaatcataacctcaaaaataagaaaatcacatggctaagagagcattcttatggatatcaagcacacaaagattataagtattaatggatgacatataaaggagaaatgaaaatatgagataatatgctagttaacaacattatagcaaatgcactaggcattaagtcagtgttgttcaagcttatattaaaaactactgcctaccaaccttgtgaacacaacaggccataaaaaaaatacatcttaggaacttcctaccaaagcagtcaattgcactagagcgattttcttgaatgatacagtccaaattattgtccatgcggtacagctaaacaaggcattatataatatataacacacggagttggtgtacacataataagagcaaactcggatgaacagagatggatgcttttttagtttgctattaaacacaaaagggggcagaagtgcaggcagcacatagtaaatttaagaagcacaagagtgaaatggatacaacctactaagaaaatgtgtatacctgttctactgtagcacgatcagccttctctgtgttccttgttttcccaattgccgtctcccttatgctgtcccttatcgcagtcgtcactgaatttgacatccccacgttcattctaccttcccattcctggacaattcaaaattcaccacattgcatttcagcacaacttcacaaagtaccacaacacacaggtgaacaagcattcctcacactcgcacaacgcgcacacgcacacaggtaagcactccgatttgctacagggctaagcaccgcagttttttttttactgcaaagttacatgaaatcaagttgaacaatacggggttctaggatgaatggattgtctaaattccaaaacaaaacaatatactccaaaatttataacgtaattgcatacactaatcgcttgcaaagtgaaattacgcaaacatgggatcatcacataagcaggcccagtgaaaaattggagtgtgcaaccaacacaaagcacgaggcaccgactactacgaggcgagagagagaggagttggaagctgcatacctccaggggtgtggcgcggatgtgcgaggcgagcttctgcgtgcggttggagatcggctggaacgggcgggacagcaccccgccgtgcgcgttcggcctccgcgccgcggcggcgcctcctgccgccgtgaaggcggccgctggccggccggagccgtcggggccctccgcggcgtcgagccagtcgagcgcatcggccacgtcggagtccgaccactcctcttcatcctcctcctcctccacctcctcctgatccttactctcggccacctcgactggcctcaccgtcgcttcctcctcctcctcctcgtcggcgtcggcgaagcggctatccacctcgggaaggtacacggcggcggcggcggcggcggtcgccatggttgaagcaaaaccctggaacggtcgtggcaacacgcgggggattacgcatatgggcttactactacttatcgtggccgtatggtgggccctaatgggctacggcctttctcttgtgggccttaatatcggcccttctatatagattttgggcttaatttttccagcctgtacacatgagttacaccgaaaattcgtggaaaataaattatatcaccgaaattttgacgagtttcggagaaagttagagaaagtaactggtctctttctcttctgctattatatatcaccagtggcgggcccaggtttttgaacttgtgtattcgaaatgagaaggggtaaaaaaaattgttcatacacctaaaagcctaaacatatcaaagtgccaacataataacatatgaaatacaaaaatgaaagaaaatgataaattaggaagaaatcttacaatttagagattaacttttcgacgcttgatattttgaaaataatcgatgatgtccttgtccttagcttgcaaattgaattttttttaatgaagccccatcttgtttctccaaaaaagagtttaaatcaacagctggcccttcttcgtcttcatgtttcagttctgaaaattaaacaaatttgataatatggtatgaactatgaactaccgtccagtgtccactagaccactacaaactaagcaagcaagtacactctcactaaatcagtgaattgcagctcccaatcctaaaattttcactacatttattcaaatttgtgtactcactaaatcagtgaattgcagctcccaatcctaaaatcttcactacatttattcaaattttgtgcatgtacagatttagtcactcactgtgttgtcactgttgtgctgctcctgtcctgcgcggcttgctgttgctgtcctgctcctgcttctgcggtcctgccctgcgcggctgagccggtcagccggccaggccaggtgccggcagccctcagtggcgcagccgcctaccgccctgcgcccggcgcggcgccccacatcccacgaccacgagcacgagggcacgagtcgcgcggccgggccggcgccacaagccccgcctgctcggcggcgcgccgccagccgcacgcctgcgcaactgtcgggatggatggggaggcgaattagggttagatgggaggggaattggggatatgtcgaaatgggctgagatgcaaggttgacaacggcccaattagaccgcgggctgagaggaaagggggaggggagtgggaagttttggcccaatagagaagaaatggtgaaataaggtccaatatgagcagtttaaggtttcttttttaattttttaaatacatatacgaactatagagtatatatacctattttttgtccaaaaatcttgcgtatacatctgaatacccttgaatatacactgggcccgcccctgtatatcaccacgtgccaactaccaaacatttttcattgaggaggagacctttttctttttttttctctatcttagatttgttaatcgtgtttgaattacaaaattgtttgctaagttttttttttttgaggtagctagccgggtacgtctatactctatatgccgtacgttatctcagcctgagtgacagagtgagagtggcgatacaggacaagacagtcatactctacgaaaatccgcaagacaaaagacagcgtttgcttggctcgtattctaccactgaattgcaccgagtttacacatttggccgaatactaataaattctacctttcttgaaaaattgaaattaaaccaaatcaatttaccaccttatgtctgtggactgtggctgccgtaagcccgtaacgcgacgtggaaagcacaaacataacacagctaacatagctgcattaaccattaaccaattgatgattaacttttctttttggtttaatacggagtacaccaaatcatccaattttaggctgagtttgtttctgcaaactgggcaagcaactctctcatattctattagcatattttccctaactgctaaacattgtattttacataatagaatttctacataaaagttttagaaaacaaaataattttttttaagcttatagtaattaatatttaattaatagtatgtgctaatgatatagtagtatctcattttagtgctagtgagtgatagagtttaatcttgtcattaattagaatatatgcatggttctattttgtttacatgtagtataggtcactgcatatttagtttggctccagctcattggcgagatgccgacgtgccgtgcgatgcggtggtgcgagaatggagcaaacaacgttcatgaagaccaagctcaactgcatgtggagtgctgcgagaagtagccgaattgcaagaaaggcaaggtcagtattagccgagtgaatcggtcctagctgtgcatgagatttagttgttgctagtgattagctgcatgtgctgcgattagtggtaatcatgtaaagggatttcttggcaaataagtaggattagttagttacttagtgcatgggcatcccacgtttgtgtgcatggcgtgagttgtggcttagtgggtttggccattgttatctctttgcatgtactgagtctatataaacaagaaaacgatgtgagctagttggctgcgtcaaccaaaagcttgagtgtgttctttcagttcttctgtgagtgtgtccacgagaaagaaaatttgagtgtttgtgattaacacctagagagtgaggagagattcctaacagtgagctcgcacaaatagttctaatcaaatccaagctatccaaacggcacattccaaagcttaacccgcgtaattccattagcttcccgagcgcgcgcgcgcgcgtcgaccggcttcacctgcacgctcccatggatcctatcgccaccgcctcttggccgtcgacgtcggcgtcgtcgtggccgcggtcggtgaggcgccgcgtgccggaggcggaggaggagagggagctcgggcggcgggtggaggagatggaggaggcggtggagcggctgcgggcggagaaggaggcggccgaggcggaggagcgggacctccgcgccgagctggacgcggagcgcgccgcggcggagacggcggcgagcgaggcgatgctgatgatcgagcggctgcagcgggagaaggccgccgcgctcttggaggcccgccacttccgccgcctcgccgacggccgcgccgaccgcgacggggagctccaggacgagctcgcctccctctccgcgctcgccgcctcctacctctccctcctccacgcccacggcatcgaccccgacgacgacgacggaagcaaccagcaagagcagctgcagcctcccgtcgaacacctggacgcggaggcagacagggagagccgctcggtggttgcgtcgccgcctccgtcggagaaggtgttcgcgtacgcggccgcgacggcgccggccgcggattgcggcgccgaggtgacggagaatctgtacgcgagggtggaggcgctcgaggtggactggtcggcgatgcggagggaggtggcggcgctgcgggcggagcgcgcgcaggcggtgctggcgagggaggtggcgcggaggctgtgccgggaggcggcggtggccggcgagaggggcgccgtcgccgtggcggcggagaggccgaggttctcggtgctcgccgtttgcaaggtagaatttcagctctgtgcatttgtattggatgatcaatcttgtcttgcttaattaatgttctgaacaaagcacttctggctcttaaatggataaaacttgttcaaattttgcctgatttcactgagctgttattcgccatgttgtacacttttaaaatgttggccttaaatcccttaaaaaaaatgttggccttaaataaaagttccctttcatgctcaaatcaaaatggtgttttaagtagtattggaggataaatgttatgggtttgtaggaacattttggttgcaaccgaacaccgtcaaaatactattcaaaatgtcaactgccaacaatttatagggcacattttggcttcaaatcaaaatggtccttaattctcctgccttgcaataacttcgaaattttggtttcggctagttgatgtaggccgtgtttagattcaaacttttttcttcaaactttcaacttttttcaacttttctatcacatcaaatgtttaaacacatgtatggagcattaaatgtggatgacaaaaaaagcaattacatagtttgcatgtaaatcgcgagacgaatcttttgagcctaattacgtcatgatttaacaatgtggtgctacagtaaacatttgctaatgacggattaattaggcttaataggttcgtctcgcagtttacaaacggaatctgtaatttgttttgttattagtttacgtttaatattttaaatgtgtgtccataaacttaaaaaaaattagcacacgaactaaacatagccgtaattattaaacatggagtggttaactgtagtcgttattgtgtcagcaattgcatagtagacgtgttgactgtcaagatcatttcctcgaaccatttttggttgacttgttccaaaaggcatagagcctcgcagggattattcctgttgtttaatccactttgtgtgtcctcctaatgccaagtcagagcttttgacataatctgaataggatcactaaacaggatgctgtgtgcatgttggctagcatattttctccaagattatttcatttttgtttggtgcaatacgtcatgtattttctgaacaagtctgtcatagcgttacgcaagtacggttcattttacagtggatttcgccttaaggccttgaatttcgttgttgctctgctaatgttgaaatgttcaatatacttggtggattattatgctatgtattgctctgcaaaccaatggtttctgaacttttcatttcacttccatgctacagcttttacagcttcgttagttcaaattataaattgatcattccaatgaagggtgtgtttagttcacgccaaaattgaaagtttagctgaaattgaaacgatgtgatgaaaaagttaaaagtttgtgtgcataggaaagttttgatgtggtggaaaagttagaagtttgaagaaaaattttagaactaaactcggtctaagtatcctgctatgctattctaaattctagtactatatatgcaatagttcaatgccacatccgcttccaacctgaaattatcactcgagaaatgataaggaaaatgttctttgctgctgtagtcttttctgcattagaaatgtgctcttgaattaaacttaattttctactgcctccagaaaccggcaagtctggcaacatttacgattccatctctctaatagtaatatcaccccttaaatcattttcacttttacagtggatttccttcataatcttcaggagaaagagatgtcatactgccaggtacgtaagaggcttttatgacttctgtttcgcctgtttctttgtatacttcaggagaaagagtctgactgtcagtagcagtgtcggatgaacatcgtgagcttattatgcaaagcaaattttgtcaaatctcaggtttacgttcagcttgtcgactacgcttctctgcctgcttctactcgtcgacaaatccgtcccgctgcatcgacgacgacggccacaaatgtgacatgtattcctttaaaaaaaaacatatgtgacatgtacaactaatacacgacgcagttcaaacgaccaagttcagaaatcagaacatagcagttttctcaattgtaaagccaaactgatgaactcctgtaaaatttgataacttttacggtgcaattaactagactgataaattatagcgtaaaagttctcgtaccgtttctgtcttctagccaataatttactgctacctccacttcatgttataagttgttttacctttttctaagttaatgttttttactttggtaaaatttttaaaaatacaatattttttaacataaaataaagaaactattaaaatatattcaatgttaaatttaacaaaactatttgtgctataaatattactatttttttataaaattgatcaacctcaaaagtttaatttttataaaattgattaaccttaaagtttaattttaaaaagttaaagtgatttataatataaaatggatgaagtaataataggcctagtggcggaaacaggggtagggtagctagggctactgccctactcctaaacctaaatttccactaaaatttatattttaaaatctcaaaacatataagatgaagataaattatgtaaattatactagttgacttgagccttatgtttaagaaaattatctgaattaggcccgaacatagactcggtggatttgaaatgctagtacgtttgtacttactactgtcatagaaagatgagttaaaacttgcaaacccaaaaaaggattgaacagtactacccaccaaaattggcatttggctcggatggcgccacgtagcatttgcaggcacctgaaactgttcctactgttcgtgcggctgtgccgcggcgcaccacgacgcggcggacatcgtgacacgtgaagaacgctcacgctcacgtaaccaaatacaccaacgcgaaaagcacggatcaaacacaacacagagcaaattcctcgtcgcattgcgtcaggacgggataggatgtggtggtggccggcgttcctgtacccgccgccggcgccggcgttcgtggcggcggcgtcggtggcgcagttcgcgttgctggcgaacgccgggctcggggagctccgcggcgagcacatggcctactccaagttctggcaggtcgtcgccgggaagaagaagaacggcggcggcggcggcggcggcgcgctgctgcccagccggcaggggatgctggtggcgtacgtgccggcgttcgtcgccgcggcggcgtcgttcgccgtgcccggcgccgtggtgggcgtgcgcgcccaggtcctcagcgccgcgctcaccgtccactttctcaaacgaattctcgaggtaattcatggccttgccagttgccaccggtttttgcaatcaactatgctcatagccttatagcgatagagtttacttgcgtacgtttatatgggtgagtgtgcgtgtgttatgagtttctacgttatactgtgtaattcttagaaaaaaatccatggaatgatgaaaattaaaagatgattgtttagccacaattcttttcatcttttctttaaggtggcaatgcacagtagcaaagttttttcggtctgctttgtatcccccataccccataaccacctcagcgtgttatcgatatatgctacttttttttctaatatattaatggataaggtttttacatgttcacgagaaaaaaaaagaacaattcaagatccttgctgaatgctagtggaaaatacatttgatttaagaacaaaactttaaatgcaaatgaaaacatttggcctgtacaccaccactaggtatgcaaagctaacgaaatcaaagcataaatatgcatttttttatttttctgcaaaattatataagtccagttagattgctcaaattttgaagttaataaaacattgaggtgtgaaaaagtgttgaattacagacggtggtgtatatcagtaccaatttgctaaatttgagttcattttgcttacttttccaactcatctctcgttttccgtacacagttatttaaactactaaacggtgttttttttaaatattttatatacgaaagttgctttaaaaataatattaatctattttttaaaaaatcaactaatatttaattaattatgtgctaattagatgcccaacacaggcttaaatattcaatgcattaaattgttttttaggtactgttcatccatcagtacagtggaagcatgccactcaacacggcggccaccatctcctccagctacctcgtcatcaccgccaccatgatctacgcgcagcacctcgccgccggcctcccggacccgccggtcgacctcctctaccccggcgtggccgccttcgccgtcggcatcgccggcaacttctaccaccactacctcctctcgcagctgaggaacgcagccggcggcagcggcggcggcgagaggcagtacaggatccccaccggcggcctcttcgggctcgccgcctgcccgcactacctgttcgagatcgtcggcttcttcggcttcgccatgatcgcgcagacggcgcacgcgctcgccgtggcctccggcacggtggcgtacctcgccgggaggagctgcgccaccaggaggtggtacgagtccaagttcgaggatttccctgatagcatcaaggcgttggttccatatattctgtaaatctttttcattttgatgaaaatttatgtaaaatgaataaatactgtacaagaaatatcttaggcttttcgtcgcttcgttttgaatttagactagctgtgacttgtgactatgcatgcaatgaaacaaataattatacgtgaggacaaataattatacgtgaggaaataataaatcccaacaaaaatgtggtgaaatttgattgttttttatctggtttttgatgtgccaaaacatccaacatctgatccgaaattttaaaccctgtgtcaattgcactagaagaatttctatttccttttgaaatgaaattaagcgcgagaagacctgttagccttgcccttaggttaagtctaggtcgttttccatttcaaacaatttcagcagacgatgcgactttctgtcattaaacatttttttcaagagaaaaacaggggtaatggcccagtaccatagatagatgacaaagattgaaattgaccctcatgaaacatataatgttccattgtgcgtaccataaccgttcttcaaaataatatggtaatttaaaattttcagttgattgtgatttcttagtttcctcaactatgactgactgaataaggattcgatcggatgtgtcagattcatgaatagtaactgatgggttggttttgaatgttcgaacatgttgaccttttaagcttgatagtgtcatctcataagcactgtaattaagaggcatgtcaagttgcagataattcaattgacatggtctagaatcctgcctatatgtattattggtcacggaaatcatgagatcaatcgacgtcaaagttgtcatagactgaagaagtacgcaaattagttgagacttgagaggtatagtattttacaaaaatgtaaattctcgttaagatctttcttcagaagttcagagatcatgattgggattcgggcagtcaaggatgaaaatctactctatttcaagttgtgcagattaatttactaagtaggtcatcattatctaaaaaaaatttactaagtaggtcatatgcttcttgcagggattagctgaaacttcactggatgttttaaatttgttctgaatgtttcttcagatatagcattttcttagtatcacatgaaaatggtcaaaagaaccttcttggatgaggataaaatatgaatgttttatgaaaaaaataaaacacctccaaatcaagtctagaacacacttcatagaacatccctggactcagtgagtttatttgactctgtcagaccgtcacacggcttaattaatacatgccgtgttaatttcctacatttcctaccaaatgtatcgaggttgacatgagcaggatggacagtagaaagcttgcttggaccttgtcatgtccgagtgaataattggcatttggtaaaattagtcattgtcatgagtcgtttgcagtcaggtgaagaaatctactcttgatagcgtgttatcgtcttaattatctgatgctgacaagttgaaatgttgttttgcctgatcaagtaccatgaatgaatgactctgcaaatgcagtcttatcatgtgttcacgagaagagaacatgcttttgtaaaccagttcacagatgaattttcacaccttcagtccaaatcgacctataaattgatagagaaatataaaaacagagtacgctgtgaattctcagatattattagagggatctgttctttttattttgacatgtatagattgaattcatcttaactacgcagtaatttattttcggtttgtttaacacaaatttgttttcaggatttgctttcagaattgtgcatgatcatttaatttagatggcgttcaaaagacggtgatacatgccctggtgtaaaatgaatttccctgatctcaagttcagataatgcctggagcttaattttcagaaagaaaaagaagaggaagttcataatctttcagtagaagaagcagttgaagatctgcaaagtaaaatgcaagtgctttttcacatggaatttgccttagttatccaacgtgcaaaaagcaaccatacttccaaaagatccaacaatggctagacaatttgtaatcaaacctatgtaaatattagatttatatttataaatatatatacacgctgtagaatccttttctacagtttttaacttcaaaacaagagaggaagttcagataatgcaaagtgagaaggctgatgtatattggttaaataaaatcaacaaattaattgcacttaatgtgttaactattaaaatgatcaagaaatgtacagtgccgaataacaaaagtaaaataacatccgaaggagcaatataaactgaaacaagctacacacatactacagaagtacagatcggttagcacttcgagtgcgactgttcgtgctaaattttcccctaatcgagaaaaattttgcacgaacactgtatgatctgatacaaacattgattagaaatttagaactctaagacataattagaacaaaacgcccagctcttgcaaggcctgcatcgtggtcggcgagaagaagaggctactcggcgacagaagagaagcagccgccggagatggaagaagaaatggatgcgccgaatggtcgtcgtcgtcgtcgtcgttgtcgtcaatcgccggcggagcaggctgacgctgctgcccaagcgcgagcaccagtgggtcggcggcggcggcggccctgcctccggccaccaggtccggcaatgtcgcggttggatccgacggcgccgtcgccgtcgccgtcgacggcttgccggtgagcttctgcacgatggccctgaactcctccggctgcgcgtggacgaccctgggcgtgagctcgtacacgatcaccggtcccatgtcgccgccgccggcgacgacacggggtttcttggtcggccgactcgcctccgccgccgccggcgacacgatcagcgactgcggccgcgggccctggatgctaccgccgcctggcctcttcgccttcgacggcgacgacgacgacgacgacatggctcgctctcgctgcagtggccgcgacgtttgttctcgtcagaagttgctgctgctgctgctgctagaaaacaacacccgcgaatgcttatataatggcgccaagcaaaaaaagatgacgtcaaaagcgcgcgaaatggtcagacagagttttttatgtgattaaattgaatattgctccaagcagcctgcagcgtatttaactaaactatgcagaccaaatcattatacacacctaatcatgcaccttaacacaaagatccgtcattagatatggttggtgttagtttaatgataatctaattacttgttaattagtagccgcatacttcctggacagtgcaaaatgctgtcgacagtgcactagacggtcccaaatatatatacttctctgacagctgcacgcgggtgcttcgtttcaggtggtcaggaactcagattgatcatcagcagctgcatctgcatccagtgcatatgaacttaattagcttgcttgtttaacatgaggttcaaaatgagacgcttgattaaaattaaccagagcgattaatcagagagagagagagagagagagagagagagagagagagagagagagcgactgagcgagctttgcgtagcggatgatgcacgcacgaacgtagtgcataatggccgcctggccggccggatcgaaggaggcagacagtagcttaattaaggtactagtagttatatttgactatgctaattaattcccatgcaaatctatctatctatccatccatccatataggcaggagtccttaaaaaatctatccaagcaggtcaaacaacgcaccactggtagagaaaccatctttcgttggtcggcctaattccacaatagtcccggttgcaacaaaaaccgggactaaagatgatatttagtcccggttaaaaagggtaacgggcatatttaacaccaatcgggactaaagatcatcttttatcccggtttaaatgctgtcagggcttgtcaaggccccccccgggatcttagtcccggttggtggagatcgtactttagtcccggttggtgttaccaaccggggctaaagatcccggtgatctttcgccccggtt

SEQ ID NO: 74301 - DNA, 6547 bp, Oryza sativa
  unsure (1)..(6547): unsure at all n locations
ccgccagcccggccctccccagcgctcctccccntgcgtcgcctcctcatcctccccctacccccgccgctgccgcctcctggcgaacgcgcgggtaggctcgccgcgttcccgcgtcgtcgcctccaccgccgtcgcctcttcatccccccaccggccgccgccctatcctcctcccagccggccgctgccgccaccgcccggagaggcctccacgccgcccggccggccctcccctctccctctgttccctctctctctctaggggcattttgggcacaaaaatctctaaagtggcatttcatccggtaggcaacgtattgagtggcattttatccggtgcattgtattgagtggcattttatcccacccatcttatagagtggcatattgttcgttttctcaactaagttgtggcgttttgtgtaactacttttgtccattcaaaatccacttagatctaatatgcgtttgagctagggaattccacatcatcagggccgtgtggccgtgtttagttcacccctaactaccccgaacttccaactttccatcaaatccaaaactttcctacacacataaacttctaactttttttcaaactttcaattttttctcaaactttcaacttttttcaggaactaaacacaacccagattttgtatagggtttggaacaacttctatagggtttggacgtgtctgttttactccatgaattgaaatgtatttatcatgaacagtaacggatactaatagtgtatgccccttttgttttgacaatgaaagctgcacttgatgagttcttaaatgtcattgcgggattaggtgcacctaaatgcatctagtcaatccatcaagcagccaaaaccaagagcattcatgaactactctacctggcaaccaccgggtttgccccatggaaactttgtacttgcaacaaacatgggacaggactcccctccttgctttttcagcaaccgatctaaattaaaacctgtttcctattggctatttctgcaggtacatagggtccggcatcatctcactgtccaggctaaaatttctttgctctgaacccatgtgctttcttaatttttttttaagcggtaagtcatggactttgaattagttgaatatatgtgtccgactgtcccgttggactttttggtaggactccaattcaataatgcaacatgcgctcactggtggatccgtttcttaggctagatgaacggctgaccgggctctaaccatgtttcatcgtcggaaattaactgccgtgaaaacatgggttgtagtgctagttgtttgttgcctgggctttttaccaaatacctgacttttctattagtacgtagaatacacaatatatagagccgagtgtcctttaaaatggaggatttttatagaaatcttaactaatcatgcaagttaaggcaaataccaaagcaaataaagattgtacgagcaaacaccatgatctcgtgcatacccatctacgctatttcttgaacgtggttaggtgcgccgcatcatagttacatgacatcaagaggctaggctgatggtggaaaagagatgaaatgggagctagaagggcatcatagctaaaagggagaaaagatgaaaccaaggatgggacaatctagtctttcatttaactgttcgttgctctagtcatctgttgtgttgttcagtgtatataaacattgaaatgcgtagaaattgaacaaaatgttgtttatgttatttcagttgtttcttttaggtttcttttcgctgtggtagctgctgctctaaaccagttcatttcagaaataaaatggtgaacaatactctttttcttcttgtaatatgcagtagccacgaccagcactacctagaaaagccattgttttagagtttatatttttcctcaaaatacgaattaacattaagaggtttggtaccagatcacatacatttttaaatcaacgtttgaaaggaggccccgtactcttttacactcactgtgctaacatagttaaaacctctgttacgaggtataagtactgtcatggactaatctccagcagccccttgacagctctccctcgccgtgcttgtaccctgcagcttgtagtttactccaacccaagaactagtactaccactgcactgctacagccaagtggcccaaacgcccaggacacattgctcctccctcctcagaacaagtactatggacctcatacctcttgtttgatatagtacttcctccgttttatattagaagactttctaacattatccgttcatatatatatatatatatatacacacacacacactaatgaatcacatatatgaatctagacaacatatatataaatatgggcaatgctagaaagttttataatatgaaacgaagggagtaccatgtaagagcctcatgggttgccaatattacttaataaatcgtttagacttattagggaataaaattaatttataggtaaatttttatacacttgttcgtaacggcttaaaaaccaatactaaaaagaaattacattgaaaatgcttcaaaatcaagtttgaaagttcatattttgcccttttgctttggcttattaggcataccgatgaggctctaaaattacataatgagatagaaaagagaaaaaaagaaagaaagagaggagttgccaccccttatgtaaagggtagtctctatacaaactcctagatagataagggaaaaaaatcaatggattgaattaaaaaaaataaggtatgagtagtatattgggacaagtgcattagaggcaatatgttgtatgggtaattttatcatccttaataatgtacctagaggtaccatattttctagtgtaatatttggtgcctctaggcactgagtaccttaaagtaccaaaaaaatttagagtaaaatttagttacctcgaggttgttaataaaatagatacacaacggagacacgaattttatgtggaaaacctttgcaggaaaaaaccacgggcgccgaccggcaatgatcactacagaggagttggatacaaacgcatggggtacattggactgtcgcaccctccccgtgcggcttacaagagtatggggctgtttggatccatgccacagaatgccgcacctcatgttagtcagccacaaccgcttagcccttgtttgttttgcttccatagtttagcctgccaaagaaagttaggcagcttctagctgctttgccacacatttttgagccaaagctatggcaaggatttcgttcgccacacttttggcatgtgctaacttgaggtgtggtaagttgaaatacccaaccaaacaggccctatatataggagaaatctaggagtcctagtggggaaagacttagagtcatactaggaaactaatcctaatagtcaacttctattaggaaactaatccgaatatattgtaggcccaaaattcgaatcacatatttaaaagagatttctgaaggaccataaaattccttatttcgtataaactatctcctaattaataagaagatggtgtgtgtaaaattaggagaaacgcctatagggttttctggttagctctatttatttgatattaggtctttccctaatagtcatattttttttataaaattagaagcatgtttagcacagctctagctccagctccagctctacttctcctagagctataactagccaaacagtttcagctctctcacaaaataaactagagaggtggagctggatttaggtagctccacaactctactctagacccaactcctgtaactaaatttaggatttggagctctaccaaacaggccaggccatatgaccatcacctctaccgtgaaacttgctctcatagcctgggtggccatagcgaaatcatgcgctcctcactccaagtcgtcgtcgtcgtcgagatgacgaggagagacaaacacgcgcctttttctagtggccgcaagaatcaagatccatccaccggcagagaaccgaaccacgcaagctagctggtcgatcgatccatccatcgacaggcggaaaaggaggcaatcgattccctaatctcgctaccgccatccgccaagcgaagcgaagcgaagcattgactcctactcctactacgagcggcttaaagtgaccagtaaccaccaccaccacgccgcggccgccgtcgccatccgcgcgcgcccccacctgcctccgctcccactcgcgcacgcggccaccacccccaccgatacgcttctcctgcctgcctgcctgctgctgctgccgcgcgccggcagggagaggagaggaggaggagcatcgcttccttgcttcctcctcacgtgccttgcccccgccgctaagtagccggcttcctaccgaacaagaactgcagcgagcgactcgggaggaggaaggcgaggggatatgcagcagcagcaggcgtgggcggcggggcttggcggcctcgcggtcgccggggtcggggaggagggcggcgggggaggtcccgctcccaccaccgtcgacgaggcgtccatggagcggagcaagagcttcgtcaaggcgctccaggtaggcctgccggccggccggggacccggatccgggagagatcccgcggcgccgcgaggctcgttttttttttctttctctgaaatgaattgcagttcttgattcttttggttgaactgatgtcgcgcaggagctcaagaacctgcggccgcagctctactcggcgtcggagtactgcgagaagtcgtacctccacagcgagcagaagcagatgtgagtttttttttttgttttcgttttcgtttctactgcgattcgaatcccagctctagcaggcaaaatttgtggcaagaatttgtgcgtgtgggcaaattattggttgcttgatgctactatgggaccatgaacttgtttatgattgctctatccacatagtttctcgtttggtgctagaaaggttgcggttggtgtgtagtaggtttaaatggtgaatcagttcagagttagctgagcatatacaaatagcagaaatggatgaggaaattacttgtgaactagaaacttgggccacatttgcgagttggaacacagggaccttaaataattcttgcgaaatctgaatttttttttttgcatgcgaaattcctgcattcataacgatcccttaccgagacactggtagataattaatcttggtgcagcatagggtctggaaatgttgagtttacttgcaataatccatccgttgtttatttcagtctactttgtactaagttctgatatcctcactgcatatcacttgctgtcaaatggttgtgttcattttctgcatctggctgctaggatttgagtacacgaaaatgtgacaatcattgggagtctgatctgatttcatatgcttatttatgtcagggttctagacaacttgaaggattatgctgtgagggctttggtgaatgcggttgaccaccttggcacagttgcctacaaactgacagacctgtatgaacaacaggcttcagaagtttccactcttgagctgaaagtagcatgcttgaaccaggtactgctgtttaactcaggaatttgtgttgatgcagaccaggagttaaactgacattcttattgctcaatatctagcaagtcctcacctgccaaacttacacggataaagaaggcattaggcagcagcagatgaccggaaccgccacaagacatcacaaacattacattgtaccgagtaaggacgtgtaaaaaaagatgtaattctctactgaagaaactattagcacctaatttaacttgctattttttctctatgagctcagctttggcgaacaaaagaatgcaggctttctctgagatgcaaactgatgctgatattgactcaaggcctagaccttatccctcaggtgcaatttcttggcactcagcacacaattaaatcttgatataaagtacctgcactaaaatggttttttctcttcagcaaaaacccttttctggcatttggcttcagagaaaaactccaaaaccaatggagcacgccaatctgaatttgtgtaagcatgccagctctattttgcctattgtgaagttggtcgcttactctatgattcttcctgtgtaattctgttgtctctatttttttcagcctagaagaaacaaaggctacaaaacctgcatcgagaggttttccaccattctatttaattgcttttattgcttagtacaccccagtagtgtgatttactttcatgattggcactgagtgtatcttaggcagacttctggatagtttataatatttgtacaggtggctaacacctcatttggaattgcttttgtttcaggtaaggaaccatcaacatctccattgcccaagcatctgcagacaaacttggccagctctgattttgctatgcataatgttggcatgaaggtaaacaacttgatgagtggtttaagacctgactatttttatgctgtaaaacttgcaaatgagcatta

SEQ ID NO: 74302 - DNA, 2757 bp, Oryza sativa
tggatccccctttcataatattcatggcattcctataacaagatagaagagaaaagttgtgagataaccttgtttgtttgtcgttgtccgttgtatcagcaccacgctcactgccagcaaggtcaataaacgacaacttgccagccaatctgggtggttttgagtcattgccatcaacacgctttttaatagcaagctgaagaatggcatgggatcttgatgactcttcatttgcaccagtagtaccggtacttctggtggcattgcctttctcaatcaactcctttatggtttcaacatcagacacccgatactcttgtaaaccaacaatgcaaactttctgtttcccatcctccctcatgcaaagtttactgcatgaagtcaaaaatgtttcgaacaagaagatgtaacaggcttcctgaatatatactgtctataagcataattgattgggggctacttacctcctttcattgagaagatcaaataatttcccaccatatatttcaaagaagctcacgaataactgatagccttgattgcgatatgtatgatgcatcaatctcagaatgtcttgggaggccttgagaggcagtggacgcatggtgtaggtctttccactacctgagtggacagaatgagattgaatatagcgttaaggattctgtacacacacatgcactataggcaacaaaataggtgcaacccaccctcactggttgcatgctaagggtggttgcagctcagatgttgccctgagtctacagaagattagacatataccagtttgtccataagcaaaacaggtagctttcgtacgattaaaaatagcaggaacaacaggttccactgtttctcgataaacctgtgaattaaatgagtaaaggctgttgagaatggatctacaaaacttaatgatatgaattactaagcgtaggtggtttatactttacactcacctcatcattcgaaacgtcttcatctaggacagcatcaaacacaaattcatgtttctcaacatattcagtgaggtcaacctgcacaaaaataccccaagacattgataaatgagtatagactgatagtagggagcaaagaatataaagaacattcgtcataacaatgcagatgaatgtaaatagctagcttggaatgaaccttgagtttggtctcatgaacagtcaaggagttcgactgttgttcaatgtctatgatatcttcttctttctttgatatctccttcttattaagtggtcttttgcggacctgcattcacatttcacatcaaatctattagaagtttgcaggttatcttaagctcagcttttctatgaaggaataattatcaaagattatggacaaaaccaagaaacataccaccactttgattttcgcaacaggagctgccttctctttctcagggaaggccttgaggaaattactttcagcaaaaacagtggatttgctcatctgtttatttggagcgaaggttgggtctgaatcatcaaagcctccattgccatagccaaatttttgggcaccatcatacatgccaatccctggcacttgaaactgcatatgaatttgagctccagttaatagaatgatttcagtatggtaaaagattggatagtagataatccttgatcctcactgcaacaacacaaggttcgtgcaaacatttaggtttaaaatgcaccatcaatcaacaaacctagtacactgcatcatgtaaactcaacaacgaaacttaaacaaaccaacaactggaccatatagtcagtattgatgcggtgccacatctcaacaaccgtccacgattccaccaaagtattatttgtttaacatcttgacattccaatccccaaaagaattgcgcatccaacctagcattcctaaaagaagaccaaaagcaccaaagcagtgcacttctccatttcctttccaaattccaactcactgattaactgaaaagaaaaaaaaacacccttaaaaaagcgacagttctgactgcccaagcggccatgccatcgcattgggattcagagcatcagatccacaacgtcggcgtcaatttggaaacgcggcgatttaacccccaaccatgcgagacaatcgaaacagaagggtgggcactaactagaaatgcagctggtcttacatcgctgataagctcggtgtcgaaggcgtggagatcgagcagcccggggctgagctgctgcctctgccccggcgactcccccgccgccgcagccgccgcctcccctccccgcagccgcgccggcgtcgtcggctccaccgacacgaagatctccccatccccgcgccgcaccccaccgcgctgcacacacacgcacacacaaacacaaacgagacacacccattagctcatcccggtgatcccgcacggccgcacccccacgcgtagatctcgaagaaccccgcacgccgtacctggccccacttgccggcgccgcccccggcattggcggggacgtcgaacatgagctgctccgaggagtatcgccggcgaccgcccccgttcatcgtcgccggcgaggctggggtggggattcaggggctccttccgaggagagggaggaagagagagtggaggggggagagaggggggcgacaaggggaggcgtggtggtggagtagagtaaaggccacccgtttttgcggcttccaccctgggactcgcgtgccgttgcggagacgccctccggtttgaattttggagtggagttcaaggca

SEQ ID NO: 74303 - DNA, 6100 bp, Oryza sativa
gggtgggtttgtgttaggtggacgccgtctaaaacccgcggagggggttagtgcggatttcgttttcatccttttcagtcaggatttgttgccctgtccttaagccggtttaaatagagagttacgtcgatagggccattcgattatcattgtttttctactaagtcattgtcgaaatgattttttatttactacttataggcaaatgtgggttttgtttttcatttgcgatgaataatttgtacaagtaaagcttgtaaccatgtttcttcgataagtttagtaggtaggagtatatgttaaggataaatctgtgagaatgagatcatagaaaaagtgctagagtatatattatagttagagttatattaggatatgcttgatttgtgttggactccttccatatttgtaattattccttatctctactctatgtatctcctatatatactggctcatgagccccaataaaaatatgtccaatattcactatattcttatctccctatactattcaacatgatattagagcggacgaactagggccgaccttctcacgcttttgcgtcgtcacactcacacccgggagtaaggatctcccgggggcggccaccatttcattctagttgtcaccaagacgccaagtcgttagcctaggagaaatcgatctccctgggtgtttttcttcgtcgtcatgcttcgacgcagagatcgatattgatctcctcggcatgtctcctgcttcgtcggagtcttcatcgttgaattctagtcttcgtgtcgtcaagtcaagcacagcaacaactccctccatgccaccatcctcggtctaccgcgctcttcctgctgacggctagccgtcggtcttggcgtgccccatccaaagcacgcgacggcttccccacctccgtatgtttgcctcctcactgtgtgctagagcctcactgtcgtcggccaccgagtcccactaccacgccgctcccgatcgcaccccctccgccttcgtcgacctcctctaccgctggcaccgctccggggtgacaaccacctctccaccaccttttcaccaccccaccagtctaccgttgacaaggaccactcctccgctgcctctatctaactaccccatcccaggtcggcgccccatgggcctccaccaccgccgacatcatggagctcgcggacgctcgcttggtcgtcgctcgtcatcgacctttgctagagcagccttgccattgatctccagatgctcgtctctagcttctatctgtctacacatgtgtgttatattatataatagttagagtcatattaagatgagattgatttgtgttgactctttccatatctataacttttttcttatctctatccccatgctcctatatatattggcccttgagcctcaatacagtgtgtctaatattcgtagtattctcttatccttatactattcaacaaagagttacattctcactatgtctttagctccaccaagtccaaagctcaacaattttatttcatcaattgtcttgtttacgaactcctgaacccaagttcttcattcttgaagactcgtctattacactcactccatatttcccatgtaagagcatctccaacaacatatctaaatttgactctccaaacatccatttgcccagcttgccaaaaatttggatagtcgaatttgcctttcactccaacagactctctattacagttctccaatctgtcagtgggtcccacatgtcagcctccttatttatttttcaccccttcttatcctcttcttctctttctcttcttgttattcctttttctccgctatcttgtcttctccacagtcgaatcctggcggcggcggaggatgcggtgatggcggcgaggaggagatgacaaggttccgccgccgctagagatgtgggggagataaaaggagacaagagagcggagacaaggaggatgttggtcgatatagcgacaaaggcggcagccggagctcaagacagcggatccggcggcgacactcctccctcgacggatggtggctgtggcagggaggggcgaagtgtagcagcaagagtaaggagggccgccgcacaggaggaagtcgccttcgtggctgccgccaccaatctagaagaactcaatggcacagtggaagaggtcgacggcgcggaggagcttgtggcgccggaaaaaggaaggcggttgatggccaacgccgagaaggaaaggcaacggtcgagggaggcgagcggccggcactgtggagagtgagaagcggttgatggccgacgctggagcacaagagatgagggggacattcgtggggaggaggaatagcatgtgggcccatcgtttggtgaggcatattggctggcaattcaagccacatcgttttttttcgctcgaatggctaaaaactggtttggagaggctaatagagaggttgttagagcatcaccaacagtccaccaataatctatccccaaaaattaatttttgggtttcctaaactaaaaataggtggtgaaaaaaccccttcctccaaaagatagcctaaattcaatccccaaaaactaaaagtgggcccttctgttaaactatcaatagaaattctagttttttttcctttctcgtgcgtagaaggagatcgccccgacacgggaaggagaggagaaacgtggaaggaggggagaaacgcgcggaaggagtggattgggagtcgttctctctccctcaaatacacctcccgagaaaattggagatgggaactccaaaacgttcagagctcttttgggaatctgttagaccagtttttttaaccaaaatctcaaaaaaataggattaggaatggaatagatagactgttggtgatgctcttagagatgttataacggatgagaacatgtttcatttctcttgaattgtgtttatcttatacttcctccgtttcacaatgtaagtcattctagcatttcccacattcatattgatatcaatgaatatatatatatatatatatatatatattcattagcatcaatatgaatataagaaatgctagaatgacttatattgtgaaatagagggaataaaagctatgcaccttaaaagcaagtacctttagtaatcctaaagctagagctaattagtgcagtactaccacgaaaattatcatgccagatttactgcccgcacgtacagtcacggttccccccgaagaaatgaacatgaagtgataccgtgataagtggcgcacgactgcacgctaagtaaatacttcttccgttctaaaatgttgctatctaggatttgatttgacccatcatgtccagattcgttgttctaggatgggtcaaattctattctaggtagcaacattttgggacagaggaagtacttcctcagtcccctaatataagggattttgactttttatttgcactgtttgaccattcgtcttatttaaaaaaattggaattattatttttttgacttactttattatccaatgtactttaagcacaactttttattttttatatttgtacaatttttttaaataaaataagtggtcaaataatacaagtaaaatgttaaaatctatcatagtatgggacaaagggagtatttcatgcaggaaaagaggagtatcatctctgtcctcaaagtttaaacagctggcgtgataaacctttctcgccaggaaaattttcaaaaagcacaaggactcgacggcaagaaactctcgcaaaatgagcgagggccacacaggccacttcggttttgaatagcgcccccctcgggtaggcgatcgcctttcaccggcacgtggcggccctcctccgcgccgggctcggccggtgacgcgtcgaacgcgaccgaaagcggcccggcgcggacggcgctccccccgcaggccacccgccggttctgcccaggcgccggacgtggggcccacgacgcaggaccctctccctgtcaagcgggccccaccccgcacagcgtccctggctgatttagacgtttaattaaaacacaagtgttttgctggttagagcaagtttaatagtttaatagtatagcccactactaactctaaatcatctatagctaatgtaatagctaattcatataatagttgcttattaatatctggttccacctatcatacacatattacgtcttaaaatccgtgctgcagctagttacaggtctatagcccgctgcttttttttttctctttttttatctttttaaaatatatttatagctggcttatagcctgctattgtaagtgctcttagtgggcgcgattatttattagcaaggactactaaacaaatcaacgcggctgatagcgttgcggcccatgtttgtggcgctttgctcgcgaaaaggtcaaaaattgcttgaaccctagcgccggagccatgcaccgcggctgtggtgcgtgtcacagactcacaggtgggcctggtttcccgattcaaacaattccaaggtaggtctgcaaagcagctgtgctcgagtttgaacgcagcaagcgagacgggtatatggcgtacgtacacgagaaccctaatcggcgaccagtcgcgggggaaccagtcgcgcgcaacctcccccgcgcggagaggtggcgtgggcggcgcggtttttattttttccgaacgatttttctttcttttttttttcggatggttttctttctttttgttttttctgttttttttttctttctgtatctttgccgtgcggttttttttgttacgcacgtttcttttttctgtttttatttctttccatatcttttttagttttttcggttttttaatatgtacatatacaaattttgtatatacgtatacaaactttatatgcatgtatacaaactttgtatgcgtgtattttttgggttttatacctacgcataccaattttgtatacacgtatacaaagtttgtatacacatatataaagtttgtatacgtgtattttttggacttttttacgtacgtatatcaattttgtatatacgtatataaagtttgtatacacatatataaagtttatatacacgtatttttttaagttctttattcatacgcacctaaactttatatacatgtatatatacaaagtttatacgtatgtatagatagtatatacacttgcatatacatgtaatattatagactagaggatatagtagtatatatactctagtatgggcaactcatcagtttcccccgtacgtacacgcctggtatccctaatctcgacgctttcttcgttctgcctcagtttcaagacgatacgctaatatctctccccgacgtttaatattagcgagccccgaaagcaaagcatatagattagtaccaccatgtttgggcaaggggacgcaggaggagtacgtgaaaacacgagaacacgtgacaggagaagcaatttggctaaaaattttgcaagcagccacgctgggcgtgtatcctgtatgagcatgggcattggcgcattgcacgcattccagagctcaaacctgagaggggccgaaaacgttcgggatttcctcgtttcaggcccatgcggtagtctaggtctacgaaaataaactacgacgggccaaggccgacgaaaatattgggattaagttcactggaggtccctcaacttaacagcgagattttttaaggtcccttaaccacagaatcagaaatgtgtacccttaaactcacataaaccgtgcactcaaggtcctatagcagtatatatgtgtggtttcactgacgtggcatcataatcagcaaaaaataataataaaacaagtgcgtggggtccacatgtcatccttcttctcttttcttccccagcctgggagagagggggaggcagcctgacgccggcgggagaaggggtggccgacgcgggaaagggagggggaggtggtcggtgcaactggcgggagaggggaagaggtggccagccgcgccgacggcgggagagggaggagagacggccgtagttccagcctgcggagaagcgcgccccgtgaccgcccatgctaccatgttctcggagccgtcgg

SEQ ID NO: 74304 - DNA, 1343 bp, Oryza sativa
agtgtaaaatagaggattgctaaacacaggaaaaacataggaatgactgtttgattggtccgcatgaaaaacacaggaatttgaggagagataaagactcagggcccctttgatttggaggaaatatataggaattttagggcccctttgaatcaaaggatttatgtaggaatttcataggattcaaatcctataggaaattttcctatttggccctttgattcaaaggattgaagctttccaaatcctatgaaattcctatggaatgacacattgcatgtagattttggaggaaatttagcaagagctccaacctcttggaaaatttcctttgagtctatctctctcatccgattcctgcgtttttcctgcgctccaatcaaacgaccattcctgtgtttttcctgtgttttgcaatcctctgttttacacttcaattcttgtgtttttcctattcctccgttttttctaccctgcgattcaaaggggcccttagaggatttcaatcctataggaaaatttcctatgaagctctttgaaataaaggattacatcctatccaatcctttgaaattcctatggaatggacaatcctatagagattttggaggaaatttagcaagagcttcgaccttttgctaactttcttttgagtctatctctctaatccaattcctgtgtttttcctatggttcaatcaaacggtcattcctatatttttcctgcattttgcaatcatctgttttacacttacattcctatcaaaatcctacgttttctcaatcctgcgattcaaaggggccctcaaaggattctttccatgaggttctacctcatgttaaatttcctccaaaacttgcatgggaaaagacaatccataggaatttcataggattctataggatcaattcctttgattcaaagggctatataggaaaaaatcctctaaaatttctatgaatgggccctgagtctttatctctctttatctctccttaaattcctgtgtttttcctatggtccaatcaaacggttattcctatgttattcctgtgttttgtaatcctttgttttacacttacattcctgtcagaatcctatgtttttcctattcctctgttttttcatccatgtgattcaaaggggccctaattctaatatgtaagtgacataaaaatattcatcctaaataaacatattcatgttcatatgcaaagtaacgtattcatctagattcctatactggaatgtatcatgttctatattagtgttttattttgggaggaaggatgtacctatatatctgcagaacgacagtgcacgtacgtgcgatgcatagacgt

SEQ ID NO: 74305 - DNA, 40542 bp, Oryza sativa
ctctagtccgaatgagatgaggcagtacaagaaagtgatgaacaaaattaaaactgaactagagttggactaagaagcgtgggtagcttcgtccccaacgctgcgggcgacgcgtcctctgtggctccggatagggagaggctggcgctgacgactccgctcgtccgtcgccgctccgcaaccgtactcgtccgccgacgccgccgcttcgcctggctgcccgctgccgctcccccgccgccactcgcccttctccttgcagcgtaggggagagagagaggtgggatagagagaagatggaggttgacatgtgggaccatatgggtcccacttttttttattattttgtgtgtagctgacatgtgggtcccatggttttttattattttttgcaaatccaattgtcacataagcaccacgtcaatgccacgtggaacgaggacctagtccaagaaagccacgtaggcgccatacaaaaccgggcacaataatgtcgagggacctattctgtatggttttgtaagttgagggatgcgttatatccggttttcgacaaattgagggaccgaaagtgaacttattctgtctcaaaatcacaggaagcgattgcaaaacagaacaattacagttggtgtagtggttgcatcgaatgtatgctgccgtgctgagcagaaaatacatacacatgtaataaccactaagcaggttcagaaagagaggaaatggaatatttgaacatgttctacaaattggcctaagcgcctagcgccctagcatggtacacaaattattaatggaatgctattttacatgctttagccttttaatcacctcgcataatacgtacttcctgggttcatcggtaggttctcacgttcctccccaagatagccggtactacttgtttcaatctcaagaccactattaattgtagatggtccgccaagaaggttctctgtttccatctctgcatcgacttgtacccaaggatgcagtgaaagcttcctcaatcggcccagctcgtcggtgatttctttcatcgatggcctgttggcgccgcacatatcaaggcattgcttggctagctcagggagccccccgagtcgacctggcatgctctcttggccttttatgtcgctcaccaacaccgagtcaagattgttccccttcatggcagataggaaaactgatgacaagcttctttgtatcgcaggtccttcgagcttcagtggcacttggcctgtgagaatctctagaaggataacaccgaagctatacacatcgctcttgtcggtcaattggcacgtttgcatgtattcgggatcgagatagccacatgtaccttgaaccattgtgacaaactgctctttgtcggatggagctagtatagatgctccgaagtctgtcactttggccatgtagttctcatcaagaagtatgttggcagttttcacatcaccatggagaattggtggagatgcataggaatgtaggaagtgaagcccttcagctgcttcatgagcaatcctcaagagggtgctgaaagagatttgcaacccttggttctttccatggataagctcgaataatgttccattcgggacgaactcatagactagcatcggaacttcgacctcaaggcaacaacctaggagttttataatgttcttgtgattgatttgggataggatgagcatttcttggccgaactccttcttttgtctttcgtcaactagtgcacatcttttaattgcgactagcatgttgtccttgactgtccctttatataccgttccatgacctccttggccaattattctgctcttgtcaaaattgtttgtggcatgtatgagttcagcttctgtaaatactgtgaaagcaagacctttttttgatttcatactctcaaacaaaatcatacccccatgttggcgaaaatattctttcttgattttggtcagttttctcctttgaattaccaattgtccgcagaaggcaatgatcatgagaacaatgaagcctataataacccctacacaacgcatcagcatcataagataggatcaatgatcatttcagagtagtcaggaacttgtattcctttattatttgaagatcataaaagtacataaaaatgataaggagttaaatgaataccaattatcaagccgatatcagggatgcatgtattgctgctcttggaaaatttccttcccttccgacaagaacaccggtagcctccttccgtgttgtggcaaacaccaccggaagggcatggccatgggttgcgatcacattcattaacatctgtcgtaaacttagcataattatatgtagaacacaacatagggtgagatagatctagtatttgtgcacatacaaataaatcaatttacaagagggctatacataccatggcatccatgtgggtctggaagataagggttaccttcgtatccatgagagcagttgcagacgtacccaggtccattggtggaagccacacactcgctgttgctactaagacaagcatagcttgtcatgttctgtttggcaatatcgcatgacttctctctgatagcccaatcgatcaccatgggtacccgcccgccgtttgtgccattaaacttggtggtgtttatgtatgtcgtgctgaaattgaacgatgctgcctccatcagcacggcatagctgcaccgaccgaacctcgagatctggcttgtgttgaatctcttatcaaaagtaacattatagtagtacattcctcttggtatcgtggtctggcagcagcccatgccggaacaagagccatccactagccctgacaggtcacgacactgcgagaaacacccactttggtaacccgtgccaccatcatcggcgatataggcaagggtgttgcacccaattacggtgaacttgttgtagacatctgaaaaccggaagggggtattctttgcattgaaacgaaaatgaacccctcccataagaccggaggcattgtagcaaaaggttgagatgccattgagtacccgcaatgtgctacggctcaacgaaatatttagtacctcaacgttgccgataaatggcttagaaatgccatgttggaccttgcattcgacattgaacaattctgcgagtgagcaattcgctccaatgccaaacgggtactgtatgtcaacatccccgcaccgactttggcattgagggctaggaactgctgccgtcgcaatagtgtgttttgctgccagaagtagaagactaacgccaagctgcagcatcgtattcatattccttggctggagaattagaattgagaaaccatgataatgtttcatcaatatttttatattaaaatcagtagcttctaattaaattaatctagtcattgagaccacattaaaagataaggtgagattgaattcttttctcgtacattcagctatgaagtataaaacgaaaaacatactacataactattagactgcttaaatgtttgacaaaccatcacaaaactacataactaattaagcaaccatatcataaagctaaatatttggcgcaagttttattaatgtagaactacatagtgacaacactattaacgatatgatacacgcatgcatgtcaatatattatttcccgtcctaaaatataacaacatttagccttcagaatttgtcctagaatataacaacctcttcaccaatattctattatcaaccaaacacaactctacgtcactcaatttcatcatctatacttctatttatcatccactcacaatcatccctcatttaattgtacctactttattagtaactttctgccctcgagaaattcagactggtaagattttagaccaattcctatattcctgacatctaactgatttagcaaaaaaaaaaaaaatcaccggccggcggcgaaagaagcccaggccaattttattaagatcatgagtgaagtacagtttataactgatgaagcatgatatgagcatataaatgttgctagctctcattggaaactacacatatatacacatataagaaattaataattctgtaaaattcagctgaaatagctaggcagttcaatccgtgcctatcagaagagtaactaagttcataccagatgcagttttctccagaattagcctcccacaagtacccttggagattgctcctttcctataggcagcgttggatgtgtatgccatgccagtatatatggagatgtattgcacatcaatgtcatcgtggaaggcgtggaacaagtccacgcaaacaatacaaaggcgccgggggtaaaaagtcatatatagcaaaaggccatggatgataggcagcgcatgcatgcagttgtgtgccattgagcatatatataaagttataagggtttaaattctaaaccatggcgatccattcctcaatatttgatgttggttagttcaacaaacaaaaagacacatagagagtacttactgatcaatatgtgtacgtgtttacattcttacaacatcgctgaacagctgaatggataaatagttcaatgatttgcgatgatattctggaatacaaagaaattaattaaatattattatgttaaaataatttaaaataaatatctttaaaacattcatataaattataaatattgtttagtagctcgagaaacgtgtacatttatacaccattcaattcctttgaaaaagattacacatgtgtaatacacactccctatattgtaaaaaataaatctattctttgtatcccaaggagtattgaaggaatggttttttttatagagtgggtaggtaagagccttaaaaattccaaatttttaactgtcaaaatcaacttattttaagacggaagagcacgtgataattaagcaggtcatcaacggtggatggatggcttgactgtacacgagtatgcgtagcccacgtgggttaaattttagatttgacatttggttagcgaccctagaactcattcctagtctagattttgatcttttctccagtacattttccgccacaaggagaagacaaagctatgtaataattcttcttctctggcggtaacacacttgattttaaattctcccatcataaattaattagcactctctgtagcacccttgaattttggtttattttaaaaattcctttatttaaaaatgggtgaatagttaatttagtccctcaagtttcaccgaaggttcaattttatccttcaggtttcattttgtccaaataggtcctctaagtatttgttttggtttaaaatcatcattgattcattgggcccacttaatatgctatttgactatttttagtcaacaattatgttagaaaatgtcccttttaccccttagtgtgtatacaactatacactagaaaagagaaaaccaaaatgaataatcaacattgcatatgtacttcccattatttcaacatgtgcacatgaaatttgagcctaagggctatcgtatacacttgcaagtacataaatttattttcgttttacataaattactatgcactatctataaaaaaaaagtcattgcacgtattttttttctcttatatatgtaaatgagggggtgtaagtgtcatttatcatcaaagttgttggttaagttgacttctaaatgggttcaaggataagtttgaattaaaataaaaacatgaaggactaatatggacagattgaaacattaagtactaaattgggtttcggatgaaacttgaaggaccactttgtctattcaccctttaaaaatttggagtttaaatttggatcttttttttacttgaagtattgacagggctttgcctcgcagtgtgatttttataaaaagaatacaaaatatttacaagttacaagttagagaaggagaaggaaaaaatattacacagtttgtaaccaatcaaaaactatctgctttaaaggatccttcattctacacatatgcaaaagaacatctgttttgaacaatgccctccaagaactgaaggagggaagttcattccgaaagatttttccatttctttgcttccaaatgtgccaagcagcaataaagaagatttccaagaagcccttctggttgaactgaatgcgagccgaaacaaccatttgaaagaagttaagattagaattccacatgactcccaaatgctgccaacacctctaactgaagggaaaaaaaagaagagatgctctcttgtctctcttacattattcatgcatagctcataagttagatcatcattctcctttgcacattgccgacggtctagcatatcccttgtgttaagcctatccatgaagaggagctaaacaaaaactttacttcataacacatcttgttttccagatccaaacaaaaggcctcggtgcttgcacattcgagaatgtgagtttatagaacttcttagctgtgtatttatcagaattccataaaaaagaccaatcatcacccttgccgtcctgaaaaagaagagaggagatttcttttgtgccaaaatagatctcaaatcatctcttagaaagatcccctcaattttttgtcaaacccttcgtcaaattcaagttcaaatccctccataaatctcctcaaaatatcaactccaaaatcccagagaaaatagaaagagtcactgttcattagggcccttttccttttctccctcccggcccaactcccaatcaccttcccctccttcttaccgaagtaggtctgcccggcctccttcccgcccctctaggcccacggcctttttccgcgctagcccaggccaccgccgagtcatcttcctcctcaggccggccacaaatgatgtaatccgtttgatgaaatgccgacccgggcgccgagacgtggcagcatcgttccgcaccgtgccgtctacccatgcacccacgcatcgcaccagggccgcgtcccgccaatcccgtaacaagccaaggccgcgccgcgccaagccgcaaatcccggcggaatccgaccatgtccctcgctcgggtttctctctaggagacacggtgccgcgtcaccctccgttccatcacggtgtcccgttgccaccgcctcatgacaccatgtcgtctggtcccgagctcccgtggacgcgtgtctcctccaaccatcgcaccgcgtccatgtcatccacctcctcgtgggaagtcaccgagcccgcgcctctctctctctctcacatcgcgtcgccaccactgcgtgacgttgcgctcgtcccatcgccgtccatccgctgttgtgtgcgtcacctcgcctcgcatcaccaccgttgcatgacgtcgcgccatcgcctcgccatctcctctatcccggaataccgccctagcctctagtcggatacaccccagatttcccgacgcctagctgccaactccccgccgcatccggccaaggccgctccgcctataaaagggaacccaagcccctttcctcgccaccccaactcccccaccatacctctttctcttctctctttaccctctctttgtcaccgctttgagctgccgccgatggaagcctcgttggaggtcgccgctgctgaccctggtcactggtcactgagtcgtgcctcgccgctgcgacacgccattgcctcgggctgggcagagcaagaggaggaagaagaaggagccccaagccactgatagcccgagcccacacctctctccctccaccggtcgtcgacaggtgggccctctctgttgtagttcacacaaaattctagaaaaatcctttaacctttgaaaattcttagaaattcaaccgtaactccgtttgatcccattcaacttgccatttttttttctaaaattgagatctacacattggtattgttgtttctctattttaatcttgtctttttgccttttcttgatttgtgctccttttcgcgtatagagcccgagtatgaagaagctccaaacgccgcttttgaaggagaaaacccgcatcttgtgcaaggaaatctctcttgatcacatttaccctatatttgcaagttatcttgtttgaaaaatgcattgcttagtgtacacaataatcttgtttaggcctcggattgtgtatgcaaccgatggaccgcccagtagttgcacttactttacctaggatgttgatatttccttacctttgatagctccacacatgtttgcgccggtatcactatccactagatacgactaccaaggtagtttacttagccatgcttatgtttgtattgtcatatgggaaacttgggttattccaaatatttgcttaaaaattcggtacgttgtaccgatgtgttgtgaaataaaataggttgtgaaaatggtgatggtgcgaagtcatgcttttgtggtttggccacgtattgtcgttgaggatcttttcctttgggaaatccatccaaacacgttacagtgcaaccccacgagtgtttatgggatacctctggctaagtaaatagttatcacatgggagtttggtgtgccaatggttgtgggatgccgaggatgagagaagacgaagttttggattcttacaaccctttttgggtagccttattgcctctattgtggcacaagttaccaataggagtaggagacatcctcagtattcctaagtggatgaaggctgatcttgcttgatgctcgtctaagagacttggcccaactaggtgacatgcgatttttatgggttagctttggaaaggccttgtcacaaataacttagttgcctaggtgcttcacttagtgcctagttgctcagtcgcttagtttctcaccgcttttagcttccggctgccgcttttatgactttctgtgatgccgtgttgctcatatataggcctgtccatgatgtcaacttatgtaaagtctactttccagtgatataataaagtagtttactttgattttacatttattctgtgtataccagctagtatgttctggtaatatattacacatgggtatgagtcagcttgttttatggctaacgagtgtcagggcgttacattctcactattccaaaatgtagtaatttaaaatcggattgaatatttcttagtacaataaatctaaacataaatcttatccagatttattaggaaaatgccggcgctcgggcgcccgacacgcgtgcgcgcggatcgggcgcctcgtgcaggcggccccccccccccccccacgcgtcccgccacatgtccccaccacaacatgctatgtgttcccaccacacactccgttgcaacaaatcacccacatattaagggaatccgtcttattttttgttccacaaaaaatgtttcacctagtgtacttataatatttcactatgtatagatcaatgttgcagtgaattgaaacattctttcgtaacaaataacccacatattatggaaaccctctgttaagggaatccgtctcattttttgtggaaccaaaaatgtttcacctagtgtacttataatgtttcacgatgtatatatcaaatgttgcagtgaattgaaacattctttcgctatttgctaaaacatttgtttttatataaggtgaaaaaaacgttagattttttaggaaactgttgtttcatacgttgtagcaaaatatttcatgaggtgatttagttgtgtttcaactttttaaacgattaaaacattttcaatatacttagtgaaacaattctgatctacttggtgaaacaacatgcaacatttaaaaacaattcaataataagctaaatattttttccatcggattatatccatgtgtggtcttgttttaaagatttaattgtaacggatttagtggtgcaatcggatcatgatttggataaaaaatttaagagaaaaaatagtttaaagttcgcttaggaagttttgcatgtatgtgtcgacgagtgatactcgtagactggatgatttgggtattggggtacgttggaacgaggatctacgtaatacgacatcaagcagataaaagacaaggattatactggttcaggccccttatcaggtaatagtcctagttcagtttatataagattgatgatggaaaaccacggcttacaatgaaagtaaacgaaacagacgataccgatgagatcgttgtcgatgtattcgacgagatctcccggcgacttggctccgcgtacttcggcttcgtaaactatggtgggtgtgttgacgatgagattcaatgccctgtacccctccctaggggtctcttttatatcgtggatcatcttgatccccaagtagacttggagacattggatcttgtacggtataacagaaactctatcccttctgagtaggattttggaaatcacctatctcgtggagatattttccataatttataacaaattccaacggcgtatacgaaaacgatccgtatacgtgaaggtataccatatctgtgtattccataagtcgtagagtatgaggtatgtcttatccgtaaccctgacagtatgtatgcatgatgacgtatgatgacatgcgcgcctgatttttctcagaaaaaatcggacacccaatccataggtgcctccgatttgttatattaagaaaatctaatccgatctactctatccgtttcacaatgtaagtcattttattatttctcacattcatattgatgctaatgaatttaaatagatataattgaatgtgggaaataatataatgacttacattgtgaaacagaggaattagttgagatggaggagtatatcaaacctatgatatgaggtatgacaagatgcgtgcacggctactctaatccggagccgaactaaactgtcaacttcgatgcacgtggtaagaatcacacgaccccccaaattttctagaaaacgcaggttggagtgcatgcttcagtgcactgcaaaactccacagtgagagtgattcggaattagttgccatataatgccaggtcaacgtgaactgtgttggtaatgtaatcctttcattggatcgatccatggagaaataactgagtggtttgaataaactaaggcctgtttgtttcagcttaagattattataatctagattattaaattagattactttaagctggattataataagctgatatagaataagctgtgagctgtttgtttctctggattattggaggcatttaagagtagtgggtctttagccacccaataatttgaaaaaaactcctccagagaagattattagattataataatctggcttatagattataataatctatcataataatctacttatttgtttcggcttactcctaataatacagattataataatcctagctgaatcaaacatgaccatgacctaagtggttagatacatcccttttcattttaaaaaaaattaacaaatctaataccgtatataatacatccactatttgaagacgtgacagccgaggggctattaaccgaacccgtttccctgcatctttgttgcttacttgcagcaaaccctcgtcagacaaacaccatcaattcctgcgtgcacgtgcagtcagaccggtttttctcttatggaaaaaccaggcgtgcggactcacccgaaacgtgcctacaccggacggagacttggaatgggctccagctccacgcaactggagcgacttagcaggccgaacatggccggccctggatcaaacgggctgtgtaacctcctttacgccgagccagatgacgatcgagcatttgtgctgtgccgcttcgcaagagccgactccccctgcatctgacgggagcaggtgtagcacgaccgttctgctgccctgcatctgacgggtgctgctggctgccgcctcgccggtgcagccgcccaagcagaagctggcgaccgcgggatccaccggcggctggctccactgctccagagtccagagagcgaggaggagcatcggttcgttcgttcgttccagagcttccttccagtccagcgtaatgaatgccatcgtcaccccgtccaatgaggccgcggcccatgcccctcctcgcacacggcacacccttatcctcccccttcttgatcttaaaatggcaatgtgtgtaaggatcttcttctaactcctttgacaacttcgaggtggagttcgttattctctccattattggatagaaagagaggcagaatttaaagtggccgccgagaatcttctcctgtacttgcatgaatcctttgcccgtactcctttcccagccgataaagcacacagaagcccgtactcctttgccgtccagtacgtactacgcaccggccgctcaccggcacggccttgtactggcatgcactgaccataagcccgtgcaacttgatcgccgtcacgccgtcgccgacttgacgtatcatcctcacaaggaattagtgcaagaagaaactgttgctgatcagtaccaaatctgtgttttccgttgggtgggtgtcaagcacagtttatcttcagaaaaacggatcgatgtgtctgcatgaccaagatttcacactttccagctcaccctaacctacacatagacagccgcaaatgagtattggccaatccacaagggttcaacgagatcaacatacaggccctgctgttgtatatatagccattagcaaccacattgccatacagtactcagtagtcgtacacattctctcgtacgcttcttcgagcagaatgaagggaggaggatcaaagaggagattgctccgggccttcctccactcatggaagaagctcggcgccgccgccgccgccgcggccccggcggccggcgagtgggctcctctcgacggtgacggcgagggcgccatcccgagcgacgtgccccggggccacacggtggtgtacgtcggcgaggagctgcgccgctacgtcgtcagggtgtcgtccctcgaccacccgctgttccgcgagctgctcgaccgcgccagggaggagtaccagttcgccgccggcgccgacgcgaggctgtgcataccctgcgacgaggacatcttcctcggcgtcctctgccatgtcgactccaagcaggagcactggaggctgatctcgttttgcagatagctagctgctgtgctgcctgctgatgcatgtcgttgttcatgcctaggattggatgtttcggactcgttgctccgaggaaacggaagaattaattaattcgcgtgaattctcacgtgtacaggggcatttaggctttgttagaatgttggcagtttgttttggttccattgttgtattggatatttggattcttcaaggatggagatggaccatgaatggtactcccggcatatttcttttttcgcttaaagtgtgattagcatgcatgtaaagatttgctcgagtgaagaagatacagtcttttccctgttggaacttgcaattggttggacccaactggatttttcacttttttaatccttttttaaaacttatttttataaataaacctctaaagaaacttagactcttttcacaataccaacgtcattggcaccgtggttcaacataacggtgccatgccatcatccccataaccttccggcgaaagctaagtcactgatgtgaagggacaacaccatgaactatttgtaattttttaaaggacttatttgtgataaaaatatttataaaataagtcttcaatgccgatgtcattggcacccaggatttatttataaatattttttattacaaatatatctttttttataacaaatagatggatttttataataaataggttcgaattcttttacaaatagatcctcgacgctaatgacacttcccccttgacgctaatgacatttccccctttatacaagtgacttagcttccgcaggggaggctagagcgacagcatcaatgtcattggcaccatcatactgggccacaacatcagtaaaattggaataagttttttaggggtctatttgtaaaataagttttcaaaagagtaaaaaatccagtggatgcaacgttaattctgtcgatcgaagatcatccaatctttgcatctatatctggccatctgggacatgctttaagcaaacatgatgctacaatatgacccttatggaggtaatttataatgcattcagagtttcagacacagcaatttgatttgtaaatgcagaaagagatggcacggtggaattgcaactgaagggtcttgctctgtattgactgagtggcatgatcctttcatatcggtaggaatttttagttcactttcctgccatgccaaagagataaggcactatactcatctatccaaacatgcctagggtgcactagaaatgtgccttgagtagtggtggaaatgtcaaaaagcactcgtcgcctatagttattcctttctcaatatgctgaaatggctctagttgaagtcaggcttctcagggtaagtgcagcctgagcgttggatgataacgtttgcagcataacaagcagctctgacacattcatcaatgctcttctcctgaaccaattgagagagaaaacccccaacaaaggcatcgcctgcaaaacaattgtttagaaaaaaaaaaccacttatgtttactgacagttatgtcgtttaaagcaaggatgtatatgcaatgtttaagccagcaaagagcatccagtgaaagcaagacacatagatgtttctacatcataattttctaaaccgactacctgcaccattggtgtcaacaagcttttccttgggcaaaacgataacagggaatgttttgacctgcagcaaaaagaacatatttaaggttatcggataaacaattatcagccgaggcttctgcagattgggtatactccaacaaatatcatgtcattaataatgacaaacgcacttgagttgttgctaagattgtaataacaccataagtgaaacaaatattggctacttcagagaagatcatcaattcgggattctaacttaggaaaaacactagctacagtactttcattaaccaagaaaaggcaaacaaatttacaatagaagaggtttgaacttatgttatgctctgtaaagcatatctcataatatcttataaagacaggaacatatcctttgcacacaagctttgtgtgcacactaactaacaaatatcacctaatttttttaaaaaaagtgtgcatatatactttcaatagtattacacatatgcgtaatattaacctcaaattcattatattttaggcataacaaaattttttttaacaatttcagtctataagtcaaaaatttgtcttttttgttgctctctatgtactccctccgtttcaggttataagatattttgactttggtcaaagtcaaactgttttaagtttgactaactttatagacaaatatagtaatatttataatactaaattagtttcatcaaatcaataattgaatatattttcataataaacttgtcttgggttgaaattgttactattattttctacaaacttggtcaaaattaaagcagtttgactttgaccgaagtcaaaatgtcttataacctaaacggagggagtatgatgaattcgaagatgagactttatacatagatgtaatgctattgaaagaacatgtacaattttttctagaaatttttatgatatttattagttgatgtacacatgaaggcttgtgtgtataggatacgttccctataaagacatgccttggaaaaagaaaaaaaaaaggaatatttacctttccatcatcagccacaactactgggtcacagccttgagtaatgacagtaatcctcttgtgtgctcctgaagccttaggcaattgcgagatcttcaaagcaatctcctcagtattctcagtctacaatttttttaatggacaatttgtaaatactttactcacagaacagaataataggtgataagtgactattacctcccaaccacgaactttagcaaaggtccttgcttcagtttcatttccaaaaatatagtcagcatacctagtttggtgatcaaaagaactttaatcctgttttacatagcactgtattggaaaaattctaacatggatgaagtgcatgggtttagaagaataatgtgctgcagttgttaatgcaacgttgaatgttctatgtcaaagttatttataataagcatatagtggaacccagtactcacggaagagccttctcttgggcatcacggaagaattcacatataaagggagcagaaaggttcatcataaacacctgcaaatagtttaatcatttatactgtaacaatgctagaaaatattctccttttagtaattagtattttaccttgttagttgcagcagcatgctcagcaacaagttgaatggaatccggggataccgtgaggaaaaagccagcaatgtaaatatattttgccttctcaactacaatcaatgaccttattattgtgagaaaagcaatcaaatgaaacacataaactgcacagtaagtagtggacagtgctaacacaatgatggactgacaaaataaacagttcaagactcatttttattaccaagtgtccagttctctggcctcttcagatgttcagacctgtagcagttcgctgcagacaagtttgcaacaagtgacctgatacagacagaaggaactcatttaattgttcctttttggcaggaccagagtagcaactttagggagatttaagtgccacgatatcagcagtaaatgtactaatagataaaacgaaataacttatcaggtgattctattagatatcgctttactcagcatacctttcaccaccaacaatgcagacagcacatgtgccagtaggagcattatcatcctcataataatgggcctgtttaaagatggtaaggtcaaggcagtatgtgcagtggtgcaactgagtgaagaggcataaaaatggaagaaatttaaaacataaagaggaacttataacttgcattaacaccagcggtttgtgcgtctttcttcatctcctcaccgaacttgtccttcccaatgcaacccatgtaacttgttgcaccaggaatctggagcatccactgcaataaatattaataataataatcaagagtgttgtgatctagtagtaacttctgggcacataaagaacataatgctagcactcagtattttttgaacttacctgagcaaccctaatagaattttgagtggatcctgaaagaatcgaacacaataaattcaaataaaatataaaccatgaaacaataattcatcacattgaagtcgtaggttaatgtatatggtgtggtaatattacctccagcgatatattcaacattgaccttgctagccaattcattgtacctggcacataacacacaaatccacaatattcagcaatcactaaggcacatcctatttggcatgattaatgttaggattttggaaaaaaaaatccagtgttgcaaggtttcagggggagaaagaaacttacataggcaaatgcttctcctctgctagaattgcattccctggcttgatatcatatctattgagttcaaaggcgcagagataaacattcagttagatcatgcgaactacttttttatcactcagcgcaagcaaacgagagagcatgttccaggccattaatgaatctatactgaagcaacatgtcatcgtggaacatacataaccccctccacccctccacccttccaaacccccaaaggccccaagtggaaaatatcatcattttccaggaccgagctgtccgagaatacacatcaagtataaatttgccaatgaatataaagggtatagttactggatgaacaattgaaatactggaattccggtccttttagcacaagtttacagggccatgtccactgagccgcatgctcaaaactcacacatactgttcttcacagtgagaaaggctctacttgtcaaactcgcatgagtataacagttacttcaccaaaaattggcagaagagtacagtcttacagactacagagaccataggttttaatcgagagatcattacagcacacgaagagggctgttggggtggttcatactttgcgaggaaggcctcgtcgacgacggcggagatgtcgaggagggggtttcccatgcccaggaggacgccctcgtagcttccgctctccatccttccctagatccccggcgaacggtgcggcggcggcgggggcggcggaaagagattaccggcgttgctttgcttctgcgtggaacagttggggaaggaggctgaggaggtcagatcgacttcgcgagggatctttttgcagctgccacggaagcatcggcctgcctatcacggaggcccacgtgaccacggcccaacacctcagcccaccacgtgccgggcctctcgctcgagcaggcccacagcgtttccggctccactcaatctgtgacacgcaattgatccaacattaaaatgggtcgataattgcggttatcggtcttattatcaggtttgtcagttaattaaaaaaatttgagactatctatacataaattctctcttatctatctaaaaatttatcagttgtaaatatattataatcacagtataaattatattgtattgtgtatgtaatttttaaaaatcccatcataatatgctatttccgtaaagtgtaggaccgaatcctctcacgctatgcgtgtgttgtgatttttccttcctcgagtatacaaatcttgaggcaaattctaattgattaaaattatacgtgaaatttgcgttgtagttacataagtacaagttataattatgttatatataaatttaacgatcttttttgagaaaatttatcaacacatataaagcaaaatcgaaaaaaaggtagtattcaaattgtttgacaaatatatgcttggttttgccccttctcttcatcgtaaagtattttcgccaacgcgtaaaaggattacacacatcgagcagtaacctcgcttaacgacgacggagtggtaacccgtaaccggtgaccaactgtgtttgtaaaccttgagaattggattgttggaatcgagtatatgttggtgtcaatcacacacactcagtctagctcagtcgttggtggtattagttcagttgagcagtccctctttcatgttagaaaaagggcagttcggttgaacaatagcactatactcggaactagtggagtggtagttggaaccaacgttcacaggtaagcgatatgtacatccatctacctccgaacctgaggtcaaacggatgctttcctcaccaacccctttctctgcaggacggacgcatcactatctaattcttgaccgaccttccctggactgtcaaggggggcaaacttatatctagcttcgtttggtagatgacagcaacatgcttttcaacttgtttttaggttgctcaggaagcatcgcctcctgattcatctcagcatctcgatctgcctttatcgatttatcctgaaccatgatttgccagctgcattgctgcaatgtgcattttaatcatcccgtttgtcgctccagtttgcacgtccaactgtacagagatgcagagagcccaacagatctctgatcattacacgaaacgaaattcagagtttcagacggatgagaaattaagccgctcttccctttgtcagcgctaagcatctatgcgagatttgacttccattctcgacagaaactaaccacgatatggggcttgcggcgacatcacgggatccgctgcatgcatggacaggctgactgctaacggcaccacatgcacggtgtagcagcagcagacacgcaccaatctactcctagcttagcaattaacatggtgcatcatggtttgcggcaaccaccagtccaccaccaccctacatccatatctgtggcagtctcgctccgatcgctcaagtgctcatgcaaagctgcacgcgaggctgaacatggacaggagatcgaaggatggatcgtgctacgatctcgctagctcgtcttgcattgtttgacgaagtgagaacagaatctcacacgtacgctgtacctaacctgcgaggctggagtgctggacggccgccatgttgatgcctcgactgatcgagttttttgtcggggttcagttttgtcgtgaattgggggaatattcggtgtgctcatgtactcatgttcatggcgatggattcatggtcctgagcagagtatctgtctgctcataggatgctagcagagtatctgcaggtaccatttagctaagcaaatactctctccatccctaaatatttgacaccgttgacttttttaaatatgtttgactgttcgtcttattaaaaaaatttaagtaattactaattctttttctatcatttgattcattgttaaatatacttttatgcatacatatagttttacatatttcacaaaagtttttaaataagacgaataatcaaacatgtttaaaaaagtcaacggcgttaaatatttagggaatgaaggagtaatatattgccgtacatgcatgttcaggcagctcatttctttttctcaatttggcacgtaggacgaataataattgtctgtccatttcttccaaccaaagaaacacaaggttctttggtcctaagagtattattataaatgcagtcacatggttcatgactaaacaatagatgtatcaagtatttgactttcatctggattatcaaatgagctatgacgcattggtgcgatgaagaaactataggagtatgttactacggtaattttcaaaatagttccaactatcagctacttccccgtttcaaaatatagcaacatagtattagaatagttcttgttatatcggaaccccacccccaccctagaaattatttcacccaactatttttttcatctttttgtgaatttatttaaaaattcaaataatttgggaccaaaattggtcatatcactaaccctcgatacaaatagcgaaatgagattttgaaccctatgccagattagacataatctagcactgtgaacgtggacagaaccttatccactctaccttaccacttcccctccaccgtcattgtaccttcccaccacgtaaaaaaatcacactgcctaaaaaccacccacctaaaagaattatttccacgagaaaatcaaccctctagaaaaaactggaagataaaattgaaccccataaaaacttacgtccatgtttttcataatcctgttgcaaagcatgagtataacatagaaagcttttgtttatatgacggttcttatagtagggcctagagccgtacctcctattcgaccaagacatgactttgagcctttgagcatatcctaacggaaggtgaacatttttcaacttctctaacagttaaactagaagaagatcaagccattcaggaatgacattgtgccaactaggcaagtagtacttgagctagctagccgggtggatataattagagcataccataaggggggcgaatggtacacgaagaatgagaaagaagcttagcggatgcaccattaggtaaaaatattctcgtaggagatatcgaggggactgtcccaatcattctagcaagctagtgccatctatcctaggggaccacctaaatgtacaaatactccctccatactcataaaggaagtcgtttaggacaatgtttaagtcaaaccttgggaatataaatcataaataactctcaagttgttgagtttgaaaatgtaaaaaatatataaatagatttgtattgaaaaatactttcatacaaatatacatatatcactttttaataaatatttttatagaaacaagaagttaaagttgtgttttggagaccgtgtcgctgtcctaaacgacttcctttatgagtatggagggagtataccttatggtttcgatctcttcgggatatttttttttcactccgtgtatacctcttgaggctgtataaggcagcccaatcctgtaacagagacatgatactttttactgaaacaatggtggcaagtgtctgtcaatatatctcaagttcacttcactttttggaaatgaaacctatcccctaatttattcttgaccttggttcccaacaatggtcatggtccatcttaaactctccagggcccaggctaaagtatttctccatcgactaaaagaacccctaatttgaaaagtacacataaatcgtatgcatagtatttgcatacgatacttgtacgatgcaacatttgccagccaaatcccatggcattttctggccgtttctaacgaagaaacacatgaatctcgtgtttttactctatattaagatattaagatattaacaaatttggttgttaacacacatccaccatctgttagcaatcgtacaatgatcgtacacataaatcgtatgcatagtattttctaatttcctcgtgttgtttttgtaacagtaacacttcgtatctccggtggtaggtaggacgagtggacctcttaatctgcgttggctgatcgacagtactgaccgtctgtttcgcatcaaatcgtgctctgcacctgccaagtagctactggtccagcaagcatgagctgatgagcacacgagagatttctgtcactctcacccttgaaagaggacagcagacagacaacacccagcaaaactatctcttgcagagttgcagttcccgccatcaaccgatcgatatcagtgatcagttcgaaagaagtggacgtaaccagttcagagttgagatgaccaatttcaacacatgtaatcaagatagcgctatattagtatatttcacttgcaaaatacaacaacggaatcagaaagctgccagccaaggccatgaacgctgcaggcgccacggcattgcagcagcaatctcacacgattacaacacggataaatacagcaagctcaaaaaggaaaaaaaaaacacggacggagaaacaacgtaatctgctgatgagcgtacgagaagccttcaggatcctgaattcctccctttcttatttcggtgcacgtatcgtctcttcctggatcttgtcgcgttcgcgggtggactggttcgatcagcagatgggcaggggctcgccgttccactccttgaggcactcgagcatcgggtcgatgagcttgcgctcgctgatggccaggaacaccttgttgcactcctcgccgggggacttgagcttctctccggtgaggtacacgcagccgagctcctcgcggacgaagcggtacagcgggaacgacctgctctccttgatcctgttggtgatcggcgcggtgccggtctcgaacgccacgcgcgccgcctccatctccctgggcagcgcctcgcggagctcctcctcgaacgcggtgatcttggagaacacggaggagccgtcgtccttctcggcggggccgttggcgagggcgtgctcgacgagcacggcgcggatcttggtcatcagcgggtagttggcgctgcacgggtcgtcggcgtagctgtacacggcctcgcggtcgatggcggtgagcagggccttctcgctgaagcgcgcgctgtggaggccgccggcggggcccgtggtgagcaccttcttggccaccgtcgtcacgcagttcttgacggcgctcttgaggttctcctccaggtggcgcaggtcgacggcctggcagagcgcaaccaggtaggtggaggacatgagcttgaggatgtccaccgcctcggcggtcttcctggcggagacgaggccgagggagttgacgtcctggttgtgctgctccgcgctctggacgtggttggtgaccgggttggcgaggaactggagctccgagcagtaggaggccatggcgatctcggtgcccttgaagccgtagtccaagctcgggttgcggctgccggccaggtttgacgtgagcccgttgttgtagaactcgttgaccagctcggagaactgggcgaacatgagcttgccgatgttggcgatggcgaggcgggtgttgtccatggacacgccgatgggcgtgccctggaagttgccgccgtgcagggccttgccgcggtggacgtcgatgaccgggttgtcgttcaccgagttgacctcgcgctcgatcgacttggtggccgcgcggatgacctcgatctggggtcccagccactgcggcgacgtgcggagcgcgtacctgtcctgcttcggcttcagcagcgggtccacctcgttcaccttctgcgcgtgcggcatgaacgcgctgccggcgaggatgtgctccatgatggcggcggcctcgatcgagcccgggtggtgcttcagcttgtgcgtcaggtggtcggtgtactcgggcttgccgttcatcacctcgcagaacacggcggacagcacctcggacaggacggcgaggacgttcgcgtcgtagagcaccatggcagcgagggccgagcccacggaggtgccgttcacgatggcgagaccttccttgggctccagcctgaagaagccgccctggatgccggcgatcttgaacgcctcggcggcgtccaccttcttgccatcgacggtcaccgcctgcgcgttggggcgcccggtgatgaggccggcaatgtaggacagcggcacgaggtcgccggacgccgtgatggtgcctcggagcggcaggcatgggctgaccccggtgttgatcagcttggtgatcgcctcgaggatctcgaagcggatgcccgagtagccctggagcagggtgttgatgcgcacaagcatcgccgcacgcgacacctccgacggcagcgagttgccatcggagccgttgccgaagattccggcattgagatgcctgcagggccgtgaaacagagcaattctttcagctttgcaacctctcagtatactgtgggtgaaagaagactatgtactaattacgtttcacaaatatctactgaaaattaacctgtttgttcgtccatgattggagttaatcagttactactactactccatccgccctaaaatataagtatttttagaacagtgcgaagtcaaactttttaaattttaaccattaatagcaaataaattaaaaagattaatcatgtaaatttgatgttactatatttatcattaagcgagctatcataatatgcaactctctttatttaaaacatcttacttttatagatattgttggtcaaagtaaatacttgtattttgggactaactaactattcgagatctttcgttttgcttcaacattcatgtcctctgttgtggtactacctaacatggcagtagtagtgtagtacagcagctaaaaacaagtggcacgcagttctaaaatctgcagctctgcatcagaccgagaggtagtacgtgcacaccaagataactgcaacaactggccgttcaccgacgcacggaggttgcacatgatggcattatcatcggaagcaacaaaacgactcgtacgtacagtaaaatggctctttgattagtgatttttttttactgtacctgagcagctcaacttggagggcctggccgtccttggtgcggcggtgggaggtgccgccgaagccggtggtgacgccgtagatgtcgccgccgtgggcgatgcagttgaggatccactcgctgctggccttgacgcgggggcgggcctcctcgtccagctcgaccaccacgccggaggcgtccttggccgcggagacggcggccacctggccgacgcggaggctggacccctcgatcttcaccacggcctcccgtgactgcgccaccatgcgcttcacctcgtccaggtggctccccgtcatctccagcgccgccttgccccacgacagcgggtcgctcgcgacgaaccccgtggcgtcggcggtctggctcgccatctctccgagcggtggtggcgaacaacgacgaggaggaggaggaggagctgggtggtggtggaagaagagctgagactatagagaggctgctgtgtgctcttcttggagggaaacggagtgcgggagatcgcttaaatagcagacgggtgaccagctgggttttggtgaggccgggtgttggtggattagttggtgactggtaaggtgtatggtggattggtggatcgaaacttaatgcttttttattgattttttaagcatttcaattgaacgtcaagtagtccagtgtactagtactatgcttttggttgggaaattggaaatgagtctactggaacacgaatgtaaatatgtcataaggcctactctctccgtctaaaaaaaatcaaccgatccctcttaagataatgaatctggacatcctcttctggttgaattatttttgggatggagggagtaacttgcgtggaggcagttcaactacagtgagactcaaggggacgagagactaaccgtgtctgaaggaagatgctttctgctagcagttgccactacatcgtcgttgttgaatccaacagacggtatggtttaactgctattactagcttacaagtataagctccactctacttagtgtcagctgaaagattaggatgtgttctggagtgagggtttagaaccttactccttaacacgcaaaacgaagaagcatttagcatataattaattaagtattaactaaaatagattaatataattttttaaagtaactttcgtatagaaaatttttttaaaaacgcacagtttagcagtttgaaaaatgtgcgcgtggaaaatgaaggaggtaagttggaaaactagagataagaactcagcctaaggtaagatgagaaaatcattaacatattattaattaagtttttaattatttaaaacttaagagtagatttatatgatatttttaaacaatttgtatataaaatagtaatataatttagcagttttttaaacacagtacaaacgccgatgtttaacaacacacgcacactcacccatatgaacacatgtgcacgcatcctatctctatgaatacattcagaaaataaactaacaattttaagattgactagtaatcgtgcacgtgcaagacacgttttggaaagataaaatgttggcataaaatcttttataatataagcttacacgaagatgaactctttgatgattctttcagatcaaatcacatatgttgctgaattccataactctatttctaagtgattaagaactgtcgggaataaacagtgtccaccctagagaagcatgcactgaagatgtgcaatattagtcacaacatctgcagtaggccttagtatattatcatcatccaataattattttttctggtataaaaggagtagatgaagacaagaaactaattaccagagataaccaccttagtaaattatcctggaaactcttaaatccaaacgattgtagataaatgaacatagtaataatgttataggcttttcaaccatgtacatcttcagttttcctatgcagctggtcgttaataattaataaaacatgtgaatcgacaaaaagcatcataccaaaagattctataaatgtgcaaaaagtcaacatggtgaaagaaagagtataaactcacatgccacattccatacatggtgaaagcaagacaataaactcacccatgccacatttcttgctaggagcatatgctctgttcatatatcatgagagaatggtcagtactcagtagtacaaataacaaccaatcccatagaataattatgtattcatgcatcagtgtaacttcagttttacattcaataaggaatacttatctaaaatgaagactaaaatgagaggattagggttatactcatcatttactttctggtaaacaaaaaattgtaaatatccaggtggatacatatgtttttctcaggggaacaactaacgatgccatgaaaactttttcctcacactttcctccctctgaagataacaccccccggcccgatctgagcagttaatattgctaataaaaggatgcatgggccatggttccaatgttatacggaaacattaacataaactattgaaactgaatggtgagctatttctgcagtataaaattcacatttatatgtgcatagatgaatgaacagtacatacttgaaagcatgaatgttacctgtgaagcaattgcagagcagtaaattgagtgctttgcaaataaatttcctgcaaaaagaagaaaagtagcaactgaacacccatatcaaaaagagttatgggttgaaccatatcactcttacatcaaaattatgtggagaaagcataccttttgacccaaaattcttagtatttgttttaggtaacttattaatgcccatacaaactaaattgaaggaagttttctttacatggtttctacctttttacctggtgagcttatcaaccaccccaaatatcatttttcagagttcttgccccaacagagagaaacaatatgaaagtatatttacaatgactactgttacatattggaaaaggaatcgaatggcaatgcacatgcatatagctatatcaaaatccttttttgcgcggagatatatcaaaatattcatactaaaaccagcaacgaaaataatttgtgtgaattaaaataaaaaagtggtttagatagttaattgtggattgaagaaataaatataaggatgcaatggcgacacatattcattttatatcttctattattcagcataggaatggtttcagatttttcaggttttacagatagaagcaataacaatattccaatataaacacaagaggaacactcttacttgttggtgacatctataaacgggaggcaccagggtgtcaatttagctttctagcgttcatgtcctacttataaaaatcatcccagcattgttgtttgcctgaattagctgtagaaaaaaatattattgaatggatacacaaattatctctagaaaaagtctgcactacaaaacatagaaacatgatgtagtatatcaattttaacatatagaatcaataaatcacactaatctgctctgcttgctgggcctcacagctcataacgacaacaaccgcacatttcttcggaattttgatcattgcaagcatgtcatatgctctctgtaaatgtaatgtgcatgggtgtcatatcgggttgctattcaaaattcatataaaaaaatttatactgcaccactgtgagtttatgacttacatatttatgctaactgtatccaaatgagattataatcattttcagcttacctctaatagtaatagaggcagaccaatttattgctccatatgcttcctttcttctgctaggaccgctacatgtactctcaattcttttgaagcactcattccttttgtcagcagtgagggagggatacttcgttctagcatgttttctacttaatttgagtcaacttaaattttagtttctacatgatgatgttccatatcttttttttggggaggaggagaggtgtggtaagcagaacagaacagaacatgaccgaagagggaaaagatcagctataggaaagcataataccagtgacataattgcaggaggctgacttgaccagcctccttttctgcctccaccaattgttatttatatgcattcttttatcagcaagcgcccattgatcctgcaattcatgcattagaaaacaaaattaagactaatcaaatacagctgacaataacaaattagctagctgcatattatattttctagctcttcgactcctaaccattatgcatgaaccatgcttacgcccttgcgcagaataaaggcttacatttttgcatagcagaaaggcatgattctttgcctcaattattttttcacatcatgattagtggcaagcaatattgaacagtaaaggaaaatattcacattgttcacagtgactaatacagtatcaagtttgaaagaaatacaaagaaatcacctagagaaaactcacatagattacgtaagcaacctgtaccactaatgaaaacatccaataacacttcgagcaaaacattggttataattagcagttattcagtcaaattgtcccaatatttctggattggtcttcagatgaaaaatcacatgttactcgtaatgtagcggcaagcaacttgactgcagcttctccatacttttcaccatttctacaacttgactgcctagtgctgtttgacagcttccaactcttggagaatccctcgtgattcagcatcaagcatgacataacaggaatagtatcagcaatcaccgcagcatcgtggtaccatggccacctgtgggcgccagcaattataagcaacatcgtggcaaatttgtagaagatttgcaatcaaaattgacactaaaccaagagattattagggtaaatacctagggttgatgaacgtctctgtgacggcaatcaggcagaagtcaagggccacaatatggtgttgaagaaggtggtggtctggcaacctggatgttggcctcggcagtgaagctgcaaaggggcacaggacagcgactacacggtggagtggactgcgatctggcggtgaggggctcaggtggtgaacacaacaatggagcctgctgcagactcatggcagaagggctcagggttggagggcctcggcggcggagcagccagatccacacgatctcggggtggtggccttggcagcggagcggctggatcgggccatttggcaatcaagcgttgatcgctgaagtccgctgctttgcatcgagcgagggagatcgcgattgaggtctgagcgcatagaaacatatcaaacttcaacaaaaatggaaaattatggtcacttgtttttagatcgtgttcgtacggagaagattagggattagggaaagagacaggatttgagggacttattgagggacttacttgatgaggggccgaggcctgctccggcggcggctccgagtaagagtccggcggagctccggcagagctccggcaaggatgcggcagagcggcggcagcagggaggaggaggcatgagcgaagaggtcggccgtgtcggtggggatggggaagaagcaagacccggaggtgggaaagaagaaggacccggcggcggctacggcatggcgcggaggagcggcggcagcggggaggagctcctgccaggacgcggggaggaggaggagcgagcgaggaggagaggtgcggtcttcggggctgcgggtggatgaggagcaatgtcttcgcgcgtgcaatcctcgggtgccaaatcgtgaggtggaaaaagttgtgcgcggatggacggctcagattaatccgggtgatttggcctgtagcattggaggggggcaactcctcctttttatattagtatagatgaaatcagtacaaacgattcactatcgatgggttacaacatcttttttttagataatggatattttatacccggcttcatctatcaaaagatagactcatgccaattataacaaacgttcttacagagtaacacttggaaacaaaaccgagataaaagttcagacgactaaagaccgatgtgtctagctgataaccatccattggaactaaaaaattgcaaagctgatgactcaagatgttgcgatgccgcgatcaactgtgaacgcaaatcctcaatgccgttgcagcttcgcccattaggttacaacatctaccactgaataaataattaatcataccataaagaacctaacaattgagttaggcttacttcgctatcatttaatagcttgaaaaacatgataataaaaattgagctaaaatatgtatctcaatcggaaacaaacggggcacggtagattcgtcatttctccccacggtgctagatacggggggttgatcccgatctcgtgtcgtcagtacgtgctcaacaaccatagggccacggtagatttgtcattcgagtgtgctggtgttggtgacttggtgttggccgctgaacgctaatggtttcgcccgccgtcacgttgcacagcgggggccaaactttacacagcaccgtttcggcgtcgcgagatcaagagcggtgcaggtgcaaatctcaccaaccctgaaagggggaaacgagggttgttgtgtttcacttttttaaattttccttgggcacccaactgttgcgaaccagggttgttggcacttgaggaggtccaattattgtgcgtctcggctagtagtactagttgtctttcatcgctaagggccatttctggtgtctttaattacgtgcacataacgtcacacgatggccatctaattaagcgcctgtcaaaaactaattgccccaattaaacacttgccactactgacatatacgaacaaatgagcaataacggaaggtctcatctcataatataaacagttgcaagtatcaagaacacttcaattttatcagttaggagcagttctgttagccgataacgacatatgcagtattacaggcatacttaagaagattgatgtctacagtactattatctttctgcattctctctcattatatatacaagaccatatgattagtccgcatatcatactcttatttaaaaaataaaaattagttagagcctcatacatgaaaaagaatccatgaacagaagtacctctactttcttttgccacacaaatgcaaaattcatgtcacggtatacaaatacaaaagagacttatacatcagttgtgagttagaaatgtaatgtatctaaagcagtgaaaaaaaaactttttcaccatcagaatgcactacgtcatcaaagaaatattggcggtccgattttctgttacgaatgatatgagccgtcaaattccttgattggcaaaacatcttctatatccttcgtaaaagttctttcacaatcaaacccttccacatccctgttcttattatttccattttcacccctactttcagactaccacgctgccgtgcgtgccgcttccttctcgcccctcgttgcaccgccgccactcttgagaggccaagacgccgactccttctccgcccgccgtctcttgtgattgtcttctcctccccaatgcaaccaccgcttcctccactcccactcccgtcgccgtcacgcctcctagccttattccctccccatctccaaagcgtcgcatctcctcccaatctccaccacattagttgtgggttcgtacttccatgaaaaataaacaggcccaacaatatatcacgcagacaaatcaatggtataggtagacttattgaattctgcctaatcaatagtatagatagacttctcatcccttttaattttatattgcaatctacaaacaaatcaatctaaactttttaataactagcacgaaaaaaatacatgtgtgttacaatggaaaaactttaatctatcatgctaaatcgtgcaacaagtgcttagggacactctgccgccgcggcaccgcggggccggtgaggtggtgatgctagctcataggtaccggttcgtttgaaaccgacacctattgattgtcccacatctttgcttggtggaaaatcatgaaaacggctacctttgagtaactgttggtgaaaacgactacctttgagtatatgtaggtgctgattttaaataaaaccgacatctatgctgtgagtaccattttttagaagaatcaatagctataatatatttataggtctaggtttttaaaaatcgacacatatactaatattgtagttgctggttttaaaaaaactagcaggagctgaacgaatccaactaaccttatctactcccagacatccttatccccacacttgctcccactccttcctcctcctccataccgcctccaacgcgcctcgttggcctcatcgtcgcggccctcctcttccctctccctctcgcatctcccccgcgcagcggtggctgtggctccctagcggcgtgacggctcgtgatctggccctcgagctcaggacctccacaacggcgaggagaaggtctagagaggagcagcggcggcctccccgctctcccctcccacccctctcatctcatgtgtgatttattttgtgattttgcctctcctctcattacctaagtgatttattttgtgattttcaattgaattgtctcgtgtcctgtgatttattttgggatgattttttgatgattccgattatattgggatttagtttttaggttagatttttgatgagttgggcttggttgtgggatctttagagcggacccacgttgacacgggcagacgacagatgaagcggataggaggtgcacacgatgcggacgacagactaagatggtcgaaaaacctccctgaagttttacgtattttttaattagatataaatgtatactcgtagtatatacatccagtaaataataccataaaagttgttaaattttaatgggcctaattaatactgataaaataggagcatgtagttatcaaattcaggtggggaaaccctcccctcctgtcaccaataaaaaaaagagtatatctagcataaagttgtcaaatggccagagttgattcacaacaaacctacgaatccaaccatttggaagtacctggtaataaaagagaagaacatcagatgacgtcgttccaaagcttagcaaaagttcggtgtgaatcttattccagcacgcagcagctagcagttgaaagctgaaactaccaggcaaagtgaaaccgatgcacccagccacccacgcacacggctccaaaatttgtaggccaacaaaaatgtaccgctatgctaaacagtaaacataaacgccttccctaacctgcatagccgagccgttgatccaccagaacttttgaagcacatctgaatctgacgtgaatgtatgtacaattgtacaccctgtatccgactagttaggacatgtacaatgaatattttttaacgaatctaacactttagagtgtgccaatttcatgaatataacatgagaaaaattgtacagagtaaaaagtaaaatttttatacgaagagaaaagctgtgatataaattgtgctcggtctcaggcacaactgcaaatgtgtgatgatgatggagtgagcttctgaaagttgcatgtcgcaaacttaagacgacagttatgcaattttttactaactatagatgaagattcacaaatagacttgaataactgttttctcattatcttagtttggtcacttgttttatgctttggtgtgtttaattttatttgaagtaaactctttatttctttattgagtgctagattgtaatatttagctatagctctattaatcaaagggcgggatgtatctattccattatttaaaaaaaaattatgccaggtgttttgctcctactaggacccaagttttggcctctattttcatgaggaataagttcactttgggtccctctatttgtcgcccagtccgattttcgtcccttgactgcaaaaccgggtataactcgtcccccaacttacgaaaaccgggcacataaggtcctaaggtggtttggatagcggttttggctgacgtggcgtctacgtggcaggtttgactaggtatccgtcccatgtggcattgacgtggcgtttacgtggcaattatatctcggaaaaataataaaaaccatgggcccacatgtcaactgcacaaaaaaataattttaaaatggtggggcccacgtggacccacatgtcagctacacaacaaataaatatggtggggggccccacatgtcattccctctcccctctcggctctctctcctcttcttcttccctatgcttccttctctttcttctctatcctctctctctcctgcatacggtcggcacgaagaaggccggcgcggcggcgcgacggcggccagagcggcgacaaagagcctgcgggccggaggaggatggaggcagtgggacggtgagggaggagcctgagtgacggctacgagggcgcgcgggggaaagagggagggagaggcggtggctcggaggtagactgcgccggtggcgtgcgaggtcgctgcccgcctccagtcggccagcgcgtgctgcctcctctcaagcaggtcctcgcgagccgccgctcctctcccgtcggccgccccgacgagctcgcctcatcccttgcggcgctcccgtcggcctgccctctcgccggcgcggcgcgctgcctcttctccagccaacccccgcgagccgccgctcctctcccgccggccgccccgacgagcttgcctcatccctcgcgtcgctcccatcggccgtcctctcgccagcgcggcgcacccccgcccttcttcctcccacccgtcggccggctcgacgagcttgccccctccctcgcggcgctcccgtcggcctcgtctcccaccggccaccctgcgtgtcacaaacgactcctgcggtcagtggagtcgaaggcgtcctcctgctcgtctctaggtccctttgagcgactcctggagtctggcagatacgtctcgccactgcccggctctgtgccactggaactgctgctgctgtggtcgcggctgccactgggagtagcagacaaccaacctccgttgccactggctggacccctggcggctgacgctggagcgaaggagagagcggatgcgggagctggcactggaactggagctggggctggagctagagctgcgggaattgcgggcggaggtgggttcctgggcgcaagctgaatgcgcacgggtgcagtcgtcgtcttgcggggcgtggtgcggatccggactcttcctggcgctgggagacccttcaactgagtattctccttcttcaggcgtgctatctcatccttcagagctatgatcctcactagcttcccatcgttcaaggccttggacgccttgtgcagatccgagtgcatcctgtccattcccctcatcacagcacacatgtgaccaaaggtggtgtcgttctcgccagctgtcggacggaaagtactgacctcatcaccgctggctcgacgagggtgaaatcggtacgccgtgtcgtggaagatgtagttgtggcgctcccgtagtctggccatcatcaggtatgctgcctcctgacaggcgtgatctgctgtgcctccggatgcctcaaccaccatattagctaggtaggtacccacgtagccatggaccttcaggcggacacggtgaggaagctcgccactgagcggtggaacagtcgtgtactctggcgcgttggggtagcccaccaccagcgtcatgcgtgccaattctgccacaaagtcatccatgccttctccgcggtggttgggtgggtggtcggccatctagagaagacaaaggagtaggatcaatgcatgctcaaatccaaatttaaataaagcaataaaggactcaaataagagaaacgaataagagcggaattttattcatagatcattttgcatgagagcgaataaataagacagacttacataacgataaaataaatgaggaaattagatacatactaataataacaataaaaacataaataccttgcaacccatattcctgagctaggacctaatgcatttcacccatcaaatcccaactgactgacgaataaatctcaaataattttactaaaaccctagactgacttgttttgacaaatctcacttaaacgagcgaccaagatttttctcttgaaccacaagaacatatcccaattttcccggaacaaatccaattgcaaagaacatatgcaatgaaaaggattcagagggctcttaggtttttccatttggcttgtcctacggtcaaggtcggctctgataccaacttgtcacgcccggaaattcccgaatagaattccaagcagaatgtgcattaaaatccccgtccaggaccggccgaggtacacaaacaacaattttgacattcagatccacgtcttacaaacatcataaaagtcttacataaatgcagcggaaaaacgaaagataacaggagctaagccttgacttgatctgcagcgggaacaccactccacaggcatcctcgacggcacggatgaagcctactcctcggagaaaccaccatctgacacatactcgtactctggggttggggaaaatagagcaagactgagtactacccactgtactcagcaagtcataccggaataggggtatgatgcagggaattatcaaaggagagctagagtggttcatttgcataaagtgagcatttataaacagaagttgaaagaattaaacagttgtaataattaatcatattattcatccactgtccaacgctataccacgttgcgacaggcccaaccatccacctatactatccaatttcattagactaaactagggtgagactaatcacggtgaatctggttgaccgtccataaccgcgggcacggctattcgaatagttttactctgatcagaggtgtacaactgtacccacaagaggccggacaggacccttcgcataaccccctctaaccaagcacaccacacctcaggtttcacccccactcctcgcaaggcagcgggcagtcccctctcgtgcctaggtgaatctggaagccgcataggccgtcgcagggcccatctaaactccatcacgcccacccttgcctggatgcgtcggctagagaaaagctacactacaagcccagccgttgcccacgctggcttgtggtaagtacgataagttcttccagggcatcccgcgaaccggtccttaactgccatgggtgcgaccaacaaaaccatgcacccacagcccaccatgtgatttattttaattaaccaacaccgaagcggtgtcactaatccaacattaccattagaacctacagtctaaacattaataggatttttccccaatgtgtgctagttgaactaagcatggctaagcaattcctagtccaaagtctattcatgttataccccaagctaacaaaggagcatgatatcaaaatagcatggctgtaacaataggtaaacatcccatagtaacattataaaacaatgtagtatttgaagaaaaacaatagagcatttgcaatataggatcaacatgttcaagtgacaggcatgacttgccttgctctgcagctggaggaacctcggcgactatctcaaagtacaccggagcgttggaagaaccggaatctaagcgacatacaaagcaaacaatgcaaacaggctataagactactgaaacagagaacaaaaccatttttaatggattctacacatttttcttgatttactgagacttgaatgggcttaaacggagcacggatgaattagttatgaattttagaagattcactgtgttgattactataaaaaaagtccttaaatcatttattgcgcattatgtcccagggctgacgtcatcaaaaagggggagtggtgccgacaggcggggcccgcatgtcagcgactcaaggggagagaggggcgccggcaagtggggcccccgggtcagcggctcaaggctgccggtccaccggaccgacggcccagatcgcccctggggccgatcggatgggcggcggcgacccggctcggctcggctcaaggccggccgaccggccacggcgatggcgatggcgacggcgcgcgcgcgcacgcgttgccggcgacggcaaccggcggcgcaaaggcggcggctcgacccggcgcggctaggagggagagggaggggaataaaggagggggaatgcctcaccaagagtggccggcgtggaggaggacgacggcgaacggcgacggcgagccacgggaggacaacgacagcgggcggacgagctccgagatgccctaagagaggcaaagagagagattagagggagaggggtggaccacggcgagcggaaaccatggccgaaggcggcggtagaggtggtgctcaccggagtgcaaggggatgcgggttccggcgacggacctcgatggaggaggggcggacggggtaacccttggccacgcgaacccggcggcggcgacggcgtggtgcggcggcgagcctagcggcggctagcggcggtcggagtagcggaagcggcggcggcgggtggaagcacggcgcgggagcgatggggagcacgagggagttcggcgagatggggaaaaagagagagggagtggcgatggagcttaaataggggaggggaatcccagacgtggccggtaggggcgggattccgccggccaacgcggggaggtggaggtagagagagaggcgggattcggaattcgaatcccagccatctcgggcgcgggcgcgagtgggatagaggaggaatgggtgcgggaggcgcggcgcatgcgcgggcgtggccgacgtggcccggaggtggcggggacgttggcgcggcggcggtttcggcggtggtggcgacgtggggcgggcggccagaggaaggggacgaccccgacaggtggggcccacctgtcggcgtcccggggagagagggaagggaggcttgggccggcccacaagaaggagggcgcgcgcggcggcggggtggactgggcc

SEQ ID NO: 74306 - DNA, 1532 bp, Oryza sativa
caggataaagcaaccatgcttgaagcctacaacagatcactctaacattacaaagccacagacattcattcatttgactgacaatgatttattcgtgcattaactctttgcacatgccgtggaacattggacagacaattccatcatttctttttgcggcaatacgtctacacaagcgatgactaaagacacagtttgacaggccggggatctgttggtataccatttaagttgaaaaattgagttgtacatactgtacatgttgtcagcgtagcatattctttagactgtaaggccccaagccttggttttgtatcatccctgccaactcaacctaggagttaggtaggatttttggtgtaatgctatcagatataccgagagaaccgatatgtgctgattccccatcagaagaccatgggaaagctctatgttagtatatattgtccatttgtcctatgtatgagctgccaggtgacttgttctgttcttgtcgtatggataaacattttgtcacaacattctcttgtcctagtatgagctaccattggaaagtagcagcattttattctcccgtgaaggttattctcttctcctgcctttttgtgtggtgaacattatttttctggagaaaacagcttgttagaatcgtcttgtagcgctgggcttttttggtgtatccgcatgattgcgatgataggtccctggacaagtatttttgcagaaactttcggtgcgtctgtccagtgggtaatggttgtgctggctcgtagtcggagcagtagaaaactagaaatcctaaacaagttggtgcaattattaaaggagaagctctgaccaagctagctggagctgaagagctggagaagatctggcccgaggtgctgacatttgacgctttgtggcgaatcttgtttcagtggttgcgggacgcacatgctcacgtggtcggcctttgcaggggtagagttcaattttcactattcaaacttcatcgtagacatagaaagcttttgttccacacagtgcaaaagctggaatagctcagttggccagagcgtatggctgttaaccataaggtcggaggttcgagccctccttctagcgattttttttaatctcatcacaaaaaatgtaactcaattgttttttttactctttcaaaaaatgtaattcaaatgtatcacaaaacaaatttcaatatattttttaatgtcatcacaaaaaatgtaactcaaatgtttttttactctttcagtattttttttaatctcatctttgcaatatctttttcactctcataataaaaaaacttttttactctcattataaaaactgtaattcaaatgttttttactctttcagtaatttttttaaactcatctttgcaatatttttttctctcatcatcaaaaatgtaatttcctttaaattttttaatctcatctttgcaatatcatttttactctcatcataaaaaactttttttactctcatcataaaaactgtaattctaatgttttttactcttt

SEQ ID NO: 74307 - DNA, 12708 bp, Oryza sativa
aaaatgcaatttccaatattattatgttctttagcaaaaatgtatttgttcttttgcgagcctaagctcatcagcagaccagaataatcgtttcagttgcttgtataagagcttgccaattccacttccagtgctttcctccgaattacaagactgataaaaagttgaaaatttagtggttctcttagaacacaaaaagaaaatagcttcacaagtttagctacatggcagtacaaacaacaccgaaaccgctaggattttacacttggaacaagccacgccttgctgaacttgctcaattattatgggatctcacatgcacacagtacagttcgtccatgtgccgcaaccatggtgccttgcagctaagaacacacaattaaaaacttcttgatgagttcctgaaacagcaaagcaagaggagggacaaagtacagttaattaaaacgggagcagttgtggtgtctgcatcacatgccgcttgcacgttataaaaaattcctgagtgccaatcaggtgaagcatccgtgggattcctcaacggtaaatgtagatgcaatgggtcacattctcgtaaggataggagttatattttcaatatgctgcagtgatatgatttttttagtgttctaaatcgtaatgcaaaaaaaaactttaagttgtcaagaagaatagagataccatgcttgcaaattgagaattgcgatgttcattctgatttctgaacgaaaaatgtttggtatgaatatttgcagatgcaaaaaacaaaattcaatgaaaattttggaggcgttaccgttgatgagagggagaggttcttcttcttgacatcaactggcatcccttgcccgcagcacaatttgcggctaagcatcataagctcctccagtgtaaatgtgctcttgggaggactccacggattcttcagctgatcatcgtcattagcaacctcccagcttttctctgatggtgcccgtggaaactgaaaatctagcgctgaagtgtctccacttgagttgctgtaagcttctgtttctgaaaatgaataccatgtgccatggcgactggaaccacctgcgcattctgcagttccagatgcttccttgctgtctggaaatccaaatgcttccagatcaaaccctagagaatattcttcctcactttcagccaagaaagggtttagcgaggaaggagatacagaaaaatcagcatgatcaaacagcggatgaaaaggagatgcatcttggagaggcttcccgggcttttcttcccactggaagggcacgctgacgacaagtttcgccggagatgggcatgagatggctgatggcactggattggaaatggcccagtccttttttggcgctccaggcttcacctcccagagaaatgggactgaaatctgctgcttgacgcgctcccttggattgaattcagacagttcaagctcatccattttggatgtgtggttttactggtttcggaatggaatttgagctgttgtagatctttcaggcactgctgatataagtaggagagaacaggtggtttagatgagctgctcctgtaccacaatgctcttgttcaactgatccttcgctaccctgcaaacttgacacacaattagacagtaccaactaccaactcctctttagctcagacatgcagaaagaggtactcaattcagagtggttgatcttacatttgcattttccacagtactagaaagaaaagagggtgtagggagcacccgaaaaaaacagagataaatcctcacagggtttggtaatttgaccaaaataaccacttattcagatgcaaatctacattttacaaatgtgactggggacacaataaagaataaaaacaatgtgatcatctgttcaaaaaccagaaaacgttttttcctgttttaacatcctattctgctactgtaccgtgacgtcaggagatcatgaattagttctaacagactccaggtactgtaccacctctgccatgtttggtcgggcagatggtgtgttcgaagtgcataccagacctaatttgagcacttggactaattcagcctcaacaaatcccttcatgctccgatcaaagcagtctgacacagtcccatcctccaatatcgccctaacataatcacgcagaaccactgctgtcgccaccccagggctctccactggtttcctccctgtcacaatctcaagcaacaccacaccaaagctaaatacatcactcttatcactatatctcaagcttggagatgctaactccggggcaatgtacccaatggcagcatgcaatctactcaattcatagctacctagaataggcaaaagctttccaaatccataatcagataatttagcctcaaagtctttatctaacattatgttggaggacttgatgttgagatgcaggacttgtggtcggcagtcatggtgaaggtatgcaagtgcccgtgctgtaccgagtgcaaccttgaacctctgctcccaggagagaccaactctgctgctgcttccggaaaatgtatgaggactcccgtgaaggtggtcgtacaagctcccgttaaccatgaactctgacagaatcaattgcgttgatgatgaccagtagtaaccctgaaaagcaaccagattggggtggctaaggttaccaagctggcccatctcctgctcaaactcatcctgacttctcacccttcccagtgtttccaacttcttcacagcaatggataaaccattctcaaaggtggccttgtaaactgtaccaactgacccaccaccaacaaggcagtctttgtcaagcagtgccttagttcctgcctcccaatcttcataccttgaaggcaagctcttgctgaaaagcaccaactttccaataatggcatttgagccttgtctgccaggagatgcaagcatcggtgtgctctcggactccagcacctcatcctcctccttcccctcttgctcctctttactcctcctcatgtaagcctttatgttcatagcacaaacaatgcaaactccaataagtataagcgctgctgcgactatgacaattatgacagacacagccaattgtttcgccctccggctagccccacacagattgttcagtggaggtccacatagtaatgggttacccatgaaggcggagctaccgaaactctgtagaactggcaaggcagggatcatgcccgagagtccattgtaggacacattgaaatgggtcaggttagacaggttcccaagctctgaggggattggtccagtcagttggttctctgagaggtctagaagatcaaggtttgtgagctgtgcaagtgtcactggaatcccccctacaagatggttccgatgaagatcgagcaacttgaggtaagtcaagttgttaagcgtgtccgggatcactccttgcaattggttgccagacaaattcctgcagtagttcaaattagtctgtcagtacatgaaaccactgtaattcaaacgaattggactgggttgcgtagttaacagacactcacagctcaagcaagaactggcattggctcagggacaccgggatgtctccgatgagagcaagaccagcaagatctagtgtgacaagcatctcaattcctccgagctcggcagggattgaaccggcaatgcctgcatttcctgcgagcctgagcactgaaagcgacctcaatttcccaatgcttggtggtatgtctccagcaagagcattcgtccccaaatccagaaccctcaggctgcggcaattggccacactctccggcaccggcccagtgagccggttccctgaggcgtcgaagtaggagaacttggtgccgcacgttgcaatgttggggatttcaccatcgaaggcgttggacgagacgttgaagtaggtgatgtttaccaggccaagaaggccgaaaggtgccggtccggcgaaatggttgctcccgacgtcgagcaggtcaatgctccggcaagcgttgagctttccggcaatggcgccggagagcgagttgcttcggacggagatgtagctaatttccggcggcgcgcagagctgatccgggagctcgccggagaggcggttgtaggagaagtcaaacccggcgaggcgcgagcagttggtaatggcggtcgggactggccccgtgagggcgttgtgcgcgagggagacgtaccggaggcggaggcatgggtcgaacagcgaggcggggatctcgccggagaacgcattgtaggagaggtcgagcaggcggagccacgggaacgcgccgaggaacggcgggatctcgccggagagcgcgttgcggctgaggttgagcttgtggagcgtggggccgagcgcgctgaagctggaggggatgccgccggagaggccgttgccgaagagcgagacggactcgagcgacgccagccgcgccacgacggggtgagcttcccggcgatgcccgcgccgtggacgcgcaggcgctgcacggcgcgggacgacgggtcgcacgtcaccccggcgaagtccacgcaggggtcccctcccgccgtccacgacgcgagcgcgccgttcgggtcggtcacggcggccttgaactccagcagtatccccctctccgccgccgtcgccgcgtccaccacccccacccaatgcagcaccacacccaccaccagaacggccgccgccgccgccagcgagcgcgtctgcctcatcgcgacagctggaggagcaggcgcagtgcgagtgcgagcgcatgcattacccccgccgcggtggcgacggcaccggcgctctacttctactgctgtgactactgactactactcccctcgtactgagagagagagacaaggcgcgccgagtaaaagagtggcgagtaggtggcggtgggtggcgtgcgttaatgtgcgggtggtgctgccgcgcggccatgagccctttcttccttgacgtcggttggccagaaaccacgttcttctgggtgtttggtgcgtggcgcgcgcggcgtttaccttcaccttacccgtggaaatctaggcgagacgcgcggtcaaaccgaaacgcgaacgcgaacgcgatcgggagcagcagcgcgcgcgcgcgcgacgtggtttggtgccacactgccaatctgccggcatgttgaggtgggcaggaagtgcgcggcgcaggcgcagcgaagggtggggtacggcatgggacgcgcggttggggaggaattttttctcttcaattcgctggctgcgcagccgcagccgctgttcacgtcaaccgctcacgcatcgtgccgctgttcacgtcaaccgacggccgcggacgtggtgtcgttgcccgtttcgcgttgcgtccgtataggtcgtagtactgtggcctacagggaaaccatgggtacaccacggatgcataaatgagcttattcactgctcgtccgtcgtgccggtacggtgctactactatggtgctaccaccgtgctgcggctgtacgcacagatctacagtaatagcaaagctactagtactgctactactagtattcattcaagcgtgagtggcaaacagatcagcatattgctgcgtgggcttcttgtatcatccgccggcgcaactgcgcgagcggacgatttaactactagctagatgtgccatctgccatgccatgccattgatgggaccaacataagatgcagtaggcatggtcgcatggagaaagtttgttggggtttggagttcagcgtgcctttctgtcggcaatgattcgtcggaacgtatcatcatggaccgacgtgcttgctaattaccccgatgatgcgttccagtgccatggctttcgactctcaaagcctgaactgcaaggtctctgtcaagatttggttaccaacctccacaaaagcattgccatggatgaaaacgatgccatcaccgggtccttaattacctcaaatagtaccagatccttgaaaaattgaaatgaacagaaacggcacgatcaaacttggcggaaatgaaggaaagaaacgtgctacctcatctactctactctacatgtctgtttcagaatagaaaggtctaatctgttatagtgctttgctacgatacccaagtactccctccgcccctaagttcaaatttacactaggggtaccaagtcctaacatctaaatcgatcccggcaaccaaatcgagccatcaaattgttcatgaattcgatgggcatgaagtaatgatctagcaatgtggcatttgaggtctgaagtactccaagttgaacttaattattcttctgttacccaatgtgtacaaacatatcacgtacaagaccacaagacaaacattatagcttacactctcatcgtctacttgttagcttatcagtcataagactcacaacaataaaaagtttaatttcaaaagaagttaaaccatctttttaaggagtaaagaggggttgtggcatcttccccctctctccccagtggtgacctcagatgacaaggagaacacctcaacggtgacctcagatgacaaggagaacataagctaggccatgatagtcgaggtggtagcatcaagtgatcaaggaaatcgaggcttgttcccgccattactgcttgtttccatcctcgttgcctccgccttagtcgttggatcaagaacgagctttagcagtagcactggaaagctccagccgataggaatgagctcaacggcaatagaggtaactatagctgatgatagcaataattgggtggcacggacacaggtcaatacacatatgtagatagaggcgacaagctcccaagtggtaagctctttacctctcttatcatcagctttcctcctcaccccagcctgaaatgctggtgataaagtaacatcttaccagcagcaacgcaaacgccttttcttatatagttgctttccactctcaaaacaccatgtcctctatggactacaaaacctttcttcaagccattttatttttctccactatggtagctctggttccgacgtgggtcaatgaagcttgtgtacccttgaatgttgaccggtaagcatggcctaaggtccatgtggtttcttcacatggattgtatatgttcgtgtttacaagagaaacaagtgtagcgtttttttttcaattgcaagaaatacgcaaacgtgcgcacaccatgcacaccgcgctcacatactagtaagtgtgcccccgaacacacgcttaaggagatggagactggcaacacatccttggacccatgaaattcctgatgaaagcatgctaacatatgattaatattcgtatacaccagaattttaaccctagtgagtagtcatgcacccatgacccaactatcacacgagtgatgctttcctgtctctgtagcaaatatagcatttgacttgacaaaaactttacatgtgtcgaataagatttgcactattaaacacaagattttcaggccaagtgaataaattaccatatcataaaatcagataatcgaaaaaaaaaatctaaaatctcatgcgtcacgagcagaggggcttgttggtataaaaagtgctattgcaactgctacgcaatgtggactctggttccttctcccgcacactacgattcggtcaacttgacgcctcgtggaccctctctggtctccatctaacggccacgatggtctaatctcacccccacgcgaatctcagaacttgtatccctctctccgtcttccaccacgacccgccacgacaaacacccccttcccccccactccactccccttccctacccgcccccgtcgccgtcctccttttcccgcgaatccgcgatcttccgccgcgcgcgtcactcgtcgacccccctaagccgccgccgggcgatggcggcgctggacccaccgagcgagctgttggtgacgccgaagacggcgaggaaggacgaggccgcctcctgcaatgcggccaccccgcccaagccctcgccggtgtcccccgaggagatgcgcgcggtggcgcgcaagttcgccgagcaacccgtacagaaccccgacgacggtgtctgggctgtcctgacggccatctccaagaatgctcgcctgcgccctgaggtccccctcccttaaaccctaaccctaaacccccaatgtttccttttgtaactgctagtactaattcagcattgccatgaaaagaggttgagatattgaatcgtaaattgctgagttagctcccaaaaaagtgctgagttagctgattggagccattttgtttaattgtagggaatgaacattcttttaagcgccgatgagcactacataggccgtgccgttcaggaatccagcttcaagatttcctctttgcagatcagtgggaaacattgcaagatatatagggacactgtgttgggggagcttaaccgcaatgaacctgtacctgttttcctcaaggactcgaggtttcttgtgcttctggttatcttgtcatgtattacaataaacagcaccctttcttaaattaacttattgtagcactgcagctcaaatgggacattcatcaactggaccaggcttaagaaaatttcacctccaaccaagcttaatcacggggacattatatcatttgtctccgctcctcatgacagtaaagattctgagcttttttcactttctatgatccaactctactgttcttataaacaattatgataaattcattgccttgtaacttttttagagctttcctgcacatggcctctgctagtttacctctgtgtacttgattatatttactgtgttttccctgtttaccttgcattgtttttcttgtatataatcgatatcgaactttttttggccatttatattgcgtgtttcatctacagatacttcctttgcatttgtctaccgtgaagttaatgctgtcagtcgtgcagagaatgaagttaccatccttaaaaggaagtcaggtaagagggaacatgtgctttcctaagatttggtgattacatttttccagctacattacaagtaatgatatatgtaccacaatttgtatttgatcttaaagaggatattcattctgaaagaaagagactaaaaggtcttgggattggttcctctgatggtcctgtttcactagatgatgttcgtcggctagagaaatctaatgctgtaagttgaccccttcaagagttcaagatggtagtttttattgccatgaaagtttcttaaccttattagcaaaaatccatgcaggagctcagggaacaacttgaggaacatgttgtcacaattgagactttgagaactcaaattaaaatatctgaagcacagcatgaaaaggtatatcctacgtctgcatcttggtgttgtgtctcttctaggataatcgcccttcttgtactgcgtgacactgtgctactgcctactgccacttctaatgtttctctccactctactaaattaatgatgatattccatattctagtgtcaagaaattactggtagtgttgccaaactatctaaatatctaaatagtgttctgtacggcttataccatccctctcctagaagtgaatgtactgctgcttttccttttaaatcgccttttgttgtcaaagactacatttcttgaaaggtgccctcttgatttccctttcttatatctgagtcttctgcaaatctgatgatgtaggaattgaaggagttgaaagagattacatcgagtacttatgttgatcaagctaaatctcttcagcaaacattagagtacaagcagaaacaaatagattcacttagtacatcaaatacagagttacagaattcaataaaagatctcgatgagaggcttagcgcatataagcaatcacgtgctgaggctgatgagataattcagaggttattttttctgttcttttgattaatgctttgtggcaatactcataacttttagttttccgtatatggtgttattagcgttaggaaaaagagaaaaaagtcgcatatatttttcagtcgtgatcactaaagtcatttaaaaacactggtatatttcacccttttgtttcccaaattacaggtatatgtattgtagtatcttacagcatagttgtgttgaactgggacattttgctggtttacttgagggtcccatatcttagagggcacatggattcagcaaaccgtaaaatactccttgtttggaataaaggattttgatagattttgataaaacttctggagggatcgtactgcttcctagaaaattcccgtgaaattcatgcacagatatgcccaagtattattttatatagcactttagttgatccagggagaaaagtgagatgttcttctggatagacatttaggctttttcagcatataggaagtccaattttaacatcactctccactcattcaaacgttttcagccagaaatcaaatatatgtgagcttgaggcacagctaagtgaggagagagacttgcgaagagaggagcgtgataaggctgcagaagacttaaagtctgcactgcataaagtgaatgcagaagctcaagaagaaatcaagagacaagctgaggctcaccttagacaacaacgggaacagaaagaagttattagcaagcttcaggttttaccttttctttccaattctagggaatgatcaggaattgggaaataatgtattgcgtggacctttctcttttattttcaggaatcagaaaaggaaatccgtttgcttgtggaaacattgagatctaagctggtatgcttttttgctgttgtttatttgaacactcattccttttccattctacaattatttaccttcacattcaggaagatactcgagagaaccttgtcacatctgagaaaaaagcaagagagctggaagctcaacttcaggatgaacagcttgtatccgccaacaatcagaaggttacagtcgtaaacatgtttagagctattaagcccaagttgtttcatttgtagttcattgaatgtatgtaacatcttttcttcacttcctccccccttgcaatcgcagaaatcagataaactggaaatggatctgagaaaagtgaagaaagaacttgaacacgagaaggtagaaaaagatttcaagttcctctgatgttttcatcacataagctaatctaccctggtcttcgcatgcatagaggattgctcttgtttacttactagctgattatctgtgttcttctgttagcaggctgctcgggaagaagcatgggcaaaggtctcagctcttgagcttgaaatagctgctacaattagagatctatcaatcgagaaacagaggtatcaaggagcaagagagagaattattttacggtaagaaacattgtttgagtttcatatagaggtgaaccccaagtttgtgaaactacaaatcagcttaccttttcttttgtttcctatgttgcttactgcagggagactcagctgcgtgctttctattcaactacagaggaaatatcttctctgtttgcaaaacagcaggaacagcttaaagcaatgcagagaactctggaggatgaagagaattatgagaacagtatcatgggtgatgatctcaataaagtgccactggcaactgtaactgctgacgatgcccgcacgagagtaaactactcaaaaaatacaatggaagcttctggtgcttcaacagagaatacccaggcaagtgaacaaagttcaagtgatgattccaaggagactgaacaacaggatgattttaccagagttgaaggggcaaacactcaagaggtagagtgcaatagtccagaaatggcaacagagagattcaggtctgattctcatggtgatctggctgctacagctcctgagctagagccaacagatactgagcaagttcccgagacagaaagccaagctggtaatgttggctgtggtgatcacaattcagctcttcaaagatttagtgaaatgggaggtgataccatgcagctagatgatgaagtgcaaccacaagagaatgatgagtccatcttgatttgcaaagatagagggcaaccacaaggaaatgaggaagcctcgttaaccctcaaagatggcattggtcactattctgaagaaaaacttgaggttaactgttctgagagaaaacacgaggatacccagaccagaaccattggtacagctgatttgttggcctcagaagttgctggtagctgggcagtggaaacaggtccatctgtcaatggggagaatgagtctcctaggagcttgggggagactacagaccatgccggggagcaggatgaaaatgtcagagggagctcagcagctgatgctttagtgaactctgatggacaggctgctgggagccagagtaatattgatcatgtcatcagtaaaataaccgatcatcatcgtgttcttaatgctatgatcgaaattgttgatccagatttcagaaagcaactcccaggaagtggtgttggaaaagatgatctgatgtctgatgcggagactgaggaaggcagtgaggcgaatgatacagatagcgacagtgaggaggccatggttgaagattctgttggataggctataaggcagctacttttcctcgtaaatatcttaaccattttaccctgcactcgggtatgagcttgtaccatttttttcaatgtgcatttttttttcatttcatttcaatttctctttat

SEQ ID NO: 74308 - DNA, 17870 bp, Oryza sativa
aaaaggaggttcaccaaccaccacctactagaaaaatgcaaggggattattaacaacattaaaacaaatgagttaggaatatgcgaattgcgctcatctaaaccaatattctctttccatgaaccacccaaaatgcctctggaatcattcttttgattcattgttcttcgctgcaccgttctgttgtgactgctgcagttgatagaatggtatctgcgtagcctgctgctgctgcagttgaaacatctgattctgagcattgagttggatctgctgagctagactgctggacgagcaagaatcgccgagctcagcggtggcgagttttaggcgttggacttcggttgtcagggcctcattcagcgctgttgaacataagataatggcgaagcagtgaggaactgagcatcaaaaccagaactaacaagtgaacaattcctgaactctattcgtggcatactttcatggtgcagtgtttaacagtatattgcaataggatgaattcatcttggtaaaaatacagctactcataacattaatagatagattaacccttaaggatgaagtcatcatgtaaaaggcagtagacatcctagatcagtgtagattcttgaaacgaaagactccttgtgagagaaggaaatgtggcaatcacatggcaatatggcatccaaggagaaacatttgatacgtgaaagccctgaaaactagggtggcaatctggagaagtcaccgcagaatattgaatactccaaaacattcttctcctacacgggactgcaggctcctaacatgctagcaactaacggattcagacttcagagacgccatagggcatactatatattttatctttgattgggggaaaaggcacgcacaatagcaaatcttcgttcttggatgattgctaaggcatgtcctcctccctaccagtagtaggagtacatactaacgaccaccggcttcccgagagaaaaatatatgcataaagaaaagctaactaccaacctccaagcgcaaaaacacgagattatggcaacagttgacaagcactaggacaaacaagcatgtcaacgtcaataacttacacaagactgttcatcatagtgccgagcacatctaaagtatcttatgacgttggcgagcacaaacatgggaggagcgagtgatcgaggaggtttaggggaggcacgtaccgtcgcgcagctgcgcctgctgctccatggcatgcagcctgaacttgagctcgttgttctgcgtcgcgagccccgccgagtcgcgctgccaaaagccaaaacagtcacagacaacgtaaacaaccgtgtggatttcacgcaggaaaaaaggcgatcaggacgatgagacggcaattgcacgagaaagcgggaaggcgaagggatcagtgcgtgttacctgcatcatcgtgagctgcgcggacagattggtcgcctccgactgcaggatctgcaccttctgctccagctccgcaatgtacctcatcttcctctccttggacctcgccgccgactgcctgttcgccagcaccctgtcaccggaggaagaaagctctcagcgatcagtcgatcgatcccctcatgtcgtagcgctcaatatacattgcaatcatcgatcgttttctaatcatttgcatttgcgagacgatatggatggatgggagagtgatcgaatattatttacctcttgacgcgctttgggtcggcgagcgccatctcggccagcttctcgtcggccatgatcttcttcatctcggagggggtgaactcgccgctgccgaattccaggctgaacctgttcggccccaacgcgacaccgttccccgcagccgccgccgtccccgccgtgaagttgaacttcccgatgaggctgtccatggagaggctcctggcgtgacgggccagcggcgcggtggccggctcccccgcggcgttcctcttgacgccctccctcctctcgccgccgtcggcggaccagaggcggatcccgccgcgggtgtcgtcggcgcactcctccgactcgttctcgctgctgtcggcgccgttggtcttgatgctgctcccgcggctgtccccttcgtcgtggcggtcgtcggaggagttgagcccgtccagcccctccaggttcaggtacgcgttgaacaggtcatcggcggccgccgcgccgccggcgccggcgccgaggtggccccacccggcctccaccttgggcggcaggagctggtgctgcccggccaggtacccgaacggcacgtcgctgctggagcggcggtgcgccttgcgcggcggcagcccgccaccacccccctgcgccgactcctccatgcacacgtcgccgcccgccgccgccgccgcgcgctgggcggcgaacacctgcggcggcgtgggcggcagccccgcggccctcggcttgttggccgccgccgccggctccgccacgaacgtcgacgccaccatcggcaacgacgacgacatgacctgcacgtgctgcggctgcatcagcgcgtcgccaatgccaccgttcatgatagcgagtagtaccagcttccgccccccccgcgaccgcgagcgagcgcggtgttgtaaaatcaatcggctccgcgaacgggcggtgcactgcacacacgcgcgcgcgacgcagcagcagcggaggaatgtgggggtttgcgttgcccggactggggatcgggtcgcttttaagggtattaagtcggcgtttggtgacggtgtttgtgaggtggtggttccggtggtgcggtggggttgcctgatagccctctccccgcctcaagtctcgtctcgcgtcacatgtgtttcaccatcagtttcacatgcgctacgcaccacttttgtaccgtcttacacccaggccagcttgcacactgcgccactgccccttgctgatttactggccaggggatggcaattttggcagccaccggcaaggcggaagcgacgaaacggatgcgatgcatatggggcgcgttgcgttccgttgccacccgtcgcagcgcagcgcactttccactggccaacctcggacgtacgtacgtgcgccctgttcgatcggtgtcagctgcatgctgctgcgaatgtggggagactgcccggcacgcaatcaaggcattcattcatgtaggtttctgcctgcaagtcttggtacgagcttcctgttggcctgttggacccctgctcattcgctagtcgctacaggcctctctgagacatgcctccctcttgcatggggagatcaatggcggaccttaggagaattttagagccatggactcaactacaactagtttttgctacgaaaatatcatgcaaaccaaccagcccaaggatccgcatgccgaatcagatcctctggcataacataaccataactttgtggctgacaagtggggtcatgtggcaattgtcacatgttaatttacgtcggaggatcatattccgctgcaaagttggatatttacatgtttacatttttttctagtaaaataaatagtatgctttcatacctgctgcacctagagttaaagctttatactgtttcgaagctggcaataaaatgtattcttccagtcataaaaacatgtcgtgatgtgttacaagctgtatgatgtttagttctaaaccttttcacacatatatgttttcacatttaaacaaaatagtcaattgtttattcctggggaggatccaaggccgagtggccatccaaattcgtgtaccttgagttaagctttcataccattttctatgctagtaaaatgtattcttctagttaaaagcataccattttgttgccagcttcatgatgtctagttctaaaccttttgacacacatgctttttacattgaaagaaatagttaattgtgtattcctaggagtggatccaaggcctagtgaccctgggcgaccgtccgagctcgtgcacctagagttaaggtccatactatttctaagctggcaataaaatgtacttttccggtcacaataacatgttgttctgttgctagctgcatggtgatctagttaacctttttcacacacatatgttttcacatttaaacaaaatagttaactgtatattcccggggaggatccaaggcctggtgaccacgggtgaccgttcatatatatgcacttagagttaaacttcatactatttctaagctggaagtaaaatgtactcttcctatgacaaattaaaaacatgtcgtttctgttgttagctgcatgatgtctagttctgaacattttcacacatatatgttttctcttttaaataaaatagttaattgtatatcctgtgagatgatccaaggcctagcgactacgggaggccatccgaattcgtgcacctagcgttaagcttcatagtatttcaaagctgacagtaaaaatgtactcttccagtcacaaaaacatgtcaatctgttgccaactcgatgatgtaaaaaaaaacatgtcgttctattgccagctggatgatgtctagttctaaacctttccacacatatatttttttcatatttaaacaaaaaaaagttaattgtatgttcctgggggaggatccaaggcctgccgaccatgagtggcactgtccgaatttgtgcacctagagttaagcttcacactatttctcagctggcagtaaaatgtactcttccaagaaaaaaaacatgtcgttttgtagccagctgcataatgtctagctagtttttaacctttttcacacacatatgtttttacatttaaagaaatagttaattgtatttttttggggggcggatccaagacctggtgaccccggacgaccgcccgagctcgtgcacttcaagctagcagtaaaatgtactcttccagctaaaaaaacatgtcgttttgtgaccaactgcataatgcctagctagttttgtttccacatttaattaattaaagaaataattaattgtatatttttgggagcggatccaagacctggctagtggttaccttcgggcaaccgtccgaactcattgacaagtcacatcaatgtaatagcttccatcgctgatgttcaatggcatccatataatcctttggacatatatgtttgttcatgttctaaaagatctctagattcgccaatgtacattcacacacttaattagtcattcgtacatgcagcgtgcttaagtttctaggcgcataaggcagggtcgactagtatcccttaataaagcttatggtgatatgatggtggcattgtgtgaactgtgaaggtgtccaattatcaagtgtacatggtagccggctcgcactgtctatatcatagctcctcttcttcccttctaaaattttggaaggatgccataatatggttttgaagtttcttggccgccaagctgaagccaccaccacactgagctgtcgatccgcgtgtatttgcagtcggtggtagtaacacgcacggtgcatcctgagccagtgagccgctttagcgacacatcacgtgcatcggattatcggaagcacacggtcaaggcaagacaggtattttgttagtcgcgattaatctacaacagttagggcatccacaatgtgctacaaaagtagtccatagggaataaactattccatttagccatttagtaacactgggcaactagtccatataaagaaaatagcaaaagatatccatatgcatatacactacctatatgacataaataatattatatatctctacttctctctcttctcctaatgttacattgtatccatatacattgtgagattgctatagttaaggtttatttatatgggtcccatctatataaaccacttttaacatatacattggtaatgcccttacatcatactactactacatcacgatctggtcaagtgcagagcattgcgcagccgcagcgcaggcaggcaggcaagcgcactgccgccacatggctgcacgaacaaaaaagctagtagctccaagcctccaaaggccggtgtggaagaagggagatttcacggttggaaaagcgacgacgaccgagagaaagcggcttttttgcggaggaaaccgtgtggaccccccccgtgcgcgcgctgccgttgctgccctgccacaccgagcgatgagtatcgagcaagcgactcgcgctcgccacgacgatggggggcgtccgggcgtagctccccgtgacgccttctcccgtggaagctgtgagcctctgtgaggcgaaatgtaacactgctagtagtagtggattattctattcggattctccacgggacgcgcgggcggcggccggtggtgccgaacacatcgcccacttttgttcgatccgcaagacgacgtgcctgccgcgccgggctgtcgtgaaggcgtagcgatggtcgagcgcgacacatggaatggatcgatcggccgattcggttatatcgccatcggttttgtctccgcactgatcctgcactggatttgggcttaatttgcagagacattgacggtcgttcttaagcgaagccatggcccgaccggctagctccaaggtcaattgcaacgaacgatcgagcaacacttgtcacgagcgtaggctggctgggccggagatgacgtgctgcacccggaccacgcagcacggggatcatccgcgtacatgtacgtacggactacgtactggactagttattcatgtcaccgaccaagcgcgacgacgtacgtacacctgcagaggtttcagaggaaatacagtaatttctgaattctaaccgagaataaggaacacacttgcagtttcaggccgtgacgccccgttcgcggtggcgcggtcgacacggcgagctagccgtcctcgtgaggccggcattgacatggcatgaaccactgtaccatactctctccgtctcaaaaaaaagacaaaccctagatttccgtgtccaattttaattgtccgtcttatataattttttttataattcatatatttattattgttagatgataaaacatgattaatattttatgcgtgatttgtctttttaatttttttcataatttttttaaataagacggacggtcaaatattaggcacgaaaaatagagtttgtctttttttttggtacggagggagtatataccactacggatgtgtgtaggactgactgtacgtacgcgcgtatcaatgccttgcttgctcgtgatcgatggccattgactactgggaggcaatgcgatttactgctgccgttccagtagagggtaaaagacgtcttcaagaagaggaccacatgggatgtggcctctgaggttgattagtcgccttccattcccaacagtacgcggtgcagcaacgtaccatactccagtaatttggtcgtgctctcttgtatggctacaggctacaggctacatcatgtgcaaacgactagacgaggatgtcctgcaggcttgccaacctcatcgtaatgaagcgcgtgtcagggcgatagatgcagagtttcttgcagcacagctcaaacgagaatttttgtatgaccacttcgaaagacttaatattcagccatgtagcacaaaggctttgtttagttgctaaaataaaaatttttcatccatcacatcgaatatttagacacatacatagagtattagatgttgataaaaataaaaaccaattacacagtttacgtgtaaattgcgagacaaatcttttaagcttaattatgccatgatttgatactgtggtgctacagtaaatatttgctaatgacggattaattagacttaataaattcgtctcgcaatttcatggggagtctataatttatttgttattagtctatattgtccgaatatccgatgtgacaatcaaacctaaaaattttacctaactaaacaattcctaagatacatagcgccaacatatgttcgattgatatttttctagcactttggcagtgtctccagatttgtttgttcgagctataaaaaaaagggtgtagctatatttatggtgccatatttttcatcaaaaaataatcggcatgtatttacattgtaagttcatagtgtatttacaatgtaagtctcaaaattacatatgtaagtactaaaattacatatgtaaattcaaaaaatacatactaattatatatgtaagtggggtgtaaatgagatataactactatgtaagtggctgaaaaaaaatcgactgtagcatatggcgccatatttctaacgactccggaaaaaaaatgtaaacaagaaagaatacatgggcttcagaaatcagaaacaggtcaagcctacagtctacactagcccaataagaaaacaactgaagccctactttgggccgagggggaacttaagcccaatttaaacagccaactcagcaatttggcctctttgtcctccgtttgaactttcaagggagaacggaagctgctacccgtaacatctctctctctattttttttctttcttcagagtttctacatctcttctttattgcatttgtgtgcatgcatctcaatatcttatcctcagactgtatatgcgtttctttttcaagaaaggaacagtacaatcactgaagactagctagctatcttgaagagaagagcaggaaaagactatagcgaaaggcaagcatacgtcaatgcagaataatgcacaatgggcacaattacaggatagaagagtcagagagacgaaagctagctagctaccagaggaggctgctatggatcgatcgcaagagcacccaggatcgagtgggctgcaatggatgccgctttttaacagagccttttcaccacagccatatattgttgtgtgaatggagatcatagatatacgaaactagaaagataaaaagaatggatggtaactttgcaggaaaagattgctcgcatgagttgagaactagctcgcaaggtgtgaatcatgtagatcggccgcccggcccggcctccgtgcgcggtgtgctccccacctcctccactgcgccgaaatgatgtaatgtacgtctccgacgcggaggaggagcatcaatcggcaaccgcccgtgtgcgcgcggtgtccagctagccagctgaatttggcagtgactcagtgagatcaaaggcaccgcccggccggccacccactgcattcagtgctgcagacttgcagaggcatgcaattgcatgcagtcgcaccttgtaagttttagtaactacatatcttaccactgaactgtcactagctaattgttgctctcgatcgtctatgtgatgaatggtccacttgtctgtctgccattaggccagatcagagaggatcttgtacttatgagctttgcgagctgctgctacggtttgcgagcttttctgtgccgtatcatgtcgtttctttgctcgtcgtcatgagagacgatcgatttgatagaggtagcgcgcgatcattccgctggttattagtccacgaaatccatcgatgcctcacgcacaccgaggggctgccagtttcctgaatgattccgttccagaagcgaacaacatggtagattttttggccacacagcagggaagctatcaagttaacaatcgaagttgattcaatttacttaactactctcatgcatgcttgtccggacaatgccatgctcacgccaactagcttttgagatcacaaccatggcactccataccctggaatggaacgggaatggaggccggcgagcaatgatagcaaggaagcatcgacaagccatgcatgcagggacagcatgtacagggaagagaaaggatgaagggaagaagaaaagaaaagaaagaaacaagcttgatgctcacatcacatgtatcaaaagcggtaagagtagtgtgcaacaagtatctatccctctatctatatatctatctatcctacatcagctgcccttttctcagtagccaacgtgttgtgcagtcactttccctttaccaacctccatatatggctgcagcctctgtccacgtaggagcaattcaatagtaactcgtaacaacctacgatatcgatccttctgatgatcccttgccgttcacctctcctcgcactagctagccgatcgatctgagatatactacatcaggcatgcatataagtcggctcatgtatatacatccatgtcacaccgcttcaaaattataagcgtgccgccaaatcaatcacacttgtgccgccagtgaaagtgagagtccagaaaaaaaaaatcaagcttagctttcttagtcagtcgggtcaccggatcagtagcatttttagcacgtcatcactcttacatcaaaggtaaataggctttttcttgaagcagctagagaggatgaaagcgcgagcatatgtagctaactagctagcagtacaacacagaagagaacaatttgtatgtgtgtgtgtgtgtgttactgtcacagcagctaggctttttatgcatgcactaagggagcaaacaagcatgctatagcctttttgccgcttacgccaaggatctcacacatgtattctcgctagccaacttgccgtatctttcctcaccaaacgatccaaaaggtctccatcccgtcgcacagatagaacctgtagtacaatgcgcggcatgcctgcctgctcaattctcggcaaaaccgcaaaagggagaggtcacgccggcgccggcctcgcgcgtaacctgcagctatagcccaccccctgcgcgggcgcggttgcgtcgtgcggaaaacaagcgagatacgcgcgcacgctggtggtggtgtacgtgcgcgtcggcgttggccggcacgcgaaacgcgcggggtggtgtggatatacgagagccgccgaggcgcggacggcgcaacgcgcgtacgagcggtggtggtgcgaggcggggcctacgtacgtacgcgcgcggggtgggggccggggctacccggcgtcgggctcgcgcgcaccgatccggccgtgtacgtacgtagcgatatatatctcgagcaaatgatgccgcgacccgcgaggtgctcatgattgggcgggcggatgggcgccgcccgggctaatctttcggaccgaccgatcgaccgagcgaggagcgcacgcggtgcatgggcgacgagccgtgccgtccccatccgcactatgcatgcaccgccccacttaccaccgttccattggttattgccccgcgtggttggataccagctgcatgctgttacagtccaaacttacagtacgtccggccagtgatctgcattggtgcatgcacgcatgtaacattatatgtatgactttcgatcgagtttgaattgtatatggggaccgtctgtcttttttcccatccagaaaccaatataatgttacctgccggggcggccgtggacgccgacacactatccgagtttaaatgggactttgtaaatgttatcatatgcttaggtaactaatgatgcaaagtgaagcagaggggttaactttgatagcgacgtttagcccgttactctggggctgcaggatattttggtcagtcgccatccggttaagtaaaacgattaattaaccaaggtaagaagagttagttacagcatttcaaagatacgcatggtgccgaccaaccaatgaaagttaagtatgaaaaataactttttatgcatactccttaatatcctgcattcctgctcggtctgatatgatcttatagtaacaggctaacagcagatatgatcttgaacacagcatccatgtattgtgcccgtcacatcacagataaagtacagttctgaacaacttttgacttttctgcatcgccggctggcctgggccacaatggcgagtttctagaggcaacaatatgtgcctgccggtgtactgtactgtgaaaagaacaacctttccatgggaaaaaatctcagcgctttttagcgttctgaggaatagacgaaaggcaaacaaaacactgtattcactcgatttgtggcaagatagctaactttcattctgctttcgcaatatctgcatgcatggctgcatctacacatcaacatgctgatcatacaaatggcacattcacactgcctgcaactcgacgtctgaacacatttgtgcaagctggagtagctagcaactgctccaagcctgccacatgtaaaataacctgtcagaggttactctcatggacgtaccttcgtgcttacaagtggaaatcctcgtagcctaaaacgacgtcgagtacaaaaacgacgtgtatgtgtactttgcatctagtgtatcttgtacgtaaagcctttggatcatcgaccataccattagccaaggcagcatcagtcagctgcagctaggtacgtgtcgagttcagacgttttccatatgtctggacctctcgacgagttgcatcgtttcaggtagggtcaccattgtccatcggtgtccggccccaggcaatatgcaacttgacctccttttcttgtcctaccaacacgtctgtattttgcttgatgttgctacgtatatatgtaccctgttttatactacattactagtgctactgctatatactgctactgctaggagtacatagtttcagacacatggattcagtactgcaatgtgtgggcctaaaagtagatgaatatattgggagctagctagctagttctagatgcatcatcgggagtagcatgattagtatatacctggacgcccagttattggccacacgattgtagtttatgcttatgtacgggtgaggcgtaacagctgctaagcttatcctgttattgttaagtgcacttttggggagatgctgttacatgcttggtgggggaagaaaggacaagtcatcagccagccttaaccaagaaagaaaagaaagaaacatggcgtgccgttacagctttccgatcgattgatcagtctgttgttcctgtatgtttcgatcgcatgcagctgctgaagtgtatagtagtaatgtgcaaatatgtgtgcaatgccagatgaaaagcgcatcgctttaagaaatatgtggtgatcagctagctagcttcaatgctgctgcatacggtgtcaactgtcaagcacatgatgaattgaagaattagtacgtatattccatagctagaggccgggagatagaacattagcaaggttattaattagaagctgaccagaaaccagaacatgtcctctatctagatgatcaatttggaactctgttccacacattaaacctgccttcccttcaggtatatgctaattaagctgctaatcactcttcagcgcaggctaatggcaatgtacattcttaatataatgaactactaactagacagtaaggttaaagtgctcgtgtagaccaagaaatatcttaaatttatcaacatgtcaaccaagaacagaaacagcttgcagagacaagaaaagtgaacccgtctatacataatatcctactggcccctgttccctaatgctgcgccactctaaccctgcagcaagaacatgggtaacccagggcacacccactgaattaattagggtttaatcccagagtgatctgcagacgacgtgtcgtccggggagcaaaagtgcaggggaatgtcgtgctccagcgtggagagcagctcccatcgggattagcgccgcgtgagattgttttgaggttacatgatcattagcagctgctcgcctgctatgtcctacctgaattaattcctcccatttgacctctccatctctctctaccaaaacatttgtgatgaggaaacaaaagttcatgagaaactaatgcatgtctatagtagctagctatagatagatgaaggggccggcattattatagtcacccggccgcaagaacatgatgcaaacccaagcaatttgcagggctgctgggcccctgtgtccataatctttttccatctctcacactacctatccttattaggttttgaaagttctgtgttacgacattcatatggtccaaaaaccaaaagtgtatcattgttttgttccagtacaccagtgtctgctatatttattggaaaaaaaagagaacaaacatgtatgttatgctgtagctggactccatatatttctagctttttgttccctgatcacttgttcatcaagtactacaaacatgtatatatacttttcagggaaggcaattaattaatctaattaaagtacgttgttgcagttgaaaatggagtactaggtctaattaatactaagtatttatattatgggggaaaacagacaaactcagtgtgacgaagaagattgagtgagtttaccacttgattaatttacaattgaaaatttcaaaagatggtgcatccagaagattagaatggggactagaatggggtgtagtatgtaggttttattattgaaggaaaaaagcacaactttttcgctttctttgcttgacgaaaaagaaagatcgaatatagatacactaccttaatccaaaatttgaccaatgcttgctttgtctctgtggtcacccagttgaattagaacacatttgtaataatcatcaacaattatagcacactagctactccgtagatttccttgactttgctcatgataccgttagttagagttggattctggtgttgtaaagctctgcacagattgaaaaaagtttccctttgtatattgggaaaaattttaatttttggggggaggaattgaaaaaattttttgggttaataaaaaccaaaccacaattggggtaaaaaaaaaacaaaaatggggcccctttctttggctaattgaaaaaaacttttttttgaacataagttggacagcagctacccagcaatgagaaccggaatgatgcgaggtttcccaaatttgatccaatcttatcacgcaaggatttgttgtttccctgtggctcctaacagtggtaggtggcatcatacttaccacaacatgttttgtgtaatgcatgcctacgcccctgtgttatcgacatcataattcccactgatcatgcttctggaatataattgatttaatgctaatggctaaggctaacagacgcaattagtccctcatcagccctggtgcatattgctctctgatctgagaacacaaaattctaggtaggacatgaataataatagtcaaattaagaaaggacatgtctgtattgcatatatcgatctgcatttgataagctagctagctagagatcggtgatttttactggcttctgtgttgagtgatcaaaatcaaattaactgctactagctagccagctagtgattgctacttacatatcagatcaaaactgtacagttaacatcattttgttcaattaaacatatcgcatcaatcacaatttgaaagtagggaaacccgttcgccccagaaatctactgcaatgatagaatggactgatcatgcatgatacctggacaactgtgtacgggacctgcaacaagcagcagctcattctactgagcaatttgttcatctgtcaactggggcaacatggtcctataaacagctgaaagcacattgtggtaccattggcaagaattaacatgcacttgattgcaccagaaactaaagcatgcatttaaaagttaatcatgcctcgtttctccaaattagagaggacgagatgcataactaacttatatatgttcttctgttctagtttcttgatcagaatatatatcaaatatagctagtagcttatgtatgccatctagcactggaatggcatgccgccgaatccattgagagatctaggtttagtctctcttaaattaagtgatatatgcatgagttactagctaggtgcagatacctttgcacctgcttctacgtatgaattactctaagagccggtatatgcaaaggccctagctggatcatggctaagttctggccgctacaagattgatcaataggcacatatatcatcagctacatgcaaaggttagacatagatgctcgaatgctagagcttcttctgtactgttcagtgccgggagaggaaagggaaagaggagtagcagctagcagcaggaggaagaggacgacgtgacgtcagctggtgggcccatatgtggggcccaagggccttcattcccctcacccacgcgcgacggaaaggagagcgaccccgacccttttttatacccgccaccttctcgacccctcttttcttctccaatgcaaactccatctcctcctctccaatgctatttattcttccacacacgcaggccagcttcttgccaacagctagagaagagaacatacagacgagtttgtgcttctccttggagaagagagtttcttgaattcgatcgcctaatctgtatagatcgagataactgaagctgtcgcttgatctgaggtgagtttcagtactggttgatcgatcagttattagctatatatgttggtgtgttcatcgatctgtgatctgtgctggtttgatcatcttgatctgttctttaattttgttcaatctagctcctctctattaggcaaaaatccttagctgcttgttcttcgaaaaaaaattctagcacttctcttctcctctttgctagcttgaactgaaaatagtcgaacaagatgtagctatgaatgtggccaaatacatctcgatgcagaaacttcttcatttctgttatggaaaaagatgtggctatatatatgccctgtttatttgcaaccttttcagttttttttcttttacattcccctcttttcttcgttgatctttattgatcataatcagatgcttaaaaaaattcttcatactggtattggtatcatatgcatctgatgtgatatgatgtatattgattaaaaatcaagctgtttattgcatgctctacatacatagtagtatgtgtgtaaagttatatattttgaattacatttgctacttcaacataatatttttataataaaaatcataaaacaaacaattctctgtgtcggtagtatatgttttgtatatagagcaattttacagttctcaaggtatcaaattttacaagagaaaagtggtaccttaaggactgtaaaaaataaatgtgacacaaataaatgtgttcattcacatgtaactacaacactgtcacaccgcacagagacattgcatccttctgattgaccccctatatgatcatagtaattgatctacctcttttccttttcgagaaagcgcagtggtcatatacataacccattttttcttctttctttttgttccattttacccccaaagaaagatctgaatcatacactcaaatagaccgaaattgccttttagattggccaatgtatttttggatatggtggtatatggtgctataaaaattaaacgagcactctcaagatggtcggttcagatcactatatactactgtagctatagtatgtacttttacacactgtgaagtatatatatgttgaactaaattatatccacttatatatgtcgtcgtacaataattaatagacggcgtgacaacacttcttttacacgaaacaaccttatatgagtaagctaataagtgctatacagtccacgcatagtagttttgttgcaccaagctagatgaggtttgcatgcagaggctggaattggaaaaatggtcggaatgcaagcaaatttccaaagtctgattaatttgaagaaaaacaaatataaattaatgtagccttttgccatgtaaactataccagcactgtactagtttggtctacatggaaatcttccataacttattttgttccaatttctactaccatataaaaacacaagtgtggaatgtttttttttgaattttttttacaagtgaccattattttagttatggcg

SEQ ID NO: 74309 - DNA, 23124 bp, Oryza sativa
cttaggataattaatcttggtaaatcatttgtctcattcttgaatcattaaacacggatacgaaggtcactgtacatatcgatctaggaccaccatcccctttctatccattctgacccaacctggtatagtatatactaccataggaggtctgtgacaatgttagcaaggtagcatgcgtgcaccatcttagttgacatccttacataataacaaccctagaggattaatactttagtgtagtgactgatccatcaataaaaaatcaacattcctttttcattgccatgaggtatatacccgacatcgggacttataggcggtctgtaattttatcctaattaaaaagggtagatctcacatgaaaggactggatttacaaattaacaattcattagcacattaatgaatggtgtatacttatatatatattataaattaattaatcatgcattatgtcctgttattcaaattcgttgcattgagcaagatctcaatttgtcatttctcttgcaagctctcgaggggacattcccttattatttgcatgtcatctaatggttataatttttttataaaaaaaataacaagatagattaatgtgatatatcactctacgacacatggaatgtcaaatttaacttctacatgtcgcaaaagaaaaattggctatgaatatatgttaactagctatagtttaattttcttttgcaacatgtagaaattggattttaacttgtatgtttgtggagtgatatatcatatattatctattttctcaaaattttcatatttatttagatgatatgcaaacaacgaggtgatgtcctctcaacagttcaaaatccactccctcacatttaggcttatcagctcattttctttggtgagacataaaacatagaaagagtatttcctagtatgagatgttgtatattatagtatgataaatctagacaaaaatttgttcattcataatactagaatgtgacacatcccatactaaattaacttaatatgtgacgaaggaagtactatataactagcaacaaccatgcatcacaatactaaaaaccaaaggggaaacacaaaatgattgtgatctacccctggaccttctgtgtccaccctacagaagagctaccatccatgcatgccctacgagctgtactgtactcctccactgcacaggacactccccgtccagtagtacgatcggcatgcactatagcgttgcaacttcgcaagcagtatctcagcaaatgtgagcgcatctactagtagctaggatcagtaggcagctcgcccacaatgcacaatgcaaggccagagctaagctagggtccctgctgtgccatggaattcctcgacaaacagacagaacggtcagaggccgtgcaagaaaaccgatagtcgtgtgcccctgctggctgctgctgtgttagctttccattctctctgtgcatgccatggctatagctttcacggagcagtgagtgatcgagtgagtgttagtggcgcttttttagcctcttcttctcctttaatttgcaggcctgatcgctgaaagggccctccgatccccggcattggctagctagcttcctctcctcacgtttttattctctccatcttttgctcccagccccacctttaatttgtcaaatttttttacatgccccacggcatgcaggcgcgtgctcatccgcccggcaaatgctagcgatgcagctttctcgttttggttgttgtgttttaagcttagccccagcatccacgcaccatgtataaatgccatatgttttataccctttttatttaggcttataagccaacttataagtcaaaaaatataagcctaaacaaacaatcagctttttcgtttggcttttttgaagccataagccactctaacactattaagccaaaatctaggttggagaagtttttttggcttatgtgagatagatgcatgactccaccattaaacttagaacattaaatccaccggcttataaatcatataagccaataagctgacttaaaagtctaagccaataagcccaagcccaaacaaagagggcattaggccccgtttgattcaaaggaaattcataggaattttagaggattttattcctataggaatttttcctacaaagacctttgaatcaaaggaatgaacactatggaatcctatgaaattcctatggaatgcctcttcccatacaagttttggaggaattttaacaagaggtagaacctcatggaagaaatccttcgagtctttatctctcctcaaattcctgtgtttttcctgtggtccaatcaaacggtcattcctatgtttttcctgtggtttgcaatcctctgttttacacttacattcctgtcagaatcatatgtttttcctattcctccgttttttcattcctttgattcaaaggggcccttagtttgcgaactagataaaaagctgctaatattaagatatattcaattctagaattaattgcagatatattgcattgcatatatacttgatgctctaagctatatacagtacgtacgtatatctaagctatgtacagtatatgtacaaaataaaggcctggcaagctctgcgtacagtgctttgcattgagccatgcatgaatccattttcatgagagctgtatgatcagaatgagtagaaaatcatgcatattgaggttcttaagtactagctatactagcgtgtatctagcgcacacatgcacttcaaaaacatatatgcagcactctctagtataaaagtcacactaattgttgctacaaattaaggcccctaattttattactctaaacaaattactgaactctgaacaaactaatcagagaaggtacaataaatctaatcagcaggctccaaaatattccaactcagattattctcacgtggaagagagataactggagagagggaacaaagcgggcgctagatgtagcgccgagcgatacacagatacgcatgcatttgtgggtcccgcaaccaccccgccgatcccgtgtatcgttttgtttctgttgtgcctcttccgatccgcccgatgcattttgctccgcttcacgccgcctccgctcacccctgtctcgccggaattttctcccgcgacgtgaaactccgccgtgaaagctccagtgcgcccaaaaagttagtaatcccagttctcagcgacaaagaaagcgagaggaggattgagaggcgcttggtgcgggcatgcaactggcacccaaagcaataagcaacttcttgatttgaattggcttggtctaattcttttcttttcttctcccactgtctgttgaatgcttgtcgtctatgtttgttctaccgattcttcgtctcatctgttgcatctagtccgttctaatctcttcctatagctccttttattttcccttttgttcttctccttttttcatgtatagattatgcagttgggcagcagtgggttgtgatatactatgtgaattatcaagtgtgttgttattcgttaatttttcaagtagagtagtagataacccatatttattacataatacaaatggccatataagccacagagttgagggcgtttctgatcatgcacatgtaaagtttattgtttgaataatgagatcatgttgatataatagccaacctattgtactagttagttttggtattggctataaaatgacatggatgttattggagctagtagctggctacactattgaccttgctcttatatagcagaccatttttctgctgctgcaacagctataattcgttgctgactatagcccacatgcctctgagatatcaccagtcgacagtatcattcgcaggcctgtagctttcctacatttgtccctgctggcctcttgcccaggctctgccgtactttgcctttttatcctagaaagtccatagtgcaaacccaacatggctggattaaattttaccaaagcactgaaacccatacacactactgtagtagtatactccttgtcagtcagtctgtagctagtcattcagtatccagaccaaaccaatgctactagcccttctgtgcagatagcttttgcatttgtgtgtcctataaaaaatcgcaagatagccagcctgcttgcaccgaatgattcgagcacttgcatgtgttctttactactagtgccactcgcgagctatatcatttgatgcatgcatgcattgggtgtggatggatatttagaagacggtgttgctgaatctgatgcacggtgcatgcaattgcagtgcaggcacaggttggtgatcatatggacgccatggaatcatgcgtccctcctgggttcaggttccaccccaccgacgaggagctcgtcggctactacctccgcaagaaggtcgcctcccagaagatcgacctcgacgtcatccgcgacatcgatctctaccgcatcgaaccctgggatctccaaggtacaactagagatcgtatgattaatttgagtttcagagatgatcattgtggcattatttatcctaattgtgttgcctggtttgttgattgatgaagaacattgtgggatcgggtacgatgagcaaagcgagtggtacttcttcagctacaaggacaggaagtacccgacggggacgaggacgaacagggcgacaatggcggggttctggaaggcgacggggagggacaaggcggtgcacgacaagagcaggctcatcggcatgaggaagacactcgtcttctataagggcagggcgcctaatggccagaagaccgactggatcatgcacgagtaccgcctcgagaccgacgagaacgcgccgccacaggtatatacatataccgatttcactagctaattggtttcttaattttctctgcatgctagctagctctacataaactagcaaactggttccatgcttgataggctaagttcctaattttaaaaagttgtatatatccggttggatgtataggctgggtttatcaaaaaaaaaagaaaatattttttaaggttgttagtgaccacattgcatacttatatatctgagaaaatatatctgaattatatacttatatatgtgtgttgcaacttgcaactgaagataaaatgcagtataccagcttaggccttattagaggttaaggtctaatggtgcccagagatttctaaagtagcacgcacagagatctgccgccgatatacatgcgtgcaagcatgtctaattcatgtaccactagtaatggaccatatagataggaatatatcagtagcactaagcagcaccacaactctttttgttcttgaaagataagtcttgcattggcctccctttttgtgagccttccaaagtcttctattctctcccaaataaaggtagcctgcatccagtgttgatgccatcctgaccttaccactaacaccaaaaccttttttccctagacaattgcatgcgcatgcatggcctagttagggtttcccctggtgtgaacgtcctaacatgcgccatatattgtttacaagctgtatgcaacttgtgctagtactcatcaaaaccattgcatgctgcttggcaaacatgtcaccacaaaactaaaaaagttatcagctcgtattgttccactatcacacagtgggaagctagctaactttacgaatgattggcaaatactttggtgtcaatgtcaaccttgcaaaatgcagctcacatcccccccgttcgtttcctcttaaaacaatggattaaattttgaatttttgtgctacgcttttcaaactgctaaacggtgtgtttcttgtgaaaactttctatatgaaagttgttctaaaatatcggattaatctatttttcaagtttataataattaaaacttaattaattatacgttattaccacaacgttttacatgaaatatttaatcttaatcttcgggagactcaaacaccacctaagtatctaactttatttgcatgtgtgtactacaggaagaaggatgggtggtgtgccgagcattcaagaagaggacggcgtatccggcgaggagcatggtggagacgtgggactactccttgcacgagcgcaacatcatgagcgccgcggcggcggcggcgttcgccgatccgagcgcggcgtacgcgcagatgaggcggcagcacaggagcgggcggttcaagcaggaggcggagctggacggcgccgccacagccctcctccactactccagccacctcgccgagctgccgcagctcgagagcccctccgcggctgcggcgccgctccagcccaacccgagccagctggccaccgccggcgaggacgacgactgcaagggcgataatggcggtaggagggccaagaaagcccgcgccgccggcgacaaggtggcgacgaccacggactggagagcgctcgacaagttcgtcgcgtcgcagcttagccccggggagtgtggcagcatggaggcaacggcggaagccgcggcggcggcagtcgccggtgtgagctcgccgctggaccacggcgatgacgacatggcagcattgctgtttctcaacagcgacgagagagacgaggtcgacaggtggacggggttgctcggctccggcgccggcgcgagcggcgtcgacggcgacctcggaatctgtgtgtttgacaaatgagggacaaagcattcacagcacgatgtgttcatcacatcaaccggatgggatatatggttatagctgaaatttttataaattgttctctttttttttcttctgcttctttttatgttcccaaatgtgattgtaacctttaatcgatctgtcccctgtgcagagtcataagatgcatggcattgcaatgtgctttttttttcccagttgatgtgatcctacattggcactttgtaaatgtctttgactcccagctgggtggcatatatagtacactgtactctctacagtaattaatgacataatatttgaagtcagcataacttgctagaaacgactaaagcaagaggtgcgcgtgcagaacaaaatgctactctgactcagcacactagctagtaactcgttgaacttgtacaaatattatcaagaaaaaactctaggaaatttagattgtgatcactagtcaagagggctgtgcgattgatcaggctatatacataatcatagattccaaaacaaagttgtattatatatatagattcttatagcactgctggagaaaggggcatcactcccggttggtaaccctctaaagtcctggttttgcaactggaccacgaattcaagactaaagatgttaaaataaccaagagtaaagattgatctttattcccggttaccaactggaacaaaagagggtagcgccaggctctctaatccctattctcctctttttttttttctttttcattgttctttgcatattgattttacaccaaaatcacatagatcaacatcacaaaatcgaacattgacatcacaaattcacacatacatcacaaatccaccacaaatccagacatacatcacaaatccaccacaaatccacacatacatcataaatccacgtatcaattcgatatacaaatttactaacacaatacactacaatttactaaaatatttttatatatatttttttaaaaaagacgagtgatcaaagttttgaagataaatagtcctattgacagttactaaaaggggaggtgaatggagtacgtgttatggctttatgcaaatttggcgtgtttgatagaagagaatatttgtgactacctgagaatacagatgtgatttgcatagaatagtgacaggctctaggtagtagatctgaagcaaaatattcgctaaatcaatatactcctatgttgttattagtgcggtctcactcaatcaccacaaatccctagaccttaattcagtcttgttcccagttgttgccaaacgacgaagccgtaagtagggatgccagtagttagtcccgttacccgtataaaaacccgtttactagttcatttcttacacgatagtataaaatttagaagaaaaaataaactagaagagagatatataagcgggcttaaaaaaaacccgcttgcatccctaccgtaagattattatatacgacaacagatgatcttccaaataggaggcctattctctcgtgataggtagaagggatcaacaactaattaattataccgtagtgcgtgcttactacccattaatcaattattataccgggataatgaactcagtctaaaatctctgttcatgttggtctaatatatattatcactaactagtctgatcaaaataatgcagaaattcctattctaaaaaaaaactgcagaaatcaaggattcaagggtgtacctgctgaattgctccggttgatcggatcagcttctgaaaatccacccacggatcgtaactcgccgctcgccacacgcccaaaccagtacaactagggcggcggtgcgcgccaacgccaatcgatcggccggtggtggcggtgacgcccggtgccggcgccggccctcatggaaacgagaggattggtgcgaccgccggagtgcgctccgatggccgattggccgcggcggcggcggcggcaccgcgagtcggcgagacgacgcctgatcaggccgccgcttctcttccccaatccctctacctcccggtcttgtactgtacatcatttaggcccagcaaagcccacgtagtccgttttttatgtgggcctcatcagtccttcctcgcaactaaggcccatttagcgaaacccaggctcgttggcccagttctcccctccgtcttcagttttctccaccatgagaggactgctacagagttgtggagtggatctccgcctccggtgagctccagctccgatggcacgcggaggcggctacgggtgggcgctcgcggcgggcctcaacgccgcgctcgccgccatctccgccaagttcttcgcgcctccggtactctactagctctctctctacctccctccgatctgaacattctgttttctgttcataccttgcttggaaggctgccgctgtaaccttaataggccgcttcagcctttgttcgggtttaatttgttcatgctggttcgattaaatgattttaccaagttcatgggcatgaaacagtcacttacttggatccgaagttgcggattcatcagataattcgaggttagatgtgtgatcccttcagctaatgacttagtgctagaagtataactgggataatgtggaaattgctgatcaaaagttaactatcatgtgtggttcaattagtttaggatcagattgtgaaaatacctcaaatcaaatgataccggtttaacctgtactccggattagttcctcctaccagtgtacttgtagtctagtgctgcctgctattttgttacttgagacttgactttattattgccttctacagcttctgaaatacagcatggtgatacttttcaatgtgacaatgtggggctgctatgtgaacagcctcaaagcactgtcatccctccaagcaaccgtcaccaattttgctgccaacttcatttcatcaggtcttgcagggtactttctgttcgaggagccactgccttctaaggtaatatgagaattctcccttctgtgtagtgcgtgcacatcaagctagttattcatgcagatcaaatagctaaaaattttcaaatttatttgtgttagcttatgtcctctgttagattgggctttttcttccctttcaaacatgggaagagtatcctaggttgatctgtcacattgcttcttagtagtatgagtaggtttatttattataaataggattaaatctagttattaagctaggccactttatctggattcatattactcgcttgaaaagtcacatagcatacaaagattatcttataatttactgttgtatgaaaaaattcttgagagatgcatgcagttggttgataggaaagaaaacacactggatctttaggttgttatgctaaaatagatgccgtttttcagatagagaaatagatggtcttgtgctttatatcatgagcaatgacttgcccccttgtataccagttaaatacaagccaaaccctgtcataaatacaacaataataacatatcacttgcctactatatctgtacagctgaatttatgtacagtctgtaaaatataataataataaaaaaagacatttggagggagagatgtccctccaaacagtttcaagaagaaatgtgagcgtgttggggattgaacacgggacctcagggttgaaaccacacaccctttgccactgcattatcaggtgtatctcagactgtagaatactgatacatcactttccccacttttgagtttacatgtatacaaaattgtaactgaactgcactcagcttttgaatttgatgtatgttcatacagtggtttgtaggtgctagtcttatcattgttggtgtttttatcctaagcaaatcaagcatcgagaagaaactgaactctgactagagtaagttttaaggccaaaattttattagctacgacacacattgtcagtttgtacttctataagcttgtggtatgtttgaccataacttgactcttttgtaaaaacttgtgtcaattatgttttgcaactttagttcatatttttgtaattagtaaataacttgagctcatctattgagacatcaatacaagattgttttaaaagtgaatgcatgatctaagaattgctttttatattgactttaagatgacaacaatcaggaagtggaagcgccatatctgaaaggagtatctcttttctcattagcagtatagtcacagcagaaattcttccctctaatattttcataatttcattgcccgagctctgactttgattttttttacggcaagaggagattttcagctgttcctgaagcactgtagatcatgatcctctgaaatgcagtgtgagtgaaaaaagataaggttctttccactgttcatgaagcacagcagataatgttcctctgaaatgacaatcctatgtcggatgctccatcaacattagcttcccatctgctgacccctccaagggacagcataatttgcttttgatacccgcggtatagtttcatcagtgtttaactgtcccttcgtttctaagagaaccttcttagtacgccagtctggactgttaactgatactactaccttgtttggtgatactgatacctgaacggctgaacctgtgttatcacttgtcaggaccttacagtttgctctgtcctgctagcgagcaacgcaatcagtaattcagtatatcgaaggagatcgtgcgtggtcgtgctatcagccgatcaagtgatgaaaacttgaatctatagggattgaattgtcatcctcatcagtaaaaaatatttgcattccaaacatgtctgaggcttttcttgaaataaaaaaaagaatcattgcagttgcctgttgcagcatccggaaagaaagaaagaaagaggagcacatgcacatgccatgcgtcccatttgagcatcttttattggggtagggtgggttcctcctgaatggatgcaatctgcatggcaagtaaaccatttctgttgactagtacaaactcctgctgaaaaatattcttcagacaaacggagtaggaccatccgagacgatcgatcgatgaatcgatggactttatgggtgtagtacgctgggcagagacaagagtttggctatcttgattctgaggatgagtcgaccaagggaccctttgcagggtcaggtttgttttttgtcccactctctggaagactggagtagtacactacttgaagcatcccatagctgggggatagtgacaattacagagtcgttctacattgtgtattcgcttatctaatttgctgatcctgaagaaacgggcagtctatcctagatggaaatggaagaacaacgatctgaaatgggaatagtaaacccgaaattatggaaattaggagtaacacaggattgattggaaacgtttcattcagaaatttttatacgttccaaacgagacactgcgtgttgcttcgactacacgttgtgcgtccggcacgatacgacaaactttccagctgaagctggatgtatgcgagcagtgcaacggccggccgggaaacgaacacctcttgaatccctctcacagaagcgaacaagccagcttcgtggccagtaagtaccaagccacagctcaccgcggaatcgaccggggtgagctgagctggatgcagattgcgcccggagtaaccgagctggggacggggttaaagtgaggacatgattagtctgttgaaaaaaaactttaggaataccaaattttggtttattgatacatggtaaaaaaaaagtgtaccagagatcttatttgctctgaattttggaaatctcaagagtaaatactcagaatctactaaactcctatttggtaaggttcatatatgtttagaagatagtatatttgatttattacgcaaccgaaatatggtatattgtttttcctaacgagaaaccaatgaagcccttgattttcggggtagaaaatgttgaaattcttactacaagatgtctgatttattaccttacaaaatgcgacagcagtaaattttggtgatctttaatttttttttgtggcaagaaacccatcaaagcccctttgatcctggcgtggaaagcgataagcggtggtgtcgcgtcgcgtctgcagtagaaatggaagcctgggggctgtggctgtggcgtgggccaaagcagcagccatcaccagataaccccgcccgcatgcccccgcctcaggcccccctccccaacgtagtatattcacctcgccgcacggcagcggcagcagcagcgtgccacgagacgaccaccagctagctcgcaatggcgcagcacgagaggaagccagtcggcgaggcggtggacgtggaggcgggaggaggaggaggacggcagcgagctgcggcggcggcgggggagagaatgaggttgacgtggtcgtgcctcgccgtggcgccgggcgtggcggcgacgggggtggcgggcgcggccgtgctggtgtggtgggcggtggcgttccacccggcgcatgagcagctgtggatggtgcccgtctgcctcgtcctcctcggcccccgctcgtcgcctggctcttcctcttcgcctccggtgcgtgccgccgcctcggcggcctccgcgccgtccaggatctggtcccgccgcccttcgctgccgagagatgactgggttgtcttcgatctgtcgtccgtccgtcgagtgtacattttcttagtcttattattcttcttcggtgttctttcttatcgtcgtttttcctaagatgatcggaatgtgatcagaatgggatccaaattctaaagaaaagttcttgctagtacaaacctgcagatttcagatgcttcgattgatcttgcagataagtttggcacttaattatattctagtcgatcaagtacgtgggaagaaattctcgttgtcaaggttttttattcagcgagttaacattgacagctccggatcgaattttgagagagagctatgcagctcagcccgacagcgatttgtcatagtcacacaaaaatgatggctcctttactactatcgccgcatagtccacacataggcacgagaaaagaaagtgttgttttctttcctacgcggtcactgccacagcttggaaacacagagtgaccgcagcgactagtacttggcagttggagcacgaaggcctgaatctgatggtggtgccaactcggccaaagtcccaattattcctcacaagtcgcgacttggcaatcgacgtcgccttcaataatgcaaggctgactggcaatgagactgggcatgtagcacgcgcgtcgctcatgtgtgtgtatcacgctaacatttgtctcggggctctggcagattatgggtggagatttggacggaagctagctagtaatatatatgttggtctgttccagttacgttgcaaactgcgataatggcgaacggatcgatgggcacaaagccacatatgcatggggcatggacttaactagatagtgcggtttggtggcgtctacacgttttagaattcgcatctcattctcggtgaataaaaacctagtcaaaagttgaggctctcccatctgcaagactgcaaccgaacagacgctgaagaatctatcttaggatcgagctcgtcgtgttcactgttcaggcggccgaagctttgcgcctggttgatggggacgggagtatctatagtggaccagtacttcactgtactattactactactactactactgctccagtacaaatactgatgatgtgtgttcgcatcacattattctggctaagctttcttcctcctctttcttgggacgaggacagcggcggcagcgtacgcagcgggccagattctacacgaattctgcacgctagttgcatgcaaaagccgccttgcgagttgcgagttccgacgtacggttacctctgggcaccaaacgggaaaccggccaagccgttgctgtgtttcgagttccgacgacgacgccgctgcggcagcggtgcactcacactcacgatagctgtggcaattcagctcgattatatcacgggcgggggcatggcgtgtcctgggacggtgccattcggtggagcgtcaactcggaaagcggccgtccggtgacacggccgacctggcctggcctctcccttcggcttcacttccctagcttgagacttcccaaagagcacccacaatagtaaagtaacgtgctatctataaaatatatacatatcagtaatagactagattaatagtaaaccactttaattgtatgtctatatgggtatctatagctctctaatccattgtctcgtttttctctatagactatctccagattagtagatatctttgctctctctctccatttaatctctttcaagtaggaaaatatgctgacatgtatcttttatagaaaatctatagataattattgcgggtgcccttattgtaccacatgttgatggagacattcggggtagttgaccacgtcggggcgatgaatcatgcgcgcatgtatcgtatggtctggagacgacgatccttttcttctcatgggctgggcttctttcactcgtcgacagagagcatcatgggccagcccaccgttgtttttgtaaggcgagagcgagagagagagagagagagagagagagagagagagagtccggtttcagggcctgtttgtcaactgggcctgaaagaattgggccaggtttctcgccagattatgggctcccaaacagagggttttgggtttatgacatttcttctgctgctaacctgccacgttgggagctgaatatctacgaactacgtcaaaatgtataaaatcgcggttttaatttttcttttcagaaatctcttagcatagccttcttaaaatagaaaactaagcattttctatctagcacgattctactttcttctaactcgcggttaggagtgtttctgcgacaaccatcaagtataactcgacaaaaatcaccggccatggagctcatcgaagtacgtatcctcctggaatcgaaatcccacaagctgacaacgcaaacaaagtcgcacgtggaactctcactccagaacaacagtgctgtccccgtcacaataatctcgccgtctacttccaaagtcacgaaagctgctgcagtatcaaccactaacacaagagttgcaatcacaattctctccaaatgtaatgtgacggttacgatttcaaatcagcaatcacacacaggtcgatcggtcacgccccctgtcgtggtaatgccttgatggcggcgaggaaaaagatttgagagaatgtggtgtgcagtgcaggcagcgacgacgaacgggacatggcacgaggcgctagtggtggtgtggtgcccccgcgtgacgccgcaggataaggctctcggccccatcgcggcatcaatcatgcattcacgctgctactggcctactgctattgctattgctattgctagccgcttgctgattcgtggcgcaccgcttccgaccgcgaccacatcaggcaaggttaattgcgtgcatgattgctggaaaaacaacacagcaaacggcatacagtagcaagatcacacacgttcgtttttgtcgtcgtcgcggtcgcggtgaattgttcagaggagagccagagtttgttcaggggaggacgtgtggagcacggatggatcagcgcgtcgttttcaacggaggaatgattgagagtacggcaccgtacgggtgctccttcgaggaaggtgcaaagcacgcatgttcagggttactactagctcgttgcctgtcgctgtggccacggtggtggacgacggcgagattttccctactccagcgtaaagaaaaccgaaaggagcgatctccaagtggcaacacgtaaaatctcgccccacatttggatttatccatccgaggaggagccacggttaaatgccgcgttcgcgcgtgctcgttacgtacgcgtgttgctttcgagtttgattaatcgttttttttgccggggtggtggtgggattgggatagagttcgggccactgcctgtgaaaactgtgaatcgcgtcgcgttgcacacggccaaaacgatagcgcgcgcacgcacgcacgcatccgtgccgcacgccgcgcgccgcctacgtctcgtcccacgcggttcccgaccggaccccacaccacacctgccaccaacgcatctccgccttatttgaggcgcgcgcacggggcgcccaagccatccagcctgcgtgcgacctaccaacgcgcgcactcctcgatcccatcatcggaaggcggcgaggcgcgcggtggaggattgatctgcgggagggattgatggcggaggcggaggcggaggcggcgggggcgggggcgggggcggggccggcgaggaggacgacgagggtggggcgctacgagctcggcaagacgatcggggaggggagcttcgccaaggtcaaggtcgcccgcgacacgcgcaccggcgacaccctcgccatcaaggtgctcgaccgcaaccatgtgcttcgccacaagatggtcgagcaggtccgccgccttaatcatcctcaaaattgaatatttatctctttttttagacatcaggtaataacaagttggatcttttctcggaggggatcgaattaagaatcctaaattattctagatagatgctagattattataaaagatggattttcatggggattaataaacattaaacgagaatatgcgcttactacgtctctaccattgtcaagattctgtctgtttggattgtttgtgattgaagaaaggtcatgtgtccgcctgtccagcgggctaaatctgctctgatctaaaggaaattagatggaattgtatcaagtttgaatcggaaatgtaacaacagattatcaagctgggccatgtaactataacaatatctccgatgcggtgatgccaaccctgtcttaatcaaatgctttctgcctagcaaaaagctgtgctagctttggtgttcgtaggagtggcaagagttgttctagattcatttttttttctcggggagttataaattcagtctgactggggggaaactcgggtattgtacattccgtgctagatcactcattggttgatgcattgtttggtggaaaaactagtattttttttggttaaatatgtgattttccatatgatgtgttggcacaattaaatgtccctgctcgagctgttctgttttccagcttgagctttcgattgtgaatgataacctcatattccacttctatcagatcaaacgggagatttccacaatgaagctaataaaacatccaaatgtggtccagttgcatgaggtactttgctatctttgcaggaacaatagcgtcattaccactcatacccttctttttttttttatctcatctcattcaatgagaattttacattcaatgtgtgtttgacaggtcatggctagcaaatcaaagatatacatggttcttgaatatgttgatggaggcgagctttttgataagattgtaaggcccatgaactttctgtgccagatatcacgattcttatttttgtttatgtacaaattgcttttacatgctgtaagagtagcttgttgaaccggcacatttgactgttttgatactgactgactaatccgcagttcttggaccatacaagttgacccatttatcatcatgttattatcaactaggtcaattctgggagactaggagaagatgaagcaagaagatacttccatcaacttataaatgcagtagattattgccacagcagaggagtgtaccatagagatctgaaggtttgttgaattatcctgcttacctcctttctgggtaatctccactgggatggatgtattctcattcatattttttatgtgccatttgcagccagagaatctgcttcttgattcacatggagctcttaaagtttcagattttggccttagtgcgtttgctccacaaacaaaagtatgatatctagctagtacccagaagtatgtttttgtagttgttaaaaaattaaccagtttctttatcctaatgtgatgtgtttgggttttctagcatttttctggtttaattgacttgttccttaacttgcactattacctcaaatgaacttcggacgcataattatttgttttggtgacaagaaagttgaaagaagtaactttggtaaactattttgattgttttatttaggaggatggacttctgcatactgcttgcggaacaccaaattatgttgcacctgaggtgattcatgttgcctttgattaaactcgtgtattttctccaaaaagatgtaagaatcatatattcatactgttccctcaggtgcttgctgataaaggttatgatggtatggctgctgatgtatggtcctgcggcataatcttatttgtcctcatggctggatatttacctttcgatgaccccaacctaatgaccctttacaaactggtaagtatgtgtaacatgcacgcattctaatgtttcttgtgaatttcattggtaaacttgatagacttttgatgttctcttcacagatctgcaaggcaaaagtttcttgtccacattggttttcttcaggtgcgaagaagttcattaagcgcatacttgatcctaatccctgcacagtaagtgacaattaaggacatatatcttcagctaaccagtttgaccagctgactgctgctagtccaatgagtttcattgtatatcctctttgaagccttttatgatggcaatttgagagaagtcagaaaacaatgagctatattctttgcagagaataacaattgcacaaattttggaagatgattggttcaaaaaggattacaaaccaccactttttgagcaaggtgaagatgtgagccttgatgatgttgatgctgcattcgattgttcagaggtaatgctagctgaacatttatctgtaacctgcatcctttcccaaaaatacgatttgtaacctgagttaaaaccacttctttgtttgttacgtttgtttgtttaacctttcaggagaatctcgtggcagagaagagagaaaagcctgaatccatgaatgcatttgctctaatttcaaggtcacagggattcaaccttggaaatttatttgagaaggaaatgatggtaggttttgatagagtccaatattataattccatgttgagaatatgttatgtgctagatagattggagtgcttctttctggaagcttgtatcggttaatataattttgctaatgttttcctcttttctttatgtgctaagtccgacagaacaattatgttttgatcaatttatcatcctattagttgtactccttagtcgtttactaaatagtctgagtctacctaatatatatagggaatggtgaagcgggaaacttccttcacatctcaatgtacaccacaggagatcatgtctaaaatagaggaagcttgtggacctcttggtttcaatgtgcggaaacaaaattataaggtttgtagcattttagacggctatgtattgactagtttgctttatgtgggtttctgttagtttccttgagaatttgcatcagtatgttcgccattcagaagtaacttggatttgttcttttttgttgggctccagatgaagttaaaaggtgataagactggaagaaaaggctatttatctgtagcaacggaggtattggaaattaaattgacatgtatcctgttaagtctgtgcaatgcttcagtaaattttgctttaataaaagaacttattcacatgctatctcacaggttttcgaggttgctccatcactccacatggttgagcttcgtaaaactggaggggacacgctggagtttcacaatgtatgttatcaaactttgtatattctatcatttcatagtgggtcattgaaaaaaaaaatcatttcatagtacccagcatctagttgtttcttgatgatttcagaacgattaacgtcatttctatcaaattgcatgcagttctacaacaatttctcgtcagagttaaaagacatagtgtggaaatctgaatctgacgcaaaagcagcaaagaagaggtgatctttagtattccaactatccaatgctcctggatgtagttccccctttgtagcgtttgcaccatttctccaggtgataccaaaggatatcgtcctcctggtcttgtgcacattgatgaattttctgtggggtcacatcttgttgtgccaatccttgcaaaagggagcgcttttttttttctttttacccttagcgcaactgtagacatgctcacatgcatgtataaggccctcccggagatgcaccttgtatttgcagttgggatgtcaaataggtgtcctacatgctttggtgaccagtagggttgtgtgccttttcttttagtgctgaaaagtatataataagatcaaaatgtgaaattgggaggctatgtaacactaagctgtgctctgttcttgagaaacctagcagcagaatggcagtgtaactttgttagttctttcttttgtgaaactgtaatggcttcacacctgagctatgggtgtatgtattcaatcatgatgcaatctgattggccggataaaagaaagaatagtaatcacctttgcatgctatttattatgaaccatcacatcctcttgggccggatcggtaccaatgcgattctagtcgggtttggtctcaccagcccatgagttaatacggcccggatggaggagagagtttgatttgatctgctcgcggctctccctgccacgccgccggtcgccggagctccgtcagccgtccaccggcgttgctgcacggaagctacaggcgatcgccctggagttagctgcactacctgtgtttccttgttctccaactcattagcagatgggaactgaagcatcaaaatttaatttctatttgcaatcttttcagttcatttgtttaatacagtagttcatcgtgtgataagttgtcttttatcagctgctaattgtatttcagttgtattacgaggctgatccatttgatacggcttttgcttgagtgcgatgatagcaaccgcaaagctcaaatacaggcgccgatggttacaagatttaaaccagaaaacagtggctgcttttgtttgctgttgcgatcattcatccgacttcttttttccttttgcagggagtacaaaaatgcagagtcatatgacatagactcgtgctggagaaaacaaagatgggtgtgtttagttcacgcctagttcacgccgaaattagaagtttggttgaaattgagacgatgtgacggaaaagttagaagtttatgtgtgtaggaaaatttcgatgtaatggaaaagttggaagtttgaaaaaatattttggaactaaacacggcgataaatttacttatctgtcaatgtctgctcctatacggacgatggtttctaggatatcatgaggtaactgtccatgtagttttgtccaagaaaattctgtcgccgagtggagcgatttcattttcaccctctgcgacaacgaaagaggcgggtcaggtgaggctggatgataaaaaccgcagcaggcagccaggtaaattttcaatggcattatttctgattttcttccatcgccatcttcaccgaccacagcacacacgtagcttcatttccgtattttctgctctaatatatttgcgagttgatgatcggaagctgaacatgacctcacaaaatcactatttttaatcatcacatgatcacatctgcatcaatctataattaacaacaattgtttcgtgatatatctggagtacgaaggctctgtttcatcgaaaacgaaaaagatgcgtcgcctttggctgaacggttgagctcctttctctagtccttcagcgttggaagaggtagctgccaatgctgtcgtcaggggtgacgagaaagtcaggatcatccgactcacccaaaccgcaaaaattgacaagcgattcactccccgtttgtttgattattataggatgcaaaatggatctgcaaatgcaaatgggaattgggacatcacaaccacagctgctgccaatattcttctgctagttttttcgtcatgttggaaatgaaaatctacccaccttttgaagccccggtgattctgccgtctttctttgcctcctcagtcctcagtgctagtataatctatggtcatggtgtgcggtatttttaatgagaaaatgcatacgcagatcaaacttttggttgagacttaaaccttttcctaactatggattgttgtgatcctaaaaccagtgcgcaataaagaactcgccgactaatcttcagtttatttatagttgaaaaagtttgtggagatacatacactagaaaattgaaaggacactaaaattttcaggcttacgagtggctgtttcttcctaaacg

SEQ ID NO: 74310 - DNA, 37850 bp, Oryza sativa
ccgcggccttcgtcgacgtgtgcccttgctggaatcgggccgctgcgaagttttctcctgccgacgatggcgttgagatcggtgttccccgctgtagggcgctgtcaaattgtcagggagggcattgccgccgccgccggcgtccgtagaacgcggctacccgctatcccacgttcagggtttttatggtatgtctttcctgagctgaaggctgaaagcactgatctgatcattgaccatccgtaggacatcaatttaattctgaactcgtccagtgtcccgaatattaattctgaactcgcattgtgatctattgtgtttgaacaatagtatatgagctgtgtgagtcatgagttcactgtttgtttttttcaggatgatctgttgagttctaggcttaagaagctgcttcccggctttatttatccacccacaagatgaatacgtgctcccttgaagatacggtgatcatggtgaagagacacgtctcgctgccgtggagaaattgaatgttagcggtacggtgcaggtatgtgccgagtttctgataaaacagtagtatatgcataagtgtgacacctcaagcaaacaacactatctgttcagctgagtggagcaactgaacttaacctgctacctgctcactagtagaaaaagacagtggctttcagacgtgtacaggatctcacgtgcatgaattgatgaatactgcatatagacatgtaactggtatctcccataacaaatcaatcttggcgctatttcgttcatcatcattcgtttgtcatgttcccttgggagtggcagcatcgatttagtaagaaaacatctctgttgtgcttctacagaactccatatggaagctaataaacagtatactgatacatgaaaattagatggaagatagaattcagataatcgtatgtaccactctgatacctgatagaatcaggaagacaccatcgataacgtttataaactgcgtcctattttagtataatcatgttcataaaccaaatggcatgacactctgacagtaacagatgaacttcttctgactgtttggagttctctcacgaattgaccatggaaaagtatcacaaattacaccctttaacttacatcaacagcagttttagtagctgcctgcctctatgcaaattgctaaatttggctatggcatcgtaacttccaaagaacgttgcaaacaagaacttaaaaaaaaatgaaagaaaaggcatacttattacagcatcagctaagcacatctgtgaacttctgaatttctgaaacacgctaatattttgctatcttctcgtcggtcctctgttcagcaatcagcagatgggcagaggctcgccgttccactccttgaggcactcgagcagtgcgtcgatgtgcttgccctggttcatggcgacgaacaccttgttcacctcctcgccgggcgaccgcgtcttctccccggtcaagtactctgtcccgagctcctcgcggacgaaccggtagagcgggtacgacctgcactcggtgatcctgttcgcctttgcggcggtgccgttctccacggccgcacgggcagcctccacctccctgggcagcgccacgcggagctcctcctcgaacgtcgcgaccttggcgaacaccgaggtgtcgacgttgcgctccgcctcgccgttggccagcgcgtgctcgatgaggacggcgcgcatcttctgcatcagcgggtagttggcgctgcaggggtcgtccgcgtacgcgaacacggcctcgcggtcgatcgcctggagcaggtccttctcgcagaaccgggccttgtggaggtcgccggtggcgctggtgctcagggtcttcctcgccaccgtcgtcacgcagcccttgacggcgctcctgacgttctcttcgaggtggcgcaggtcgatggcctggcatagcgcgatcaagaacgtcgaggacatgagcttgagcacgtcgatggcctcggccgtcttcctggacgagatgaggccgagagagttgacgtcttggttgtgctgctccgcgctctggacatggttggtcacagggttggccaagaactggagctcagagcagtacgatgccatggcgatctcggcacccttgaagccgtagtccaagctcgggttgcgcccaccggacaggttggacggcaggccgttgttgtagaaatcgttcacgagctcagagaactgcgcgaacatgagcttaccgatcgcggcaatggcgagcctggtgttgtccatggacacgccgatgggtgtgccctggaagttgccgccgtggagcgccttgccacgggagacgtcaatgagcgggttgtcgttgacggagttgatctcgcgctcgatcgacttggtggcggcacggatgacctcaatctgggggccgagccattgcggcgacgtgcggagcgcgtacctgtcttgcttgggcttcatcagcgggtcgagctcgccgagcttcttcgccagcatcatgtaggagctcccctccaagatgtgctccataatggcggctgcctcaatctgtcccgggtggtgcttaagcttgtgcgtcaggtggtcggtgtactccggcttgccgttcatgacctcgcagaacaccgcggagaggacctccgcgagcacgccaaggacgttcgcctcaaagagcaccatcgaggcgagcccggagccgacggccgtgccgttcaccatggcgaggccttccttgggctggagctcgaagaagccgtgctggatgccggcgatcttgaacgcctccgcggcatccaccttcctgccatcgggcgtcaccgccacagagtttggtcggccggtgacgagtcccgcgatgtaggagagcgggacgaggtcgccggacgcggtgatcgtgccccggagcggcaagcacggcgtcacgttggcgttaagcagcgtggcgatcgtctcgaggatctcgaaccggatgccagagtacccctggagcagagtgttgatgcggacgagcatggctgcccgcgtcgccgcggccggcagcacgtggccgtcgtcgccgttgccgaacgccccggcattaagaaacctgtcatggcaaccattacaggaacacacgttaggcctctgatccacacaagctctcaccagacgaacagcaaactcttgcggcttcttaccggataagctctcgctggagcgcgccgccctccttggtcctccggtgggaggtggcgccgaagccggtggtgacgccgtagctgtcggtgccgttcatcatgctgttcatgacccagtcgctgctggccttgacgcggccgcgggcggactcgtcgagctccaccctggcggcgccggcggaggccaccgccgcgacctgcgcgatggtcaggctggcgccctcgatcgtcaccacgggcctgcggtactcctccaccatgcgcttcaccgcgtccagatggctcccggacagctcctccgccgccttcccccagttgagcgggtcggcacgcggcttagccacgcacaggctgctgccgttggcggcggcggcgacgtgcccgttctcgcactccatcggaacggcgaagcagaggggagatcgatgtgtagctgtaacgagtggtggttgctcgagcggtttgctcccgatggaggtggaggagttgtgtgtgcggaagagccggggatatggaagctgcagtggctttgctcttggaggggaatggagggagttgtggggagtttaaataggaggcgcaggatgggtgggagtggggagtgtgggttcggtgtggccggttgggttgaccacgggattggtgtgccggcgcgagcgagtttgggagcgcaactacgggccgggtgggcgtgtggctacgtagaggtttcgtggtggtcgtggcgtgccctgtgccggttgggctcggggaaccgaagcggccgatgcggccgccagtgccgggagtgcatgcgggggaagagagagagagttgcacgcggcagcggcggcgcgggggaatacggggcgtgaaacacctcgcgtcgtcacgccacgaagccacgtttggcttgggggcgtctctcgccgtttctgcggctgctgacggtcctcgactcgtcgtctttcgtttcgtccgggcgtccgtttatctggaagggctgtgaactcatatccagatatcatttccttggtcccccggcttatctttctctatcgctttctacttcgtgcaacacgtttgtttaggttttgtgttctagttacatattccataggtcattggttctccgcacgtaggtgatgggctgatggtcaagcggtctgtgtacaaacaacaaaatttttctggggttttgggggtgcatgaggggggaaactacggcacaagagaggtaccaatccaattgcgcggtcaccagtcccccgacaaaaactggtgttggcataaccctttcatctgtctttagcaagtcctaatggttcataccaagtgctagtattctctccgagctttcgttctgcgcaatacacacctgacttgactgagaaaatatagacagttttttctcagaactagtataatgtctgtgcgacagaaaatcttttaaaaaatatagtttattgtgtatattttaaagaaaaaaagttaattatactctcaactagctggtggcccgcgcaactgcgcggctagtacacaaacaaaattatatattttttaagtatgattttgcttaaaatttattaaatagctatttcgttgtcttaagactttgaaagaccaaaccttatcatctccatatttctaattatatggtttttaaagtcacaccagctgctacgtcttacttttctcatatcattttttatttgcttgctcaatctaccactatttctattcattctccttgaaacctttaaaaataggatcttatagtttttagagtttagtgtctcgttgggtttcgtttttataatttctataagtcccgtcaaacgctgtcattatactcctctatgccccgtcaattgtcttttctatttattatcattgggattttaaaaatcgaacataattatcattcgggttcattttttactttctagaagtcctgccaaaccgtcagttgctttgccactgtactcctctacggcccgcccgctgccgcccttctttattgtcattgagattttaaaaatcaaatatgattatcattagggtttatttttttattttttagaagcccgaacctttaaaatttgaaccttatagtttttagagtttattgtctcgttgggtttcatgttttttataatttttagaaaacccgtcaaacactgccactatactcctctacgactcgtccgccgcatactctttattgtcattgggattgtaaaaatcaaacataactatcattggaattcattttttactttctagaagacccaccaaccatcggcggctctgtcattgtactcctatacgacccgcctgctgcctctcatttttattgccattgagattttaaaaattaaatatgattatcattgggatttatttttttttactttctagaagtccccgccaaccgcattaaccgattgcttcacgacctgcccgccgtccttccttttaatcgtcattaggattttatctgattatcaaccaccaccactctgcttctctctagccatgttacttaattaatctcgtcatgtgttttagatggtcttttctttcaatagtcttatttttttatcaccaattttagttatttataaatggtatttctagtgagatcttatttttctttttctgatttcagaatttattttatttttcgtattgtgttcttttgatatttttattttttattttcaatttcagttgtttcaaaattgtacatattttaactctctttttaatttgcctaattttggatcttttttttattttttattccgaattttaattaatctattattggattcttatatggactcttattccaatattgcttatatttaattccgaatttaagttaattttaaattgtatttctacttgaactcttcttttttttattttttattcaaagttttaattaatctcatattggattgttgtatggactcttatttcaatattccttatttttaattccgaatttcagttatttttaaattgtattcccactcgaactcttccttttctttttctaattttgagatttattttatttttattctgaattttaattaatcacgtattgggttcctatatggactcctcttttaatattgcatatttttaattccgaatttcagctatttttagattgtatttctatttggattcttcttttctttttctctgattaatgtgggaatttatagcctccacaatgaatgtggtgcatcctttcaagactgttttaatattataatagatagataagatatattatcgtgatgctacttttgctatcggtttctatgcacctactaagctgtttgtggcctatgaggttgggagatagcgaaagtcttgcctcactatgttgtgggtctcgtatgctatttgggtggtggtaaattcatcgccactactccctccgtcccaaaatataagggactttggagggatgtgatatatattccagtactttgtctaaattcatagaattaggaatccctccaaaatcccctgtattacgggacggagggagtactactaggtgaaaccccgcacattgctgcgggaatttagtatgataacaataaaaaaataacgtgtaagatagctagataacatcagattaagtaaattaatgtggtttatgataatttaaatttaaatagtatgtagaatggtgattcaaacgtaaaaagtaaggtggtatcactttatgaaagaagaaaagtagggagatagtttggactgtagattaatcatctaaaggctaaaaacaatcgatgtgatatgacttaattagagaaaaaaaggagaaagataatttataccatagattaattatttaagcactaagtgaggatgaaccatataagtatataggatatcataaaacataataaggatatacattaaaacattatgtgaattatgttggatgataatttaacatgtttgtatttgaaaagctcttaaattataaaaactataaagatatagtatgtttgcatgatgtttaaatgtgattattgttagtggatgatgacgtggcatcttgttagtggatgatgatgtggtatctttgcatgttaaacttaagaagttagtgggggataactttatagcaagataggattagtatagatcttacgggtggggttaggaacacctcctctcaggcacgtaaatcaaagcacacattaacacgtgattaattaagtattatctaaaataaacttgaaaaatatattaaaatgattttttaaataactttattgtagaaaatttttgcaaataaatgcaccgtttagcggtttgggaagccttgtgaaaaactaggtgacgttgttctctcttttcattgaacagtctacaattgcgctgtttgctattacgaagattttttaagtgtacgttgtggacgaactgagtctgaaactgcatcataacttccagtggtttctgttcgtcattttattttccatcttggacttgcagtcgacctcgcccacttggcatgcacatttgcaaagtcatctttccctcttccttctgaatgaatatgcgactatatgcatacttgtttcttgtcagtgagtgcttgagtgttgaatcgcatatttttcctctgcacgcgatggcaccgaaaatgcgagagaaattacaactccatttctccctaattctaaaagcagttggagtgaagttttccattgtgttagttgactaggctagatgctagagtggtcaagtcgtcagacatgtctgaatcgtccaagtctggaatgccgcagagcgtgttttcgcccaggtcagagtcatgtgcttacgagtacatacttttgctgagttgcggtctctcgaaaaagatttcaagttgacctgtggactgtggtggcaacaatgtcattgcaaatgtgcaactgcatgcgtacgacactaggatcaaatgggtcaccgtacgaggaaaaaaaggagggagatttcgtggaagtgcttatggcatttggtgttctagattttctatcgaaagtccttcaactttagttagcactgattgaaaaggctgtactacctcttaggattagtacatgcatgcaatttctctcgaaccagtggcaatgttccggttaattcaggcgtaatttacgtccgtgtgcccatcaaaatgttgacagtaacatgtataccgcaaaatttgtagggcatttacaaaataaacgggcattaagattttcaaaaaatgacaagcatttaaatgtcataccacataataaggggagaaaagatagatcctgccaacgaaatttgaaagggtggaaatcaactggaaccaaccatttcatcccaattttctgaagcttgcatgcaaactgtaggaacatattgacaattttgacattggttgcttcgtgtagtcgtgttggtaaccatgttatatcaagctgagaactgtagtcaaatcatcctctccttttttgccaaaaagacgctcacacttgtctgcagctgtgtgagctgcgacagagaaaaaatttttcgaggaaagctgtgagcctgtgacagagcaaatgtaatcgacttatctgatgtttctcccgttttcagctgtgatttgcaaattactcttcagcatgctttccccctctgggcctctctgggtcaatttttttaccgttgaccttacgtacattggtcaaatcatggacagtaaccaaaatgataaagacaaattaactcctcaattggccgaaacataaccattttcggtatcctcgaaaaaaagaacatttcatgtgttgggttggtgagacacgttcaatagtaatggaggagttcaacgatcagcggcggcctaagcagggaaacggccaccaacgctttcgtctttggtcgtaaaaggccttcaagtgttgactcgaagagcgtcctacgctcctgctcacatctttttttaacacgtcgttttgaatttgtgcagagtcattatttttaaaactatacatgtataaaatatataaaaaatatttatgacaaaattactaatataattaagcttcagtttcatattttaaatcctaatattttaatatttattaatgatttaaagttatgttcgactatatatatttcaccatccttttaaaaacagaagtactttcaagtttttatgtccttgccccctttagaggtcaatcaccatctcgtaattagttagtactcccttcgtcccgttcactaagatgcgcacctattttacaattcgaactctttaaatattttattataaattaaattttattgatgaaaataatatcgttgattgtcatttaatttttctttcagatgattgtgattttgttactataaatatcgtagtatataaaaaaattaaaattaaagagtagttttaaaaattatgttgagtctaaccgtgccttagctagtgagatggaaggagtactagatcacaaggcctatcgtttggcaaatatttatggaaaatcaatcgaatttgattagcttgtgttttcttctgttcttagatgatttttcaccaatagtatgttttatctcctagctttgtttggtttctcttggtaaacaaaatggatagcggcagccaagaggtacgcaccaacggtccggcgaaaaagaggtacacgcaccaaccttaggacttccagagaaagtttgaagacattaaaacattcaaacttggaaggatgttcatacaagttctggtagctacagcctacaatccttgaaaaatgctggaaaaactagaaagctctacaatgcttggtaggtaatcaaatgtgttcatctgttaggtgttgcatggactcgtgttaaaccgcaccagacaaccctctcatctgcgcctctgttcttcagaaaattgacatggagatgtagcacttgtaaatcacaatggtctacgtgaaagcctccaaaacaatgtatagcacgtcatcactgaatctacgtaccttaattgggtggtcacactataacttccacaaaaacaagagcctcactccggtgctttctacttatagtagaaaataatccgagccgttgatcgtatataatcgtagggttgagatctaattctactaccaccactcatagtggtagtagaaacgtggaggtgtatatttgtccatagataataattcatgtaagggtattatcgtaaattattattcagtaactctaaaccttcgccattctcaagcgcctgaccccatccatcgttgacttcgtcgcttgtccatctccctctccgcctccatcatttccagcgcgatcgacatctcctccccctccagcgaccaagggtggcccttctcctcttcgccaagccgctgaaggtccttgcccacggcggacgactagtcctgccatgtagctttgaccaagacaggagatcgccgggcaattggacggcggacgaaattcaacgggttccggcgaacggcggcgaggtaggaggaatgggcaactgggaatgaacgagtgtagtatggggatgtggtggacggctcggattggccaagaaatgagctatggcagccggcgacgtgcggtggcggagctcgagtgaggcggtggcatttggtcgccgccggcgaccgtacgagcggctaagggacttgggaatgaggtgtttggatgctacatgaatagggactgtgcatgacttcacaagctgccgcggagctaatgcaaatgcttttgcataaacacgacagtagaccagggagtttgcagcaaagagtgaatcaagatgttctaagcccccattagtagacattgtcctatgactgaaaaaaaatcaatttagtggcaattgagggcttagctacccccatatgagcacaagaaaggaatcatgtagcgatgattcagagcgccagaatatgacagaatgcagttagatgtttcgatggtatgaaatataaaacaaatcctgaattacagctctgactgaaatgcaatttacatatgggcaaaactctaatagtgaaaaatctcatttaagcagtttatcagattttttcagtctcactctttcaggagcaaaacaacttgtttactgatccaggagcaggatgacatatttcagttcaaattgcttggattcatctcaccccatcacagttgcacacaaaaaaaatgcacaacacactgacatggtcaacacattgacattactagtagtccatcactattcaccttttcttttttacttaaaccattactgaacaatgaatatattgggacagtcacaagatccaataaacatcagtatctcaaagctcatcaattagtcaatgaagtattcgacacaccatacaactgaatattacaagcagaatgaactgggcaggccttcttgttgtcacggagccacttcgcgatgttgcaatcctcgtggaagtcatgcccgcaggagagcgtgcggacagtcgccggccaccatcctgagctagcagatcgggcatgccacatgcatcgttcagcgtccgatccagtgtcctgacgccgccgcgagcacggatgtgctgaaacctctgagcattgcggtctatcaggttcgccggcgacgccttccacggcaacacgcagcaagcgacactgttgcatattctgcatctcatgccgtgctcgcggtcgaggaggtgctcgccgatgcaagccacaagactcgggcacgcacggagggggaccggggatacggcgctagaatgtatcgcagctgcctcccaagtggccgcagcccacacaatcggagcaacacggaatggagatcactacccgccggcggaatggattgaatcctccaaagtgggcgctgccaagaatctcaggtcttgcgcaggggctccggcggaatcggacgcgcgcggaaggccactcgcagcggacagaaggccacgatggcgaaccaggatgccgacgtggaatactggagaggaggaggaacggatagacaggtgagaggtgggaggaggggacgcctgagggtttcgccgcaccgcgccacggcgtgccgggaggagtagcgataagcaacgtgcgtcgggcgagatgcagtgcttttcgtcggacctgatgcgatcaagccaagaccgaccgagacagagaaaatagatcctgccaaaattgcccctaatatatattaggagattactaatctaccctttaaaatgaacggtcgagattaattttacctgtagtataatactccaagtagaaagcaccggagcattgctccaaaaacaatgatggtgactacagtaccattattgcctagttctgtttctttggacgcaaggtgcttttctttaaagaaacgtatttttgaattaaaaatgtcaatacatgtttttttaaaattacacggtacaacgcagatattcataacgcacgcacgctcacctctataaacacacgcatcaatacatgtcgttgaacagaggtcacattctcggtatctccacgacggcgccttccctgctctgcttagctagcctgatctcgacaccgttgatgaacaaggcgtgtgcctgcgtggcccatatgcgattttgcaactacgagagtatccagcgtggataacttgacacttccgctgtgccgggcggcaactgcaactctgcaagcacgtaactagagctaggccggggcgacgcggccacggctgcgtcgatcgctgcctctaccacagaaccgcatcgatgcggaggtcggtaggtagtaaagatcggtaggtggtagcgagtggcggacatgggcgggtgggggtttgagctggcttggcacgccgcggatccacgcattccaccaaacacacatcccccccaacgggcaacgggtagctgcgctgctagcgaccagcccggccgggacgcgtgcacggcgatgttcacgctttgcgcgcgcgctacacgcccacacgacgcagacgcagcacagcaccaccaagcccttgcctctgctgcgtgccaaattcagcacgatttttttatttaaaatatttaaaaataaattactgtttcgacgttttgcaaaaatatactcctcccgccctaccataggacgtgccatataaatcgtcctatagtagagttatagagcaatctatataacgtggcgcctcgctaaaggagtgtgcaatgacaattttgtagacagccccttcccggagatagtgtgatttatcgctgggagggggaccgtctacaaaattaacacggtgcaaagtttggtgatgcatgggacgtaccatagaaattttgcaggtgacgaccttcgagtgataaagcgtcatttcttaggtcaatttatcctcttgggccgcctgcaaaattattatggcgcaccttccaacttccacaagatgtcacatcatatatattaccttaatgtagagcgatttatatgtccaagccctgcaaaagggcgcgagaagtatatttcaaactttgatatgagaatttattttttaaatcttttaaaaataaatcttttgccaatacttttggtacgtcatccgtgtttgaatcggtttttaagttcaatttctttaggaaatatagatccgtgttagagtcggtttttaattttgtttgtttttagaaatacagaaggagtcgtataaaaaatcttttttaaaaaacttgcatgctaacttgagacgatcggacccctaattgtggctcatgattttgtaaaaagaatatccaagtgaattcttacggtgaattcaccttagctaaaccgtacaacaataataagactaaaatagtattcacccgttgcaacgcacgggtatttttctagtaaacattaaaaaaatcagcccaagcaatgtgccagtgtggccgtttgggtgtccatttgcgagtgtgaagcaccgtactacagcacaggccgacctgggcaaccatcggttttccaaggcccaaaaggagttctttattaggccggtaaagtactaatgggttgtacacaaggccggtccatttaaactaggaataagttcaccggagatccctcaacttaacagcgagattttttaggtcccttaaccacaaaaccagaaatgtctacccctaaacttactcaaaccgttcaccggaggtcccttggcagtatttttgccccgttttgctgacgtggtatcctagtaagcaaaaaaattttaaaaagtatgtggggcccacatgttagttgcacatctttttctcttttcttctccttctcttctcttttcgcttctgtcctctctcttctccttcaggctggcggcgggcgcagccgcgatggccgagcgcaaatgcgggcggccggcgagcgcggcagcagagcggtggcaggctgtgggcggagcggacggcgggcgagcccggcgacggagcggaggctacgggcggagcagccgcgcgccgtgtccgccgtcgtcatcggctctccactgtcgtcgtcgccgtgggcgaggctacacggtgcggccgttcggcggcatcggccaggcgtcgcagtggccgtgcataggtggctcgaagtgccggctgacgatgcaccccagtcgctcgcgctcctcctgtgccgcggcagcggcagtggtggtggcggcagcgtcgccggcctgatcccatggtcctcccggacgcccagctcgtgcagctgtagcaggagcgtgtccacgctcggcgtgccatcggcatcgtgaacggtggtcggcgcgggcgcggtgaccctcgtcgtcttcgccggcgtcgcggtagcacttgacgtcgtagctcatacgcatatacgccgggtacagacggccgcatgtacatgcgtcttcgtacgagcatatatatgcatgcatggagacgaccagctatagcctagctagcttcttgttggtttgccgcccgataacatgcagacgtatatattagccaagcatgtgtatatggctgagcacactcgcatgtatatatgccattacgtgaagcggaggagcgcggatgcggggggtgcagcggaaggcgagcgcggcagaggagcggcggcgggcgagcacggcggtgggcaaagcagcggagggcgagctaggcgaagcggaagacagtggatgggacgaggagctcccccgtgctcggccgccaccaccgccgtgcccccgcgggtggccgacgatgctaggagaggcaccaccggcgggagaaggggaagaggcagaggaagagattgtttcttggtcaccggccgcctccccttccctcctaaactcgctggtcgccgctccgcagccgcgctcgcgctctgctactctgtccgcggcctgctcgcgctctactgctcggcccgccaccgcgcttgcgccttccgctgctatgtgcagttgacatgtgggccccacgtgttttttaaaattttttttgttgactaggatgccacgtcagtaaaaccgggcaaaaatactgccgagggacctccggtgaacggtttgagtgagtttaggggtacacatttctggttttgtgattaagggacctcaaaaaatctcgctgttaagttgtgggacctccggtgaacttattcctttaaactaaaccagggacactgttatatttttgcgaaaagagtccactttaggtctcccttcttgtttactgaatttcaaaaacatccctgaaccacaaaaccagatacaacacatctcctaacttacaaaactaatgtacacgaggtcactcgacagtattgtctctagttgtggttgacgagacgtctgcgtggagttgacgtggcattgagtaaaattaaaatttgcagaattgaaattaaatatatggagacctatatgccagtcaatcaaaaagattaaaagaatatgacccatatgtcagtaggtcctactttctccagctcaccctctctactcctatctcctctcttcattgggatcaagactaaggcagctgttgaatggaggcggagagggaggaggccaacgagcaaggtggaaaaagaggaggtggggaggccgacaagggaggtagggaggccagcgagccggacggagagggaggaggccgccggcctcgcgccttcttccacccaactctctctctctctctctctctcccccccttcctgtgccctagagagcaagggcgctcggtggcgaggttgatgcctaacgcgatgaggttcggtgcggtgatggtggagatcaagcgacatcgcctgggagctcctacgctatcacaacctcctgacgatatgggtacaacgtccatgggatgagaaccaagttaaactagacatgtagctaccatgtcagccgaaaccatcgtccaaactgcttttggaacctttttcattccggttttgagggacgaggaatacgttgtagccggttttgcggttcaaggatattttaagaactcaacaacaagatgagggacataaagtggaccttttccccctatttttgctcctttggactttatcctattttcgctcctttggaacaagggattttcataggaagtttgtagaattgaaaccccatagaaaattttcatattgggccctttgatttgaaggattgggctagaaatttcccatagaaatgcatcatttccttcactttttggtggactttaaagagctcaaaccttatggtcttgatttcctttggaaagtccaataccctatctttcttcatctctcctctcaactctattcttaaataatgtttttcatatgaagtttctgtgtggagtatccaaacggtttatttgacaaattcctgtgttttcaatttgttagagttgtatatgctatgacattcaattcctatattttttttattcatgtatttttcgattactatattctaaatgggtgagagtatgcatagtacacgacatggcactatggcaggtcggtggctgatgcagacatgcaactcccggagtgccggttgctccgctctagaagacgatggctttcttgtgtgatcagtgatcacctttcacccattgattctgtgggggagaggtttttttttttaaaaaaaaaacctttctggaacgtatagcgtgcgtacggagtatagaattaaacgaagtagctcagtgacagtatacatgagtaaatgtaagtctggattttgattcggtttgcactaagacatcattcatctgtaaaaggaaaaaaataggggaagattcaacagaaagattatggcaaaacaacgagtagttcaacacaattcaccactgacaatcatggggaaaaaaaaaggaacaatcctcctactaaagtagtacaaacaaaggagaaattggaagtttcaacagtgtgaaacaaaccaaaacaacacgacgcaccctgttacttgcctacttgggcggggtgggcggtgcgaactgctgcggcggcgcgggcggtgcaaactgctgcggcgatgcggcctccgcgcggccacggttccggccgagcaggtagcaccccagcgcgatgacgagaaccaggaggatcgccgggatcgatatcacgagctcaaacatggatgctgaacaatgaatagccccccgcgcctcctcttcacctcgatccaaccctgcgcttccgcgaccgcgcggtgctagacgaaaccggaaggcgccgacgaacctggagaagacgggcgcgcgaggccctctatggcgagcggtgcaacttcccagcggcagcgatgcggttccccgtcgcgaatggcaagggacgtcgcggcagctggcaacttggcaccgtcgtcacagtggctaaggttgacgctccggaacgaactgtatcaggttagataatctagagaaaatccaacacgccggaagcctctaggaggggggctatagatccagcaacgaaaaggacgcgtaagcaaccacgatttggacgtctttatttaaccaaaactgtttcaggtttctgtcgtcctgattgagcagcgcacgaaggaaaattgacaaatttttaggtccttgagagaggtaccttctggcaagtggcaactgatattgagttgttccaacttttacactagtagatatggtacttcccagtacctcctcaaaaaccatgaaatcacccaaggaaatttgtagttttgtacacttcagatcgcctacagcagagcagagcaatggcttgcagctttgctttatatagtcaatatgaataccggtacaacaattcagtgtatcaaataatgactacggactacctgtatcagtgtatctcattgtgtcaaatgatcgaatccaatctaaaatttagggtagagaattgcaaatacttggcatactaatgcggttttctcggaaaacaatgtgacagcaatcacggacaatactatgggtccaaattacaacaaacatctatttttcacatacacaagtacacaaccaccaaaggcagcatctagagaaggaatagaaaaaggcttctcagtaataaacatacctcatcagttcctctctggttgctcagtttacaactaaataaacaggtgaaattacatgttaaaactggtcaaaatatctcacttgcttactgcaatttcctgccttgcacaagatagttcccaccttgcaaaatggtcttcaggttactgcaaggcatagataaacaacgaaattgtcttacactcggatgaaccagagaagagatatctcatacctcgacagtttccaaagaaacttgtagaagtggaagcttcaatttgaagaaaaaaaaaaggtgattgaaggattcccatgatgggtatatcatactaaaccagcatgtcaaatggagataccgtacttggattggcatactattaaggtatttcctactgtcattatttatgatattgcattttgcttggattcaaattaaatacagattgaaagtatcatactactgaacattggctttacaggaatgttcagggaaaaagggccgggaaactttcagcacattcttaccagccaacaagaaaggtaaatgaatcacggggaagaagattgtacctctgaaagaacccaaggacataccggagaatgtaccatagaaggcaaagcatcaatatatctgttatagtcaagtgattacatactaataactcaaagctcttttcagtttgctgagattagagacaaaccatgtggtttgccaaatagtataagtacagatatttcattcttttgtttcgaataagagatatttcaaacattctttccaagaaatacgaataaagaacatcccaaagctcaactcccacagaatagttgatagtgcaataaagtaaaaagatcactccagattacgaaagaagttttgcaagaaaaacagattaaagaagcagaaaaatcttggttgtaggacaattaaaatagcatacagtttacagaacaaaaggttgctagaaaagaaaatacattgttttgtagtgtcaaaggagagtttccctagcttagttctatgtgctttcaagaatctgttggtgtttcacgttcatttcgcattccatgtcttgctttctttcatgcaaatatgcatgtcatccacacatttcagattttttttaaaaaaaaaacaacaacaactagccaagagcccgtgcattgcaacgaaaaaaaaatagttcctagcttattaagtcaattaagcaaatatttagtccaagtagtatttttatgattttcattgaacaaataggtgatttcaaaatttgggaagagccagcaatgaaacaggagactcattggagggtggattgtgaggcccaaatgtcggtgataggttgtggcagaacgaccaccaccactatgaacattttagctagtatagatacttgtgtggggaaagctcacttatgtaatgcagttagtttatttttagataatagatcaatacccggtctctacatccaacaaggatgtccatgctatgttgttagcggcagtagatattggcccttggttaagaaaaaaaatcaggagaaacgagacttaacttacagaacagttgaccaaaaatccatcaagtacttagctttaaaaccgaatactaatactagtttttgccatacctaatactcctaagagattctacaatcccgaatttgaaaaccaaactaattcctcaaaggggatcctaagattccgaacggcttcaaaagataagatcatacgttcccgataacaagactattcttttttctttcacagacaccacgcggtgaaacggacagatatcagaatccaataatttcacccgcgcgggcttctcagattcagagtcaaaagtaggagataaaactagaccgaacaagcagcagatttgaaggaacaaggaaatcagtacaggggacaagaggaagcaggcagtggaaggatactgaagaggtagcgctcccaccaatcgagcatgtagagaccgacggtgacattgtagatgtggatcttgcgcccaatccagttcatcctccacgaggaacccgacacctgcagatcacctcgctcagatccggagggagggagcggcgccgcggtggggtgtcagattttcagagggggaacagtggcaactggaaggagtagtagatgcgaacgaagagaagggcttatttgtacaattcggatctaaataaggggcatattttaaaattgttggtagtggcccagaaaaataagttcactttagatccttcatcttcacatcgagtttgaattgtatccttaaaccataataatactagataaaacgcatcctttaacttataatacccaagtacctgaggtcgcaaggtagtattgtgcctagtttcgactgacgtggtagctgactccacgtgggacccacatgtcagtggcataatctacttcctcatctttttcttgtctctctccaagcggcctctaaggcatgcggtcgatggggagaagggcggcgagcagtgaccgacgagaaaaagagcggtggccaatagagaggagctaggcagagaggggaaagctcaagttaggacacttgtcctatcctcctaagttaccattgccgctgttgtgaggagctggtggagatggggaagcataggcttgacgaggagagtgggaggtccaggaagcatggtgtcgcctcaccgccgcggcctccaaatccgcacgatgctctgccattgctagcagcattgacgattgagctcaagtgtggccaccctcctcatcgtctatggaggagcgcaaggacttggcagcgtccagggacctccccatcctccgacgtcgataggatccactggacgggaaggagcatcatcgacatccgctaccgccactcccgcctggatctcaggttcttagtaaaggtggcacgacaaatctggcaaatccattgtggccataacacatggaatagtgtcaccctttcatctatcgcctgcaacgatgctgcccttccagtctgatggctggtctgcacagctgcccgctaccatcgcctcgcctcctttctccccgcatcgaccgcaacaaaggcgccccctgccacccaactcttctcccgtcgatcaccgctcttctccccgccggatgccacccggctcctctcccatctaccgcagcccatctccatttccccatcggactgaagacctagagagagatagggaagagagggtagagaggaggaagaaggactaggttactgactcagccaggtttactgcaatcaactcatcatcagctaaaaccaggcatagtactgccaggagatttcggatgtttcggttttagaaattgaggtacgcgttacatttgatactgtggtttataagaatgtataataactcaacctcaacgtgaaagtgaggtacctagaatgaacttattctggcccaaataagaaccggtgcaaaaacgccatcatatgggccgggcaatagcaggtgaatcgatcgatataagctttcatctgggctgttatgggcgggaccgaagcgaactcttcctctagcttcgaactcttgcacggagtaattgatatcctgattctctgcatctttttcagaacatatgacgaattcaaagctcgggcatgacctcatgaatttcatttcacgggttgtaacttgtaagagcaagtataatagtgagctataagattactataaacttatgtggagaagagatgtaccaaaaagttaaaggtgttggctctcatgcaagagctagcttaacacaagctccaagacatatacaattagagcaagtataatagtgggctataagaagtctgaatgctgaggtggatgggagaaaagaggagagagatgagaagcgggctgtaagtttacagccggcttaggcacaataaccaagaaaatttgtgagatagacatgtgcaccatatatttatagtgaagagctaaccattatatgagtgagctgatagataggctataagtaagcagctggctgtattattatccttgctcttaatgtataagtgagagatagaaagatgagaagaaaattgtagtcaaccttataactaatctattagagcaggtacaatagcaagctataaaccagctataaccacatatcgagaaaaaaagagaagaaagagaagaaagcgggctacatatttgtagttagctgcaacatggactccaagacgttatgtgtgatgaaaggtgggaccgggtattaatggtataatatatttttatagttaactattgtataaatgggttattagattagctacagttgttttggagccaataattggctatactattaaacttgatcttatatatgttggctttaagattggctaatagtaggaagtgggctctattattatccttgctctaagcattagtttcacgtaggtaggtgcgtccagttaacttgacagcgtacctgtaaactccacgcaccggcaccgccggggatgttcaggcgctgtccaacttttaggatgtttatctggcatccatacattttcacttatttcaggtggagtctctgtaagtctgtatcgtatcataactctgatgatggttaggtcacacattttcactagttcaaacagagtctctgtaattttaagtctgtatgacatcataactgatgatggttaattaggtcattcattttcactatttcaagtggtctctgtaaatctgtatcatatcataactgatgatggttcagtgcgaccgggccattctacgttcgcgttgaacagttcgtgtggtaaacatctcatcagtaatcacaggaatcaggacacaacatttaaaccaagctcttcctgtgcagtttaaatccgggtcatcactagactactcgaggtcgtcgcagcattgcagcaaccatggcttcgcctctatctgctctagcacctctgatcccgcccgctccgcaggtgccagtgccagtgccactgcttcctcctcctcttcccgtgccggtgccgtcgccgctgaactccggcttgcagaaactgtagtaaatctctcacgcatacccctgtcgatcgttgaaacggggggtttttttttaacaacattcggtagctcgtcttgtttgaagaaaggctacagttttactcgcttatatatgcatctgtttggttgtttgttggttgcaggtcgaggttcttgtgctgcggttggcttgttctcatgctgctgctgctgctgcccaccaaagcgtgagctaggatacctcttctgtagcagcggttgcagccttgcaggactgaagaaggtgacggggctgaggaatcagtcatatatccgctgctgatcgatgcattgacgctgtcgcacctgcaggctatactctgttgcggatatatgatttctgtgtttctaaaccgttaagtcgttaactgtgtgcactgtggtgctccttataattctgttcgtttgagtacctgtgaattgtgatgcatatctgtgaataaaaggagacgtgcttgctagcgtagtgtgaggagtgttcattgactcattgttcaacacttcaactcctaacacaagttcctctttattgcttatttttcacccgtaaataaataaaacgccattatcttggtcttattagaatatctttagcatgctactagctgttgatttttttttgagtaaattgccatttggtccaccttttattacccaaatttcaatttggaccacccttaaacctatctttttaatttggacagggtaaatttaccattgttgcggtttggactaccatgacaacttttctcgtcatgtttaactttcctttcggcaaacatatgaaccatatatagaggagattggccgtatactagagctgatgtgtttaaggtcgttgattgcatgagaaaaaaaatcattcgtggtagtccaaatcgcaacaatggcaaatttatccggtccaaagtaaaaacatatgtttaagggtggtccaaagtgaaacataggtaataaaatgtggcccaaagtgtaattcactctttttttttcaatgaaaaacgcgacttgctaagttagatcgttacctcaagtccacatcccttgcacattttcacatcttgttacactggtgatcaaatatcgaactctgttgacgagtcttgactctttgggccgatctatgagttggacaggatcctgttaaaaatatagttcgccttcgtcacggggaataagtccacttttaaccccccccacccccacccccaccccctacgcaatatgatttgtaccctcaatcacaacatatgatattttacaccccaactattaaaaccaataaaattttattctcaagatagtattcacagctaatatcatttgtttggtccacccagctaaatcagtatgtgaggccaaacatcgcctcttatttgttttgtatgtctcaaataccaattcaaatagtaatttaaaaaaatctaaaaacttgacaacattgatacattactcatctatcatcctgatccacagaccgaggaaaaaaatacagctcggttagtaataatactagaactaaaaaaggcacccttctctagtagtggactatgggcaatcataacccatagtgtctataagcagtgtctatggtgccatgtcaataagacatcacaataaaaactacactctacaacctatggtttcttaaaatggactattaataaatacatcatctctcttctctaccaatcatatttattcttcatttattatgaagacattattctctcccaatgtaaaacttgatagtgtctagtgcataggttctcgtgttgaagctgtgtcttgcatgagacccagtttcttcctctcttcactctctctcttaattaatatagtgccaaataagctaaaagtcctatatggcaatgtagttaaatgctatagacactatcctaggtggaggattgagactgccctaagcgagtagttcatgagctggtttgtttaacttaacaagttaattaaaatactaactcggcttattaattatgactacagatttaagctgatccataccgaactcgaatactcgatacgagcttcgagcttttctattccacttacttccagtactagtcaaataatctgctttagttatcacactatccaatcgatagaaaaaactagagaaaattcaagaaatactattgacaagcgttcaattccaaaaaatatcatttataaatatgtgttacatgaaatgtcatcgtacaaacgattatgttccaaaaatcatcgccgttagggttccgttaacaactctgttaaatgctatatgatgaacaatatatttaacgacgcgggatggacggaaaccttaacagtaatggcatttctgggacaatttgtatgatgacatttctggtatttcttggaatttagcgcttgtcaatgacatttcttgaatttttctccaatactaaacttaattgaaagactttgttcaggagcagtgctaagtaaaagattaagcacttgtctggcttattatcatttcaaaccttaccaatattttggtaacactaagatttggtattgtcaaaattttgataagaggcgtacgtgattgtttggtttggatcaatttttttttaagagcaaggctcttgttcgtttttcttggcaaaacttcagccgtgccaattttttgggtagcaatttaaattccatctaactttgttgacaatgtcattttttaattttggcacggtaagtttggacaccaaacaattgcttctagtacgatgcaattgtcggggtccaactcagtagaagtaggactgcgctaactaattaaagttctgaaccgatcagcctcataattggttgattcacacaatttattattggtccccttaagtatatattcgctgtaattctgcctcccccactggctatgctctgggctgacatggatcagcttgccactagaattttgcagttttgtccttactaactattaatgaatgcgttcccggtttttaaaacggggccactgctaccacacgggagggacgaagcacgtgcatgcttaatttggaaccagtggcactgtggtctgtggatcgttatctgtactacctccatctcaaaatacaacatctcaaaatacaacagtatattccccgtaaaaaaaatacaacaatatatagaataacatgttagaaaattgatagaaaactttaaaacatttaaataatttgtggttcatatttaatttaattgggagtacccgatcctcgatctcatcgtgccctacctaggggagagaagcatcctgactgccgtttgatgatgatgcacaagatggcagtatgatttgatgatagaataacaaaaagaaaagacaaagttacccttttaatccataccgtttgatcacgtatacttgtagtaatatattgtaccataaaaactctcaaatacaaatatataacttagctactaaactggatatatatttatccaaattttcatatagctaaaagttgcgtatcatattctacgacgaggcgagtacgtactatgtacctacattaaagatcgatcagtacagtagagcagtagtagtactccaaagaagtgtacagcttaacatgcaaacggcgagaattgcacgtacatgtgcctacctgcctgcctgcgtgcctgccaagccacgtgaaggccacagccagacgacgctcgctcgatcgatcgatcattcatggtcttgccaacaaaagcgttctccagtactcctatagtgcccgaccattagcttggctagctaggcgcagccgtttgctgttgcagtaattcggcgagctgatcgagcgcgtgtacacgcacagtcacacgcgcgtaagtgcgctactgctagatgcacgtgatatgcccttgattcaacatacgaatgacgaaaaaaaaacatgtagcgtaaattttatatgtagggtaaatctggaagctacagtaaaatatacagataaacacttgttataaaaactaggaaggttagttccaacaaaataagttgaaattaaagtaaggaatttttctttttaattcaattctcattgtttattttttccataaaaagtctcgagaaacttttattgctagtaatttttttaccaacgtgcttagctttctttttaattgatcaaatatacgtatcttatttaaggcttctctgtaatatgtgagactctatggtattttaaagaaaagacctagtcaatataaatcttaaagtaataatttattagaaaaaagtatagattataagaaaagctactgatttttgccgccttagaggcttatacatgaaggttgtggagaaacccatggagctactttgaagaatatgaatttactgaattttgttgatttattattgaccttcatctcttggattgcttaatatgacttgtatgaagacaaatataaaacaaattgaaagaataaaatattattacgttgtaaaatgagctatgttttactataacgaaaggagtagattgattcaatactatcttacgtgttaagtgctccactaaaatagttttatgtgtaaaagcttcaatgctacattgctggttaagcaccccataaaatagttatgtgtaaaaggattgcaaaagttattttcaaagatgaaccttgagtttgaggcaagaggcttggcacataggaggctgcacatttgagtcacatgtgaaaagaatgctcgcaagaaccatttgtgtagtagtgggatgaaaataattatttatacaattaaaaggttggaaaagtgaaaataatggtacttgtgcccatattattgtttgccaacaaccgatagaacttgatagaacttgatagttctttttgttatgtggtataattggctagatattttagaacttactattgtatcgtgtagctgatgtacctactaatatttctctatatgctgcattttctcattgttgattaatgcattccttggtgcatgtgacacaataaatatttcaaaaaaaaaagtctagtcgagtctaaattgattttggattgtgggaaataactcattgtttcatgtagagtgcgtgggacttcaaatagactacgaatataatttcatagataaaaataactctgcaagcataattattattgtaatgtggacttttcatgattgccgtcatgatttaaaaatttttactctaaaatttataattcaaggaatttatatactcgaaacaatcactctttgtaactttcttttagctaacatgcattaggcatttagtattacacttatgtgtaaagtattactttaaattcatagccgtataataaaagggataaaaattttgacagtataaggagtataaatgtataaaatttgacgatctaaaagtacaaacaataatttttgtacaatttttagtgagatatgtgtgtgtatgtgtgttagttggtttacaccatgtgttcacgtagtctgtgcataatcttcaatgcgaagcctgcaatacctaccctattttatcttctttctttgaaacaattaggcatttaaacaatcatggtagtttattatgtccattgctataagatggcataagtacactgaaagtaaaagttttactcatgatgatagtttttaggtttgcaatatatgtggtttatactacatattttaccttataattaattaaacctctgtttatatgcatcgcgccgccctcggtcccggcggtgcacatgtaaaatcgtttgcttgaactaaccagaaaacaaattcactccaagttgtttgttgcttatgtatggcattatatatatctatggcctgtgtttatgagtatgcttaagtatatatatcaatcgttagtttgttctagccaacgaacaatttagcacaatacagtatgaatcgggacatatccatcttcataaagttgaagttgtgttgtatacaatataaagtgtagctcatcaaacaaacctgacaccgtgacagcgatctcctgcaacgttggagatgtcgtagaatttgtttacaccgtgcatcgcatgcacttggtaggtgacgtgggtttgaccgcttgaggctctgattagttagatctttctaatctaacggtgaaggccctggttgttctctttcgataatataaatccggtttcatcaatttaagtgaaaatcaaggatgatatatttttgctttttatcataatttatatgattttctaaaactattaaagtatcatgtgatgtcttagaagcgtatgtagaatgtcatgtgatggttcagaagcatttgtagaaagtttgaaggacttttatataaagtcatgtgtttgtgcaagtatattaccccctattaaatttacaataataatgaacaatgtacatatgtgttcgtagaacacatttgcacagtagatataaagttagcacaattaattttttctgcaattaacaaaataatttatcaggcattggtgtgatcttggtacatctgatcagtctgtcatgaccaatgctaccatctcggccgaccaatgctaccatctcgatcgatcagcagaaagagaggctgtgaatttgccggggttctgtcgatagatcagtcgaggacttctccggctgccatcaattaatatgcctggacgcgccggattaatggaacgtcgatcgacccaacgttcggcatcacataggagaggattttttttttggcataattgtaacacgcatgggaattcaatttgttggaattaatggatgagccttagcccactcaaagattaattctttggaaaatcacagaagcccacctcatgggatggcatgcatgtggagtttagtaccaccttgcttattctaggagagggggacctccttaaaagagaggatgccctcctagccacttgaagcatgtgtggtggaaagaagagggggaacacgcttgctcgcctgccaaggcaggcggcgcgcgtgcatgacgtacgcgtcgaatgatccgcaaaattgactcctcacccttgcgcagatgcagcctccttttgtagttttgttttgctgcaggaaattcggatttgttttgttctggaaacattccgaaaaatccggtgcgtgaaaacggcgtggagtccggataagtttacgcgcgacttacccggtccggttacacggagtggagacttttgcagttttgttttgctgcaggaaattcagatttgttttgttctggaaacattccgaaaaatccggtgcgtgaaaacggcgtggagtccggataagtttacgcgcgacttacccggtccggttacgcggagtggagatcatgcggacgccctgatcaagcgacctatctctataaaaaccaagccgccgccttcacgcaacacaagcgaaatcaatttagggtttgcctcctactctgtattacgccgtcgctcgtagactactccatcctgcttgccggcgtgcaccggcgatcgggagagcaggtctccggaacctctaccttcgacgtcctgcaccgggagaaggtggcaataaggtttttgggaagcgcttcgcgcgactgctccctgttcatccacaacagctcgcctttctctccgctcgcgtgctgcgcgccttcgtcgacgcccgcaaccgcgagtagttcctgccgagcaaccagtctttccgctacctcggtacgtgttcgtcatgttgcgcatatttgatctgttcatattttactgcttagtttacatgtgtagatctaatgatgtgtttatgctagtttacatctgcaatgtcataatttatttatgaaataaattaaattattatgtgctaaataattcaacaggttcacgaaccagcttgggtattctgacaaatccactcatatttcattgcttacttcaactacccggtacccttttctttacagtgtgcctctcaaaattaagaagcattcttctttgataaaggttatgagtatggcagtgttgaatatatcttctcaatggtcaattatattacatgacctaagttagtcggttgagtgggatgatttgttttaccaactagctaagatgaccctctcagataaaaatgactgctttaattatttggttgctagaaaaagctaatttttggtcaaatccatttacagggcaataatgaatttcaatgtaaaaatccgcaagagaattttaggagttaaaagtatcattaaaaatagaagtctttacatgaatcttttatatataaaaaaaagtaatcctaaataaacatggtaaagagaaaagagggaagggggcaagcaaatgtgttttttaatgcacaagagatcatttaacacattttcttagactgtcatgttgttgcgtgttttgcttcgcggtgtatcttttttccttttagtgcaaaagaaattttgggtggtggtatattttttctttttttctgattatggtcttacagggttgtaattttgcttcttttttttttttttatcaatagaacttcgcatcgtatcaggcgagtcattccaaaaaaaaaaaaaaaacaaatgctcccaggctccctgctttgcctggtcgatcggccgggagactgcctgtgttttcctcgtccttcctcctctagctgtaagcctgtaacctcgctgtaaagaggagcctgtgttcttcatcagagtctggaccgtgaagccattatccactctgaacagttagcccttcaattctactcccaatatttactgatgggatggtccagaaaataaactcccgcactgcgcgcaataacttttcaatggagttgcaaaagtctgctgcaacttaattttgcaacagtagttgcaatttacagctagctcgttgcgatgacagtgcttagacttgaagcataaatgtccaaaagaatttcaatcgagatgatggatcattggaccccctatatattacactggacctgtagatacataatgagcatatagggaagtaagtaaagtggccgccccccctatatgcgttttcgctctgcctaaatgcatcagactacattcagctagtcaggattccctgaacgggttgcatgtgcatgtttcttctcttcttcctttgctcggaagtctgtctatgtcatcttgatgaaccctagctagtgtataacaagcaagcagggttgtgtcgccgacatgcataaagcttttttggacatgcgggcctgcaggccgcagtaagaacgagccggcatggtctcatataaaatctgaactaaccttttgagataagaaatctgaagtagctagcacgaacggtcttcacttctgctaaacaaacaccggaagagatcaactaacagagacggcattattagtttaagtgattccaagtgttctccggatcaatcatattaatttagcccttcttgatgcatgtcctgcgtaattagcacatcacattcagctttctgctttctatacacccagttaggtcgaatcacacaacatgcagctaccaggatatatattataccaacacaaaataatcagatgatcagatggggcctacaagatacctatatataacagcaaagcggtagtgcactcaagtgtgagcaaagccatgctgtagtgggatctctctccatccattcctgcagtgccgccactgctatagctgcgagagctatagctagaaaaatatcaacgtagaaagtgggaggagaagtagatgatggatacagatcacactgagataattaagaagggagaggcagtagtggaagccatggctctactccagtctcggttcaggaggatatgcgtcttctgcgggagcagccagggcaagaagaagagctaccaggacgcagccgttgagcttggcaaggagctggtacgttctactatatttctcaattctcatatatgtaatcgtcttgacaaagcagctgcttcatttttcaaccttgatcatgacatcctttctgagatcttgcttctttaattttctctcgttaatcaaaaacaccatggccatggagctttttactgatattcagcacaacgcgcctggtgatatgtaggtatatagagagtacctgacaaggttttgggtttcttttcaacgtcgtaatcttggagtaatataattatcaagctgtgtagacgtacacttgctgaacaagggctaaaatttatctctctatatatttaagtgacaatatatgcgacattactgctagctgtagacgtactcttgcagtgcatgcagcttgttcttagtagaagatgagagcatatgcatgagctgagcacagcatgtgtaggtctgaattgaatttctgtatcatgcagtaaaacccacttgtattacaaaggagaatgtcatgagggcttgcacatgagcttattaattacttcacatgaaagacaatatgtctgccggtgaacatggaattctatatttatgcagcttgcatagttccatagaaaatgacttactccccaggaacctagtactggattaggttatgatcttgtataaggctgctatattttgaaacggagggagtactagccagcaagttactacgcgcatttgcatttgtatggtgacttttcgccgggattttcggtgctcagcgcatttttctctatccatttcgaggcacggtataaatgcaaaaatgaaatagacaagtcgcatggatcagtcttaaggaaactatatatagtgtgtactgtatgtagtagctagactacatattctagatcacttgatgatatatattatagaagactagattctagaatgtggaaatgcatccccactctccattattatggtttcaccacaggtagcaaggaacattgatctagtgtatggtggaggaagtgtggggctcatgggcctggtctctcaagctgtctacaatggagggaggcatgttattgggtatgtaaaaacgtaataattgttgatcattcttcagcactgatacatggaaagaataactccgtatatagtacactttgtaagatgtcatcttgtcatgacaatagacttggattatggttcctttcctcaggtgctacatgctagtactaatatataatttgccattttgttgtccctatatacacgcagggtgattcccaagactcttatgcctagagaggtaagcacgctcatctcccttccaacaagtcctgacatagtttattcacatgcaacgattcccatgagcttgacatcattgttgctgatcaccggttaaaatctcatcattttcattggaaatgtcacttgaaaaaaaatctagttaatacttattgatcaagcatgttaagtattttgtaagcatgatagtatcactagatgagattgctttttagaaaaaagtcagtagcactgatctaaaattatatcacttataggtattagaaaaacatatatatatggtatgtggatacatactactactggaaaattatgcttgttcattatctttcttgaatcttgatagtggaaagaagaatgcgatcttatctgcttacaaaagatcgcatggaacgttcaaagaaaatcttgtttttcctttccctcgtagatgaaatcctgctgatcttgactgccgcttctagtggctgcccctttgttcttaaggccttgatcctttaagcagatgctgactttattaatcagaaagaaatgtccctcacattttctttttgtcccccaacaacagcaacatgattgcctctcctgaacctttgctgcgttgctctgattaaactatacatgctaccactcctgttaaacagtgctcatccccttgctcgttggctagtttttgcatgctctcttactttttgtggagcagaaagctgcagggtgctcctgtgtctgtgcgagaggctttgtcacatacgcatgcgtgtttgcttgtgtgtgcagattacgggtgagacagtaggggaggtgaaagcagtggcagatatgcatcagaggaaggctgagatggccaggcaatctgatgcgttcatagcactgcctggttagtctctctcaccacctggatatattttttttaagataatgaaaccacctgaatatatagcttcatcaacttgtgttgagtcgacatgtactaatttgctttacttttgttgtcaattgccttgtcatattttttcctttatcatgttatgatacgtggctagtggaagtgtgagtggaaagttgcgtaaaagcaagcacaagcagggtgcatgagtttgactttgacctgctaaattggcttgcatgcatgctgctgccgcccagtcggtgcagaatccttctttatacgcatgagctggtcgatcagattgtcagatactcggataagagaggacctgttgagccacttcgtgctgatattttcagtatcgttcgtagcttatctttttcagttatttgattctttttcctaatcatcagccaactgaatttgtgattcgcccatcagtcttaaaaaaaaattgtgatacgccttgttagcaaggaccaaatttggcccatccccgaggatgggctgggaattttaactagattcaggaccatcctagtgaaatgggctagtattttttctgccttctcaaatcaaacctgacacaacttcatactactatggatttatgaggttcaaactcagcctagaaatattctgaagataatgcaaacatccgacaattatacccaggcagatgctgtatccgcagattccctcaatcaatactcgtatttctggaggagagagagatccagagcgagcactgttcattacttaaatttgtttactgcaggtgggtatggaacacttgaagagctcctggaagtaattgcctgggctcagctcggcattcacgacaagccggtacatactgaaatagttcatgatcagcttttgcacatgcaacatatgtacacgcactgatgaacaatgcacgtatatacacggagagccaaaacttttttttaccttggcttaatgtggacgatcgatgctacgtacaggttggcctgctaaatgtggacggctactacaactctctgctgtcgttcatcgataaagctgtggaggaagagttcatcagcccctctgcgcgccatatcatcgtgttagctccaacaccaaaagaacttctcgagaagctagaggtgtatatacttatatatataatctatcgatttttctgatgcatcatggcacactgcaaaggacagaagaaaacgccggtttcatcggtgaatgagagatcgagctgaactttcctcttgctcgcatgcaggcgtactcccctcggcatgacaaggtcgtgccgaagatgcagtgggagatggagaagatgagctactgcaagagctgcgagatccctggcctgaaagaaggcaacaaggcgaccatccaagcacagcgaggaagcatgctctgaaatttactgtagcactagctagctatagcttagccaatgcgtgcagcaagaagattcaaaacttcttggtgcacatgaactgcaacttttaattcatgtaactcggttcattagaaggcaattgatcactgatcatgcaattagtcgtgtacgtagccctaagaatgaaatcatcagtaagatttgtaaatcacagagctccagagcagcagactgacataaaacgatatgtgggctagatcgatctcctccgtgggctgggccggatttaacattgggccaggttcagcaaaacataccacagttcgacagttcgtgtgaacaaagaaaagagcatgaactattcgtatgcatgtactacgtaccagatgaagaatttttttcgtttttagatttttttaatatttacagaaataatctatcgaccaaaaaaattgcagaaatagtccctgccgccctaatggtgggcggcaagctgacgtggcagacggtgggtcgaccgcgccgtctgccgccgtcggccaaaattgcaattaggcccttgccgcccatacagaaggcggcaaggggctaattgcaattttggccgaccataaagagtttg

SEQ ID NO: 74311 - DNA, 7910 bp, Oryza sativa
ttgttttgttattagactatgtttaatactttaaatgtatgtccatatatccgatgtgacacgataaaaatttttacccctagatttaaacacagcctttatgaattatcgtcttgacaaacttcatctccgtgaagcctagcatacctttatcatttcacactcgaagaggcggcaagccagcaaactagcaatgcactgatgtcaacgaactatgtcaaaaaggaatacgaagacattttttttatgagaaaggagatgtgttggtaggactaaaaatgaaatcatattccatcctttcagttctaaacaagactaattcagcatggtccactggaacggcaatcattcttcattatgcaacgactaagagcaggtacaatagcaggctataagccagctacaaacatattttaagcagataaatgaggagataaaagggcagcgggttacagatttgtagccagctgtagcatagactctaagacacagtgtgtatgacaggtgggaccagatattaatagtgtagtatgtaactattgtatgaatgagctattaaattggctatagataaattggagctagtagttgactatactattaaacttgctctaaacaagatgtaagtacaaatttcccagagccttcgtgttatcctttactaggatcatttgactagcaatgccatcctacacttctgtctagcgaggaaaccgtatcttacacaaccaaaaaaattcatacaatacaattttatggtcggtaactcggtaatgcatcggctgtgaccaactgaccaacattcaaggaatttgagtccagcagttgaccccttgcaaaggacaaaaactatagcactgtaaagcgttcatgtttacctattgaaagagtaaagagtagcctctgccaaaggaaccatggaaaaaaaattagaagacactttgggaaagcaaaagcataaaaaagaaaagaactaaaaaatatgttccttttcctaggccgaaggtgaaatgctgcttcttgttcttccatgtggagagcatatgtacggttgctgcctttgcaagccatacagtgtaggaaggcgccatgtaatctcactccaaagaacctgtgtgcaatttcttggcattgggaatactagatccccttatcatctcggtcccatccttgtccgtgatttagaggcacgtttgataccctagaaccacgaaaccgaatagtgatgttcttgcccgatgtgacatgtgttcatgcacctctggaccctcaaaacatgaacagaaaacgtagaacccaaacagttcgttatctaaaaaaagaacccgaatagttcaggcaacagcaagaggcatatccaaggaggctgcttgttgttctgcaacaaggtgaagaggtgatagatctccctctaattaaaatctctctaaaccatcgtgtcttacggctcctgtcgagaacgagcaaaacgggattcatgcatccaaatccaaaggtagcaaacgtggtgcagtctcataattaagctagatattcacaatctgaagaactcatagttttttcatgggaaagatgtgtgttgctatgatccaaagcagtacgagtactactactaaactactaaaacaaaccatttcccgttgctgctcaaatagcgcacgattgtgaatgagtgtccgtagtagcaatctcagttgcatatgccatttgccatgatagcccaactctatgctcactaggaagactgaatcgattgccttgccccaactctactgaagttcagactactactgctatgcacaagcacaatgaaggccctatctatctaccgcaaacgaagcatctctcccctcctctccaagcagtcaagatccgcgaaatcctgcacatcgcgtttcatcattgcacccgcaagtttctgcagagagggggatgcagttttgtcatcagtacaaaggccagccaagaacaaaagaagcctcctttcgcagaatataagattagagacaattttttttccattgggcatcatggccatggcccccacattagatgcacgctaggcctcctcggattcgctgctaatgctgacgacgacgatgcacggcgtaactcacgttatcagcgtagcttttgccaagcttttgcgttagttatgccatggctttcctaacccgaacgagattaaagtcctaaagccaagcaaaggtcagactaaacaatgctctatctctctctgggcgtcgtcaaagctttgggccattctcgtggcctttttttctcacctttgctgcctcgcacacaggtgaactcagatgagaaggtactgaaggtgatgggaggggcggtaactagcagtagtgtggttgcacagtaaactggtagtggtaaaacgggaggaacagcagcggcagagcagcaaaagaagagggggaaggggaaaaagaagaggaaagagaaaggctgcagcgagttgccgtggaacggcagtgcgtgctggggataaacaaagccgaaagaaatgggctctcgcggcgcggctcgagaggagcgaatcatgcgcagatctttgtcccgcccaaatgcccacccacccccacacagcccacaaatcgtacgtatcgtctctcgccaccgtcctgatcatggccgcccctgcttcctcctaaacacatcttgcaaagctacattttggtgtatcgtatcatgtttctgagataactggtcatgttctgagaaaacgggcatgtgggacacggttcgatcgagtcagagagaagaatgcagtggatttcaagtgcctaattacaggtcgtgttgcgagtaacaaaatatgaaaaagaggagtaacaacaagtgacatacagagctgacaactccacgcttgtacgtgaggaggggagtggctaaaggagcctaaaaggagctctttccccgcgcctaaaactacacaaaagaacgaactcaactcactcactcgcaccaaagaagaagaaaggttaataaaagagaattctctcgctcgctgaaccaccgcgttttcttttcttgaggcttttaacaagcaattcgtacttgaaggttccctcgtcttcttcttttttttcttcatctcgccttcctccgcgaaattcagcgcgaagcttcttcggaggcctctgcttcgtcgagagaattcgaagccgattggtacagctagcttcgtggatcgctccgtgaccgcagcaatggcgagtcgaactctgacatggacgctgcacgacgcaagtgaatgaacacggggcgtcaggattcagtgcacttcgagacgagatcacgaaatggaggatcacaagtgacaatgtggcgcggggcgcgtaccacggtggagcgactccttgcagtgcgcgatggcgctcgcgatgccgtcctgctgctcgaggagcgagtcgtcgcggcgaggcggcggcgactggcacgccgccgtctgcgccgcggacgccgaccggctcttccgtagccggaggtccgcgccggcgctgggggctacccggcgcagttgcctcgagatcttgctgaggtaccgcctgatcacgtcccgcgagggcgtcctcctgttggcctcgtccccctggtccggcgagccgtagccgaacgcggcgaagagcctggccgagcgcgcgctgttggagctcctggagaagctggcgcggccgccgtagaacgcggccttggcggacccgaagctgagcgtgcgcagcttgccgcgcctgccggagccgtaccgcgaggcggcgtcgctcggctcggacgcgcagaacttgaggtgcgcgggcgccgccgccgccgcgcgcgcccacccactaccgccgccaacgtagaagacccgctcctcgtacgacggcgacgcggagcggctccgctgcagcgagatgacgaagtctgactcgccggcgcacgacgagtagtcctccgactcggaccccgactcggcgctcgacgcgggcgccgaggccgagcagcacgacaggtcgaggtcaaagaacgggccctcgtcctcgccataccagccgccgccaccgcatggcgtggcccgcgccgtcgccgtgatcgtggacaccgcgcggcgccggaaccgccgcgccgcgagcagccgtaggaccttcatgtgcgcagctgctggtgttcgggacggtggtgctcgtcaggtcggtgttattagtgggagatgtggaggggtagtggtgttggtggggggaggcaggaggcggggcggtggctcgcttttaaacgggagcggcaaaggccgcagcgtcggtggagtacgtgcgcgagatttaagaaaggccctactgggttttcttggggagtttttccatgtttcggcggtgtttgcggtgcgaagtgttgaagccgatggcatccgcggcgtttcgcggtttcgccaggcaacttgggttgggtggctcggcgcggtgtgggtcgcgtcgcgtggcgtggcgtggcgcggccgttgcgttgccgtggttgttggcgtgcgccgcacgggccgtggatggcaaggggagcgtgcgtgcgcgcgcgcggcgcggtgcgtggcagtagcggccagtttcgagcgcgatgccgctcggctccgtggtgtcgccggcgtgcgtgcgtgcgggcgcgctgttgccctgaaatctgtgaattagtggtagtatcggtgggtaggtttcgtcaagaattccggatttttacttttgtctcttgcttaccaacccgatatccagaaggatggctaccccgtaccattttcgcgttgttaatgacgttgttgtgcctagtgtctatgtaaagtatagtgagcgctaacaacttattaccaacaaattaagcagagtgaataatacttctatgtactactagtatcttcgtgcacgtgtccaatcagtcacgggcgctctcctgtcaacatttctgagcttctctcgcacaagatgaattttccttttcagagaacagctgatggttataactcatcacttcatgatcgatactaatgactaatgtcaactactctcccgtacaaatgaaaacagcatattaccctctccaggggcacttacatactgtcatgctgacaatcatggtgcccagcccctgggactattcgatgaacaccaagcctgggaaaagaaacatgaaatcaggaatcattcattcctgagccaaaaaaatttcatggcctcactaacagaagcttcacaaaagtctgcaaaaaccatccactagctagctttgctttcaaagagactgtggagtgtgggcagcaaaggaagggagctgccagatgggaactgacggctgtgaacaacagcgtcgctcaagtgcaatgcagtgcagcgccgttgcagctagtagctgcagcagaggcagcagcagcactcgatgagtccaactccatggcgcgagctttcactgttttcacagcctttttcaccggtggtcttcgtcttctactcttccctctcctcgtctggtccaacccatctacagtagtttcaggtcaaaaaccgccattattcggcttgaccggaccagtcttgagaatggcctgcacttgtcatatgtgacgaatagattctgtaaactgttaccatagtgtactatatactggagttgcagtacatttatactgttatctgaaaatgcttttgccagatttgtttaagctctaccattccgtgttaatggccgctacatttgccgttttctcaagaaagatgtgacgtgatggatcatggacgatgactttcagagctagattttggcaccctgtgccaggtaggtcaggtcaggagacctgcccgtgcgagaacacatgtcgccattcgaaatagaagcagcagagttataatcagtgaagtgtgattacaagaaaaataatccaaaatggatccaatggtgtgcatgtgcttgactaactagtctcatcatcgattcagagcataaaaggcttaaagcgtcttaccctttctttcctgcagatctcgaacaagtgtttgcccgtctgtccatgagagttcagagaatgcgtcggcgagactaccacaaaagtttgaacagagtttcataaatttctgtttcttaaagccaagtactgcaggaacagcagcgccaacggcatgtaccacgtctgaattctgatggatcatttccctggactgcaaagcagagcaataaatactagatcaaaggaccaagttcagatgaaatattgatggttcaaaagctcgtcatccacagtccaccaaaaggttcttacatggtgaatgggtgatactagcagtaaatcccgtcattcatactgtgtaacattagtgcctgaattcctgccaatcctgttttgaatgtgaaaggaaaaacgtgaggaactgaaaaggggtttgtctatggctatttgcagagtgaagtccagaagaaaatttcaacgcaaggagttcacataacacagaaaataaacatacaacatcaatgttttcttaacatatcagagtaacgattcaaatgattgcatgtatacgatgttttaccaaggaaaagttttactttggccctaattggaaattggaaattgcatgtatacgattacagataaagtatgtcctttataatttaaccttacatctatcctctacaaaactacccaaactattgcagtctactactcacatagaatgtgtgcttaattccgggaagctgcatccggaagttttgcttcgacgagtcaaggtcatcctgcgatcgcctgactgaacctgttcagtcaaaggcaacgataatggcaagtgacaatattgcgggtcctgctccaaacggtgaccatcgtacaaggatcctaagttcctaccacctcccgaaccagagaagaaagaaacgtcttcacaatcccatgaagccatgaactactactgctgactactgtatccgttggacccgcagaatagttgggattaagcaactccaacaattgttatcttatgtattttggagctggacttagtgctcttgctgacgttggccagtccacacgaagggcaaaatttcggtttatgagtcttgcaatccagtcagacgcgtgctgtactggtgttgtatttgtgcactgaagtctacaagtcagtggacaactgaacagggtttcagttcagtagactggccagtacaggctttgaggtttcagcatcacgacgtcttcgggttcatgtatcttcttcgctacagaatttatcattttcgcttgtggatttatccaccattggattccatattccaactttcgctgtgtttagttcttgaaattgggaaaaagtttggggaaagttggtagtttggaaaaaaagttagtagtttatgtgagtatgcaagttttagatgtgatgtgatgtaatggaaagttgggagtttgggggaagtttggtgtcaactaaacatgacctcattaacttcagtacttcagttctgattccatgacggccctcggagtttgatcaggttgggcgccaaggggaaaggtcccctgtttgttagatatcttgaggtccaaccgcgagtgttgggcttatgtacacttttctgcggccctgtataaaaagcccataatggacacactcgttgcacgccaggaataagttcacctgccgtccctcaactttacaccgagtttgtttgacatccctaatccttaataccagaaatcgtcatccgtaaatcctagtcagcaaaaaaatgtatatgggacccacatgtcagccaccctcttattccttatcttttcttcccagaccttccgttcgccggccgctcaagtgggccagtagcaacggccacccggcgctatctgctgccgctgttggtgcccccgggagctgccccgactccgacct

SEQ ID NO: 74312 - DNA, 34474 bp, Oryza sativa
aatttttaaaaataaaataaaacatattttttattttattacctaaaaataaattgtcataaataatgtatcgtgcaacaaaatgataattattaatagtcttatgcgataaacttttatattttcaataatgtaatttataaaaatttctatgttcatccaaagggtaaaatggtcaattttatagaaattagatggtcgactgacgggagggatatggaagggaccaaaataaaattttaggagtatacaaagaaagcaagtaaaattcagaggcataaaaaggattagctaaaattttagagatatataagtgattttctccaaccggagttgaaatgggattgcactatatgcacttcctacttccaagacatgtagtcatgcacgcctgcacggatagtctggtagatatatgtactgtatttgtttagatttgactacattagcaagtttttttttggagataatagaattgaatttgataataaatcatttcttctctttcacgagaccacaaatacactcgatatagttatatatactttatataattatatacaactataataatcgtcgatctacttcattataggttgcattcactatgatcaacggtatacgtctttatttttcctatcaacacatactactgataggcccacagaacgaacaatctcctgtcttacgtcctgtttcgttcatgggtctaatccattagtcccttcattttaatctgttttagtctctaagaatttaaacaagatgactaaaattaactaaaagtgtatgttaggattaaaatccattaatcccttatggagatatttgtaaggaagaaagtggcagcctctctcttctctctccctctatccacatacctttagtcccttttagtctctggatctaaatagtaggagactaaagtttaaagtttttagtttagagactaaatgatccaaacaagaccttaacatgatactccctttgtttgaagtatttcaaaattgagggcagaggtggttcaaataacataatactacaaaggtacgaataactatactttggcacggagtaaatagatagataaatctatctattattatatactaaaagtccattaatcttcctacaaacactctcaaggagccacgtggctttctaaaaacgttctcaagccgtcacgtggcactctaataaattagagaaaatcctacaaattctgagaaaaaagcaaaacatctagcccttagttttcacttaaattggtgacccaatatttcaggccattaaattaaatctattaaaatcattccttcttctaatatagatacgatgcgtggagaggaaggtacgatgtactattcgtaaacagtaaaaaaaaatcctatgcgatgcatatggaaggagaggaatgtacgtatgtactacctaaaaaaaattacatgatatacgtttatatgaacgtaatgtaagatcgtacgatcggaaattaaaaagcataaagcgaaaaaaccaaattatatataaaagtccactaaactttctacaaacgcttttaagctgtcacatgactcctacaaacgctactaagccatcacgtggcgctctaataattaaattagagaaatctaaaaaattttgagaaaaaaaaggaaaacattatatcattgattttcacttaacatggtagacccatcattttatctcctattatctcacctgctcacttctttatccaaattttctagatagcagctcagtacataacaataagaaatgctatattaactatctattatatagtacaaatcaaataaactccgtacaaacgctttcaatctgtcacatgcgtggtgtgctacaaacgctcctaagatgccatatggtactcaaacaaattaagattcctaaaaattatgataaaaaacaaaccattgattttcctttaaataggtgaacccaaaaattatatctactacaataaatattttttaaaataatttttctatctatattgattcacatgcataactaattgcacatatatgagaagtaattaaagagagggctagcaggatggtaaaaaaaaccaatgaaagtttgttgatatttcttcacgaaagagatatataaagaacactcaattcaaaatagaaaatacgttactttaattttaatttgatttgttagaactattttcgaaacaaactaatgcgcagcccgcgtaaatgcgcgggctatcttcctagttaaataaacaatatagaaaacctaatccattagaccaatggagacaggtgttgaacataaaacatttcacgtattttcttttttagcaaagcagtacgtagtccatgatttcaattagccgcaaaagatatcatctgcgaggacattattaatttatttatagaaggtataagaagggactttcctcttgtagtaagaatgactttgtcactaactaattccactgatggatctaagctaggaggcccaaacgaattaggcaggataacctcacaaaaccacccaccaacaccaaacccactactactaaaatggagtaatggtactactggtagctgatagtaagaccatatggacacagaaagtggagtatcctttcattcctaaaaagggcatggaatagaacaaccccaattttggaaacggggagcagagccattcagctgtttggggaccaaaggcaaggaggcatgaccgaccgatccccatccattccaagccttcaaggagacaagatattttcgaagagagcacacctaggccctagctagcacagtgcgcgctacagtatagtattaggagcacttcttttcccccgattctccaatcaatccaatccaatcctcgtgtaggccaccaggaggcccctccatccgtcccactctgccctaccgcccatctcatccccatccatccggtcgctgaaatccgccgtgcacgtacaccgtcttgtcgatcacgaccaaaccccggccgcctccgcctcctttctggtggcgcgcaccgcccgcgatctcgatcgttcactcccggccgtgccgggacgatcgcgcgcgctcgccgaccggtgtcacggatcatatcaaatctcgcgtagctagcggtcgaagtcggtggccatcgtttgttcgccttcgcacaggtgtccgctgatctcggcgctcacaaagcggtcaacacctagtactagctactgaagtactgtcaagagatcgagccaagccgggccggccgggtatatccaggggcgatatgacggatctggcaagtagattaggcatgcggttagttgggattagatcgagaggcatgcacgcccgcgcccgctttggcgttgccgggtgccccggatcacgctgttggtccaaaaggcggcactgtttagtgtcatggcctcaaatctcacgcgatggcgacgtacgccacagcgggaagggtcaggagcccgacacttgtcgcgctccggcctcccggacacttctatatgaacaacccccccaacgccccaatagtagtatatgccgctcatatcatcacttgtttactttagatcatgtcctgtcatcgcagtataagggttaaccacgatcgagcgagctagccaccgtgcgtggctttgccttttgagggatttgacgtgtaggcaaaagctatagctcggagcagtggagtggcttggcttggcttggcttgctgctcggtcgatcgatcgagagatggacgggctgcacacggagctcgcgctggggctgatcgggtgctgcggcggcgacgggcagcagcagacggcgccgttcgtggcgaagacgtaccagatggtgtgcgacccgcggacggacgcgctcgtccggtgggggagggacaacaacagcttcgtcgtcgtcgaccccgccgccttctcgcagctcctcctcccctgcttcttcaagcacggcaacttctccagcttcgttcgccaactcaacacctacgtcagtatcattcaatcgccggcgccggtccgccgtactcccgatgattaacgctttttccgtcttgtggtacgtgcagggattccggaaggttcaccctgaccggtgggagttcgcgcacgagtcgttcctgcgcggccagacgcacctgctgccgcgcatcgtgcgccgcaagaagcgtggcgagggcggcggtggcggtggcggcgcgtcctgctctttcggtggcggcgccggcgagcaccaggtggctgctgctgcggccagcgtgggaatgtcgggagaggaggaggatgcggcggaggacgtgctggccaaggaggccgcgctgttcgaggaggtgcagaggctgcggcacgagcagacggccatcggggaggagctggcgcggatgagccagcggctgcaggcgacggagcggcggcccgaccagctcatgtccttcctcgccaagctcgccgacgaccccaacgccgtcacgggccacctcctcgagcaggccgccgagaggaagcgccggcgccagcacctcccttcccacgagcccaccgtctgtcccctcccgccggcgccgccgccacaacctccgcagccgctcctggctctcgccggcgccgcggccatggacggcacctactggtggacgacggagcatcatcatcatcatcatcatcagatgaagcccatgacggtgttgccatccttggagccgcccaccgctagctgcggcgtgcaccaagtgccggagctcgggggtggcggcgtgatgggcttaacgacggacggtgaggccaaggtggagccgccattcccattctgtctacttggtcaagctttcttttaattaacctgccgaatcatgcccatgcacgtagtaattcttccattccacttactgattcagtcactcgatcctacgtacacactgccaagaaaaaaaaaaacagatgttagttctagtgcaatgcatgcagtaacaccagcatcgatcagtacgtgttgatctgattattcttacagggtacagattagattacagacgatggtgtaaaaccttaattactactgtgtacttatgtacaacgcatcaaacaatagtggtacggtgttgattactagtacttttttgattgctagctgatagttaattagtactactattattagtaagtagtgttttcattaggtggatgcatggacatttcttcttgccctccaagtttgtagggttcatgatttcatcaaagtgcttatattaatctctgctgcataacttttgctggaaacatgcatttggcttcctgtgattgcccatctaccctgatgttaacttcagcaatacacttagtttattgagtggtttgtgacttttgtgagaagtggcttttgctttcagactctttaatttctccagggcccactgcacacagccaataagaagctaggggtggtgacgaattgccgatcgctgtgctgtgttaatggtccaggtgtctgcttccattagcattttctgtagtgatgatgttaattaaagtttggatttggacgtcgatgccggaagctagctagctagctagctaagggaagcagaagaagaaatgaaaggctcttagagctcacgagagggcgcgcggcgcgaccagcgatttggcgatttttgacgtgattttcccctgtgattttctcctctcttcctctctcccccgtcgctctcgcgggcgccgcgccttcgatcgagtccacttcttaattacgcgccccgcggatatgcaggagtttgcaggtataggagtgtacttgactcctttagtttggactgagatcgatcgatcgcgtggcttaatcgtggctaagcatcgcgaaatctttgtttaattacaccactaagctggtcctgcccccagctgttaacttcggtggcgcgcaaggtgtgacactccgattgatatatgatatataatcctactagtaatctaccagtagtaatttgctttgcgggattattattccaacctgccggcaggtgtagatcgatcgatatttacaaagatttggctgtccgccagcttgatcgtcgatcgatatatcgatcgagtggtactacgtgctagctagctactggctgagctatagctgtgaggagatatatatgtatatttatgggcgtacggtaaatcactaactaaaggctgagctaattaagtactctaggtggtatatatatagtagtaccagtatagtactccgtcttaaaataagtgtagttttacactattcacgtttaacatttgaccgttcgtcttatttgaaatttttttatgattagcatttttattgctattagatgataaaatattaataatattttatatacgactaaatattttcaaattttttataaattttttcaaataagacgaacggtaaaccgttagacacagatattcacgactgcatttattttgggacggatgcagtagaatgtatagcgcgatgcatggccactagccaatatccatccaccacccacgtgacatgatatggtccatgtccccctcggccggaatatgcttatatgcaaatgatatgacggctcgtataattacgctggtctccatggtcaggtagccagacactgacgcgctagctctacatacattactgtatttcgtaattcataaaagaattaattgaaatatataaataccgtgatatcgatggtaattaagggaatgccattatggaacgggatataaaatgatttttttatcattgttttctatatatcggagtgatcgatgtcatgtcactgtacgacgacgcaagtggctgtaggactgcgtacaagatcggatgaacaatgatcactctcttaattgttttgacccgtcgcgcgttgagattatagcgagagggcatatgggcaaagtaaacggatgtgtccaaaacagggtgggccccgcgatatatattcagcagcaggtggcccccagttggcaggtctccatcgggcacaaagatgactttggccatgtttaggggagcttctcctcttagctgcagtttttttcaaaaattgtttctgttagaagctgcctcaaatagttacagattctaaaaatgaaataaaaagccagaaactggagaagttgggtttcagagttttttcagattctcataagctgactatcaaatagctgcttctcagaatttaaaactccccaaacatatcctttgtctgtgtttactgtgtgaagcaccgatggaattatgtctcgcgggtgtactgtgttacgttggcgaccgtaggagcccaccttgatcacgccggccttaaaggtgcccatacacgtacagttacggttactgtgagccgcatctccaaccgtcgcgcgacgacaggcgatatacgaccagctgctacactatttaattaagccgcgtgacaacaaagttaaaaacaatcgatactcattatcaatcgacgggctaattaactaacaacgttctggcggtcagttaacgagttgataatacacggtgtaaacccacatgcatgcaactgtagagtatatacttctactatttacagcacgcgcgcaagcaaagaatgcaggatagctaaaggcaaaggcgacatgtatctgcctacctatctatcgatcgacctctcatctcaaaccatgtgagaaaggaggcaaaggcagcgtgtgtgcaggcgtgacatgccactgtgtgactgtgactgtaggattgcctgggaggtcatgcatgcaggcggttctctagctagctatagccaacttgatcgcactgttgcgcattcaatcgcatgttagccggtgcggggctcaccatgtcaggcataaaatatgttatctatgcacctgcttagctgctaggctaggctgctgctagcagaaatcaagcaagctggctgagtagtacggaagtggatttcttgctccctagctccgtcctaaaaataagaaattttgaatggataaaacacattatggctatatttagtttatttaaacttttaaaaattccatcacattaaatgtttagacacatgaataaaacattaaatatggacgaaaaaaatcaattacacagtttgcatgtaaattgcgagatgaatcgtttgagcctaattacgccatgatttgacaatatggtgctacaataaatatttactaaagacggattaattaagcttaataaattcgtttcgtagcttacatgcggaatctcgtagttatgggtttttgttattagtctacgtttaatacttcaaatgtgcgtccgtatacgtccaaaaaaaatttgaggaggaactaaacacggcccatatttttaaataaaaaaggtcaaacgttggacacaaacccataactacgcttaaaatgcgatagatggagtaaaacccatatgtcggtgacttaagttaattatatttccagtttagtacatactccctctgtaccataaaaaacgaatatagaattggatgtgacacatcttaacactatgaatctggatatatttatgttcagatttgtagcactataggatatgtcacatttggtaatagtttatttttatgtaacgaggaagtacatcatcgtgcatggccgttcaatgttatccatcgatctcgctgtttcatactccgtatgtgcatgagaccgagttcatgacttcatgtgtgtgacgagttacaaacttagtacgtggtatatatgcccgattttagggtttgtcgacggatattgggatggaaatattatatcgtggagttatattgatacttccttcgtcctaaatataagagtttttagatggatgaatacatcctagtactacggttataaacatactcttattcagattcgtagttatagaatgtgtcccagcattcacccaaaaacttttatattttgagatacagggagtatatagagtagacatggaggaaaaggaatatttacgtggtaaactcctctgccgccatcacccctctgcctgatctgggagggagagggagagggaggggagggaatcaaggaagtgaaggagaggggtggaggatgagggtaggaagtgagggacttagccgagatgaatggttggaggcagattttataaggtatctaactttttgtaagccgatatttttacgtctcgtgtgtgaaaatcgatttttacatgtgtgatctaaagaggtccgtctgtaaaaataattcttacctcttaagaccatacctgtaaaaatcgactagttttaattttataggcaagactagttttattgtacctttacttatttttgaaaatggtaattttttttacctttacttatttttgtaaatggtaattttatagtctatctggaaaaataaaataatgatgttggaaaaaatcgtcttgaaaattcctacagtatatttttccctcaaataaaaaaactcttattttttattaaaaaaaactatgattccgtatatccgtggacagaggaagaagtttttgtgatgcgggacggggggtaacaacagcagcatatgcatgtttgcacgcatggatgcatgcgaagggtgtcgagtagtccccccttgcacgtgtgcgcgaatggtttgtgttcccttgcaatgccgcatggcatactgtgtgcgggatattggacgcatattatggcttatggggcaccgatcgatcgattattctatcatagattcaaatatacgatatctacactatgatcgaattgttcttattcataaacattatggtatacagcactattatgttcctgccttcctggtatatatccattaagttaggcccttgctctattgtcagtggactggcatctcttaggacatgtacaatggtctttattagcggtctctctttattgtcatgcaagcatatttggtgacgtggaagagagaggaagtaggaaagagaaagatggttgctacgcatgacaacggtgtagagtcgactcttagcatttattagaaaatttttttgttgcattgagtctaataaaggaaagatgactagtaagaaagtattttggtacattaatggttagagactgtactggcttaactattgtaacgtgatagcctctaattaacgtagagaccacaccgatctctacctttgtacttgcccttatttagccatttttctgcaacgagaaatggtaattaagatatggacattgatatgtctaaattaattaaggatcccataccttctagaaatcttgctgcttgtaaccctaggcgttatatcaattcagcggatattccatgggcatgcctttacgttgctattgcatattctggctcaactgctaaggctctaagaaaacaaaaggaaaatgggaaaacgttatttcgctggtgttattatattttgctagagagagacgacatatgtagatggttttttttcttctgaaaactcatgtatttattcgatataggagttctcacatgcaaacagattacatgtgccatttggacatctctcagaaaaagagagattgagttgctagctctcagtagaacaagcagctggtagaagtacaacacaacatgcaaaaggatccttgaaaaaggacaagttatacaaaggtccttgaaatatgtaaagaaggacacgaaaagaaaatagaaaagcattccagtccttgcttcgctttttctccctcaccggtgacctagatgatgaagccgacaacggctatggtgaaaacaaggttgactgcaaaagatgacatccagccacaaacccaacaggggcctcgtaaagtagaggttgaaatgaactcgacactactgcaggatagatttttgtggacgccgcccccttttatttccatgcgatctgtaagtggaaccgcacgggaaaataggaagaccggcgccaagccgtcgcccgcacgggaaaacgaattatcccgtgtgggcggcttaagccaaccgcacgcgaaaatagaattattttcccatgcggatccttaagaggcccacacaggaaaatcgattttcgcatgtgggcctcttaaaggcctgtctataagtctatcattcctccccttatccctcctcgatacttcaaaatttcatccttatccaccactcttccttatcttcaaaatatctctcctctctcactctcacctctccttcacatccttatctcctcgcctcgggattgcatcctcacatcctcacctcggttggcgcactgatcaactgcatcgggacgatgacgacgaggaggcggccagcttcctcgccctccggcggcggctcccttgccctccagccgggagctacgacgacgaggaggaggcgaccggctccctcgccctccggccgggagctacaatgatgacgaggaggcggccgggagcggcgcagccggccgaatcaacgccgcccctgtagccgacgacgacgaggaggcggtggcctcgagcgagcgagcgagcggcgggtggcgcagttccctcaatctctggcctcgagcgacgacaacgaggaggaggcggtcgggagcggcgccgccggcctgatcaggccgccgacgaggaggcgcctgtcgcggctgctggtggaggcagcgcggtggccgccgccgacgtcgaggaggaggaggcgacagtcgggagcggcgccgctgccgatgacgacgaggaggaggcggccgggagcggcgccaccgtccccacctcatgcggccgccgacgatgatgatgaggaggctgctaggagcggcaccgcccttcccacgccaggatccggcggtggcggctgccctccggctagatctagcggcggcagcagggagcggtggatctagggttagggtttcggtaatttgtgaattttatttttttttcaggtttttatttttcgtgcgggcgacataagcacccgcacggaaaaatccaattttcgcgtgcgggggcgcctcccgcactcaaaaatcacgattttcgcagacgagtagttgcgtgcgggccattcattcgcatgcgaaaatattttttgactgcacggaaaaacccttcctgtagtagtgcgatgaacaagagaagtttcagtcaaaccttggagataccccatcgaagacaaggaaggacaccagaccagcagcgacaacctcactggagatgatttgaaagaccagcaccacctcatcgttgtggaggaagaagtgttcccaccacagggaatatctgttgcacttgtggatctaacaccaacagaaacctccatagcaaccctctgaaccgcatgaagctgagaaatcccggattgaactcaagctgagcatggaagggagcatctgggatgaagaagatgggtgttgacatcgccttcgagctgtacacaaaagaggaagaagaaaacctagaacgagataaactcgatacataacgggataaatctgaccacgggatgaacacaatagctccctgaacccccaccccccccccccacgcgtcaacggcgactagctgccaccacaagcgtaggggagaggggtttcagcgaagtggaaaggaggagtctggctgttcactttttaccgccaacgggagagaaaggataaggttgagagagagaccccatgacatacgtagatgtggagtattattaatgcaagcacggaaggagaaataatgaattaatgaacctcggttgaaaggcctctctgtttggcccaatcgagttagtaataagtccgtttcatctccctcatcttttgctcttgattgagtcacatccctcgattacaaaatcaggtataatgcttcccttaacttaaaaaacaggtgcaaatcagctcattcattggtttaggaagcagtttcttcatgtggggcccacatgtcagtgagacatgacaaaacatatgcggtgggccctacttgacagtggcagtagcggccgtgtgtgcgagaatgcagccatggatgtgcgcaacaacactacttcaacacccagttccgttgatattgctcactcgtgccccttgccgcctcgtcctcctcctcctcctttgcagatggcatggtggttgtcggagacccacgctgcgagctcctcccaccgaccaccgacggggcgcctaggagaactgcaccacgaactcctcccgtactgaaggcaggcggtgcacacgtattggaggatgctgggcacgataacctctacatcagcatacaccatgcgggcactttgccgtcggcaacgaagcagccggctgggggaggagccaacagcgtggaggcacgggagggttgggagaaggtgcagatgcatattcgaaggggttgggcacaactacgtatttgccagcttacactatgctggcgctatgctcccaccgacaacggagccaccgactaggggaggaagctgcaccggggcaacaggtttcgatcactgaagctatccatggatgagctgctccccgcggagcccgttggtgttacgtatcaggcgctgctcaaactttccatcgtagatgccaccgagcttctcctccacttccttcaccatgcacggtgcccaagaccctccctcatcccctaagcgtagaaccgccatcgtcactgccactggccattagaggatgatgcatcggagaaagaagaggacggacgggatgtgtatctgggcgatggacaacgaagacgcaacgggacagcgaatgtgatgccacgttaggggaggaagacggtgtatggaatggcgcatcgccggctccctcgcttccctcctctcctcctccactgctatagaccgccttcctcgccggctgccaccctcactaccttgaagtcaatagccgggaatgtggacaagttgacacgggagcatcggcttcctccgacacaaccttgaggttattgggtcgggaacagggacgggttgacacacaagcggttgaggtggagctcggccacacagacgacagatgcgaaggggtagaggagaaaggtgaggtcaatgaggagcgcgaggaagagtaagagtaggagcgggcgagaggaagtggatgaggatggggacgaagaagaatgtcagcggtggggaggtggtgaaagggggagagagaagaaggaatgagaggggggtgacatatggatcccactattatttttttaaagcttgtactgctgactcagcaaaaaacgcttcctaaccaatgaaagagctgatttgcactggtttttgaagttgagagatgcgttatatcctattttatggttgacggatgcatttttggatcaagggcaagacagaaagatgtaaaatagacttattccctcgagtcatatggaattgaatgcccaaagaagtaagtcacgtatgttcaactggatcgttgggccgtccaacttgggctcacttgtgacgaggataacgtaacacttggaataagttcatctaaggtcccttaactttacactaaatcctattttcgaccttaaaccccaaaaccagatacaactggtcccttaactatcaaaaccagtgcaaacaaagtccctcgacggtttgtaaggcggttttgactgacgtggcgcctacgtagctggtttgactaggtcttcatcccacgtggcattgacgtgacgcttatgtggcaattctatcccagaaaaataatagaaaccgtgggctcacatatcagtctcactcctccatccctctctcttctctctctgttcttcctcatcctcactcccctcttcttccctctcccctctctctcttcttcttcttcttcccggggagtgccggagcggacggggcgggtgggcggcggagcaggcgagcgaggcgggctgtccgagctccggcggtgggcaacggcgccggcgacgggagcctcgaccgggggagaggaggcgccgcggtagccggagccggggtggtcggcactgcggcgggtgaggtggtggttggcgcggcggcggagagaagctgctgctgcatctccagcatgatgcagactctgctttccggattgcttgctattggaagaattgaggagtcgatccctgctattggaagagttgagctagataacatatcactgacagttaagctatagctatttttttctccatatcttaattttcttttgttgacaaaaccattgctatgcggccagttcatagatcatcaggcacacgttcaattcacaacaagtacttttctttgcgaatccacaatccccgctacgaccggccgcctcgccatgccagtatatgccttggcgaccccttcccgaccggcggcgtggtggtcggcgccgccgcggggtcttgcgccggccgcatccccgccctcagtaccgctgccgccgctgtcgaactccatatccttctcgagcgtgacggcgatggcgccggagtggtcatcctcgtcgtcggagcccgcggtcgagcgctccgactcctgcggctactggtccagctgtcgcgtgagcagccacggtcaccaccacgaggccgcggaagacgacgacccgtcggagagtgaaggcggcggcgagggcgccgcctcgccgaggtcgctggccgcagtcagtgtccgaagaagagagaggataatgggaagaagaggagggcagtgaggatgacatgtggggcccacgtaggtcccaccattttttattttgtgtgtgtgaaactgacacgtgggtctcacgggttttattattttttcggatcgaattgacacgtacgcgccacgtcggtgccacgtcagttgaagaccgagtcaaattagccacgtagacgccacattggccaaaaccaccatgtaaaccaccgagggatctcatatgcactggttttgatagttgagggacccgttgtatctggttttgcggttgaaggatgaaaatcggattcgttgacaagttaagggacctcggatgaacttgttcccgtaacgcttcgctatattttggcccgcaaaagcccctcggatttccttctctgattctccctcgcaacctcctcgtccgcatttttgggaacacgcccggacgttcccacgcatggctcacgaggcatgtgagttgataactgataaaccggttcgtcggagcccaagtacgagctgaccaaggaggttctccgaaaccaccacaccgagaaccaccagaccaccggtggaatcgccgaactccacgccagcgacgaaaacaaaaatactcggtgaagaacgcgcgcgtcgacgtcagtgagcagcaacgggccgcgccgcgcgcgacgccatcgggaacaggggcagcgcgccgcgccgcgcgcccagctccgcacatgcgcgcacgcacgcacgcacgaacacgggcaaccgaactcgaggccgtataggaaattcccacccaaaaaaacaccacaagtagacgatagaagagcttagcgcgcgcggagtcggcaccacccaccgttgctctcgcggcgttcgcgcgggggcgggaatctgaagacccgctcgccgcgtgcggacaagcgcggcggcggcttatgcttgttcctgcacgcgcggcgagctacgtcaccgattaccgaattaccgaccgcggtcaaagaaagttctactgtagggctgacgcgtgggcccactcccaagcggtcctctggtgggccctacgtgccagtcgctgcgtattgcttctctcctggggatttgggatgattaattattggatgacgcacttgctagctaaaccatcttggcttgtttgtttgttgtcaagatggagagcatatatgctcctctggtttcactgcctcctcctagctaatactcctactcctaccattttatgtaatcctaaaagttggcgctcctgttgctacttggtactacagtgcttctgatctgatgagtagactaggatgtgatgtgagcgtgtgagcgaccacatccaattcagggtggttcaaattcaccaagatgcctaagcgatcaatcagcataaagctgtggtgtggttggccatacaaataacagcatctagcacatgcaaatttggcctggatattgtttgggtcaaactttctacttctctgaaagctatcgttaaaacattgatgtgatgttacagtctcgcgcacgcagacctgcaggcgtcctttggcactatggatccaaaccacgggttcgcttgcaaaggttgcatggtgtatacaattgcagcaaccgtgttcccctttgggatcagatattccaaacacaattatgaactcccaattttaacatgcgcaaaaccagcgccttgcccccctgattggatttcagaaatttgttgcccgccgggccgtttgtgatcatgagcatcgaaatggaagaacaatttttagaacctaggattgatcgatcgttcaacggtttcttcctgacttcctgacactacagttattcataacacgagcacatatgcatttgatggcacgatcgatatgccaattcttcatgtaaatacaaagtagacttaactgcaaaccaagataacacgcattaatgccgatcgctcgctgcatctcctaactacgtacacctctgctctactggcctcacaacgaacgagttatagcttggttggctaatcaaacaaggctttggtcgatcggttggttggccactgtcactgatcagtgatcgctcactcactcctcgccgaagacggcctcccatacgtcctcgaaggcggcgaggatggccgggtggtgctgcggcgagttgagcgagaggtacgaccccaggagctcctccatctccggcacgctgcagatgcgccgctccacgaccatctccaccatcgagctccggaagtcggcgtacgggttgctcgaccgcttcaccaccgccatgcccgcgccggcggcggtgtcgtcgtccgtgcccagctgcctcttgatcgccgtctcctccttcttcttcatgtcgttgtgctgcttcttcgtcgccgccacggataccaccggccggaaggcgtcggccgggtcgctggtgatcctcgccgacgcgcgccgcgccggcgggcggcgcgccggcgcgttcttgtggcccttcctggcgaggctgctgctgctgttggtgtggtagaactccgaggtggagtcggaggagaagctgagggacgagaagagcgtcctcgtgtcggcctcctcgccgccctcctcgtcggtgctgaacggcgcgagctcgtcgtcggtcaccgtggacgacgaggagctgtactgccccggtgcccccctcgggagccgcgcgcggccccaggaggacgacgggcaatgccgcctggatgtcgacggcgaagagcgcgcctttctcctcgccctgctctgtttcctgccatccttcgtcggcaacgacgacgagtacggcaggaggggcgcgtcggagtggacggagcggcggccggaggtggccccggccccgccggtgcagtcgatggagatgtggaccagcgacgcgctgcgtcggcgtcggcggggacggccgggggcatcaagcttgggcctctggtaggtgcagggggtgcagaagtacggcgagggcggcggcggcggttcttggtgcgtgtcggcattggtcttgtcgaggctgacgaaggccgtggacgaggtggtcgttgtcgtggtggtggtgttggtggtgcaagtagatcgcactaggatctgagccagcctctgcttcagccagccaccggcgcccaagccgtcgaggcggcggtgggggctcttgtccacgaaaggcgtgtgcatcgcggtattctttgggtgtttggaaatgggttgaggaggggagagtggagtttttttttggtttatctcacgtcgcggcttggtttgcgcctccttataagcttctcgggagtgtggtttgcatcgtgtgaaatgtctaatggagattgcatgagacagagaatgcagtaggaagccggtagaaggggagggggtagaagtgtacaaagtgtacatcgaaatttctcggctatgtacgcacgtgtagtgatgcggtggagtggtggggttaggcaagagatgtgataagagaaggttgatttgcacatttgcaatcaggtttcatatattcatgaatatatgacatagagtactaagtaggagtatgtactttttttagataatgaggagtatgtacttgcattacaatggtcaatgggtcaatgctaataacattaaaaggagagtgggtgatacgtggatttaacataaaaagaggattttttttatccagacatttctttttctgcttttctttcacgatttttttttcggagcgcaccattcgttttttttttcttagcgtgcgctacgtgccagggggagaagtgggaaggacagctagggtgatagaaaaagaccgaaccaagagaccgagaccgagaaattcggtcatcaattcggtcatagatagtgaaagatgaaattttattcggtcaattcggttagtctcttcggttaaccaaatagacagaaaagaccgaattatcaaaaaaatgtctaaatgcaacctacaatccactatgtttaataggattaaactctaattttcacgtacctacttcttctaggcatgcaacctaataagagtctttactcataagtacttacgaattttttttgtgatttttgtgttgaaaatttccattatttctttgcatatatggaaatgttgttgaatttcggtcgagaccgagaccgaatttgtcggtcctaacatttttttcgctgaaattcggtcttcactcttttcaaagactgaaaccaaaattttcggttagatcgaatgtccgcccctaaggacaacgacgattgtgcttttatagttgtagatatttgctgctccaccattttgcatgacgggatgatgttagctgtcaaaacaatttatacgaggaaaggcaacaatgtccttttgtttccttgacttggtgttatcctcaatccttcaatcctaaaacctccattccagtctctcgcatgaaaaatatattcctcttcttttttttttttttgcaaaatttgatatatgacacccaaagaacgtgtatcttcttgttgatattgtaaaaatgtggtaattagttactggacacccaccgtattattttattatttccgatggaaacagagagagaaactttcataacagacaagtttgcccacgggccatctgtataattgatgtcattaacttcttagttaacattttataagtcgggcccactcgtcaatctcatatctccttctctattcctcttctccctcggcagcaggtggtggtggagctggttagccgcgatagcggcagagtcgcagagcagtcgcggggagaagagtcgcagagcagtcgcggggagaagaaaaacccgaagccgtcgtcatcgccgccagtgaccccgagctcccaggtgagcagcacctcctcgaccacccctgcggccgctcccctggacagcgcgaggagcagcgccagcagcagcgcgaacgccgccagtagtgactgcgcgaatttggctagtggcgtcgctgaggaggaggctggtggccattgccgcgcgcgggggaggagagtggccgccactagggcctgggggccagttgcagaggaggagctatgacccgcggacggtgaggtcgccccacaggccggtggcgtcgccgaggaggccggcgaccatcgccaccctctgccgcgctcgctcgcagaagaagaaaagagaagaaaagagaggaaaagaaagaaaagaggagaaaagagacatgaactttcaacgctctttctctctctattttcaccggaaataataaaataatgtctcggtgtccagcagctaattaccatatttttacagtgcccacgagaagatatactttttttcacagcaaaggccacaagctttaagtgtcatgtagcaaattttgtctttttttatccggccggtggaaaaaaaagggctccgaccgatttttaataagattgaggaagttctagaacaagtgcaacatcgggccaactccaactagcttagggcctatttggcacagctccagctccaactccacctctcagccaaacaatttcagttccaccaaatatgggagtagagttgggtggagctctatcacaaaatgaactagagttgtgcagctgggtttaagcaaccccacaactctgcttcagacccaactcctgtagctaaatttaggagttgaagctgtaccaaataagtcattagtaaaactgtgctgcaaggagagatgttggcgggctccacttctattataagtgatggcaaatgactaagaacatgtttgtttggaatgtttccttcatcaactttctcgttatccattagcatgttttctcaaccactgaacggtgtatattatgtaaaagttttctatatagaagctcttaaaaaatcaaataaattcattttcaagattatagtatacgttaatgatccatcccagcggcctacaactacagccatacaaccgatttaaactcagcctaaaataccaagtaacattctttttagtgttatatctctaattaagcactttggtgtggtaaaaatgtgaatttcccaaaagaagctacttaagtgaagtactgaatgaaatagaattgtcaaagaaatgtcactggtggagtttgtggatgttactataatgtttttatgaaatttgtcaaactttcaaaaaaaaaataaaacaccaaaacttgttaaaatatggaacagagggagcaggtgacattatgaacttattgaaagtttcctttaggacgtgaggaactgaggactatttcaaagaaggcttccaagtttttattttctttcccaatcctttatatattaagtatcatgtatatatgccctgccatctctattgtccattggtagctgccggactgccgcgttttggccttggccaccggcgtccggatgggattatgggatgcggtgcggaccatgcggtcatgcggatggatgacggatgcacactcgcagtcacaggcagcactgcagtgccgcgcacgtcgttcagagcacaatcacaaaaaccagcaagaatgtggcgggcccgacgacgccccgtacgtgccaggcggctggtcgaggcagtcgaacatgctggctgccggccgcgctggtggtggtagcgagcgccgagcgcgcccgccgcccgtgtaggtgtcgggtggctgtgcctgtgcgtgactcgctcccgttgacctctctgcgcgcgccggccggacggaccagcggtcggagccgcgcgtcgcggaagtggaggagaataagatgtcctcatgcgcggcagccgcgggcacgcggggttcggtggttcggtcggtggctctcgcgatcgtccccgtgatccggcgcgtgcatggtggtcgtcgtacgtaccggttcatcaccacgcgcaagcagagcgtgatctggcccacctcgcgccgcgccacggccacttgccgcatattccgccctggtacagcgatggatcatatatatcccagccatttcgctcatctctctcttaaaatgatagagaattcattgtggcatttgtttcatagaaactataggagtactatacaaagttgtaggttgaaatcggacgaactacaaaaacaatttaattaaaacaagaaaaaattttgaaacactagtctaaagagagtcgtaacgaacctccatctacgcggaactatagtggcttaagttacatgtcgtttttgttttcctcaatctataaaacagaaactccgaaatcagcgggtaataattgtgccgattgaatttcactatattgtatgatccttcttttctagtctattgctgctactgactctacaacgggttttacctagcactagggtttggtaaattttatttgagaattcaaaatttccaaaaaagaaaagaggataaacatttagaaaatttgatgtaagtagtatttaaattgtagtgttatctagtgaaaaaatttcgtgaaaaaaggaagttaacatcatatttttgagccaaagtgataattcaaaaatgacaaagaacaaacgagatttttaattgcttgaatgttaaaaataaagcaaaagtcataccgagttttcctatgttacattaatatatggcatttctacatgttctaaatgtcccctacatacttttgtaattatcctgaatttccccttaattttttactgcttttcattttttttctttcattttgttttcttacaaacagttagcggtaaccgcgtcttatactgtacagttcccaatagccgtcgaaaaagttgaattctcaagccgtgaagaacgattgtgaaggcattacaaatttacaatacataggattaggagtacgttgatcgggtttaatataatttacgagatacccctacttcgtcgctaatgtctggacttgctcggtatcacgactcacgaggcatcttaaggtgcaggataagcatacacatttcacggcttattctctctgattgatgttccactgaggccgagaagacattctgacctcaatgtgcaatgtttcaacagagtagacggcaccaaacacaaacaaacattctgccttctagccagctatatatattcagtactactccctcacttcgatttcaaaccaaagtacgggtttaactaataatcagtacaaaaccaacggcctaatttcgctctcacctaggtgatccttccaccacaaagtttgtaaccacatgattaggatgtagcggaatgtttcatcctcccaatgcagtaggaggcagcctaattacagcatcgtcagtgtacgcgtcctcctctaccgtaacacgacgaaaggttaggcatgtacagatctactgcaaattaaagcaaccatatgcatataatctcatacacgtacaaggctaagtccaaggtggagaaattaaagatcaggtaacgaaagaacagttaaaggctgcacggtccttgaatcttgaccccgtggactgaagtacaatgaaaaagaaaccaaaaggtcttcgtagatttcaaatgcctttggacttgatgtgtgtaatggccaagaacaaagggacaggtgatgcaaaacaagcgttgtgttttgcagcgtaagcttgctgtgccagttacaggagaaatggtattaacttattatgagtactatggtaggtaaggggatgaagggatagtggctaattatgtagtactacgctggagtggtgatcagtcttggaaaaggctctaacacagcgattatattatgaaagagaagggagagggttttgttcctttctcacttgtcttgttatgtcacaggctgaacttaggtgcagtggtgcatgctagagatgctcctcctggagtctctcatctctgcatcaacctactcatgcatctcctaaattccaacttgccatcacgttgtgtttagcttctgacattggcatgtgaacaaagataagagcgatctggctgacatgattgcgagcagtcgtaaaacgcaccttcttaatttgagctttgattgtataaacgcccagaggccctcttccgtacttctgctccatgtataccacgttggaattcacaacttgtcttctaaaaatctctgttatctgacacgcatatctagctacgtcattggtcagtgacatacttctaccaccataccatagcaaatcaggggtcagtactgctgactaccttcttcacctgagccaaagtgccccttgacgtcttgatcatcaatcggagctagagtagtgtcacgcagagatatctctgcgattccggcaggtgtaccatgcacgtggaaacacaactgaacggggccaatgtacgcgctggctgtggtcacacacaaacacaaggggagagctactccagtagactgtgtcgcgtaacggatccggtgcagatggggggctaccaattccggcctagctaccactgttctggtgccgatccagatgagcatgcaggcgcatgataggtgagtcactgctcaaacgaatccgagcgacaaaaagaaggttatccatatacggcgcacgtctgtacggccgagggtgagtcttggaaaggttcaacgaacgaacaatccgaacagtcgtacgtgccttctggccgggccttggctagtcatccacctttgtgcttgccgctttgtggttgccgtcatccaccttcacggtgcctccaccgtggagagctgatgatcgagtaagatgatgttcatttctatactaatggcactgcaatggacaatcctagctatcggtgatactactatacactgattgcctctcggtaattcaaatattgctaaatggcaaaatggacagatctcttgcttttgtgatcagatagacgaaggagctcctgttcggaatgaggaatttcacaattaagaagattcatagggatcaaaatagagttagtcatgaattaacaagtattgcttgaacccagaagatgtcaaacttctagctggatcatgattgtaccctcaccaaacagatgatcattcaggatcagtctgagattcatgattaatgaaatccccttttccccgtaaaactaatataaagttagaacatacaaaataaaaaaccattatcgtgtaattaattaaatttgaattactacaaacttttaaaaatggatctatctaatattttaaaatagcttttatatatatataaaactttcacacaaaatactttggtttagcagtttaaaaaacgtgttatcgaacacgaggtgaaatcataaaagaacgggcctaagggattgtttggttaccagccaaactttgtcatagtttgccatacctaaggttaagcaagtttgatcacattggcaactgtagttgtgacaaaattctctttcaataaattgggtctcacacatcattggctcaaaaagtgttggcaaagatttccttaaacttggaatttgatctttaagatgtagctaagaatttgatcatctcaacttagataagtataacaatatttgttgataaagagttgtagagtatagccgagaatgcgagaaccaaacacaacctaaaaccacgttatagactgtacgagacgctctcccccttccgagaccactcctgagtcctgacctgagcagtgacttgctttaccgtgaataatgtcctcgattgggggcctttggatgctgacgcagtttacgacccttttcttctcttctgctgcggcatatgtaggcgtggatctgcgtcgagcagtagcactgtagcaagcaacagcagcggatgactgacagtcgctgcaaggcggtacgcctgcctgaagtcccatgggtgcccggcaacgtgggttgctgaacttctcatgatgcgcggctcccgcggtccggccgctgcaaagacgccagccagtcagtcaggcacacagacgcacagttcaccgttcgcttccaaatccaactggagtatcacttgccactggtttgagtataattgagtataatcaatggatggaaaggaatagatggatgcatttgagagcctacgagatttgccagattgatagacgcatgtgatctcgcaaggccctgcatgcttaccgggcgcaattaatgaacgctaacaaaaccctggttctgaaatcaacgtctccgccgctgagtgcacggccatatacacgcgacttgtaggatccaggtcccagctgtagagatcgcgtcgttggctcagaaacatcctgtcatcttcctatactacaatagccataaatagcgacatccaaacatgtactaattgcaatactagtcgtatatgagacaatctatgtcgattggtgatcaagtgtcaatatagctgaaatcgtcatgatgtttcggttatggatggatgcgaatataattaatggcactaacaaatgatcaatcatggcagtagctaaaaaggtttctcacagcaatagccatcacatgtagtcatgtactaatgttactaccagacattctaaaagctactagttaggatacttgggagaagaatgatcaatacctcttgaataaacaggggaggcatggttaatgacaatgatccatattggtcccctgtcctgtctgctagtttgtcctgagaaacaccacaaaagagttccatgagtcttgctccaaatgttgccaaataagtaagaaaaaaattgaaaattgtagcatgatgaacaatagaaggctttgttccattcagcatggacgtaaccaaaacttacagcagtatgacacagggagatcacgcaaactggtagcaagcaagtgggctaaccagacataaagcacaatttacgagtaacacagaataccagacatgattatgccaatacaatatcagaaagattcggacgaaaaggaagaaaagacagacacccattggaaaaactttcacgtgtccacaatcaagcactaacactgcagtagtgtgtgcgatgtaactgggcagatcagatcctgacccattccacttatcagatactagttcagtcccccacaaaattggtggttcacttgtgtacaatggtaatagtaagcacaagaagttgggagtgggacatgtcaatgagttggcatcacccaacacacttccatccccagatgggcatatagaaaagagaagacctatggagctactgtgatttactataccaggaagcactctctttcagtctactatgtatggtgatttaggtagggtaagataagccttcacagtttcactgtgatctgccccaacacacttgaagaagataagaactgtgcaaaacaggaaggaagcaggaaagacgaccgagaaagtgaggcagtcagctacatcaaatttcttgctattgcagggcatctatgcggaaagtgggaactttccattatcacgattcacgaatgaagcaagctccagtgaaaataaacagtgattggtcaaacagaagactgataataaattttacagtacatatgctatttatttcaactacagtttacagaagggcctcccaactgttctttttcaactaaatggacatgccatcgttctgcaaattagaatatttgtcatttattagagagtgtgcttgtcatgcaaattaatccattcggcacaactgtacgttgtgagaataaaagaaacaaaacagcattctcaggcatgatctcactctagcagttcatgctggtaagaaattttgtcttcatcaacacatatggaaaatgcaatgttcttgatatataactattgtctgcattctttctattaccagaagatggcagcagaattttaaccttgaagtttaagcaggatgatctttttaagaaaaaggggtcagctgccaggccattatactattcctgatccatatccgctacctaattgtttcttcaaaccaaacttagaagccatattaaaattctcaacaagctaaccagtcaatacaagtatgtcttccattggtaattgcagtatctgctcagctaaccacaatgcttgacggaccaatgttttaaagacatttgcagactcagatactgtaaactataaaagttgcctttgcatgtaatattaggcttaaaagctggagcctaattagtaattaactttcctgatccagcctccaccctggagagaacgaatttacattacaatccattcatcacaagtattattcattatgttcaaattccgctaactggacttatcatcatatagaagtcaggaaaacaaggagaaggtcaagaaaacatacatgaattcttaacactgcaagcttataaaagattcagaatctatattgccaggagtactttactccctctgatctcaaaaccaagttgttttggactttccatggtcaaatatatacaacttcgactacctagttctttagcacatattaaaaaaaaggttacacaagtgtaatattatgaaagctcttgttataacaaacttgaatatcatttttatatacccaaaatctatactttgaatgatttttatggtcaaaattaacttgtgtgactgcacgcattcttaaataacttgtttttgagaccagagggagtactagctacttaggacctataaacttttgagaattgaaatgctttgagaaaaataatatgctgctactgcagcagcttctaagaattccttagcttattgaaaatgactaatgagtacttattctgctgtagattcacttattgagtggtcttgataaacacatatacaaattcttcactcattcctgtactgccaatagcatcttccctagtgaagtcaatagcattttaagtgagatactaacacatcattctaaattttattttccatacaaactagctggaaattaaccaacaccccaaatgtacagaggtgataacaatacaaaaaaaccaacatctgaattgacatttctttaaaaaaattagaacggtcctctagatagtagaatttaggcactaagacaaacttggaaataacaaatttggttgtaaagtaggtcatgcgtgtcctatagacacatgctaagatggaacgatacaacgcggattagagaagagaataggagtgaatacagataagtatcacattaaaactttgctatcttccaaaaccatgaactcactagcaaattaatttgtattagcaccattcagtacccttgttgcatatagtctagaactctagattagtactttattttgacacagtcgtaaattactggctatgaccatctgctttgtaagcatagaagaatcaccttattttattttcttgtggtaatataaacaagattttgttcctgtaagccaaacatagcaagaaatcagggaaaattgttggttttgcgtaggtattttgctagtcttggaaaaatgagactgttgttcaaccaggtgtatgggcggttttgcactgctatgagactgcactagacattactatgatgctcacatttaaggcaattcaaaaccaatgatggtatgtctcacaacgttcatgtattccacccagggcccagttaaaggcaaattttgccgatgattgtttgcttatgcatcgctacataatacatgaccaaaccatgaattggaagatttgatgcactgatactccatgaagagacatccatttggcaattggcatcactcaacagtaaaaagatgacggaggaaatagcaccatctaaaaatgtcactcgagaagccgtgcaatagatagaaccagtaatgacgatatgcaatatcaaattttcaattttcactgtaagacatgaattagagatcatgtagagcaaccgaccattgcaatcgcagaacagtccaataataacagtaatgagttcaccaacacagttccatcggtcgctccccaatcagcgagaagatacggcagtaaactagaaccattcactgtatcagactggttcctgaggaaggggttagttaccgagcacgaagaaagcgacaaagaaaacgtacgaaggcgcggttagccggagaggtctcttcgtcgtatccattgcgagaagctgcgccgcatccacctccggcggactggcggcgcgccgcccttcccgtccatcgccataggcggcggcggcggcggctaagtgggttttttcgcgttccgcgcggagaagaaaagctgaagagccgtttccccgtctcttcttcattacagcgacaccaacgttgatttccgctaacgacacaggaaggcgtattctggataatgggcccacttgtcagcctcccgtgaaccagatccaggttcccaccaaacagaaaaacagaagctccaccactgcatcgtagtcgtcttcttcacgcgcacggcgcacccagatccaagcgtccatcgccgcggccgcatccgccatggctccgacggcgcccacggcggcgaagtccgcctccccgtcccagccatccgggtgcgccaccctcctgctccttcactcctgacggcatctctttcatccccaacctgaaccctaaactgaccaattttggggggacttgtgagttgaggtgtgcaggaagagcgaggtggcggatctgaagcagcagctgcggcagctggcggggagccgcgcgcccgacgccgacgaccagcggagggacgtcttcaagcgggtgatctcctgcatgacggccggcatcgacgtgtcggcggcgttcggggagatggtgctctgctccgccacctccgacgtcgtgctgaagaagatgtgctacctctacgtcggcgtccacgcgcgcaaccacccggacctcgcgctcctcaccatcaacttcctccagcgcgactgccacgaccaggaccccaccatacgcggcctggcactccgcagcctctgctccctccgcgttcccaacctcgtcgagtaccttgtctcgccgctcgccactgggctcaaggaccccagtgcttacgtccggatgatcgctgctgttggtgctgcgaagctgtatcacatatctgccaccgcctgccttgatgctgacttgcctgcggcgctcaaagcgcttatgctctctgatcctgatgcacaggtgagttgccattccacaaacaatgttgtgattatcatgcaactatgatgctgctacctgttgcaatgattcattatctgtagattatagtgctcacaataccgtttaattaccaccgaaaagtctatgacatctgtagtgctgatttaaagttggaactggtagacaatcagtaaggatttaatacttcttgcatgccaatgtgagctgtaacttgaaatttggttcagcatgcagccggccaatcgttttctactttgcagtttgtctaatagaacaggtggagggaaatgcctaatgaagctgcatgctagtgatattaatcttcattgataatagtttgattttgatctgattgatcatataggttgttggtaattacttggaccgacatattttgtgatggaaagtatagtgacttaacattgctgaagtagcttgaagccttgaagtgaaaccacaatgctagtcaagacaaaactactgaacctagatacaccctattcttttaaggttacataatggaagaaatcaactctgaaccaatctgatcatgcatctatgtgggtttgatttctgggaaggatttggaggctattaggtgaattcatatatttttgctcaaaacattcttgttttggcttaggcttttaagatttcagccacaagttgaagggtagagtcataattttcttctggttattagttctatcatgatttttggcttttaaaagtccctgtggtaaagctgtctgttacttaaggcttagaatttttggtttataagccagcgaattagctgaagcaagcagggctcaacatatgaatgtggttctgggaaaatagataccatggtactcaaatataaccttgcaagaataagagtctgaacacaggtaaaaatggtactgagaggatagataccttggctgcctttattggttctgtttctaactcgctatccccattttctaccgctcttgtccatttttcattgttgcatgctgttgccaccttgagagtccctgcctcaccatgccgccacacctttgaagtgtacttttgatattctgtttgtctgctacattttacatgcgtatgatttataaattttggaacaattgtttcagtatttgccaacataaattcctacaatactattgatgtatatttctattatgtgcttaacatttctggaatgttcatgcataatatccacatgtattcatgaccatattcatattaaatctatctgcatgtaatttgtatttgatattatacgaatccatatcccaaactgaaagaaacattatataggatgtgaaaaacccatacatggccacattttacaagattgcagccctacattcagtattgttcctgactgcctgtataagatgctattcttctatacaccttttgaataaagttacacaactcttaatattattcagatgtgtacaacttaagaaattggtcacacactttaagtctcaaatgattgtaccttgtgagagtagtgtcagtcgtctcagccgtatgctgttttatatctaacaaatactccgcctttccactccaaatgcacgattggctatggattttctcacatgaacatataggagaaatactaaacactgcaatttgtttttggaacaacacaggagagctgcatgttatttcattaaggaggaaaaaacaaagtacacatggtcaagaaggaaatcctgacctgaatatacatattcacacacactaaacactgcagtttgtgcaattattctagattcaacagcattttgcttgtacccttgggttcttgttttctcacaatgccttcaacagtataatacaacataataggtttacatagtgttcactagccaaactagatagggtacttcagagatagtatttaccaagaattatattgcagttttttagttatatttaatgtttaaagacatctcaattttgccatttatgatttatcactagaacatattgtaattctttttgttccacgagtaatattggtgttctacccaaagtaattgaaaccacagtaggtgttgaactgcccaggtgtttggcttgctagtttgctggccacagctggttcactatttaaatcggtcattggtggtcaagtgagtggtaaactcatgttatatataatactaataggagagtagccaggagcccaggacaataagccatggttggcaacttccacagctcctaggtggtcggacctcttggtatactagcatatttgtccatgcattatctcaattctcaaaaaagaaaaagaaagaaaaacatgaattcaatcattacacaaataaaaataatttacctcatgtctaaataaaaataatttacctcatgcctaattcacattagatcaacatcaactccaccaccaattccttgcttcctatataactagtaaagacgcacacagtggacttgaaatctgaaggatttgttgctaagacctgctggatagaacggccagatgtttttatgtttatctagtgtcgatcacttattttcacagggcatttttgaccaactttaaaagaatgttaatgagaaaaccgagaaattgaccagttccacttttcttgatgtttacaatagaagctatccacagagtacttgatttgacttcactgagtttaccgactactccctccatcccaaaaaaagccaacttctgggtatgtatctagacataccctatgact

SEQ ID NO: 74313 - DNA, 2623 bp, Oryza sativa
ttagtaatatgttaatttactttaacacttgattaattcctatttaatatattcagtctatattgatatcttagtataaagtagtatcggagtagtagccgatacgcgttaaatctacaacatcggctatgctatgaacatatataatctttatattaaagtacttttagacataagtgatttatactgtctcggcaagctggtccgatctatccgaatcacttggtttaaacatatttcgatttatagattatatactgttaatatctacagtcgatcgactagatttaactttctttttgctttatatatcattgccgatctaattcacgttacatcggctagcttacaaacgatacgtcatcggcatgtggccgatcgactatcgtttatggatttaactatgtttctttgtttgtttcttgttggttgcaggatcaaaccaactggcatgcccttaaacccaagagcaaggtcctgcactagagttaagcagatctctcaggccagcgtgtgtttttcacatcaacaaaccgtcattgccaattagagatagagctcaattaagacaaatgtatctattaattaagttagttatgtcggtttgtgttagttttggcaagagagcgccgttatggtcttgtttgtatcttatctttagaaatgtttgagtcatgtccataatagactaagtttgtactcgggtgttgacgagaaatccgtgctcggtcgagccggaactgtgttggcgtgaactaagtcgacgaacacaatggcctaggagatctgcttagctccagtgcaggtccaaaggttgacgagatgcggacgtgccagtcagtttgatcttgcaaccgacaagatatacaaatagcagatcaatgagccaatcggctgataagccgatagagcgataccaactgatgtcgataaggttttgagcaatcagccatatgtttgatgtagaatctgatacttaatgtaaataaaggcaatcggctgatgataattgttaataatggaatttggcatcagattcgagtaagaaggaatagatcgaagcggatttggtgttggatttagttgaactcagaatcggactgtgtatcggctggagaccgtatcggtaggaaacaagggctgaagattgatcaagctgaggggactgatggccgatacagctgatatggcatagcttgggctcggtatgggtctagattggactaaagatgaagctcaataaaggcaattgtatctaatataacttcggcgcgccgaagctcaataaaggcaattgtattaaagcaaatccaatacaactttggcgcatcgccacccttttcttttacttgttttcggcgagttatctccacagaggtaacccgtctcgatggctcgtgctatcggggctattatgtcgttttagatgtattagttcttgtattatgaccatcgctgagtctgtccaggcaagccagcggctctgtgtgtgtgtgtgtgtgtctcggtttccgtcttctgcctccataacaagaacgtcttctcgccaagttacgtggtgaaggcagccgcggtgtcggcacgcccggggcccgggctgccttcgatcccagtaggaatcgctcctccttctccctgaaggaagagcatggaagtttactagggaagtaacacggagatatctgtccggttgtaccttcctctgtaaggtacactagaaatatcctaactaccgctttaaaggatgtcaggggtgtgaccttaagtcctgacgggaggtgtgaagtctaagggccagttgtaaggcaatgcaccccctctcatcatgaaaccaagcttatagaagatttctcccgctgacaacggagagacttcgacaagacttgggtggcaaatcgttagggtcgatggcacccccgacacgtgtcacacatgcccacggacgccttccctcggcctagccggtagggaagagccgtgtcccgccgaaggtagcctaggccctactaggcccacctcgcaccacgtggtgtgcgagctggtggaagcccaactacctctgacaggactttggagctcggggctgtgtgaactgcaagacttgaagggtttcttgaggatcacagccaaaaagtcagacggcagagataagacaattgacgtgaaggtttcaagggtagttaggtaatattgtgagccccaccttacactataagggggggactagcaactatttaaggggtcggtctttttggaaggccggggacattgccatacattgcttctaattcttcccttaggctagccaattcaccttatactccgtcggccggccttccctacggtcgtcggcctagggtagttagtgaaagtgtagcgcccgttccgtcgtggcgcctagcgggaaaattatctctcaaaaaccctaattgcgaaattttgttcctttgattgttgtctagtgtccgtgccatctcaagatctcaatccccgatctatcgtcgagttcaaattccgaatccagatcttccgaatcaattcctccgcaaagtctaccttgcccccccggcccatctctccccccccggcccatttccctctctctctctctctccctccccgg

SEQ ID NO: 74314 - DNA, 31261 bp, Oryza sativa
  unsure (1)..(31261): unsure at all n locations
ccgccgtagttgccgcacccatgcttccccccgaccacgatgccgccacctccgccatggcgtcctccgaggcccccgcgccgcaggagcagaggaggagggtaagtcgtcggacgcgtagtcggcggcggggggccggcgtcgagctcctgtccgcgtgctgctgcgactcggcaacaaccggctcgccgacctccttttccccctcccgccggcacagccggccattgtggtatcctcctcctcctcctccgcggcggcggcagggggcggcatcgagctcccgtccatgtgcggctgtgacttggcgacaaccggcttgctggcctcctcttccctcctcccgccagcacagccggctgccgtgatgtcctcctcctcttccgtggcggcggcggaggcctcctccgctgtgacaaccacaggttgagataagaagcaaggagagaagagagaagaaagaaagaacgaaaaaaataatagatgtggggctcacgtcattttctcttacacgtgggtctcacatattttatttttattttttctgactaggatgtcacatcagtgaaaccggacatctatacttctacggaatttaaattacatgcctttatatagtttaggagtgaatttaaagtcgaggaccggtaggtgaatttattccaaaatattggcctacctgttgttttcaaggtttcgacgaaacggaggcccagaaacggcccagtgtactggcccaggacaagccgaagacggacgcacgcagcaggcacaagtgcagaacggcgaaagttcactagcccgaccaactgataagagctgccgttttttcatggcagcatcacaggcctgttgatccatgcatatactgtactacgcagtagtgctcatcgaataaagacggagtttttaggtttgatctattgcccggtctacggaagtgaaaagagtactggtacaaatacaagtgggtttctcttttattgttttctggcatgatcgtgcattcgtgcgtgctcacactgtcacacatcagctatatattctcctcgaaaggcaggcatcggctatattctcgaattatcaaattctaagacccacacttgttctctaaactaacaataaacactacgaggtcttatgcttattaactgctagtcctagttggttgttttagccgagataatgagatttagagagagagagagagagggagagagagagagagagagagagagagagagtataaaaggtgtggcgtgtacacgaccgattccttttcgcttcgagggtaggcagctagcagcacatggccggcaaaacagttttgcagcaggagagattcatccgttcaattcgctgcaccctctcattacctttctgaaactttttcttaagtccagatgatgacggtaatgacgtgtggattccctgaaaagagggaggggtacatgatgatgatgatgatgatgggcaataggaatacgagttgctatctcacaagcgaactcgtcgccgcgagcaacggccgatcgagcagggcaaggcatgcggagggagtggaggagaggacccttggcaagctcgatcgggcgcttcttccgctccaaaatccacgaggttcaggccgtccggcaacagggatggctcctccgttcgttattcccctcctgcaagggccgcatctaattgatctgaccaacttgcaaggatagtcattagtcattgattactcgttaggtgctcaggtatctgtatatatttcggcttcgttgcaaagagacagctgacagccgtcggcccaagagcccacactttgagtggcgatataaagcaaatatttcagggtgggaattgtcctgattcatgtgagattgcatttcgttttgtttatgtgaaaaacctgaaatatacttgtgaatagtactttaaatctaatagattgtgcccccctttttttaatatgcagattttacctaggtttccgttagtatatatgtttttcaaactgctaaacggtacacttttacaaaatctttttatatagaagttgatttaaaatataaaatattttttaaagtttgtaacaattaaaacttaattaattatacgctaatgtcttctcgttttatatgcgctaactttgacatctatctcagtagtccaatatttatgttgagaaatttcttacatcctcccgaattttcgctcgatccttccattccatgcctatgaactttagcttatcccctacatatttttcattttgattccctgttgtgataattatatatcaaaacctttgtttttatgaaatttaatctttgaaaaatatataatgggaataggtggggtgaaagatttactgtcaccactatcttttttcaaaatagtatagatattaggttagaatatgcaatgctgatctaacctattaagacgaatttctgttctataatctcaggggagggtgactggattagcaaccctgaaacactagccacctttgatgctctgtgcctctggctaaaggggggcagagactaggttgaccctttttactcattagtaacatgtattaatgttatagggtatgtttggttctctactttgctaaatctttggtgccaaaatttagtaagttttaactctaccaatttttttggtagggtaaagttatgatacatatatttggattgttaccaatgtgaagccaaaatttgatgatatagtgaagaaagttttagaataatgctaaactgttcaaaggcattgccaacaatttggttttgatacaaaacattcactagtactatccaaactaccaatgaattggtccgacacatttggcatcaatccgaaataacccatattgcttattacggagtagtgaacctccttattttaatgcgtgattttttagatatgtttgataattagtcttatttttttaaaaaaaatgcaatagttgttatatattaaaaacggagatagtactggtcaatctttagctttagctgcgcattgcaaaatcctaacaaacaagcacgagcagaacggcaggacgacgtaccactccaaccttatctctactttatactgttataaaattgaaaatgtttttaccagtactttggtacatcgtccgtgcatgagtcagtttttaagtttgttcgcttttggaaatacaaatatgtatttgagtcggtttttaagttcgttcgcttttgaaaatacagaaggaatcatataagaaatatttttaaaaaactcacatgctaacatgagacaactggactcctaattgtagctcataattttctaaaaaatatatatatccaaacaagttctcatagtagattttatcttaactaaaacgtataataacaataataaaattaaaataacattcttccgtagcaatgcatgggtattttttttatattagtaaaggatgatggcagtgaaagtacttaaacacattcacgtgttggccatcaacgagaaaaaaaaagcaccccaaaccacaaacataaccactgtagcacgtagtggcgaccggccgaccagccggtagcggagataacgtcaaaccgcgcgctccgtgtcatcgctcaccgaaacctaaacacccacgccctctcttatccaaatcaatcgcactcaccaagcccgcaccaccacgtacacgagacatcgctagcattgcactccccgtgcgccgcgcccgcgcacgtatcgctcctgcagcgatcgaaatcccccccgtgaatccgtgatccgcagccaccacgcgcgcggcgcccggcgcccggcaacggcaagcaggtcagcagcaggggccgcgcgcgcggccgggcgctgcgatcctgtcgggtcgttttcgcggccaaaagcggcgcactccaccgtcgctttggcacgtaccggcgcgccggttggccggggctcggcggccccacgccataaactacgaggcatctggagatatgatgcatatggccaagatctcgtgctgacaacatatatacgtgctcgatcgtaccacgggggggatctcgctctctctgccctttgacatttgcacaaagtcagtgagatgaaaaggggaggacaatggacacgggagggaataatagccggcgcctgatggctctagcagtcaaggtgcaggcaataataggggcggtagtattaaaaaaaaagggccaagtgtaaaagtttaattccccccacactcgcgtcttttatggcgcgagaggcgagagagagctcgaagattccagcccttttggttctcctctctctctctctctcccttttgacatttggacaagtcaaagaaaacaatacgggagcctatcgccctagcctagcaagcaaaagaggcgaggcgacgacgatcgatggggtccctcttgacaagtgtacatagcaacaactgatagaagaatccctttccaaacaccagcaagctgctgtcccatttggcgactagtttatcaccaattacgacttgtttatcgccaattatcggcatatctcttttttcctaatcgcttgctcccgccgtgcccaccactagtagcgtggcgtttgactctactcccgctagtcgctagctaagccagtggtactagtagctagctagtgacacttcagaatcctctcggaatacgcgtctatgtacagggatacgcgtgtatatatggcgcggcccggccaaaagtcaaccccccgcctccggcgcgagctcgcagcagcacgcgtccttttagctgctagctcacctcgtcaaactctcgcctctccccccacaacgcgagagcttgccgacgtcggcgttcatgcgcggcccgctgctgctgcgcgccgtcgtcgtcgtcgccatggagcacttcaacgactgggacctgcaggccgtcgtgcggagctgcagcttcccgcaatcggagcctcctcgcgtcggcgtcggcgtccccgcggcgccgggagcgggcggggctccggtggtggtggcgccgcccgcgcgcgcaccggatggtccggatcagatggcgcgggcgtcggcgtcggcgctgtacgacctcgagtacctggatttggatcataagccgttcttgctgcccgggtcgtcgtcttcgtcgtcgtcgtcccgagcggtggcgcgggcgcgaggggaggatgacggcaaaggcagacacgaggtgatgatctctttccccgcggcggcggcggcctccacgtccggtgcgcagccgcggtcgccgtccggtcggaagccgggcatacgcaccccgcggcctaagagaaggtagtacacactactagtttgcaaccgttttacgtaccagcgcattggcagcctgatcgctccaagaaaattctcagcttatttcgaagtgatcgattattgtgatttccatggtgtgaggagcagcaagaagagccagctgaagaaggtggtgtacgaggtgccggtggcggacggcggcgtctcctccgacctgtgggcgtggcgcaagtacggccaaaagcccatcaagggctcgccttatccacggtaactaattattaccaacactttctttgaccctgccgtcccctttccacgcgtcactactcactagctactcctgcatatcaccataatcatagcgttgggaaacctaaaattgaaggaaatgagcacataaatttgatatttttattacataatggcatataaataacctgctgcacattgagatcttgagattatggccacaacaatcgaatgcaatgccttgcgtttccaattggacatcatggctttggtcacgctccacgtgacatgtacttccggtgtagtacaaggcaattccctgtacttagcagtacaatcggctgtaagcatgtatactttgcagttgacctaatgacctgtgcgctcggctcaactaacttggcgatacgatggttcgttgggtggttgtgatggatacaggggatactacaagtgcagcagcatgaaggggtgcatggccaggaagatggtggagcgcagcccggccaagcccgggatgctcgtcgtcacctacatggccgagcactgccaccccgtgccgacccagctcaacgcgctcgccggcaccacccgccacaagtccgcccctaccggcgacgacgacaagccgacgtcgccgggccctgcagccggcagagcggccgccggcgagggagtggtcaagtgcgaggacgtcgacggcaacgagctgtcggcgatggccgcggatggcggcgcagaggacacggcggcggcggcggatgacgacggtgagttgtggccggaggggatggggctggagctggacgagttcttgggtcccatggatgacgacgtgttcgagttcgaccatgtcttggaggacgacggcgtgctggggcgacggctctcgctatagctgcaagagaaaagctgtactagctagctttgacgagccttttaggacagttgactgtcagctccaacctcttcaggagatccaagccatgtataggcggtttttattcgtgcgtgtttgtggcatgatctctctcaagtcaaggttccaagtttcaagtttgcacaagtgtatatacttgtaatattcgcagggatgtcagtgcgcattgacacttttgcattcctgtacataattctcgtggttggtgactttgtcccaacacgtggaccgggctcaaagggaagtgacagcttcagtgcagtttgcctgcttgccagattgctattgtaacatccaagggacagtgcagataagagcatccccagcggctcctctatccagacatcgatactgtgtttggtgtatggaggtgaaaaattgcactccagcagaatctccatcacacacgccatttttataggtcctccaaaccggggagtggattttaatccctcaaggggatatcccctcgtatacctttttctttcaaattcgatgcaaatagttgtgaaaaattctgaaaaaaattgacaatgtagagtataatgatacctactagtccaccaaaatttatgttcaaattcgatctacacatcgagaaacaaaaaagacaaatttagatataaacagtgcactactattcatacgctgaatttgtcttttttatatctcgacgtgtgagttgagtttggacttaagattttgtgaagttgtatatatgtgttgtatgaatattgtcaaatttttccagaatttttcataaccgtttagatggtttttgagcaaacgaggaaacatcccctcgagggattagaatagtttccctccaaaccgagcctttcacaagccaaaaatggcggttctctctcctcatgccatcctcaactgccgacctcgcgccactatatggactgcataccgtgggagagaggagctgcataccggatttggaggtggagatcgccggagtagaggtggagaggcagcggatctggcagtgaggtcgccgccgtccccgccgctcggggtctctgccgctcctctgaccccgccgcccctctgccccgccgctcctccgccgccccttcgcagagactgggtggtggtggtggcggcgggccatcggcgggaggaggagggagatggacccaccgggaggaggagggagatggacccgccggccgtcccttgcgccgctcctccgccccttcgccccttgcgccacccgcatcgctcctccgaccgcgccgcccctttgcccagccgctcctccgactgcgccgcccctccggttggccctcatcctccccgtcctctcggcgctggtggtagagaagaaagaaaggtggggagatcggcggtagagaagacatacagatggggagtttttttttagagtagtgataagtatgtggtagttgtaaaatattagtaaaatataggatgttggtatatagaggatgtaatatagatgatctgttagagtgaaaagtaatatggagtaggtatcttttttatgactatctaaatgggagtatggaggataaaatttagatgagctgctggggatgctctaagcttcctcctaccgaacattatatttgaagttttgaatggcacaacaccgcaatatccactagtaatatatgttactataaaagaaggattcgattaaaaaaatacagaaacttcttgatctcttatttctgaacaaaatcaaatgaattcaatgtatctttgcactctaaacatcggaacaaatgtttgcaaagcaaaagacgtataaattgcacaccttacaagtctgcaagaattgcagtaaagaatatatactccaaaattatcaagtggattcattactcgtcaccatttctcatgaagcatttactatctctgttctaaaatataaaagattttgtccatgcacttacatagatatgacatatctattatatttttagaacgaagatagtagacattaagctattatcttctttgtgcttcgctagttgccatctactgatccacgtctacaaatatccgatgatatcaacaaatacattaaacgagcacatcttttttgaatcagttgcatacatacaaggggaatgcacgggtctccaaccaccagtgctgcaggatcggagagagaacaggggagagggaaatatggctagcggagcatagattattaaaggggaacaatcgaggaaagagtactgaagaacctgcatgctgtacgtaagatacattaggtgcttgtttctaattttttcttcaaacttttaactttttcatcacattaaaactttcctacacacataaatttctaacttttttcttcaaacttccaattttagcgtgaaactaaaccaattttggcgtgaaactaaacacagcctagcctgcggaattgattatttttcgatggaaactgagcaattatttttcgatcgaaactcaaacaattattctaacactcattggttgcatatatttgtgttaagttattttatttttgttgtatgcatatgtacgttttttaatctaagtctttgtctatgttacaataagatgagtttttttttatattggacataaaaaaaatactctagactttcagatgggagagtaaacagatagtcaacaaactaactgtgagcattgtagaggctacaattaagacgaacatcgcatttcagggatgataggagatacagcactactttgcaatattagtaaaacgacagagcattctgcacttcggagcaaagattcagataacgtattcttgtgtccagatgtatcttccaaaactaggataaagtcttagacaagctagcctgtcacacagagagcttacaatatggaaacgcaacgaagagcatcacacaaaatccaacttgacaatgatgcgcgaaatctccagccaagtgatgactcacgacgataacgaatttacagcatgcacgaaccgagatcttagtactcccatttcttaagctccatcccatcaggtgggcttccctctaccttcttcgagccaacatctttccaattggtcgacagaacagtaccgttagattcaacctgcaaacaagcacatcgttgatgtataagtatacaaagttcaaacttactaaacgcacttctgtcagcaaggtcactagttataaacatttcatcaattgtgctaaagaaagacatacaaaagatttcatcattgctcgtcgcatgtcttcatcagcatcactgtagatgtcacggaaaaatttgttcaatgcagcatcgccttcaagcttctcctccttctcctgttggaaattcaaagtcatggcaattcaataattaccagagttcaaggaatgtccacaggcagtgaaacgttgaaccatgtgcatcatactaacctcctttttaacttcagcttccagtttatcccagtctttcttggattttgaggaaggatatgatggcctctgggccgattcagctgataaaagaagggctatcagtaaaactgtaggagagatggggaaagaataacaattgaaccccaaaaaaaagccagacttgatcttggttgtattccagtcatgtacagttcatgcttaagccgatctggcagtaaaccatcagcctcaacaaggtattagcaagataacactcagaaccctcttccattttcatttaaattcgattaccaattttttgtgacattaatgtgttcaacaagcacaggaaccagcaaaatggaaatgactagcctgacatgtgagccagcgatcagcaagtgcatagaacggcagaccttattgataactaccacatgaatggaaaagaagtcatttctttccatggctataaatcagctcaccagttactaacataaagcagtaaataattatacccagcaaagtacagatatttaaggggaacctcttataataagattgaacagtgcaactttcaactaaccacaagaagcaacacaatagtaggttcaacagttttctggaaatcaactgcaatagttttgcttagtttgttacctgagggattatcttttgtggaacagcctttggttttttatcataatcaagtgaggtccatgtaatctgttcagctttagccagtcttatttcaaccttcgtggatagcacttggtatctgcttttctcagggatgatctgatagtcaagagattagcaaaagttaagaggtgagatgattggtactgtgcatagaaatcataataaacagatgctgagtattggttttcaaaaagaactgtatgtatggatcaacagcaatgcaaccaaagaaaataggcaaagcagtacacccagctttattaggtttggaagcatatttcaggtaaataccttacaaattagaggaaatgcacaaacatattcaggtcataacaatatgcactgtttccatttccaatgcattaagaagagaaataatcctggtattgcagggattgcataccttagaaaacagacgaggctgaaaatggtacggctcctctccagggacttcaatcgacacacttaactaaaatggaaggcttaattagtgagcacagtaaattagtaaatatagatgatttgcaacaatttattgttaaggtacacaccatttgttcaccaaaatcaacaacaacattctcagcaggaacaccctttgcaaaaattgtcaatacaacttctgtagcactgttgtagaagtcgtgcctgcaacaccaggtgcatttccagaaaatgtcagtaccaaatcattggggttaaaatccagccctaagaagcacttggtttagtgtctgagaaagggtgtgggacattatcccatatattcatgtggattctgtcaagtggtttccaaaatataaagtggacccctcaattcagaataacttgatacttgactaaagaactgtattgggaaaagaagcacagtgttaaaggattcatgaactggttacctgtattttggcttcacttctaccattggtggtgtattatccatgtttgcagcatcatccttttcctcaacaaaagaagcaacagagggggcagctgctccatcttcagccttcttaacagggacttcactaagctcctctgaaaagaaaatgcacagcatcaaagtatgagaaagatgtctcgtgcatacatttcacttcaacttacaggactgctgtggatattcatcccagaggacaaatatgtgtgaaaatgcatactataatatggtagtctcacgtaatggtatgccccaggtaaaaatataacacaatactgcaaatgtattaaccaagcaatggactcaaagggacagcttaccagcaatgcgctcatcacactccttcattaggcgagtaaaccttgagtcaccagatgcgaacgagtaacccaattcaagagctgcttttgcagtttgatactcctccagtcgtatacatgcagcgctaaagatcatttgcttatcagccatcataataaattaatgtgcctagtcttttttcataacattaaataatttagtcaagactgaccctttacgaagataagccttgtgcattgatgggtcaagttcaatggccttgttagcatcagctacagcctctgcaagacaaagtgcaatttgttgctttaatatgaaacagcatgataatgtctttgcaaacaaaacaaaataaacatgcagctaagtcattttagcaccagcacccttatactgaggtattttaagatatagcagtgctgataatttagggctacaggctacaaaacaacttacagctattactgataaggatgattaatgccttgtttggcaataaaattttgcaacatttcggacagaattgtcaaagatatgtgcaacctgacaaatttttacaaagatcagaaccaaggggaatgatcaaacactagtccaacctgacttttttttacaaagatcagaaccaaggggttttctgctggcaagcagcaagttgtcgccagatatcattttagcaccagcactcttatactaattcaatactatgataacagacagaaaacagtaatcagcaaacatgcaggagtatagcatttccttgagttggcaaatttagctgggaattctcagtaagtaatagctgaacaataacaacaggtagacccatcaaaatctgccacggctaactattgctctaaaataagagtagacctactctcctacatagctagctaaacagtcaagcacacatatctttataaatttcttgttttatcttactttgtaaatcaaaaggaacaggcaagatcagcacactaaggagttaaatttgattgtttcatcaaattttaaatatctgtttttgtttgctatatgcaatcattaggcatgatatgcggtgcagatgaaatttggatatatagaacaagggaaattttaaacaatcattaacatgcatcatcttggatcattagttgtcaattttttctacagcgcacaccagctttgtcatatactccctccggttctatattaattgacattttgaacaagattgatgtcaaacttttataactttgaccatcaataactttaaaaatatttagtttaaaggaactagaacaacatatatagatttgtcttttaaagcactataataaaagtaaacatgcatttatttattatatatattataatagaaaaataagatcaaatatatatcttgtagaccgtgtcattgtccaaaacatcaattaaaatgaaaccagagggagtacaataactagaaataaacaagcaactaagtatggttcacttaatgaagtctgacttccatacaaaatggttagtgggttcaatcaagtatactttaacagttgaacaatactttctcatcctttgatttttaactactccaaatatctctcacgcttccaaactcaatttaccccctaccaattcactactgcgcaccatcatcattcatgcttgacgtaaatcatttaaaagccctctgaattgtgcctaggattctggtcagaagtgtcaagtgtttagaaaatggagtatagcaagtcaactctcacctatcgaacagatttccccagtccaataacccccgacctagaccaaatccaaatcacacagtacggcacgcgaacggaatggttcgaattcgaaacatggtatttgtggcgtcctcatatcccccacaaacaactatgctgcttctttcgactaggatggtacctgccacaatgcagctatgccctccttgcgctcaatatctcctcctatcagcaagtcaactgtcactaataaaacttattttggcccatcccatgaccttcaccctagatccttctccaaatcacgaagcgcgatcacacacacgcacacgaattgcttgaacacgcaaaacaaacaccggtttgacgtaactcccgcaaataggcgcaacaaaccacgaatcaaaaacgcacaaaaccacacaccccacgcctcacgatctcatctacatccacacagactccccagaccaccaccaccaccaccgcacacacggcaaaccaatctaatcgaaggaaggggaggaagggggagattgcgagagatggattaccagtgtagttgcctagcttgatatgggcctgggcgcggtcggcgtagagctcggcggtggcggggctggcctcgattgcctgcgtgtagagctcggcggcgagctcgaagtcgtcgtcgacgaaggccgccttggccttgctctccagatccgacgcggcggcggttgccatggcggcttggcttttgcggctgcggtgaggaggccgggggatgcgggtgggggaagaccagacgaagacttcgcggaggggtagaataagatcacggtgaaaggcctttttaagggcccgtgtggcgagtttctagagagttcgatgcgggagaggccgggccgacgcttggaatttcatttttcttctctctctttttttctttgcctttttttttctctttatctttttttttctttcgtgtgggtcaagtcgtctctctggtggtttgttttttgttatccggaagccaggaagtttccggaatcatttgggtttcattgatgtttaagcgttgcaagttgtgtgtttagtgcacttattcggattgtgattaggaagcgactactagctggcagaccatcctcccttgtcatcatggtctcatactctcatgtggcgttgagaatttgagatcaatatccaaagttctaagcgggttttcctggtggctggtgatcaagtcggtgatatggataattcccgtctcccgatcacagccacaagccatgccaaaattcagcgtgtcgatcggagtgtctgaattcgtagaagttaccacgattgtggaactcaatttcagaggacttgtatcaaaaagtagcacacttttcggtaggagccactagtgagtactactccctccgtcccaaaatataagaatctagaactggatgtaaaatttacatgtccagattagtagtactagaaaatatcacatccagtcctatgttcttatattttaaaacggagggagtatctatttgcatagagcaaacttttttttaaagattaaggtggcaggagctctgccgactatattagaagaagtaaaacaaaaaacaaacaaacaggtccgagagtatatattacataaacattacaaaacagaaattaataactttaggccatgtttacttcccacctggaacgtttgaacacatacataaagtagctaaaaaattaactaattgcacagattgtgactaatttgcgagacgaatcttttaagcctaattgctccatgatttgacaatgtggtgctacagtaaatataattaaaggaatagaaaaaggagcatccacgttcgctctcatggcctacaaattctcacattaatcggagaaaaaaaaacagagtccatatagaaatacaatttagaaatagctgaaattcggaattaaaaaataaagaatattaaaagaggagactagagtccatatagaaatacactttagaaatagttgaaatttggaattaaaaaataagaaatattataataggagtatagagttcatatagaaatacaattaggaaataatagaaattcggaattaaaaataaggaatattagaagaggggtatagagtccatatagaaatacaattaggaaataatagaaattctgaattaaaaataaggaatattagaagtagagtatagagtccatatagaaatacaattaggaaataaccaaaattcggaattaaaaataagaaatattagaagtagagtatagagtccatatagaaatacaattaagaaaaaaatagaaatttggaattaaaaaataaggaatattagaagtagagtatagagttcatattggaatttaaaaccaactaaaattcagaataaaaaggagcctccacgttcgctctcatggcctagaaattctcacattaatcagagaaaaataaaaagcagagtccatatagaaatacaatttagaaattgctgaaattcagaattaaaaaataaggaatattagaagaggagactagagtagttattacacattagtagttttgaaaagttattgcaaaatttaaaattatgttgtcattgtaatatattttataataatataatgagaaaacatatatgcttttatatgagaaaatataatgatgctagccgcgcaatctacgcgggccaccatgctagttttgctaatgatgaattaattaggcttaataaattcgtctgcggcttactgatggattctgtaattagtttttttattagtgtccgaacaccctatgcgacactctatataatatctgatatgacacaccaaaactttacaactctaaagctatacaaccccttagacacagagtaaaagaggctagtagctgactggaagcgtaaacgcaagtacgctttgttctaggtcttctatgattaagtttattgtcagcttccttgaattctccctgaaaaattctactatttcgttgcaactagatatgccaccaggttgtgagtagtgcccccgtcctctggcgggattgtgcctttgtggcgctgtttgttatttgaatcacccaatctataatattttgggcttgtgcagccacggacagtggtggatctagaaagaaataacaatggagtatgagtaaactagatagcaatagagtctcaataaactagatagagttactagatagagttacagttccccctttcatctacatatggtaaaaattttagtagggttttttttggagactcttatagttttcacgccaatagtgagggttcgagacccgccatcccatgctagatccgcccctggccagaggattccttctttttagtgagtgtattccagacttgtcttgtgtatgcgcagtcacggtacaggtggtctacatcctcaaaagcttctctgcaaagggagaaaatccaatcacaggccaatgcctaattaacaagttttcttctattagggtcttttggtgcaggatcagccagcccatgaagcgttgctttagctgtgccggcgtttcccaaaccgtggtcacgaactgtgtttgtatttgcataaaacaaacttaaaatatatataccacttcacaaaaatgttgagtctaaacttcactcacatatcaatattattttctaaaagaagtctagcattacgcatttactgtaatatttatgctcagatttatcttttcttttcttaatatgtaggtcaaatttaaacttaatttttgtgaattaaataagtcattacactgcacatcattaattttttatacaaccatttgcacttgaatttgcattaattcatttttggagtttgaaataaccaacactcaattaatcatgtgtttatctcgttttacgtatcttatcattttttttcttttcatgttctatcaaacaaaccctttagaacagatacaataacagactataagacagctataaacacatattgaggagataaaagaagagagagataagcagcaggctataaatctgtagccaactgcaatacggactataagacacaatgtgtgtatgacaggtgggaccagataatatgtgtatgacaggtgggaccagatattaataatgtactatatatttataggtaactattgcatgaattaactattaaattggttgtagataatttggagctagtggttgactagtatacaattaaacttgctcttagtgagcgaaggttgtgttatctagtctaagttcataactcatctcttattttctgtatacacgttttctaaattggtaacaatttataagatagtccgatggatgatgggtctattcgctgcaacttttcggcagctgcagccgttacagtgactatattgtttatacacattggtactgttgatgtagttgcaactgctgcagcagcaagctgcaccgaacagagccgataagtccaatggatgagaagtccgatgggtatgcaatctatcgaatgattgttcctgtgaacttttatggggatgttttgcaaactagtataatgggtataatgggtttatagatgttattgttccttccaatgcctaagattagacaaatcgtcacaaccacaatttgtgagcagataagaaacacggttgcatgggctgatgggcagcatcaccagagcctgccaagaaaatacagggccggagtacacatatcgaagattggcaccaactagctagtataatctgagcaatcctaacgccaattaaatggagcaaacagcaaacaactgacaatgctgcaacaagattttcaccgtacgtacattccttattacacgcaagttaaattaacaaaccacttgggctatgccccgatgaatcagaaaggttttcagaagaggaggtcccggaaggtggggagcttcatctcaccctcggtggcgagcgggatggtgaanctgccgacnacggggaggtcgatggtgatcccgacctccagcacgtagtcgatgtcccagtccccgctcacgtccttgatcagcgacacgatgaagtcgtacggcaccttcaccggcagctccagatttgtcgtccgctcgccgcgatccaccctgggtcaggcatcgtgccggacgctatcaccctgcaaaaattgacgcaaatcgcgcgagaaccagccagctgactcttttttaatttgcttcggataatttgaacacgaactaactggatgcgccggctaacaattatgtaaataatgcacgcacttgtcgccgctcttgaaggtgtaggtgagctcgcagatggggatgcggtgcgagtaggggttgttgacgtcgaggtggctgtggagcgtgatgcactcgcggctgacgcccttgaaggagacgcggtccagcgtcgcgtcgggcttggggattttcgcgatcttctccgccacgaaccccttggccctgtccaccagcccgcccaccccgcctcgctcccgccgctcctcctctccaccttccccatcgtcccgctcctgccgatctcctctctcctccgccgcgctcatcctctcgctcgcgcgcgcgcacgtcgtgacggatcggtacacgtctctgttgctcgtcgcggctgctgcgctctcgcgtacgcgcggcgtgttctgcctgcgttaccattccggccgtgtgcatgcgcacgggtcgcgggctcgcggctaggcgcgacacgcggggagtgtgtctgtgtgtgtggatcgatgcacgcatgcgcgcgcgcgcactggtgcacggccaccacggaaacgtttggtccgcgaagcgtgcactgcgcgcggcctgtacggcagatcgggcaatgattgtttacgctgtcttgcgcgaaacctgggaataaagcggcgcagggagctggaatctttggacgtgagatccaaggcaagctcgcgtgagggagggaccactgttcgtgttgggtgattgggtcggccgctttgtaagatcgaaacaaatctgcaaaccagggcccgggggattgtgggcttgtgatattattgtgtacatgggtgggtacaaacgaaaacaaaaatataaatgagaaaaaaaatgaaattgaaaatgattttgcttcaaactaaccatatccgacttttattcttatggtaattaccatatttcatattatgataattatcgtatttctaaatatgcatttatgatctattttcttatttgacatagtttagaggtctatcaacttcacaaccaaatccttaactcgagtacaagattaaaagaagataatttataatttacatagcataaccttgaatttattttaacatattatatagttatgcaaagttaaatgtgtgattttatagttcaatatttccaatatttgttatggcttcctattgatactgatatgtttctgttcgtatagttcatttctggttttttaattgtttttgtttccgcttttaccattttttattcagtttttgggaaaaaaacatggctatggaaataatcgagatattttccaaccgttttcatccctaattgtgcagcagcaaactaggtgatcaaatctgcaagggagaaatggattcacatgaattgaagagtgtacttcctttaataagaaaaagaaaagcaaacatgcatctgatgtccacattgttttggtgttggcgcatctcattgtttactgtttaaagtgattatagctggtcattttctgaagagaatagtgatctctgaattctgggccgaactgtcatatgttgcatattatggccgagaacatgatgagtttgaactacagaaacagagcataaggatcacatcttttgcctataacgtatatgccaatgttaaaatttaaattttaaaacttactagttgattttgagatattttattatatttcatttttcagcattgatgtttaagttatttgtaaaagttttaattataaattattttttcgctaatacactctttggtgtattatccgtaattggccaatcgatggcataggatgaagaaaatcttctagcgttgcgctgctccgggcccaatacagaatggggctcaaaatggatcgcgttatcagcctccatatacttaaaatgggccttctgcaaatgggcgtctgactttctgacttgtaaactcatagatcgttttttgttccattttctcatgtagtagaacccgttcatgattacaggctttcagcgttgatcaacaaaacgttcttgccctcttgataaatgataatcgaccgacttgccgcatttgcggattgagggctgctatataccgaaatcccactccaaaatgggatgaggtatcgggtgatacttatcaggtatcatgtgatacttgcgaggtatcatatggtacctatcaggtataatacgattcttaccacatagaaggagataattgcgaggtatcatgtcctataacctaaccggtatagggtgatacttataaggtatcatgcgattctaccacgtatcagatgatacttgcgaggtatcagatgatcctcgtcgtctccactgcaccgcatgcccattccttcccccggcggcgctccaccaccaccaatgcatcggcgccccagcagcaggaggaaggatcccttggagtacaaggagtacatcgtcctcctgaggccgtggccggacgctgccaccaccggcatggacgatgacggcgcgtagtggagctagtacatgcccttcctccccggcaacagcactgctggcggcaagccgcaactggtccgctcgtacaagcacatcgttgacggcttcaccgcaatcgctgtgtccaagaagcccgacttccgacgctgcttccaggacggcatcgcttgcttgcattgctggtttaaacaggaaggaggatggcaaccttgcctgatccggccatggtgacgacacgctatgcgcgcggcgagagcactcgaggcagagctgctgcggatgcaccagggcagaggcaacggcgacgcgccgcctgcgcggcggagttcggtgaggtgggaggacgcgagggacgacgacgccgccattctctctccaatccaatcccttcgtctcgcgctgcagggtggacgacacggtggacaaaagtggatcctatcccgtcccgacgggatcccgctgtttagcatttatgttgcggatttatcggcagcatcaagtattagccattttggactcggttcgtgtaatatgttttcaataggttgtttggaacaaagaaatgtcgaccaaaaattcgttgaaagctctcgtactatttatctatttaaaagagattggaaattttagaggataatgacaaggagggcctatacagccattcgctcgcccgcgtagcctcccgcacaggtgacccgggtggaaaccctagccgccgccgctgccgcccccctcccccaacccatcccttgcctcaccgccgcttgagcgagtggctggcaaagccgacggcctgcaaggacagcggtagcagggctcgcggctgcgaccaccatagttccagcgcgggcaagtccatggtggaagctggccgaaaagacgacagcgtcgaggcggggtgccggcgctagcggggcacctggatctggcaccccccacgtcggatccagccgtggcgatggcgacagaggaccagtggcgctggcggcgaccgtggctgcggcggctgtctggcgtcgtggccgtcagatctgggccacgacgttgactgcggcggtaagctgcgggtggtggcatcagcggggaggcgtgggagattgcggtaggcggcggcaggagcgacggcggcgcacgaaggagcaggcgcctggccggcagcaggcgcgacgaatgtgctggccggtggggctggcggccaacacggtgaaggagactcggccggcgccggctaggcgaaggaggtgtggccggtagcggtgcagcgcgaggaggagtggccggtggccgcggagtgaggaggtgcggccatggcacgccgaggacggccagtgcgcgagggcctccgcagcgggaggtgaggctggtggaggtggagccagtgaggtggtagcacatggagattggccggcggggggcaccggtgcaatggtgcccacgtgccaacggaggcttagatgacgatggagcaatggtacacctgtggtagatcggtaggtgatggatggcgtgtgaaaacctagcctggtcttgaccgggctggcaatgatgatgttcgagcgtcattcccctcctgggagcgttgttgtgttgtctcatccctcaagtgtggttgcctggcgaaagcccagtctcggctctctttgagaccttgacggacggcggtggcggtgtttttcgtcacttctctccttggcgacgtcgtttaggcacctccttgccgaaacccccaaccaattggtgcaaccttgctctaaatttcatgctcttgtagtgacatcctagtttctataagttggccacgtcggagggccttagggggagaggagttccattcttctctctcaccctctctccctaactcctgaagacttggatagagtggggctttgtgttggttgtaatggtttaggttttgggcgatctcggctgtgttccgttgttggcctagcggcggtcgttcacgcttagcagcggctggtccggtgctagccttctcctgtatctgtgagttggcactgtcagtgtatgggtagtggtatacctttttccttttcctggttacgacctttcaagtttgtaatcttgtaattttttttcttgttctatccatagaatttcgcaccatatcgtgcgagtcgttaaaaaaaagggagaggggggagcatacatgtttggaaagataacagcaggggggtttccagaagggattaaatattaaacatctactaatgcagtcgcttccatcattgtagaagaataaaacggtgggacataacacgacgcgaaaacaaactccaaccctatccaccattgtccccatggacccccatactgtttcttgctgctaatagcagctaacttcgtaactggatagggacgctaactccccgccgattcctgtaatgtaaaatataatcttgtttatactagtactgttttttagggggacatactcaacaaataccatattcacggtaccaatcaggcacactcactcatgtactgatgcacatgcatctagtacacatgttcgaaaattacgagacaccaaatcctatgtgagcgccgcaaggatgcatgcatacccagacatacgcaattatgcatgttcatctctctcagaaacagtgaacatgaataatttctctgtttcacgttataaaacgtctggggtttttaatatattcatgtatgaatgtatgtatgagtttgaatttatatgcatatcagcgaatttagacgagcatcttatagtgtggatcggagggagtactagatatccatgtttgatgtttctaaaaaagaaaaagaaagaacataaccatgtttgatgtaaaataacatcacctgaccatttggatactatttttttgaaaaaaaaatgatcatgttcctactcctacctctatgaatgaaaggaacaaacccactgcttattttttttctaggagaacacggagacagagagcgtctcaacctccggactccagagaggtttcttgtgcttgcagggccacgttgaggatttgccattggccctgttttgatccaagggttagagttagtttctagctctcaactaactctgaactaactctagccctagaggtgtttggatggaagggttagattgacaataaatatacttttccaatcatttggctcctttccaaccggatttggtgtggcagactcatgtgtagcctcctccctctcacaaatgacacaaacaaatcatatttcaacccctccgccgccggcgcctatgagttgaggtcgaagccgacgccggcagaggaagcggtggcagggccactcgccgacggctgcgaagcccacgcgctgaggtcgtcgaagccgtcttcgtccatgcgtggccggcggcgcagatcggtggaggcggcgacgcggatggtcggaggcagcgcggctcggggttggcggcggcgcggttggagggagggcgcggcgcgggtagtgggggaggccacgccgcgaggatcggcggcggaggcgcggatcggggacggcggcgcggatctgtggcggcggcggcgtggatcggggaggcggcggcgtccagcgagaggatcctgtgcgggatcgggaagagatggggatccggtgcaagcagagagagagaaaagtggcttctacggtgggccccactcaaactagctccaataagcacctcttgaaggggctagtttttttgtgggttagatgcaactagccccaatctaactcctcatgtttggatcctttaaggctatttgagcctcaactagctcaaactaactctaacccttggatttaaacagggccattgtcttcattgtaagttggaataggtggtgtgtggagtgtggactgaggagtgaggactacgagatgtgtacgctgcagtgcacgcaatatattgcgagggtatatggcggcttcgtgtggaagtgtgtgatcacactgatgggctgatggcgatcgcgaacgaaaataatccaagatctggatcggccaaaaaccttcatcacatgttgcttgctctggatgattggtacgcctgctgccaagacgcgaaagggcaactggtgctagaaaattcaacgatattaagggacccttaacttaagtactcttatccggcatgtttgcaaatcggttactccctccgtccaaaaatataaatatttttagactccgacacaatctttgagatactactttgaccaatattattaaaaatataaatgttttaaataaaaatagttacatattatgattttgattaacgataaatctagtaacaccaattttacatgattgatcttttttttactattaatagttaaaattaaaaatagttgacttgacactatacttaaaaaagcttatattttaggacaggatatatataagttaatataatatatagttgcaaatcgaccgcggtgctgacggaagggtgcgtcaagtgacaatgcagctctcgctttcgttgtacttcctccctaatgcacagtataagagtttcatcggttgtctatattctctaataaatcaaaacgacttattagataaaaaataattcatagataaaaattttatgtgttacataatgatttaaaagccaacgctaaaaaaataggttaaaagaatcttaaaaccaatcttaaaatcatcattaggcaatccagttagtcacgacgacatgatgccagaatcagtccgctcccgcttcactctacacgttgctgcacacgtcgccgaaccccctccagtttgtccgaaataaaagggcctacccacaggccaccgcatcgaacagcaatctaagagcagttcaatactatagtcaatccatacaatatttacctataaacatatactacacatatctgatccaacatgtcatatacatacgtcttagagttcgtgttgtagctagctacaaatctatagctcactcctcttctctctattcttttatctccttaaaatatgtttatagttggcttatcctagtctgttccaaaaaaaagccaaactctagctatgaacctggacacatgtgtgtccagatttgtagctaggattgaaacttttttgggacggaggggtagtttactattgtacctgttctaaagatatcgtcattgccatctaaaactatagtacacatcattaaagctgctctccctcttcagagatgggcatcattaacaacacccacattagagatggcaatggccccgaaacccgacaggtaattactccattaggtcatttccaatccaataattaggatggtgtctatagcattaaataaactaccacataagatgaaagatgatgtggcaaataaataaatgaggaaagagaagaaaaccaggtgttgtatgagacatagtttctacacaacacccactagtaaaaaaacacccataggtgtcggccacaaaggtgccggttagccaaaaaccgacacctataagtcatttcccgccaatttagcaaaaaaccggcacctataacgattaataggtgtcggttttgttgggaagatcactggtgccggcactaaaaatactcccgccaacggtctgaaaatctcataggtggcggtcatggacaaaaccggtatctatacgaaaggtggtggttatttaaccaaactgacaccttcatataggccggcgagggaaatatgtgccgtttttttatccgaaccggcacctatatattctcactattataggcacctataatagtataaccgacaactatattattataggcgccggttatagaaccggcaccaatgactttgataataggtgccgaccaaaaggtgttgggcttgaaactggcacctatagggctttaaaaactggcactaatgactgttctgtttttgtagtagtgatccaagacatcatgtgagataagtagcattaaatttaggtatggaaatgtgatgtttgtattggaagagtagtgtctagtactagtttcttgatgacgtggagtttataaaaactatttctagtgtcgactggtcttagtttttatccacgtgggtctcttaacgggcaaaagtgtcacccgtcgggtggagcgggtgcgggtccattatcttgcccctgtacctgttaacccttggggctgatatgcactgcttgtttaatatgtggcccaccagaatttttcacatgcatttacttgcccaaggcccatgcggagaagagcttttcagcaaaaatcaacgaaccctactctcgttcctctctcttctcgctgactcgctgtagttcacacgcggacacgccgccgccgccgcctctgcaccacgccgcctgcccaccgcgaccccgttttgtccgccctccgtgctacaccgccgcctcgatgctggccaatagatcgacgaccggcggccccaggcgcactgcgtgctcgaccacaccgcttcctcccgttctgcgctgctcctcttttgttgttggcttgctgttgtggttgctgcagtcgggtgggtgtgtagtagactctgcgggcctggacgggggaaatctacacttttactgctacacccgtatgcggggatggggatggtgacgttcgattttttctgctgcggggatgggtacggggtggtcacacccgacgggtgcagcccgttaccatcccgcagcacgaactggttgacagacagcccacgccggcgcgcgcccgcatcaggagccgagccctccactttccccgccgctcgggccgctttctccattgccaagccgtaccttcgacgcttcgccttgtcagtcactgtccccttcgtggtcgtcttcgccacttctccccccgtctccacttgccccatatctgcggcagcctccctcctcctcgcggagatttgacccctgcgggctcgccttaaaatagaggcgcatcccattcccaagtggctgcttcctgcaaccacgaggtccgccgctctcgggagctccagcgagccgcgtcgccttctgcgcccgccgcccggtggccggcttaaatttgtgcgcggaggcgagccgtcgtcggtgccgcggggcttcctaattcctcccgggggagtgtggtcgagtgggggtttctggggttcttcgccacttcgccgcccgccggtgagttcgcttcctctcttccaagttccagtaagggcttgggtcactcgattgatgctgattcggcgcgtttcgcttgactgggaagttcgtcacgcgattgtcatacggttctcgcgtaattggtggcgtgtttcgatgagaatggccgttaggcttagcttgtagactgtgcaagactgtttttaggctgttgctaccgtggtctgtttggtgagaaaatggctggccttcctgattccttgtggtgttcgtagtggaatttgatgggggtctgatcgttgtggggggtcgcttgccggtgaaggaggctgctcttcggcaaatggttgggtgggtgggtcactgggtgctcaccgttttccggatctgggattctgaggtactgaaggtggtgtcgtctgtggttggggagtggtgcggttttcaagtttaggggcgtgtttaggacctgatgatgcaattgtaaatttgtaatacgatttgcaacgtccatatgtccacagcaacccaaatttattggtatagctctgatgaaacttcgggagtttcatttcagtatccctgttggtgaaaattatctcttctttcttgtattttgttcatgaagagtgatacaattaatagtattgccactgttactgtttttttctgaaaaaatttggcgccttcttttgtcttaacctgcttggatgatacgcatagttaatcacatcattaatccattatgctgtaatgatgtgtgaattttcttacaaactttgttttcttttgcagtttagtaaattcaacattttggacctacatgagttgattaacaagtccattccattgtccttcatggaggcttcatcttggttgtgctaccaagctcgtggttttggttcatccagagtatggttatggcttcttctagctcttgttcttctgaattgcagcctggtactctcagcctcgccgtatctggtcggtatggggagcttcgacataacaggacctgcagcagatgttaacatgatgggatatgcaaatactgagcagattgcatcgggaattcacttcaggctgaagtcacgtgcatttattgtggctgagcctaatggaaagcgtgttgtgtttgttaatatcgatgcttgtatggcatcacagattgtgactataaaggtgcttgaaaggctaaaagcaaggtaagagttaacatttcttgcgaccttattaatgcttgcatgtttgttgcaactttatgtgatatgcgcttatagatcgtgtataaaatgatccatcaacctttctacatgcatggtatgttccccaaaaaagcagacccgtaactcattgtcaagttactcatcatcatggattgagaatttgagatcctctgacttacttccctttgacttggagtcactgacatgtgggcccgctacctaaagggccaacatgtcggtgatccctgtcagaggtaagtaagtcataggatcctcttcctcaccatcatttgttgatggccgtcttattgttttcaaagattgttcaagtgaggcactgcctcaaaatcattggccattttgcaatgcatgttgcagaaacattgaggaacccagatgccctcatgttcactggtatgatcttgtttgaatctgttatgtcccaaagctcagtgaggcattatagcacgccatcatgtaggctggtgctgacaatgctgtagctaaggtactcatgttgcttgtctgttgtagcacgcctagagtctcagtcgagtcactttgttggaagttggaacattatctcttaaatcgactacctactcaacatggtattgtatttcctatgggtaaataaaccaaatttctagtttatattttgtccaactgaacctcaaaaccttgacttacagcatcaggattcttcccagtgcttctggccagccttgagacccttatgcagccatgcacctaataaagtctgctcagtagtttttcataacatcagggatcctcaaatttgcaggtatggtgatctttataatgagaacaacgtggctatcagtggcatccacactcatgctgggcctggaggttatcttcagtatgtagtttatattgtcacgtctcttgggtttgttcgccaatcctttgatgtaattgttgatggcatcgagcaaagcattgttgaagctcataacaacctccgtcctgggaaaatatttgtgaataaaggtataaaattagcttttgcttggactagccaaggttttccaaaaccgcctccggagccaatttttgctgctgtttaattaatgagtaaattacactttggtccaccttttattacccaagtttcactttggaccacccttaaatctatcttttcaatttggaccggataaatttaccattgttgcggtttgaaataccatgaaaaacttttcttgtcatgtctaacttccctttcggcaaacatatgaaccatacatagaggtgttcgcccgtatacaagagttgatgtgtttaaggttgttgattgtactgaaaaaaaatcgtttgtggtggtccaaatcgcaacaatggcaaatttatctggttcaaagtgaaaagatttgtttaagggtggtccaaagtgaaacttaggtcataaaatgtagcccaaagcgtaattcactcttaatgagtaaattacaatgcacctgttttctgttatttgtgacggttttaatctcacatatatgcatttcatttagttgcaagtaggccttcaaatgtcattacttgaattccggttatttctttcttatcattcaga

SEQ ID NO: 74315 - DNA, 2480 bp, Oryza sativa
cctgtcgccgctttggccgcgaccgccgagcgctagccctctcctttgaccgccctaagtcggttcccaaaccgacattgccatcctataaacccgagctccccccctttttcctttcctctcccattcacctccgcgccattgccgcccctctgtttcgccatcgccgttcgtcgttgcgcgtgtcggaggagccggcacgagcaaggacgcagaaggggacttcggccacgccctctccttcctcttccccggcccgaggccggagagattactcccgcgccgtcggcctctcgtcacagcgccccgacccgcacggtagtgcctctctccgttcttcctcctcgctccatctccccccccttagttttcggtggtagcacgagtagcctccccgtagctagccggcgccgccccgaccgttgccgtcgctcgccgtgtgctcgtcgccgtcgccgctcgagctccgtagcacccgctcgtcgccagcctcgctcggcgtagctccgcccaatccgacgctaacatcggattcccgtagccgcgtagatgctctcaccgccgggaatcggcccctcgtgaccttgtcgccgtttccctcttccctccccgccggttgccgccgccgcgattcgccgccgtcaagcttcctccggcgaatccgagccgttggctcgtctcccctcgtctcgtgcaaccacccggtgtgctcgttttcgccggtatcgccgtggttcgctccgccgctcgccgctgttgtccgccgtccgttccggccggcgtcgtcgtctacctcccgccagcccacgtggcagccacgtaggcgccacgtcggtgccagctcagccgaggtcgggacgggccgaccccggtcagcccctcccgtgcgcgcgttccaccgcgagccgtgaggctgcgcgtgggcccgccgcatccgttcctccgcagaccgtgcgcgtgcaccgcgtccctcccccgcccgcgcgcgtgcgccgcgtactccctccgcacggtgagccgagccgctgacaagcgggtcccacccgggaccgcgcgcggtgagcccggtccaccggctctctctcctccctcccgcgcgcgcgaccgtcttgggccggccggcccatttagctcggccggaccgccccaattctcttgggctgcgccctagccgcccgagaaaagtctattttccctccctcttttcttttcttttcttttcttttcttttccaaaaaggatttaattaaatccttttcctttagaccaaaaatccaataatcttagaaatccaataccttcccaaccgtaaatccgtttgactccgttcaacttccaaaattcctcaagtctcgagatctatctaatggcacgcttagaggtcattaatagggctttattttcgccgtttgttgagttgttccgtttcgcgtgtagtttcggagccggaagacccgcagtgcgaggatttcgaggatcaagctccagatctcgagcaaggcaagccacctttgaacatcttgagcctatatttgaaatttaattatgttgcttgaaaaatattatgcactgataggatcgcacttaatctgttgtcccgtctgcaaggcagtttggcggacatacctaatttgttgcattgatcctccctttgttaattgttatatcatgtccccttgtaaccatctagatgcgtctcgatattcgtgcaccctgtgcgagtatcgacggacgccttcaaacttaaaatctgaaaaacaacttgggtaaaacttgggttttacaaaagacttggaaaccccgacacctgggtcggtgcttgcgaactaaatgaatttccaaaaccacggaccggggaacgtaccgggtgtacggtttcccgctctcgcacttaaggaccgattccttggaatttcatccaaacataagtcaagtacgaccacatgggtggaatgggacacccctggctgagtaactagcttatcaggggagccttgatgccgagagacatgtggatttgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcacgggcggatgtgaggtgattcctagcgtagttttgtttgactactgcttgtgaaattgctgttgtggaaaggggttcgatgtttgaaaaatcagcagctgacgggatcagctaggcccgggtggccgtctgaaagttgttggcccgggtggccgtttgaaagttgttggccgggtgccaatcttgatcaattctaaag

SEQ ID NO: 74316 - DNA, 11374 bp, Oryza sativa
tgtcgcccaccgccgtcatgggcaccattgcccgccgcgacatccgctgtcctccacgcggtagccaaccacgaccgccgctgaacctcgctcctcctcgctccccgccgcacctaccaccgccgtcccctccccacttgccgcctgcttcctgccaaagtgagagaagaggaagaggggaaggaagaggagaaagaagaagggagaggctgacctatgggtttcggtgtcataaagtcaaagtagagatggtaaaaggagaggctcttggagtgaacaattagtttgactagccaaatcagatggagagttggttatatgggtgtttggaaagttcaatttagagaggctgttagagatgctctaattcatccacttttcctgcttgacagccaccccttttagtattgctgaaatattgtttcgacacattactgaatgtaccgtcttgtcactagctatgcatcgggccaggcatgaccgcataaattcagaggtcgagggatggttttgtggtgggtcggagaagaaaattaacaggctacctgatctgatcctgatcctcgtctctagtgctccaaagtaatcgccactgtacgttgatacgatggagcacacaggccgccggccacgaggagaacgatccatatacccaacctctgaggagtcggtgttcctttctccgacccacagcaacgttatgtgtattgcactgcacgatccacaaagagagtagattttgattcctcaatgggatgtcctctcgttgtttatatgtcgctcaaatggttataaaaagatttgaaaaaaattggaaatttgtattaacatgtgatatatcactctacaaacatacaatttcaaatccaacttctacatctctcaacgaaaaaacaaatttgactgtgaatatatgttaattagttgtagtttaatttgttttgctttttttcgtagcgagatgtagtagttaattttgaacttgttgttataaaaccagccccgaaatcggtagctaaacgcggaagaaacgccatatgagatctaaacatgacgacaacaccgagacacgatatttggtagttcagccgtagcctacatctccggggcactaattactagcgctctttcccgattcagcatattacaacatatcagagttacaacgactcacagccggtcgctgtcggcatccgctccctctcgctatgctaagtctccatacgattacagtaggcatgcccctctatttaagatagattctaagatagagttcgattcttagtctaatcctaatacctattacaactctaagtcctaaactataacgaactacgtaaatatattcgacacaagctcataaccatttgagtgacatataaacaacgaggggacatcccctcgaggtatcaaaatagtttacagatccacgaatgtatatgcagttgtaaaatataaccagctagctagcgtagtgtgcatgactaagctacgttcttcactcaactttcccaacctctactctcgcgtgtattgtgaacaaaaaaaatctttctttcaaaattcatactaatccactttttttaaaaaaataactaatacttaattaatcatgtgctaatgaatcgcttcgtcttgcatgcgcaaggggttagttcccaccaccaacttcatagcttttacaacattaccttgttcaatagtgctccctccgtcccattttaagtgtatctgttctgtcttacttgaaaattttatgaaaaaaataaaaataataagtcatgcataaagtgatattcatattttatcatttaataacaataaaaatactaattataagaaaaattaaacaagacggatgatcaaacgttggacatagaaacccataactgcatttaaaatgggacgggggaagaataagatgtcgagaaaaaaactaaatgatggagcatgcagacaagtggatgaccgataaataacataagagcgagctgaggaggtgaaaaataacataagaaaggaggacagcggccggaccataaaagagtaggtggtggtaattgacgggatatccagaaacttaaaaacagaattcccaataacaattaggttcaatttttgaaatttcaaagacgataaagaggaggggcggtgggcaaaggcgtagtgtcaactgccatagtgtcctggcagttgataggattttgaaaaagtaagaaaaaaaaagaacccaacgatgattaggtctaatttttaaaatctaataaaaagggaaggggatagcgggcgagtcttaaagcagtaagttgacaacgttttataagactttaaaaattcataaaaacgaagccgagcgagtaagtggaggagcgttaaatgagtgagtcagtgagaggtatgtttggatggtagaatttgcatggatagaagatgacggtccattttcttacagacgagaatttcctcggctttgtcggaacactgccaccgctagtggtggcagcatcagacacctccttgacgaccttaactttcagagatgacgccacctgatggtccgcgagcggtccgatgatatcagtcaaaggaagggcttacgctcaatcaagtcataaagtgatttcgaaaggagaatgcgggatgttcatcaaatatacttacattgatggcttcatcacgttccgccgcccccttttcacaaaggggcatagggatgtcactcgccgtggtcgggccactgatcatcacttggccgacgcggcgctccacggtttcgccgctcaaacctgttaatcgagaaccaaccttcgataagtcaagaggaatgcgagcacaagtatgtcaagataaatgcgagaaagataccccgaggagaaacccgggtcgcgtcctctggcctggaatagttataagctggatgggcccgagcctgaagcggctggatccgcctaccaacgaagtctgcaacgacttcatatcccgacaaaccccgtactcggagatcgtcgatgatgtcgataaacgattgaagagagggggtcaaggggggctttgcggtccaagacggaatcttgtccggttgatcttcaggaaccacgaagacagggttcgagttcttgatctcaagataaaaccacctattcctccacttgctgcgagaagaagggcactggaagggaacgtaacgcaacttcaggccatcccgaagtcggaacccgacgcaaccagataccctgttggattccatccaacgcagttcatagtaaaagcgaaaaagatcaaggaaaggctctaccccgatgtaggcctcgcaaagatgcacaaagatgctaaggaaggcgatggaattggggttcaaatggagaagagaaagaccatagaaattcaaaaccaggagaagaaattcagaaggtggagggagaaaaccgcagagaacataatcttcgatcgcaaccatgcgacccaagatgggctgaggattagtacctcctgcttccctctccatggttccacggccaggaagagcgccatcctcctggagtttcttcaacgttgcactggtggaagctgatttgccgaggtccattgctgatcgaaggtcgccggaaaacgagcctaggttgatgaactagggtttcttgcggcggcagagaaggcaaagagtgcatggaggtggtgtgtgtttaacaggtttggctgacttcaaaatagactcccaaaattcctttaaataggcgcactaccgacggtgcgaattccagggaacagagagatgcccgccggaaatttctggtcccgttacgcgcgacggttttttggacttcagtttaaaattcgctcgtgaccgttgggcttcaaatggcgtgctcgactatggtctatctccgcggtcctcgcaccgggaaggacaacagtctcgacacccgaagtcgcaaatggttacacgagttcattttaagcagaagtcgggggctactatcagggttacgggttaggcataccctttacccttcgatatacgttacatatcgatatggcatacccacgcgcatgtagatatttcctgtatattctaaggaaacctttcacagaatctacagatgggaagaatcctactcgggcagaaccaggtcgttggcgtatcgtatagggtctgatacctccgagttctatgaggaaatctccacatctgcgatataaaaggggccccccggggagggtttagacatcgaatctcagagccaacacaacctccacagcctacgaagccggagcttacgaggagccaagtcatcgagagctagtcgaatcaactcgactacaatctcgccggatccgacaagttcccttgttctctttgtaacctgtgttttctaccatataattccacatcaactggactagggctattacctatcaaggggtctgaaccagtataattcttgtcttttgtttgcttgatgtcgtactacgtagatccttgtatcaacgtaccccaataccctctatatccggtctacgggtatcacccgtcgacaaatctatgatccgatcacaccgttgtattcgttgtaattaaatctttacaacaagatatcgcatgattatattttgataaaagaaaaacatatgtttcaatctgttaatacttattgtttcacatgtgacagcgacatgttacaatgtgtatcttcaccatgtttcataaaatatttaaatgtttcaattgctgttttttttgtttcaccatatataacttaatatttcacttgttggtcaacgctctcccccgcactgtcgtgcgcccgcgttgctcccgtgccgcgttgcttgcctgtcctgcatgtgttgcttgcgttgctgcttgcatactccctctccctctccctctccctctccctcctattacatgtgcctaattttttcctcaaattttaaatatttttctccaaaattatatatctgatctaagtttcaattataccattagatttttgcacaaatacttaattatgttgaaatatttttaaatagacgctacaaatcatacgttcaatatttttttcaaatatcaaatgctgtttctcgtctgtatgcaggaacgcgttggaggagtgaggttgtcgcgtgcatgcatgcaggagtatagctggttgccaaggtggcctgaggaaccattactctctctctcttaatcaaactttaaacaaaattctattctaaaatatatatccaatctataatttataacaagatctcacatgaatatattttgataaaaatatatatgcgttctagaaaaaaacaaacttatgttgaactatttaaaaataattctttcatcacttgtggagatgtttcaacgcacttcacaaattgttccaaagaggtacaacaaataaaaagtattgactgcaacaataatcattattacatgaaacattaagtcccgactagtgaaacattttttatatttagattgaaacatcgaattataattattgttgaaacataaaaaatgtatttgctgaaacattgctaatgcattaatgaaacatcaataaatgcttgttgaaacatttcagtaacaatgtgtgtaacatttagaaagtaaaataaaaaatcatcggaatgtagtcatgtgatatcttgttataaagatttaattgtaacgaatccaatgatataattagtttgaaattcagataaatagtttaagagaaaaaatcatttaaattttgaaacatgtttgcatgcatgctccgttggctcgtcatacacctaactaactgtctcaccatgcacctacacggttgttcttttagattgagacgctcgattttttatttctggccggacggccgatggtaagcatttccgcaagaacacgagccattggaatctcatttctctctgccatgccaattcatgtgtgtgtaaaattgattgataggagtttgacagcaagaacgcaagaaccattttttttctaatgaattcgtgaaatttgcttatatttttttaacacgagaggaaaattactcgtttgcacgtattgagtttgggagataaatagagatatatgtggtggtgcgggccggtattcttaccatctccaagtttgaggtgatcataagagcttatccaccctactactcctaactaaacataaatctagataagcaaattccaccaaacaaaaaactagaccaccatatctatacctaatagaaaaataggtaaatcttccataaaatttttcgtccattggtatctggcttcgattactatttcctcgatgatccgtgcaatacaaaatccggacgcatgacgctaacgcctaacaacgagattttttgaggtccctcatctacaaaactagaaatcttagcccctaaactcattcaaaccgttcaccggaggtcccttggcagtatatgtaggtggtttcgctgatgtggcatcctagtcagcaaaaaaaaattaaaaaaggcccacatgtcagctgcagtttttttccttctcttttctctcctcctcttctctttcctctcctctctctttgctggcggcgggtggcgatgggcgagcccgcggccggagtaggcggaggggcggcgtcagcgcgcggctagagcaagcggagcggcagtgtctccgagcgagcacggctgcggcggcggccgcgttcggctgcccctagcgagtggcggccacgccggaggccgtggacgtgccgcggctggtgctccacttcgatagcgctgggtcatggagtagcagagctcgagcacgggggcaatgccgcagagctcggggattacgtcgtagctgaacccgaacccgagatccacgcacccttcagctcctccaggtcgtcgtcgactcgtcggtcaggctccgtgcgtgccgccgccgctgccatcgctcccgctccttgccgtacacgcgccgccgccaaagacgacgacgccgcagggctcctccttggcgaccaccaccagcttcgtccaccgtggccacgccgcctccgagcgcggcggagggcaagcggcggctccgggcgtgggcggcacgcggccggagcaggcagagcggcggcatctccgagcgcgggcagagcagagcggcgggggacgcggaaggcatggcgggcgagcggcggcatggcgtcgcctatttccccctctcccgccggcctcatctcccccactccgcccggcctcctctccccctctcccccaccaccaccatcaccatcacttccagggagccgaggcctggagcgaggcgcgccgctctcgccgccaacgacgacacggctggcgaagtaggccggcggagctcgcccaccaccgccacgctcctccttcggccacctctatgctcgcccgccgtccgctctgcccgcagcccgccgcgcttgccttccgctcgcccgccgccgtccaacgcctctccgcctgccgccgcgccgcccgccaccgttctgcccacaggccacgctcggctgccgcgcggacccgccaccgcgcttggccgccgcccattcctcctccgcttccttccttcgtgctcacccgccggccgcgctcgcctgccgcctcccaccgccacacggacccgccgcccgtgcaacgccactctgcctgccgctgcgccacctgcctccgttctgcccacaagccgcgctcggctgccgcgcgaacccgccgccgcgctcggccgccgcccattcctcctccccgtgccattcctcctcctactcctccgcttccttcctccgtgctcgcctgccaccgctcggctgccacgcgaacctgccacccacgcatcgccgctccaccggcctcactcactctgaagaagaagagaaagagaagagagaaaagagagaggagaagaaaagaaaagaaaaggaagatgtgcaactgacatgtgggccccatgtactttttaaatgttttttctgctgactaggacgccacgtcagcgaaaccatccacatatactgctaagggacctccggtgaacggtttgaatgagtttagaggcgaacatttctggttttgtggttgagggacctcaaaaaatctcgttattaagttgagggacctccggtgaacttattccccccgcaaataaaagagaaaagagagagagaaaaaaggaataagttcatctgaggtctcttaacttgtcaacgaatccgattttcgtccctcaaccaaaaaaaccagacataacgggtccctcaactatcaaaaccgatgcagataaggtctctcagcggttttgagggtggtttttgctgacgtggcacctacgtggctaatttgacacggtcttcatctgacgtggcgcttacgtggcaatccattcagaaaaataataaaacccgtgggacccacatatcagtttcacgcacaaaataataataaaaaaggtgggacccacgtgggccccacttgtcatcctcaccctccctccctccctctgtctatcctctctctatccctttcctctctccggccgatggagcggggcgagtggcagccggcagagcaggcgacgggtggggcggagcggctagccggcggagcaccacgttgtccatggccctcagctccggtggcacgttgggctcgtcctcgaacacttccaaccccgcgccggcgacccttccctccgccagcgcacgcaccagctccgcctcgtcgatgttggcgccgcgcaccacgttcacgaccacgcccacagcgtgtccagcacgccccagtccatgatgtgatgtgtctccgccgtcagcgcgcacgccacgacgagcacgttggagctcgcggcgaggtcggtggtggtcgaaaaagaaatcaacaaaagaaagacatccccagaaaagaaaaggcatcatcatttgatgaacaacataggggaaaaaggtagattaataaacgcatgaatgaactaaaatcttgaaaccacgcggagcaaaaatgaaaaccgaatgagttcctaaatccccgaccagcccttatctttgaagaaacagaaggcagattggggaagaatgttaccaccaaaagaaaaaaagatacaatctctgaaattcataaaggttgaactggtgatgacgagatagtcctcaaaagaaacctgcaaaaagacgatctcgcagcaaagtaagagagcagcaatacaatcatatgaaaccatagagaacatcaaaggccatgtctacccaagaacaggagaagggagaaggaatcacaaccaaagctgatgcatgtcatcagaaatttcacctcttttcctttgcatttgcagctgcaacccgatggagatccagctgctccctatagcagaagcgggcgacgacgcggtgctcccccagcgcgtcaagcacgcccccagtccagatgtgccgtgtctccgccgtcagcacgcacgccacgacgagcacgtcgaacagggccgacagcggtggagtagaccccgccggcgttgacgacctgtacgccgcgacacacgcactcgcggaggtcgatgtggttgatccccgcgctgatggtgatgatgcagcggagcgacgggacggcgtcgaggagctcggcgccgacgcggatgggcccgccgccgaagacgaggacgacgcgaggtgggtcggcgtcggcggccaccgtgttgagtaatgcgtggatgggaagcgtcggcgccgaggagaggggagagagaggatagagagggagtgaggatgacatatggggccacgtgggtcccaccattttttttattattttgtgtgtggaactgacatgtgggtcccatgggttttattattttttcagctcaaattgccatgtaagcaccacgtcagtgccacgtcagataaaaaccgagtcaaattagccacgtaggtgtcacgtcagctaaaaccgccctcaaaaccgtcgagggacctcatctgcaccggttttgatagttgagggacccgttgtgtctgattttccggttgagggactaaaatcggattcgctgacaagttaagagacctcagatgaacttattccagagagaaaaagagagaaagctagctagcagcccaaccaaagcagcagcaagccggcccagcaaaaagcaactacagcctagcagctagcccacagagcagaggagcagcagcccagcacaatactgcatgacactgtagcaaccaagcacgaacaataccacctcgcttttccagcttgagcaacacagcttaaataggaggcttgttgaggactattaatgctgcatagagtttggacttacacaaacaaggatcgaagaaaaaataacacatttttaaagttataataaaaacaatcacatgccttttttttaattgaatcgtgtttacataacctaaccacatcatcagtttttttttctttccattcattgcacgatttccttctgatttttgtagagtgaaatgattttacgattggagtgtagtgaacttgatatgatagctagccaaaaaacatttcttctactatggctcttctttgctagtgaattttttttatcaatatcaagtaccggaaaaaataaccattcattgcaactgaatctaataataatacatgacaaaagtaaatgtttattatggtttcaaattttagtttgtaatacataattttattttaaggtggtattaatagtttttttataatcatccatgtcagtggatctagagcaacaaataattatgttatgtgagtgtctttcctctttttttaagaaaaaggacacccatgtgagtgtctttctggcactggaaatatttgatttgcctataaggacttcacttaacctggtaatcttacgcttccacacattcactactacttttttttatacttcatctagtgcaacgtaccaacatttttactagtatatgggtgatcatattccatctcacttgaccatcatccaaacacgaattttttttatttataattttttttattaaaagttttacaaaaataatttttcattttgaaaattaacggaaatagtcgcctaccgccctcccagagggcgatttttaaaaatcgccctcccagagggcggcgaaaatgacgtggcagacggccgttcgctctcgggcgacggccgtcaacgaaatttgcaggcggcccccttgccgccctccgcgagggcgattttctactgtgcggggggccgcctgcaaatgggcggcgagggggggcatggaattttgcaggcggcccccttgccgccctccgctagggcgattttgcactgtgcggggggccgcctgcaaatgggcggcgagggggcatggaatttttcatgcggccccctt

SEQ ID NO: 74317 - DNA, 9751 bp, Oryza sativa
cggcgtgtgcgtttcgcctgggtgcgcgtagcgggggagacgccctgcccacgtggcaggcggtcggcgacacgtggtggtggcggtccccaccctccagtgagtgtcgtttcggtgcgcgtcgtgaaaaaggacacgagttgagttgagtgcggtggtggagggtggggccctgtagggatcccttgcggcgtgggacatgtgctgcccctgccgctgccctgccttcgaggttgtatacgaagaggctcggttttgcgggttaattacgcggggtgccatgaggtaccatagcgaattagcgatcagatcaggggtagtttgggaagtttgtcacgtggaacaggcgtctctgggtggcggccccacctgcacgtgtctgtctgcatattgctttgttggtgtggagttgggtagtgtggcaaatactgtataactgtacagtgcctttcttgtaaaaatactagtgtgtggtgccattagctagctttccttcagttcagtgcagtgcaggtcaagaaaggtgttgctgattacgcgttctaatttgtgttcttaattagtggtagtagcagtgtagcacctacttaactttgttagtgatgagtgtatactatagtatgggccggatgggcgctaagcataaatatcttggcttcctttacttaatttgatatcttttcgatatcttttcagaaagttgtgtcgtagtggaggccgaaagttgtctgaaaagagagatcgatcctgagactgagagcgagactgccggctgccgactgccgacgacgacgtacgaagccccgatccgtcgacaatgcaaggtactacgtacccaaactgtacagaatatgaactgtttagtttacctctattcctaacttttcatcacattatatcacatcaaaaactatcctacatatataaacttttaacttttcttcaaactcctaactttattcaaacttttaacttttttttcaagtaactagacacatcgaatgggtgctgctactagtgttcgctacgtgtcattgcctggttgtctcgatcttttcgttccttccggatgttttggcacacctgaccgttctcatcggtggatcggtcaatcaatgcaaattagtaaggcccagtttaattcgcgaaatgaaaatttttaggtgtcacatcggatgtttgaccggatgtctggagggattttcagacacgaatgaaaaaactaatttcataactcatatggaagccgcgagacgaattttttgagcctaattaatccgtcattagcacatgtagattactgtagcacttatggctaatcatagactaattaggctcaaaagattcgtctcgcaatttcccccctaactgtacaaatagtttttgtttttatctatatttaatgctttatacatgtgtttaaagattcgatgtaatgtttttgagaaaaactttctggaaactaaacgcactctcactccttatcatttcggtcgcatgatgatgttgaaaaacatccagaaacaaaaacacgcaaaaggacacatcagactagctagcgtgtacgtacgtgtacggtgtaccggtgtacacccacggaaagtacaatcaagagcaggagtgatccttccattattctccaaatctttatatttcgagtaatagtacaacaaatctttagatttcgagtcatcaatatatgtaaagatttaaaggtatgatatgcaaaaactaataatattaattaggtggatcgatcataaaaaatagtataacttcacgcagcaaaaatgagcgtacctatcattagcttccttgtggaaatttgattaggtgttcgtaactaattattctttaagcgcaaattactatatcaataacaagatatgtcagagatattcattggagtcgcgtgtgtttgcaaaggtgagtgtgagggtgtatatataagtgtcatatgcgtgtatgtgttaaaaaaaaactcatgcaattataactatttttttttacaaaagtatgatttagaaaaatagacatgtcttaggagacacccacaaacccttcgaactcatccatgatccatgaagcttcaccgctcaagataatagttaagctcctttgggttcatttagctaaggactttcatccatgaagaagagcatgaaagggtcatttgggctgggccaatgggccaatagactaatttaagctcaagggctactgcagcagtgtgggccatctccatgaggccggcccctatatagccacggtccaaaggcccagttattagcttaatcctgttatcttgtcacaggaggcggcccataaattaatgagctaaagtttacacaaacttaaaacccataaaatccatcacggcccatcccttgcaaaaggcagtctttcaagcccaaagtccacagaaatatatgctgatagattattaagctattcatatcaatctcggttcggccttctttagctcatagattcgataagctaaaataatctatcagcggattaatctcatgactatttaggagcagctagctagctagaactaatactgtattgcggtcatggcacggtcgatcgatagcgatcgagatggatcaactagtaattagtttgttattatatatggtcatcaagccatcattttctcttttttttttgacgcgaaagccatcattttctgatagcgagttggatcgagttgccactggctagcgagcatgcatatgcagtagatacagccatacaggagtcacaactgaattaaaggatatactccgtatataagctagacttgtcgacggattgagatgttctacgctttattattagtctaatcaccatcatatcgatcatcagtagtagtacttcgaccaaattaagcgatactaatttacagattcagtgcatgcagaccaagctgggtgaagatgatctcttacctagtacagtacagaaccagacattatctgtgacgggctgacggaggccggcgatttgtcaggtattcatccgtgtcagacaaaaaaaaaattcaaagattggaccttttttttttctcgagaatgtgaagattgggcttcacggctacgcctacgctcattaccgacgaccgagtcacctttaataatcggtttgggttgtaacccatcacatatgagttatccgtgacgggtgaattgaaccatgaatattgaaacccatctaagatgtatgacatctgtgacagtcgttcgcccagttttcacatcattgatcacttatcggataaggtcatatatcctctgtcaacacagatgaggatggattaccgattgtaaattccataatttcatgttcttgccgctggctcctatgtaaagccaacactataaataaagtcagccaattacattaatacttcctccctttctaaatatttgacaccgttgattttttagcacatgtttgaccgttcgtcttattcaaaaatttttgtgaaatatgtaaaactgtatgtatacatataagtatatttaacaatgaatcaaataataggaaaagaattaataattacttaaattttttaataagacggataggttaaacatatttaaaaaaagattaacgacgtcaaatatttaaaaacggaagaaatatttacttcttcttcgaggtgctcgagcctgatgctgatacagagtaagggcaaggttcgtttcagctttttgggcgattagccacacggagatggatctcgaggagtaatgctccttatgatctcatgcatggactgcctgatgctttggggtgaataacgctaaaattgaaagtttggttaaaattggaacgatatgacagaaaaattgaaagtttatatgtgtagaaaagttttgatgtgatgaaaaaattaaaagtttaaataaaaagtttagaactaaaccagaccttggtactgtatattaattgtactacgtactccgcagtcgtccgcactgcaggactggtaacgaatgaattgatcgatcgtgtagccgtgcaaaagcagcaggtcctgtacacgttgacgacccaacaagagcggccggtctcgatattatccatcacgtacggattcacggaccatataggactacaagtactcatttatatatgggccatgtttagattcaaaatattttattcaaactttcaatattttcgtcacatcaaatatttaagcatatacatggagcattaaatatggttaaaaaaaacaattgcacaatttttatgtaaatcatgagacgaatcttttgagcctaattacgccatgatttaacaacgtggtgctacagtaaatatttgctaatgccggattaataattaggcttaataaattcgtctcgaagtttatatgcggaatttgtaatttgttttgttattagtctacgtttaatacttcaaatgtgtgtccatatacttaaaaaaaattggcacacgaactaaacacagctatggtgtgatatgtcaaccatgggaaaagatgatctatgagtgttttaactgtgaatcttttgttgtagtgctaggattgatgcatgacatcttattgaataagggatagttggggacggacgcggcttgcctgctcctccacagtgctcccatccgtactcccaatttatcggacggctctgattttttggtgatgggcctacatcttctttctcccaagcctattcattttctttctccaagttcctctcccatggaaataatcggagaaaaggaaaaaatgaatcggctagaacaacgatcaacggtggcaagatctttgattctcttcggcaacgcgatttttcaaatcgtcaatgctaacgatcaagcacatgttaggatcaagcgattgctaatttgggctttcgtgacactgtaattagcactaagcaactaattaaatattttatcacagtacatgaggttaggatattttctgcagcatgctcaatatgaatgcagttattcaagtgattataataaaactatcagatagaggatgctctagatggtttcccctcaaatatgaggttactttggatatctttggtagaagaaggatgcaaccgatctaagtagcagttttatgatttatcgtctgctatatgtcttcttttctgttgaagttttttttttctttcgaaaaataccgccgctgattttgcaggtaaaaataaataaaaacagagacgaacccaccgctaaataaccgaagccgtccgatgcaacggagcatggatggaagccgcgtccgttggggacgagagaattattagaggtaagatgagaagaaaattaaataggggtggccggttgatatattagaggtaagatgagaagaaaattaaatagagcgctgttaatgatatatatatttggcaatagaactgttagcaataggcctgttggaaaaccaatatggttcgtggtaaaacctgcaactggtatagcgcccctattttcataaactactatataattattatttttaaaaaatattttgaaataagtgagaggagtcaaaaatgaacttattgagggagtagtttgagatgatcaaaatttgcagctcaagattgggctagccgcaggcatgtactactactacactggtagtactagagagagacatggagtagtggcaggtcacgtcgctctcgcgctctggccgatgtaggagtatctatctagtgctcggtcgtctggcatagtggcatggccatgctgctgctgatttgttgttgcgatgagaggagagggcaacgtagagatagatgttactaaaacttttaaatccctgtcatatcagatgtttaaacattaattataaatattaaatatagactattgataaaacttattctataaccctagactaattcacgagatgaatctattgagactaattaatccatgattagcctatgtgatgctaccataaatattctctaattatagattaattatgcttaaaaaatttgtctcgcaaattagctttttagttttgtaagtagtctatatttaatactctaaattagtgtctaagtatagagactaaagttaagtctctggatccaaacaccaccgtagttctgggatggaataagattcatcctagattgctatattataggatggagggagtaatacactacactactcccgagaggaaacatgctttaattttgcagatcaaagtcatgagtgtgcagtgatgagtggcagtgtctgcatcgcatcgcatcgcaatgtgcgatgggatctcgtcggcatcaggtggcaccactctactactactcctggtgtggtgggcccttcctgttgaccggtcaagatccagccagtgatgatgagttggatcccatgcggccagtcagcagctctcagctcctgggtcgtctccatcagcacacacgtgccagatccctccgtacgtcccctccagatgtaagttattactggttacatttgtaccgtatttttttaatgagacagagcaagtatatactccctccgttctatagtataagtgattttttaagggatgtgacacatcttatgattatgcatctggacaggcttggactatgtagatacataatcctagaatctgttacatccctccaaaatcacttatgttatgagacggaaggagtacttttgcatgtgtcgtcgtcttcacctctcattctctacgagcagggtttacaaaaccacacggttatcatgttgttatcatggttatcatatgctgtaacctttttagttttttaaaccacgatatatcttgcggttaccgttaacccgtggggtgatggtagtaaaccccatccacgagctggcttagctacaatatatcctctgcatcctccatctgtctctcgtggggctgcctacactcctttacatataaaggctggattttaatttgttatcttaaaatccatcttgtataacaagacgagcatatttcgtactctcctagtctcttttcctccctctctcggaagacatcttacgagtttcttgaattgaatgagctctaaaagaatctacttctacttacaccatccggtttcataattctcgataattaattaagttttaaagtggaataggcaatgtaatttaatactaaacaccacaagagtatttatcaggtggttttggcgccaatattaaatcgttaatatgtgcggttactttatcacgtttgtatgagtatatgttatggcaacatccaagtactatattattaagagatgtgtggattacgcgaatgtagtgttataaacaaaactagctgcccttccttttatactgaatgattgaatggttgaatgatttatgatactcctaactatttaagtatacaaatgaatggactaactatattatgaagttgaaaagcacatttaattattccaagaaattcgtatatacggtagagggtcttttaaaaatcacaccgtccagcaagcgtacgcattcttttattcatccgtcaagaaataaattaaaaaaagaacatggagtacgtgaagtccaacatgacacatatattgctgaaatggagtatttgataggtggcaaactcttaacttatctatgtatatgataaactgcaaatttattttcaaaaaggatcgataaatggatatggtctattgcgatattggactatctgatgatgatggccgatctactttgcttgctttctgaccaagttaattttgaccatttccgatccttaagctgtctggctgagtgaatgatgagtggtgaactacgaacagtgcatttgggggacattgctttgtttggatttaaagcttgttttaacttttgcaagcaagttgtttggtaagagtcagctaaacaaaaccaagctagctatgacgaagatatagatcaatagatgccccggtgttcacctttctaccttccggttttcttcttcactttctctaatttttctctttctctttatttctctttctctttacagaaagggtggccatcatctgcatctgcaagtgataaggatgcatggctagctagatgcttttcatcttaatttcatttgttaattaattacgacaccaattctccttgtgttgtcactgaaattgtttccatggaattttatttgaaaattttaaattagagccttgtcgcggagcatgcatgcagctctgcaaactgcaattgcataatttatgttaacatcattcatgcacaaacaaaatacacactaaattaacaattctgcctagagaagaaaaataagctaatcggtcgatcagcagctaaatagttttttttcttgggaagtagtaactaagtaccttttctccaactcttttccaagatatactctgtatatattataaaatcaacagtagcagtataattcttaactgtggcaagtgccgacaaaggagaattagattcaattcagagaatgagaatactcccaattctatgagcacctccaatatatagttagaaaccttccgtggagtattatgggactgcgaagtgaatgtagcttaactggttacattgcttatgatagaactaattcacataggttcgagttctagatttgatacgaattcttgtatttacggctaattaatctttcaatgataggtaacgcacccgtcgacagcgaggtgttcgtggtagctttttgtcaatatcaaaatatgctagctcttcgaaggtgctagctcttcaaaggtgtttatagaattgggtgtatatgtgtttatagaagtgaatgtgtatgttgtaattaagcgcatatgatgttaagtacaagtatcatgataactaatgaaccgactaagcactgaagctagccgaagttagtatatgtataaatttatgaaaggacagcatctatcgattatttgagtcgatctgaaggcattcgcacatcgactttatttctcttcttacacatgcatgcatgctgtcatatgtacagtgtacattgtctgatggatccgcacgtactctctcatctgctttgaataattattaaattatcgccgatgattcgaatatatttgtacacgcacgatcgatcgtgtggttgctactagcttttgatctttgtcgtcttgttcatgttctattagtatatgatcacaatcaaatgccctggtcaccaaagtatgctgtttcgaacatgtttgaagtcaaactttaaaaattactctctccgtttcatatattataacacttcaaatttatcataagttatttttttaaaaaaaattagctgagttcatagaaaaatgtaggaacattttcagcatcaaaattagtttgatcattaaatccacccttaaggtctatttgttttgtgttggaaacggtgctacatctttgtatgtactgtacacttggacaaatttgaataaatttgacctaactatagatccaaaagcatcgcgtaatatggaatagagcaagaccaacaccaattttattaaaacaattatatcagatttatcaaaaatatatttttagatttgccttgaaactttacttccacaaacactattactctctccgtttcataatgtaagtcattctagcattgcccacatatatataaatgttaatgaatctagatataaacacatgtctcaatttattaacatctatatggatgtgggcaatgctagaatgacttacattatga

SEQ ID NO: 74318 - DNA, 18902 bp, Oryza sativa
cccccccgcgcgccgtcgcccgttgcctcgcgcccgcgcaagccgagtggccgaccgcccggtcgccgccgccgtcagctctgcccgcgccagtcgccgctgtcgccgctccgctccaaaccgcccgccgtcgtcatcgccggcccccgccactccgcgcgctagccgccaaggcccggaggccgcgcctcacctccctctgccgcgtcgtcgccccgcgcccaccctccttttcccgaatcggcaaaggagagaattcctttctcctcctccttttccccttcctcctttttcctctcccgccggcgtcatcccgtctgccaccgctttggccgctagccgagcgccagctcgcgctcttgaccgcgcaagtcggttccccaaaccgacattgccgcctccttaaacccccggcctccccttctccttccctccccattttcgcctcctccactgccgtctctattttcgccgtctccaatcgtcgccgcgcgtgtcggaggagccggcacgagcgaggacgccgaagaggactccggccgcgcctcttcttcctcttccccggcccgaggccggagagatcactcccgcgccgtcggcctctcgtcacagcgcctctccttcccgcggtgatgtttcgcttcgttctccctcctcgctccgtctcccccccttagacttcggatttagctcgagtagacctcccgtagttggccggcgccgccccgaccgatgccgttgctcgccatgtgctcgtcgccgtcgccgcccgagctccgaagtagccgcacgtcgccagcccagctcggcatagctccgtccaatccaaccctagcatcgagttcccgtggccttgtagatgctctcaccgccggaaatcgacctctcgtggcctcgtcgccgtttccctcttctcccgccgccggttgcggccgccgcaatccgccgccgccaagcaacctccggcgaatccgagccgttggctcgtctcctctcgtcccgtactactgcccggcgtgctcgccttcgccggtatcgccgtggcccgctctaccgctcgccgccgtcgcccgccgttcatttgcggccggtcgtcgtctacctcctgccagcccacgtggccgccacgtaggcgccacgtcggcgccagctcggctgagctcgggacgggccgaccccggccgatccctccccgtgcgcgcatcccaccgcaagccgtgaggctgcgcgtgggcccgccgcacccgagtcctccgtaaaccgcgcgtgcaccgctttccccctttcgcccgcgcgcgtgcgccgcgtgctccctccgcacggtgggccgagccgctgacaagcgggtcccacccggggccgcgcgaggtgagcccggtccaccggctctctctctcctctcccgcgcgcgcgcgtaaatgggccgctttgggccgtccggcccgtttagctcggccggaccgagccgaatacctttgggccgcgccctagccgcccgaggaaagtctagattccctcccttcatcatttccttttcctttttccaaaaaggatttaattaaatcctttttcctttagaccaaaaatccaataatcttagaaattcaatatctttccaaccaaaactccgtttgactccgttcaacttccaaaatttcccaaatctcgagatctatctaatggcatgcttaggggtcattaatagggctttattctcgccgtttgttgagttgtcccgtttcgcgtgtagtttcggagcccgaagacccgcagtgcgaggatttcgaggatcaagctccagatctcgagcaaggcaagccacctttgaacaacttgagcctatatttgaaatttaattatgttgcttgcaaaatattatgcattgataggatcacacttaatcttttgccccatctgcaaggcagattggtggacctacctaattgattgcatttgatcctccctctgttaattgttataccatgtcccttgtaaccacccagttgtaccgcgatattcgtgcactctgtacgagtatcgacggtagccttcaaacttaaaatctgagtacaacttgggtaaaactggagctttacaaaagacttggaaaacccgacgcctgggtcggtgcttgcgaactaaatgaatttccaaaactgcggaccgggaaacgtatcgggtgtacggtttcccgctcttgcacgtaaggaccgatcccttggaatttcatcccaacataagaccagtacgaccacatgggtggaatgggacacccctggctgagtaactagcttatcaggggagccttgatgccgagagacatgtggattcgccggggtggtgtcggggaggacccctgggtttcctagcacagtatggtctgggacctaacctgttgttggtctgggacccctctcgtcggcatatggcaaacctgcatcggctttcgaaatgccttgtcatgaaagcttggaggtctcccgacgtggctgatccccacgggctgggtgacccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttatgaaatcgggttcgatgtttgaaaagaatccgcagctgacgggatcagctaggcccgggtggccgtttaaaaagttgttggcccgggtggccgtttgaaaagttgttggcccgggtggccgtttgaaaggtgttggcccgggtggccgtttaaaaggcctttggccgggtgccaatcttgttcaaatctaaagactgatacattgcacatactccgaccggacgagacacactgcctcatccgtgtcgtttgagaagcactcacttagttgcttttagaaaagagttcaaataaaatcaattgcaaaaacaacagccattccttgaagcctgcattaaacacttattttcccctggcttgctgagtactcccgtactcacccttgctctatataaatatcccccccagttgctgaagaagatgaagcagatcctgctgatgaggagttcttccaggagcaagccggctacgatgagttttagggtttcggcctagttcccaagtcgcgcctgtgatgattggtccaagtcctggcttccgtttcgcttttgtaatgcagttgtgagctcgggttctgtccgcagcccaacatgactgtactcctactctatattaaagagacctctgttgctatgatattctgtctccctgtgataccagcactgtttcctgggactggtatcgattaacaggttaatttggagcgtcacgggctagttccggccggaactggttcggggcgtgacagaaagccaaaacacaggagtaggttattatacctccgggtggcctgaacctatataaatctcctcgcctcccgccacggggctagctcgagccctgcgcacactcgcgcccttgtcctctgccacccctcgcgacacactccatgccgccttggcacgaccaccgtccgggcgccgacaaaccccttggccgaatctccattctcacgggaaggggtctccactccccactgaccatggaatcgcccccacgacacatacttagtgctgcatcagtacattagatctgctaagtcgtgcatagaatcatgagctctagcctgtttttgactgataataggggtagtatcggtatttcagccgatcctatctaatatgcatgtttctttatctgtttcatgtatattcaccatctatatagacagatcacctaatagcatcatatcaagtctaggtcaaattggctgtgctatcaatattgactactgaactttacttaatatattgctatagattgatatgcttatatagatttgtactggagtattagctagtacgttatccttattgctctaaatattgttataccggaaatattgttatattggctattttctcaatattgtcttaaaatcttttattaacctttatggacagtattacagccgatagggcatatttagggttttatattctttgatttatcaagactatagccggttcggtcttaccccattagctgggaccatcaacaatacgctatcagcctatcggcctattggctatcggttgactaatcctatcttttgtttccttgctggttgcagggtcaaaccagctggcacgcccttagcacttcgaggcaagccctgtacctgcactgcagttaagcagatctcccaggccgtcgtattcggtcttatcccatcggctgggaccatcaatgatgcgctatcggcctatcagccgattggctatcggctaactaatcctgtcttttgtttctttactggttgcgggatcaaaccagctggcacccccttagcactttgaggcaagccttggaccagtactggagttaagcagatctcccaggccaccgtgctttcacagtaacaataatataatgaaacaataatataattcaatagaaactaatcatccaataatgatatgatagatccgaaggttaaagcatacatcggctggagatttgatgtcataaaatctacaatattagataaatagtgaaacctttattgtcatcggctaaattcaacatatatgctatccttgtatgccgatacaacatttagatacctcatcggctgaaaccctgatgaaacccttattggcaactaagaagtaggctagagattgtggttctaatcaagacttagtaggttgaatgtactaatccagcactaagtatgaaaagaaacacaatatctagacaatcaagcctttgactgattttcagggtggtgtgtcgtggggacgatcccacggacagcggggagtggagacccctccctgtgagaatggagatttggccaggggttagtcggcgcctggacggatgccgtgtcgaggcggcgtggagggtgtcgcaaggcatggtggaggacgagggcgtgagtgcgcggggcccgagctggccacgcagtgggaggcgaggaggtttatacatgttcaggccacccggaggtgtaataccctactcctgtgttttggctttcactaactcccctaggctgacaaccggagggaaggccggccggcggagtacaagatggatccgctagcctaagaaaggagctacaagctatgtgtgccaatatgggaagctatctccaaagcggcctctctaaatagttgctagtcccctccttttatagtgtaaggaggagctcacaatattacctaactacccttgataccgtcacgtcgatttcttgtctctgccatctgactttcggctggccgtaagacatcacacctcccgtcgggacttaaggtcacacccctgacattctttaaggcgatagttaggatatttctaccgtaccttacgagaaaggtacaaccggacagatatctccgtgttacttccctagtaagcttccatgctcttccttcggggcaagaggagcgattcatactaggggcgaagccggcctgggtcccggacatgccgagaccacggctgccttcaccacataacttgtcgagaagacgtccttgttggtgctcccggatgtgcccgggcccgagttagttcgggactctaggtccgaacctaacacttttctcaactccccaggatgcaaactttggggggggggggcgggggggggcaaggcagcccccgagcaaccttgaggcggtcccgggctcccaagaccggggcctgcaaccacgacctccgattagttccctcttcggaagtgctttggtgcttggttaattgttttgacgggccccattcccatttcgtcgactctctcatatccctccagctcgctccccttcccttccttccttcccctcctagatccggtggaggggaggggcagcggccaaaggagaggtgcggcggaggcgcggccaaaggagaggtgcggctcccctccctctcctctccctcggctctactctcctccgccgccggtcacgacgacgacgactaccgcaagacgacgacgacgccgccgccggccggtctcggggaggagaggctgctatgatgaggaggtggggcggaggggaggtgcggctcccctccctctcctctccctctgtcgctggtcgcgacgacgaggaggtgaggcagcggcgcgcgcggaggggaggtgcggctcccctccctctcctctccctctgctctactctccctctgccgccggccgcgacgacgacaccgccgccacttgggtcccaccaccgactgtgacgatgacgtcgtcgcctggatccacctgacgcgcttctgtcgctgttttactgtcgctgttagatcccctacctgacatggttctgtcgctgttttagaccggcagatatttgaatcgttgtgcactctgcttggtgcgaagagtaatcacagtagacacgtaatatttggatcgttgtgaaccgtgcttggtgcgaagagcaatcacagctgacacggagtttatactggttcggaacctcgtagtcgagtttacgtacgtccaggtgctgcttcttgtattatttcggcgagtagagattacaatgcagctaatccctatcaattcgatgggtacaatataggtctacctagctatttaagtcactacgccagaaccctacatctgtgacggcacaccaatgacgggcctaaggattggtcacagatgaccgtcatctttgacgggtcgttaggtttgccgtcatcggtgaggcatccggccgtggcccgtcacatgtatcaccttacatgtgatgggccagaattttaagccgtcgcaggtgaggtagtgacggggttgctctccagcccattactagtttgacctcacctgtgaggggtgttaaatttgcaacccgtcaaagatttgatatctcatctcaaacgagttaaaaaaattatagccgtcagagatggcttacaaaaaaaatgccccaccccacccctgcgaccctactcctccccttggattccccttccctcctcatcttcccttctcatcttctttctctcctttactcactccctcccactcatcttccttctctccctcctcactctctccctcatagatcgggccgtggccccccctcgagagctggtcgctgacgcctcctcgcctcccgaccgtcggccgccgccgccgccgcctccccacctcccgaccgccggccactggatctggcctacaaggcgcggatccggccaccgcggcctctcccccgtccgtcggccgcttcctcctccgccactacaccgctaaccgcggatccggccaccgcgacctccttcccgatcgccggccgtttcctcctccgccactgcaccgccagccaccggatccggcctcgacaagtttgggggcgcggatccggccaccgcggcctctcgcccgaccgtcggccgcttcctcctcctccaccgcactgtcaaccgccggatccagcctcgacaagtttgggggccatggatccggccatcgcggcctctcccccgaccgtcggccgcttcctcctccgccaccgcaccgtcggatccgtccacgcctccctactgaccgccggccgcctcctccgccaccgcaccgccgccagatggagttatcctttctattttgtgcctagatgaatatgattgtgatgatttttgtgattttgttttgtgcccaaatgattgtgaatgtgaagtgattttgttctttggccagatgaatgtgattgcgagaatttttgtgattcagttttgtatcgaaatgactgtgaatgtgattatttctgtgaattgtgatgcctaatggtctcgcatgcaccaatctgtggcggcgaccatcctctgctgcgacctcatttttgtccgacgatcttgttccggggtcaccatcagccagcctagggctggccatctcactttaatttgcgcgcgcgcgcgcagcagtagcagcttaggcgcaagcgatcaccaagttaaacccctgaacttgtttgtcagatcagatgtgttcgtccaacataatttctacttaatttcaagatgatgctttcagaaaagtaaaccatggcataaaactcttgaccacataaaacactacagcgacatcgactcttctactagctatattcaaagatagatagatggactgcaacagacagttctactacagcgactagatcacacccaagtgttagtagcataatttggcttttggttaggtcattttagacaggccaaattatatagaatagttggtgtaattgttttagtggtttgcttaagaattggttagcttgactagggcaggaatttgtgatgcaccgggaggtgtacgagttgctggggagctgcagaaactagagaagaaggttgggacttgggaggctgcaattctcagattttgtcagttcaagcagcttagcatgcagcgatggagcttttgccgattcaatggatgtgaggcttcactggttgattttatgtggctggggttggatgcatggctatgtttgatgatatgcctgttgaagtctagccacacaggatcacattgttgccagagcaaggggagacaaattctgaaagttgggctggagcagcgttgcaggatggaggcgactttcggctgaggcttgtatacgtctacatggaagctgtcgttaaaaaaggacggttttcattacatagaattaatcacggatttacctagagttttctatatatgcagtacagcgtattcctttactatatactatggattttgcacttggtagggctcgaaaacaattatcatcatatattattttcttctaccgttttcatcgtacttttgctcttgtttctttggccaaatcctggttatctagggtgcggttgatctttactggtttgcgctgaaaatcagtcgggttcttccacgaaagtgaagatctttgctactttgcttgaaaactagtcgttcgtcgtcacgaaagcacgacggttatcattgttgttgcgtgaatcaattttacgtgtcaacaccaagtaccaacagataaagataagatagatcttcgctcatatctgatcaagctgctcctcctcctgcctatgcagataggctccgctcggcccaccacgccgtttacgcgacgagggcgctcttcgcaacggggaaccgctcggcccgccgtccccgccgtccccgccccgcccgccgtccccgccccgttggccaggtccaccttgacctccgtcgccgccgcggcctccgttgcctcctaggccgccgtcgccgccgcgaccgccgcggcctccaatgccgagaaagccgccggtgccgccagtgccgccgtcgccgccgtgagggccgaacgcggatccgccgcggccgccggggccgccgccctggcccggttggccgggctcgcccggctgtcctcccgtcccaccgtgtcctcccctgccgccgccctggcccggctcgcccggttggccgagctcgcccggctggcctcccctcccgccgcgtcctcccctcccgccgccctggcccggctctcccggttggccgagctcacccggctggcctcccctcccgccgcgtcctcccctgccaccgcgtcctcccctggttggcattggtggtggatggatctaggcgccgccgcagagaggaagagaaggggcaaaaacctaaagcctccaccaggaccgatgaatatatatatatatatatatatatattagcagaaaacgcgaattgggcctcagcccattaaccctccctgttgcctctcagagcaaggaaaaagtctacttagactcccttaattgttcaccgaatctaaatcgtaacccttgacgggaaaaccagataggacgactccccgaattattgaaactacccaatttgactcctccagcggttttggaggacggttttgcagacgtgacgctgacgtggcggtgctaacccggttttcattccacataacgcttatgtggcattagaattaaaaaaaattatgtggacccatctgtcattcacacacaaaatatattgtgggacccaccgacatgtggggcccacatgtcatcctttctccttcacttcttccccctccctccctccctctcccttctctctcttttctctctcccttttctcttcccccttcggaagcatcggtggcggcggcagccgggggctggagtggcgacggcggcgtgcgggcgagggctggttcgaggatgtcggcttgccggcgccgggcttttgctggggttcgaggctgttgtacaagccggagttgccgctgccgccactgaggtccgtcatctcctccaagtccggtgaggtccggtcgggcggaagtgcgggcgggagataggggtgaagaacctgtgggacatcctggagtcgtgcaagaagaagctcccgctccaccacctccagtgagtccccgatccgccattaatcccggcagggctagagggtagaggtttgctaagagcaagtacaatagcaggctgtaagcgagctacaaacatattttaaggagataaataaggagagagaagagcagcgggctacagatttatagccagctgtagcacggactccaagacgcagtgtgtgtatgacaggtgggaccatgtattaatagtgtagtatgtaactattgtatgaatgaacggttagattggctataaataaattggagctagtagttagttattctattaaacttgctctaagggcatccacagcgtcgttcgactcatgcctgccacgggagacgaacgaatcaaagattcgatagttgtagtggtaaagtcgatcggtgggacccacataaataaatatctattcaatcactaccgttcatcctcccttgcgtgagcttctaatgatatctacatggtccattcctctctcgtgggcaacaaatagttttttaaacggtagagttcgactctaaagtagatgtcgatttaatctccggcacgtaacaatcgatggccgtccgttcctgatccaacgatctcacgatggtagatgagcagccacgatgggacacgtggacggttagatcgtccctagcgtgtgatcgaacggatgatagcggcaggaaccgagacacaattaataggaattgtggggtttttttttttccaaaagaaccgatgatgtggcgcgctaaatcttcagcattcccacagtgtttaagtaaagtaatatttgaaacggtagagctagaaatgaaaatgacatcgataataatggaaaatcagaaacggaactattcaagggaaacacatcaaaagaagtaattctactgttttcaacaaattacctataccggatggttcggtcgatgcaacttcagaaaggcgagtcagtccgtaagtaatttctatgcatttgatccaattatcagactcacgtacgtttgaatttgataaacggttataaacagctgcaatgcatatgaacatactcctgctgtcccaaaaaatcaaatctatgattgacatccagattcgttgtattatgatatgtcacatccagtactagattgttttttaagtgacggagaaagtatatgttttgattgatatatggctacatgtctctagttatacggttatacacgagttgtacaattgggttgtacgtgtagcagtactcatttccgagattgttttcatccatgtactccacattactgttgttaaaaccctagggaatagttcttatcataacctactatcattagtactaaactaaaatttggcattattgctagtttgctactgctaatggccaagtgtcaggttgatccggactcaggaggtcttcttgtcaatgcaaatgccaagaatgatctccttgtgctccccgtgcagcatcttgggtggcacggccaagaacgtcgcctcctccacggcgacgccgccgggcgccacgccgctgctcgccacctccatgtccaccatgaccatgtccgccttgccgctcgccgcgcccgccaccgccgccgccgccgccgccggcgcgttcgcccacatcttgcacctgtaccgcgccgccgtctccgcgctcgccgcgacgcgcaccaacgtcaccgcgctggccgcgccgaccgcggccatggcgaggaggaacacgcgcttgtcctcctccccgacgagcaggcgccgccgccgctcagacgccggcacgcggagacacagggccttgccgtactcgaccttgtccacgtggcaggaatgcgccgcggcgaggtgttccaggagagccggcgaagccgcagccgggctccgggcatgagcacggcgcgtgcgggcacgcgcgctggtggtcgtcgacggcgtagtaggtgacgtagctccggcagccgtgcgcctggtaggggcactggatcttggtcgacgagacgaaggcctccatggcgcgagagcgggcgtagacgacgccgacgccgacgccttcgcacgagtggcaccggccgccggcgaccttgccgcggcagttgctgcaagccatgtgcccagcatcgcactgcataaatcgatggacaaagaaagaaacgattcatatgaatgcaaccatgaaacaagaaatggatgaagcatcagacattgcagcaacaagcaaggaacctggaagattggaggcttcaaggggagaaagcagatggggcagtgaagcatggccatgtcgatcctcacggcgatggcctccggctccggtgccacaaccatcgcgcctgcttcttgtttccccggccggccggtcaccgccgccgcggcgatcatcgttctccatcgagaaggcttccgttttctttgcaatgctgaagattgatttctctatcttttttttgatgtttgtcaaactctcagagcaatggcatggctggtcccttgtcaatctgccaaaccacgcagtgttgtgttgccgtgtactagtagggtgaagaacaagtagaaagagctctaccctctcagtaccaaaaaaactcaattgtgtgtcagattcaaatctagaattgagttttctttttggacggagggagtatgaaaaaaaaagaaagaactgttagatggatctccctccccttgagcccaacggctcaagggggccttgacccgcgccctgatcgggggcgcccagcccaatggctggtgggcccccgtcacactgtgccatataaagaggggtggaagacgggacggcataacgacacaaggaacgaggttcgtcgccgccgccgccactccaccccataaaccctaaccgatcgagggggcgcagccagtgacgggacgggaccggccgcgccacgacctcgccgggatcccctacgaccaccactgccgcgcagcaccgtcgccgtcacgaccgccatcgccgccgccgcccacgtcaagcagagcgacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaatagacaaccctaacaatggtatcaaagccaccctagagtttagattggttggggaaagaaatccaaaagaaaggcaaagaaaagcaaacgatccaacggatcgaaaagatcgaaaccctaaccctaatcttacctcgtcgccggccgtcgttgacgccggccacggagggggagaggggcaaagaggcaccgccgaggagccactcgacagccgcgtgcgcacccgcgggtgcacgcgcgcgccggcgagggggcccgcggcggcgccaccatctccgtcgtcgccggtctctcactcttcactcgcgtggaggggtgagacggtgggggggagaagagaaaagaatagagggcgtggcggcgcgagggcgtcggccatggcgcggcggcgcgaaggctgccggcgtcggcgacgccgctcggcacggcgcacgcccgcaagagaaaggagagggcgccgcggcacaaccgctcgacggcggcgcactcacccttgagtgagtgcgcgcatcggcgaaggggagtgcgacggcgccgccgtgtcgccatgccgccgccggcgctgtgctagggtttcggcgacggcgacgccgctccgtgcaaccgcaagagaaagaagagaagaggagctagggtttcggcgccggcggccgggggcggttttgtttgcccgatccgcccgcgcgaccgtccgatcgaaaccctagcgatcggacggccgacggcggccggaccgaaatcggcccatgtgggagcgcacggcgagccactttcccggcccaggcccaggttgcggcctggggaaaggggagggggcgcccgcccgcgcgcaaggcggccgtgggccgactggcaaaggccgaaaaagttcattttaggtccctcggggccgaatcaaaagaaaggaagtttaataaaagtccctcggccgaaggaagcattttcaatatgtttaatgattgtgtttatttctaagcaatttgaaccaacgtgaaaattgtttagagaatagataaatgtgagaaatgcttctgaacatgtattttgtatttttcatgcaaattacaatagaattttgaattgttttacatgtattatctctgtttaaatttgaaccaacgggagaattttacagagcgtaaacaacagagttttgttacaatttatatgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatcttaggtggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacgattgagccaaccatattgggctcaatcccagagtatgacactgtctctaagtacctcgaaagtataaagagccagtttagtggttcttcaaagttttatgcgacacagctgataaagcagcttgttacagagaggtaccatggaggtggtgtaaaagaccacattcttaggatgagcaatatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaagcaacagtttacagttgagacaagatcagtgtctacattgcaagaaaagacattccaagaaagatcatcctgacttcctgacagtgatcatggcaaagaaaggtgagaacattattacatttgtaaagaatctcattatgattggttattctagatccacatggtggattgattctggagcaactattcatgtgtgtaattgtttaaagggattccgttcaatgaggactatgcaaagaagtgaaagatccattagagttgccaatggagttgaagcaaaagttgaggctggagatcttcgcctagaactcgcgaatggcttcacacttttacttccagacgtttttatgttccttctttgcaaagaaacttgataataagtgtatccaaattggattttgatagatatgattgccattttggaaatggcaaatgtgaactatggtataataatgaatgtattggtcttgtgttgcaagatcagctttatttctttctgagaatgtgaatgttgtgtcctcgttgacaaaagaaaagaaagcgaacttctgatgtctcatcgaaattatggcactgttgtttatgccatatttcgagggggagaattgagagactggttaagaatgtagttcttcctccattggagttctctgttttagaacaatgcatacaatgcatagaatgcatcggtgcccaaaacaccgtatgagctatggatcctccgtgtgtgggggagtcctgcaaaggataaagtatttaacccaaaacagtaagctgccattttattggctattctaaaagatcaaagggtcatcgtttctactgtccaaacagttatacaaagtttgtagaaacgggacacgtcgtcttcttggaagacgaaatgattagggggagctcggtaattcgagaaattgatcttgaggagaggcgggtgtctgtacccgctccgtcgactcaggaacctttcttctctctacctgctaatgttgtgccagcaatgcatgccgttgcggtaccaacacctgttgttatctctcctgtggcaacaatgaatgaaagtgaggaacctgttctacaggattcaacagaaattattgccacatcagaggaggagatgaaacagcctcaaacagataatgtgccagaataggaggcccctagaaggcctgaaagagtcgcatatggaggatgatcccatctcatatgaagaggccatgagaagccatgaaagatgaaatgaaatcaatgaaattaaatgatgtctaggatttagaagaaattcctaaatgagccaaaacagtaggctgtaaatgggtctacaaaaccaaatatgactctagagggaatatagaaaagtttaaagtgcgactcgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccgaaaggttttgtcatgaaaggaaacgaaaatatgggatgccgtataaagagatccatttatgggttaaagcaaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgaaagacctcggtgaggcttcatatgttttgggcatagagattcaccgaaatagaacaaagtatgcattgggattttctcaaaaggcatatatatagaaaaggtgttgaagaaattcaatatgtacagatgcagtgctacacctgctcctatagtcaaaggcgaaaagtatggggcatcgcaatgtcccagaaatcagtatgagctcaataaaatgaaaacaaagccatatgcgtcagctgtaggaagcctacagtacgcgcaagtgtgcacacgacctgacttggcatttgttaccgggttatttggcagatttcaaagtaatccaggcccagtgcactggaaattggtaaagaaagtcttgcgtgtttgcaaggaacaaaaggcctcatgatgtcttacagaaaagcagaatcgctccagatagtggggtattcggattctgactttgcaaaagataatacaaagttaacatcgggatacatgtttaccctggcagcaggagctatttcatggaaaagctcaaaacagactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaatccacagtaatgtactctcacaacaattagtcaagtggtgctgccaaacacattgacataaagtactatgttgtgaaagacaaagtccgggatcaaacaatcagtctcgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatctgtttctgaatagagatgtgtatagtggctgtcgaatccatcggtaattaaccgtgacgatgaaacatgctctatatgtaaatctgtgatggaatagaaaaagctaaaggaaatagtgagatcaagggggagaatgttagatggatctccctccccttgagcccaacggctcaagggggccttgacccgcgccctgatcgggggcgcccagcccaatggctggtgggcccccgtcacactgtgccatataaagaggggtgg

SEQ ID NO: 74319 - DNA, 33407 bp, Oryza sativa
gctcattgagcggtgagtcttttgtttttgttgtggctttgtggaatgggagatcgccattccctgattcattgttgtcataatgtgcatgtacaactcacccatggaacctcgtaggtcgtttgcagcaaattttaaggcctgaattgcgtctttagtgacacgactagtttactagatatgcacgcctttcattcttctgatgcttagtgggtaacatagatacgatgtaacgttttgttttataaaggccatggatccattgcacttacggtttctctgatgtaacatatctcagatgctttatcaacattgcatacataatttataatatgtagttagtgcataaaactaaaagatgccttacagattgtgtataacattcaggaacttaagttttttttcttgcagctgtaagaacgttattattgtcaatgaattgtgcagaatattgtcaaatgatatacgatagcattttcatgtattatgctctaagtgcttgcattttgtttttgtctatatgttgcctatactgtggtcactactgctacagatttcacattgaaaatgattttatctgttgaaatcaggatgttgcaaacaggaactcaaccagatgacgaatcctacaatttggttgtaaatcttctgattaaactgaaccgggtggactctactttgaaatatttggatttgatgcttaaatcaggctacacaatatcttcctctgtttttgttgagtatgtccgggcatgtgtaagatctggtagattggatacattggcatcagtcatagagaagtgcaaggtacttattattcttttagactgacaagtctgtttactgtttatatactgttagttaggactcctaatttccaatgctggaaattctcaattgttataagtttgtgggctaccaatgggccttcaacattcttcattttcgaatatatgtttcaatcttctcggtgtatgtactaacggtgcacttattttgtttcaggctacagatcagaacaaagtcttgtgtccaccatggtcctggtgtgttgaaatagcagaagctgcttttgaagctaacaacagcaagctgggtctttttgctttggaatatcttgcaagatggattgctcgttctgagcgtgttattcctcctcttcatctttcagttgatgaaggtttagtactctcagctctaagtgctgctgccagaacttgtagcactgatctcctgaatgctgcttggtcaatattacgtaagtccttgcaccagaaaagggcaccgacgccagaggcatatcttgccaagatttatgctcattcatccattggtcatcttcagcgggcttttggtaccctacgtgaatttgaaaatacctatgggaactttgaggatattgattcagagctcttctcaccgttcacttcattgcgaccactcgttgttgcttgctgtaaggatgggtacaccacactggactcggtatgttctctttacgctatgcataatacatcaaggcgcaaaattcttatttggagatcatgtttaaaatcatccatgatgagctaatgatgaaaactctgtatgtgtagttccattggtgttatgaatttatacattatgccttctgtggcactgaattattctttcttgacgtttacctagttattcacttatttctcttttcaacataaaattggtgctttctttcttcactgttgatgttttatttagttatcatttccaccagagtatttgaggcacatttttttctctcaatgacaataattcctcatggctatggtagccttttgtattttggttcctctctgcaagcataccatgtatttcttcaacattcttatttctttgtggcccagtttcatattgacagttcaaagaattattgacacagtcctttttcagtgctattaggaattcgtcatagcattgtccccgccaatttgtcttgacattatgggaggaatgttttattgcctgttatgcatttctttcaccaaatatgatggaatatcctaacactgtaggctcctgcctgcaggtctatgtgcaattggagaatttaagttctgcagattcgccatacaaatctgttgctgctcttaactgtgttatattggggtgtgcaaacatttgggatcttgagcgagcatatgaaacttttgaggcaataaaagaaaagtttggacttacacctgacatacattcttacaatgcgcttttgcatgcatttggaaagcggaaaaaggtattattattacctaatggatttgatactttcacaacatttatcacctttttgccacttaccaacaatccattcaacctatgatgcccatgtgtattatacagactgaagaagcttgcaacgtctttcagcatctagtaagccttggtgttaagccaaatgcaacaacttatggccttcttgttgacactcatcttgtaaatcgggacgcaaaagctgctcttgctgtaattgctgagatggtatggtcaatttacttttgcacatttcctgtctatctatagtttctcaatgtgatgtctggttcaggttgatgcgggctttactccttcaaaggagacacttaagaaggtccgaagacgctgctcccgtgaatcagattttgatagtgacgagaaagtgcaatccctggctaagcagtttaactaccgaatgggtggtgaaaaccgcagggagatgctctttaacattgaatacagcgctgagttcacaagtactcctagtccaaggtactgggctaaccttttctgaatccaacattttctttatttttcatcgcataccagcaatggctctttttttttttttttgctttatctaatgcatttgctgactgatttgcttgatggttttgttttgcaagttgattttgatgatgccggtgcgctctagtagacgtaacgtgtaccctcgctcactttgctggtacctgaagggcacggaagctgtagtctgtaaattatacttctttgtaccaacttccctaattatttcaagcatctcaagctatcatttttgttggcagaaccctcaacaggatttatgttaggatttcagaataagggtcctaatagatttttttttttgcctgctcaaagcaccatgttttacaatcaatggatgtttgctcaacttatctctcagttccagccttttttacggctctcgtgttatttattcctatactgcatgccatgtcaattatgtatactcttgatgtttgtttttttggaattgctatagttacttcaaacgaattagtactagcacattgcattggagagcaatattgtttactgaaggtaataatagaccgctcatcgtgtaaatgcatcatgatttactgaagataatattgtttacttaaaaagaaggctccgtgcaaaataacgtgcaaaataagagacgcagttcgtaagttgtagatcatgattggcttgtgcaatgctccattaatttccttgagaacgttgttcagcttagtttcattaaatccaatatgaaacccaaataataccatacaacccaaattcataatttgaactcataagaaatccgcattgtagtaccttgccgctatgctatacatcacacaagacgtcatgcagcttctgaccatcgacaatagcaccagatcgaatagagtacaggagagactcaagcagcagacgatagcattacggacacaagaagccaagcaggagacgatagcattgcggacactagacacaagaagctttacccggttaccccgcctgggcatcagtcttcgtcgaaagatgaagatagtaggtttcccatgtgatctaaaggaggatccgtccttgacctcatcggcacccactgtttctcctcgaaagtgacgatgggtttgttgatgttcttctcggcatcagccctcagagaggtagctatctcttccacattcacgatattgctgtgacaagcacgaatcgagacttccttcagactcggaaggaactctatgccagtgatctcttggatggaggcttcttcgaacagagacagctctagccttgctagctttggtagtgccccttcttcaaatcttgcctcccaatcttcagacatgtcgagatgaatgacaagcagtctaagagatgggaattcccctgctgaagcagaaaattctgttcctatgtatgcattgtgatgcaacctgaggtatagcaggctaggtaaacttcctagtaccttcaggtcttcctcggcgcttagttcggttgcgcgaagggttaattctgtgatgttggaaagcaaaggaaaccaacatggtagttgtgttaactgacctcgaaggttcatacttttcgtaaatattggtggactggataatgaattgacaatgttgaagttcatcgcgccatcaggtcgccaaagtaataacgagcgaaggctgccgctgagcttctcaagagcagagatcaaggatgcccaggtgctgtcgtcatcaacaaacatcagtactccaagtttcctcaaccgggatagcttcgacaactcgctgatataatgtgatgtagaggtcgtgatttctacctgtgcaagtgttgtaagtgaatccatttttcgaagttcgttagggatatgtaaaccccagaactcagaaataggccaccgcccagtgtggttataggatcttcttcctccaagtaagtttgctaaatgtggaagattggttatgccaggaggcaaatgctttatggctgtgtcccttatatccagagtctccaacttcttcaggtttcctatttgtgcagggagttccgtaatatgtgttcttctcagattaaggtattccaattgaaacagcctgcacaagtctttgagatctctatttctcaggaattcgtagccttctaagtccaatattctcattaatttcatccaaccaaactgcaatgtttctccatcggcaaatatgctcaaggaccggacatggcataatatttctcttgtggcaatatatttcacacctctgctatgaacagttagccgccttatcttctcttgcggaaacaaagtgttctgttctcctactagagtgataaaattatcttcaattgactttgacacaatgatctccaacatcacatcatgaactcggaatgttttaaccttccctgtaaagctagtggtcactggctgaataatgctccggttaatgaattcatcaaagtagctttctgccacctcaaaaacactcagtccacgtttgccagtcacaaagcgttctgctacccatcgcctgagtatagttttccttctgatattatggtcctcagggtaaatgcttaaatataagaagcaagtcttcaagtggtaaggaagatcattatagctaagctcaagtattttcttcaatctatcaagtgatggattggtttcaatctctgaaccaagagagctataaatcttctcccaaagatctttactgtgcacaggcttgctagccaagaggcctgctatactgactatggataaaggtgtgccaccacattttcccagaatcttagctgaaatatcttctaagtgctcaggacaaattgagctgccaaatattcttttgaagaataagtctctggattcacaatcagtgagaggtttgatttcgtaagctcggtcgtactcatggaaacaacaggtgtgtgctacagctctgattcgtgtagtaaccactattctgctaccattatttgagtccggcaaagaaaaccgaataccttcccatgcagtcatgctccagatatcatcaagaacaatcagatatctcttattttccaattgctgcctgaggatgctcgcaagttgtaccacattccatgcttccatgcccttgagtaggccttccatgggacctttgccagctccagttgatggagaactcggttgattaactggttgagtgatttggagaagaatatctctcatcagaaccttgacatcaaaactctgggacacagttacaaaagcttgacattgaaaaggtccatttcttccagatagactttgatatgttgtcatagcaagtgttgtcttgcccaaaccaccaaaaccaaatatagacaccacccgtaattgttgcacatgtgcctccaataaccagtgcacaagatttccctgacgtggttcaatgccaacaagctgccttctctctggaaagagtgcagtaatgcgagtatcaacatttaaaagattagcttggctatcatatgcagccatgctattcccagcagttccagagatgagatgattggcactatacctgcatgcaagaacaactaagtaagtttgctgggtgatgaaatcgtactacagaagtagaaaagagattaaaaaaaactgtatatgctcagaaactgtactttatagtaatactacggagaaattgctaaaagaagaggtttctttttgatgacatgggtcattcatgggcaaattgcacaaccgtggcaacaaccaaacctctaagactaaaatacaactgcagattggtgcataaagcttgctcatacatgcaaaaggactggaggcgtagattaaatgccctagtgatttacagttgttgccttgttggaacacttggaaggagtggaacaggcaaacttttcaagaccagagccttcagtcacaggacatcgtctataagagcttttctagctagtttgtacgttttttgcttttgtgttgctcctccttaaagttatattttatcctcctctaatgcaataggcagagcacctgccttttcattcaagaaaaagaagacgacatgggtcatttcaagagtagatacttgaacccatgatctccaccttcacaaccatgtgctctactaggctatatgggtctccccaaacgtttttggcttatcggtgcaacatatttttcaacatataatttgtggaaagaattcaagttcataagcaaatctatttacagaagggacaactatagataaacaagagaaactttgctgccttttgtaccagattgttggtgtcctgctagcacctaaagctatcaaaaagcaaaacggcaatagtccagaatttgaaccatcattcgggaaaaagggacagaaatagcacagaagttaccttgaatttcgggcactgatattcatagtacgcctttttagttcttggatttgtttggcaatctgatgcctcactctggtggtctgcaatatgtgggtggccttgcggaaaaacactacagggccgctgccaccggcactactgctgtcaccaagttgatgtttgaactcatcaatacaatcctcgatatcatatgcaatctcacgcacatgcttcttccaaatcttaacttgcttgccgcattcatctctcccagaaaggtcctgaagaaaggctgtcatgctctccagttcatccttcaagtgttgcagttcaccccgaatacctcccagaagctgggcttcttggaggacgattgtgccgagctttcccaagagagtgtggatcgcaccttccgcggcactaacaacagcatgttccatctatctaggatagaagatgaacaaagaaccagaaacaagctctaccgcacttctgacctcaaatgaaagctgggagagaaaatacaagcttagagtcagcaaaatgggattcaccttttgaatcctttccacagtccaaagtcaataaaactgtagcctacgtcacttgagtagaaaatggagactgtttccagctttcttttgaaaaggagattgtttatagcctactcaaagataacctgatcagttgacttttgagttttatattgttcaggatggaagctttcttgacgaagttaacttagtttacttatgagtgtattattttactgttttcacttttcaatataatttgcacacaaattattattgggagacagtgctgtagtcatgtttgaccaaaaacctcagagtagtgctaatgaatcaagctcaaacttgcaaatctaaaatcttcaagcaacatagcatgaatacatctaaaggaaccctcagattatcataccatgcatgacactgcacaatggtaatctatccagcttcttgaatcattatcaaaagttcaaaaacgaaggcaagaatggactatttgctatacttcactaaaaaagaactattccctccgtttcatattataagacgtttaacttttttgttagtcaaaattctttaggtttgaccaagtttataaaaaaaatagcaacatccacaacaccaaactaatttcactaaatttaacattgaatatattttgttacaatgtttgctttgtattgaaaatattactatattttgctataaactcggtcaaacttgaaaatgtttgactaagaaaaaagtcaaacgacttataatatgaaatggagggagtatctgctattcctcccacaaagtcctcactatatgagcaggtcatctatacaattaccttgtggtaaaaaaaagaccaagctcctgagatgattatgatcaagtattatcttaaacctctgttagaagtccattcatcgctcttctcctcctatcccttgtggccatcctctcaccataagtcagaaagatgtccccaagatcaacatgccccacatccttcaacctccttccaacttcctcaaacatcgacaccccatcctcatttgaaaagtagtacaagaacttgttatagtcgaaccttggcacatccactccaccccacatagtcctctccacaaacttagttgcctccaatgtcctcccggccttcaccaacccaccaacaaagatgctctcaaagttcaccaatggatccctccccttccttcccctcttccccaagtgcccctgaagcagcataatgtatgtgtgcatgttcggctcgcaccccgtggcaaccatctctctgaaaacctccgtcgcttctcgagctcgcttgatcctgatcaatcccttcatcaacccatggtacagtgcaatgtccttctccttaacaccatgaaaaaccctgtatccttccctcaccctcctcctcaccagcagcccatacaccaaatcccccatcacctctccgtccacctccacacctctcttgaacatttcggcgaacaccatgtacgcgccccacatcctcccttccttgcacagccacgacaccactgcccggtagcacccgcctctgccaccgtctgaaactcccctcctccgcattccgtcgaacaccttcatggcgtccgcgacgcggttattcttgaacagcgtcaccacgatctcctcgtacgcggcggcgcccgggtcgagcccgcgcctctccatcccgttccacaccctgcacgcgtcagagagcatccccgcgcggcagtatccgacgaccagaagctcgcagcacctcccggtccgcgacacgccgtaccggtgctcggcctgcttgatcaccttctcggcgacgtcgggcagcttgcagacggagcaaacgacgtcggtgatgaagttgagcgtgcggggcctgtcggcgtccgggaagagggcgagcagggaggagaccttgccgacctcgcgggccggggcgaggccacggatggcggcgcggagggcggcaagggagcggagcgcaggcgggaaggagagcagggtggagtggagcaggtcgacgttgcgggacttggcgaggacgtcgaggaagcgcgcggcggtggccggggagtgcgcgaagccgtgggcggcggtgaggtggtcgaggaggcggcgcacggggcgccaggagagcgggaaccgcgcggaggcctggaggaagagctcgcggaggtcgtcggccgcggcggaggggagcggcagcgcggagaggcgccgccgcagcgcgtcctccggggcgtgctggtgctggtagagcaccgtgcagaggcggagcagcagcgacgggtcggtggggcgccccggcgcgggggcgggggcgggagcggcggcagcttccgcggcggtggagaggaggaggcggcggcggcggcgggagagtgggaggaggaggaggaagcggggcagcggcggcaacggcatggatcaatggaggtggccgccgtcacgccgattcgcggtggcgaggtggatggcgcgacaagattgagaaggggaagcaggccgcaacagaagcgtagggaatttgggctttgtgggccgtgaggtcgtcttgatcttcgcggtgtatgagaaataagatcactttgactccctcaactgaccaccgaatctaaatcgtatctctcaaccgcaataccagaaatcttgactccccaaatttacaaaaccggtgcaattcgactccctgggcggttttaggaggcggttttgctgacgtggcgccacgtggcgcctacgtggcaatattgaccgagtcttcgttccacgtggcgatgacgtggcacctacatggcggtagaattaaaaaatatgcgtgcgacccattagtcattcacaccaaaaaagtgggcccactgacatgtggggcccacatgtcagtccttcttcctcctccctctctcccttctctctctccccttcttcccttcgaccagtggcgcctctctctttctctcaccctcttcccttcgggcggcgacgggtggtggaagcgagcggcaggcggcgagagcgagcgacggcggcacgcaagtgaggcccggagcggcgacggcaggatgggcgagcgagcggcggcgggaggaggctgagcgggagctctggccgcgttctcaccctgcttcacgatggcgttgaaggcaacgctgcccttggcgtcgacggtgagcgcgaggatctccgggaaggccccaccgtcgccgaagtcctccagccgccgcggcacgaacccgccacgcttcccgtacagtggcacgggcttggcagggcccgaaggcttcggccagcagcagccgacgctggtgcagtggcgacggcggggcggacgatgctggggcagtggcggttggcggtggccgacgcgggagaagccgagacgatggctcctcctaccgcgagcgcgaggcgggtgggagggcggccggtggcggtcgatgttaggggcggcggtggccggcgatggccgacgcgggagaaggggacacgacggctcctcctaccgcgggtgcgaggtgggagaatgagggagggcggccggcggcgatggccgatgctagggtggcgatggcggccgacgctggggcggcggcggctccggcttcgatttcctccgctctctcctccgccgcatccttccatcctccccacccgcctccctccatccctccgtctgcctcctcacctccgtccgccttcccgcgcgggagagaaagagagagaagggagagagagaggaggaagaaggaaggaggactgacatgtgggccccacatgtcagtgggcccacatttctttttgtgtgaatgactaatgggtcccacgcatattttttagttctaccgccacgtaggtgccacgtcatcgccacgtggaacgaagactcggtcaatattgccacgtaggcgccatgtggcaccacgtcagcaaaaccgcctcccaaaaccgcccagggagtcaaattgcaccggttttgtaagtttggggagtcaagatttctggtattgcggttgagggatacgatttagattcggtggtcaattgagggagtcaaggtgatcttattccggtgtatgacgacgtcgtggtttgggaaaaagtctactttacatccctcatcgttctaaactgcaaaaaattacagatttttccccggtttccgttaacatgcttttcaaactattaaacggtatgttatgtgtgaaaactttctacatagaagttgctataaaaaatcaaataaatccatttttcaagtttttaataattaaaactcaaataatcatatgctaatgacttgtcttattttacgtgcgcacttaatcttcatccttccatcatattcgaacggggctagctccctgaaccgcaatatcagaaatcttgatctcctaacttgtaaaactaggttaaattaagtcttatggtactatatatatatatatatggctagtttttgttgacgtggagagttgattgtagtcaacatagctgagtaggcttgagcccccacatgtaaggctcctatcttcttcctctaacatctttctcgcccctcttctccatctctaatttctccacatctcccttctctttctcctggcataggccgtaaaaggatttgaaatttgttttctcttatcccatttgtcatttgccagtaacctttcacttcttctgattatatatattgacgtttgaaattagattcagttaaatatttatttaaaaataataataaacatatattactccataaatatgcaagcataattatgacaaattgcataattgcataataaaaaacaaaaatcaaacatggctgtgatcacacatatgctattttgttacaatttatggagatcgaatttgtgtatgaagttatatatctcatatcaatatatcttattatttttaaaaaatatatatatatattaatagttatttaataacatgtaagaacaacgggatatcccctcgaattattagaatccatgtccgccgtatacataagacaaatatcatattcgccaacacacctttctttgtgggacaaacaattaagctatgatagatgtttagggaagtacttagatgcaaactatactcatccaaataaacatacataagtaggtccggtacaccgatctatcaaagaaacaaagcagtacaatatacaccaccatacgtacatatatatccatatatacaacgcgctaaacaaatgctgaaacatcatactccctccgtcccataatccggttctaggttggtttttcatgggacggagggagtactcctctagcggaaactaatactacaaatcatcaatgagaaagatactgtatatagcaagcacatcatggatcatgccatcatcgatacatatgtatatataccagtctatagaactgtacacacatatatacgtacgtagaatcataacgtatttatcttatagatatataacgtatttggcaatgcgatgagtataaaaaaaatatagattggctaggtggagtgtgctctgcaagccaaagaaatgtggggggctaggaatccaggacttagagactcaaaataagtgtatgcttagtaaatggatctttaagttaattaatgaatagggagtgtggcagaatttgttgaggaaaaaatacttggtaaggaaatccatttttcaggtccaaaaacaaccgggggattctcatttttgggctagccttatggcagcaaaagaacccttccagacacttggccacttcacagtgaataatgggaaacaagtaagattctgggaggaccgatggttgggaaaccaaccccttcatttggaatttccaaccttgtatagcttggttagaaataaaaacttagtagtggccgatgtgttaggaagggtccctttgaatgtctcttttagaagagcaattgtagggaaaaacttggaagattggcttgaaattgtttcaaaggtggtgagtatcaatttgaatgataagcaagaccaattcttttgcaagagcaataaaaaaaagggttgttttatgttaactccatgtataaaacccttatgcttaatggtgtaatacctgggaaatctttaatttggaagctaaggattcctttaaaaattaaaattttcctttggtatattgaaaagggggtgattctaacaaaagataatcttgctaaaagaagatggaagggtagcttgctttgtagcttttgtaactctaatgagtcaattcaacctctcttctttgattgcataatggctagatacatttggaatgcgatctatcttacttttggagtcaagcaaccccgtaatagttcacacttgtttgaaaattggttaagaggttttgaacctaagcttaaaagacaaacttgggtgggtatagcagcgatttgttgggctttgtggctcaatataaatgaattatagtctttaatggctacaaccacgtatttttcttacaggtaattttcaaagtaactcagttgtcaaggctttggtctttgcttcttaaggaagacgaaggcattgaagtaatcgcgaagtgcaagcttttagagaagtgtatgatggagctgatcttctctacttttgggtggaactttagaagaatgatggaagcttagcttttagttcctcttgcttgttatccatctttaaaacttatttatgttttacccatgtaacgggagagtcttatagtcttgtgtactcgtgtttgttacttttaggctgtgtacatcctcacaaggtgtagaggccaggttttttataatccattgtctaaaaaaaaaatactgtgtgtgtatgtacgatcatggctgcttggtctccggctccgggtcgtgaacctcgtgctccggcggcagctccgccgtgggcaatggcggcagctcaggcttcggtggcagcccgtgctttgggaaccccggcacggccgggtagtgcggcagctccggcacgacggggtgcggcagcatctccggcacgacggggtgcggcggcagctcaggcttgggcaacggtggcagctccggcacggcggggtgcggcggcagctccggcacgacggggcgaggaagctcagggagcggcggcggcagctcgggctttggaagctccggcagctcggggtgcggcggcagctcgggcacggcggggaagtgcggcgccttctcctcgaggtgcctcgccgtgctgcccatggcgccgcacgagagcagcagcgccgccatgagcaacagagccgacgacgacgacgacgacgacgacatggcgttcctgctaagcttctgatgatctgatctagctaagctaagctagttcttcttcctcgcagccagggatcgatgactagaacacaagggaaacctggtacttatagcatgaacagtgaagtgcagatgatatcatatcatatctaaccaggggtccgttgccattttcaaccttaccgaattttggtaaagttacccaaaaaaaatggctacatttagtttgctgtcaaattttggtaactatataagaaatcctaccaaaattttagcaagtcgccaaaattttggtaactacaccaaaattttgataataccaaaattaggtaaggttgaaaatggcatcaaagtgaacatgccccagatcttgatgcgtacgtgttgtttggtacatggcaggtgaactgctgctgcatcacacatctctgatccttctggtttcctgaatgcgtgttcgaactctcctgatctctatctgttccttcgtgttatggttcagttagttgggaattccgaggattgttcagagagagatcagtgatcacctaatcgctagctgcctagctgcgtatatgcaccggcaaacaggtgtgcaaacagcagagtcattgcgggcaacacgtgtttcaccgcgagatgtttatgaattatgctgctgtttggccacctgaaaatgcctgaactctgaaccatcccggtccatggtgacgaactgcttgacttgctggttacaaatctagttgaaaacgaccattgttgtacaatccgtacacggcaacttgcttaatgttgcaggttgccgtgttgatataggccgattttcaaacggcttacgttagaagacctatagaatatacacggcactgtgagtacatgactaacgtgggtattcagttgacaatcaggtgcagtgcaggtaagcagcagctatgtgcagagtaggtagcacatcttaatttcttaattaattaatttttctccatattttagataaatataggttcctcgatgtacttgctcaataactataaatgttttgataaaattagaacaaatttgccttgtttgttatgccttaataaatgatgattgctaggggacggcattccgcccattcgacatgatactttacgaaggtgatgtcatccgcacctccgctttatcctcgcaagtctacgactccgtcccaccccacgccacgtgctcatggctcacaccttgagcagaaccattggtcgacggaggagcatggtgaggcgaatgcatcggcgccaatgcctaggatgctaggaggtgtcgacacacatggcaacgctagccacagcaacactagggaaggaaagaccagagccaaggagaggcgttgaatggagaaaagacattagtgggaaacggttcgccagccagccaagcagcgatggcgagtgtcctactgatcaggcaccaatggttataagatggtatcggtgcccgaggtaccatgcctgatatctgtgcataccagccatgataccacgagtatcagacttggcacctatcggtatcaagcgagaattacacgctgcacagtgtacctacacacaatattgacgagcagcacgatggattggcaaacagcacaagctgccaatcgaagctctagatctagcaccttcgtcagcctttccctccatcaccatcggtaccagccttgaaggaagactcacaccagacaccgtcctccctgatggcttgtatggagaaggaggccatgaagccagcgtcgtccatcgcctcatcgccaacatgcactcagaatggatctagcaatgagaatggcctaggcctccagatctagtgacagaaagaggaaatggtggtcggcgagaggggggagcagcgatgtgctatttttgccagcacgagcaaggaggaagagaagagggcagagggaggatgtgaggaggagggtggcggcggacgtatgggtgtgtggctcacaaagatcaacgagtggatgggaagcacttagggtggatggagagcattaattaagtatctcgtccctaactccctagatgggataccatatcgtagtttttctgttaataaatagatgcactaggagcactaccattttttcaggaagaataataggcatcttgttatcctgattcactctgattctggtatatatatttacaaaattcaatagactaggatatattattcataaaatccgacggatgtagattatttgactttttatgtggattatctgatagatttgcctttttgatataggatatggtattgataaaattcgacggatgtagattatacgacgttttatgagtattattgcttcgggataatccaacaaaggctgattctatcatgtagggagccaaatagtttgatgcacatcgtctcttgctctttttcaaatggaaaagcttgttagagcataatccaacttatcaactatgggccaccgagatcacattaggcctgcgctccaatagaagtcacaactttatgttttggacctacacaatccaaaaagactaaactggtaggtgtgaatctttctcaccttttaagttatgtttctccaccatcaattttcgatgtaggactaaatctaacagttgtcccatacggggctagtagtacctaggctagacggtcagtgtggcataatctattcttgcacacaaagacctgctgtaactggcattcttaataatttttttaagactagaaaacaagtatatattgtaaagcacataataatgcataccacaaataagcaatattataggaagatagctattttattgatttatgaagcatgtatgatacaagtgtagatcgtgtgtgcacacacataaatcagcacatacgataacacaataactcatccaagaacaaagaaagctgccacaaaacaaaacacaacaacaacgtacatcatctcacacactcacacagctagctagatcatcactgaaaatatcttaggcaaacatcgatcaaagcttacacatgaacatacacacatacagcaacacgtagtaatttcaggatacgatacgaccggccgatcgatcgatctctggatcgatcatggcttctcgggataatggctctcaggcttgggcggctgttcatgctctggcacggtgggatgcggcacctcgggcttcggcaactccggcaccacagggtgtggcacctcaggctttggcaactccggcacgacggggtgtggtggctcttcgtgtttcggcaactccggcacagcagggtgaggcacctcgggcttcggcagctccggcacgacggggtgcggtggctcttcgtgtttcggcaactccggcacgacggggtgtggtggctcttcgtgtttcggcaactccggcacggcagggtgaggcacctcgggctttggcagctccggcacgacggggtgcggtggctcttcgtgcttgggcagctccggcacggcggggtgcggcggcggcagttcaggcttcggaagctccggcacggcggggtgtgggtgtggcggtggttcttcgtgctttggcagctccggcacgacggggtgcggcggcagctcaggcttgggaagctccggcacggcggggtgcgccgccgggtactccacctccaggcgtcgtgcagcgttgcccatggtgctgcacgagagcagcagcgccacgaggaagagaagaaccgaggaagacatggtgttctcaagctctcagtggcttctatctctatatcttttagtgtgagctagctaagcactctgtgatggctgggagaaaggcaagcaagccagatatttatactgctaaactgcaccttacttaagcagttaagctactaatgcatgattatatttgattacagtgagcctgctgattaattactggtaggtacgtaggtgatctgcacccctttttggttgtttgacttgtttcgatttagtcagtcagtgactcagtgtgtgatctccccttatctttgattgtgtatgcatggtttgattaattagttgggaaaaattgagacccaagaaatttggttggtgaatgctatagaaacctagaacggacggtgtccttgtgggtacttgtgtggccacatgatatgagggtagtgggaagtaagtgaatcgtgcatgacaaggacagagtactacatgcatataattcctacgtcgcaaagtaaaccaaactcgtacgagataagatagatgaagtatatattatctttccaaaaaaaataaaaaagagagtagcatatatattagctatacatcgtacagccaatgctgacaaattaatgcttagcttttccagttgtaagaaaagatatgaatatactgcttttaaaccgctactacatatggcatacatgtgagaacaatttagatttaaatttgaaaactaaaacataaactttaaattgtatgtgtataagtattaatgtgttctatatgttgagtcgatgaaaaattatgcgttattagtcatgcatgccaatattgaaatctaaatttaatattaaacccggtaaagtttagtcaaatctatgttaaatatcaaacatttatgattgtagggagtatatgtttcgttgggcctgcttgattactcaaagttttatttttgatccttaattgacaaagtacgggagatgtgctgcattttctaccgttaacttaaaagcacggtatatatttagatatcttctcagggaaggtaaaaaaaaaccattcttactcgtaattaattaagtcgttgaagaattcagtttcacacatctcttgttcatattcaaattcctatatatggtaaagtagaagttgttggcccacagtgttatagtaactgaaaaaaatgtcctatgcacataagctttgcgcataggtataacactaatgaaagtatatacacattatttttctagaattttttatgatatttgttagttagtgtgcatagtgagtgcataatatgcataattcattcttacacacaaagacctattgttactgtgcattttcaatcatttttttaagaaactaaaaacaactatttttcctgaagcatattatgcagtctgcaaataaattgtaggcaaataactatttactgatttatataatactagaaacataattcaaacataaattaatgaagcatatatggtacatgggtagatgatgtgtgcatagatataagcgtagcacacgcaagtacatcctccaagaacaagaacaactggatggctgaaacatcaagcatcactcacacattcctagcaaacaccacagtttacatgatcatatcatacacacatatacaaataaacccatgattattcaggatgcgatatgatgggcccgatcaataatctctgcatcgccatccgatcatggcttggccatcggcacctcggggtaatggctctcaggcttcggcggctgttcatgctccggcacctcggggtggtgcggctcttcaggcttcggcagctccggcacgacggggtgcggcggctcctcgtgcttgggcagctccggcacgacagggtgcggcggctcttcgtgcttaggcagctccggcacggcggggtgtggcggcagctcaggtttgggcaactccggcacggcggcgtgtggcacctccggctttggcagctccggcacgacggggtgtggcggctcctcgtgcttgggaagctccggcacggctgggtgcggtatctccggcacagctgggtgtggcagctccggcacggcagggtgtggtggctcctcgtgcttgggaaactccggcacgacggcagggtgcggcggctcttcgtgcttgggcaactccggcacgacggcggggtgtggtggctcttcgtgctttggcaactccggcacgacggggtgtggcggcagctcaggtttgggaagctccggtacgacggggtgaggcggctcttcgtgcttgggcaactccggcacgacggggtgcggcggctcctcatgcttgggcagctccggcacggcggggtgcggcggcacctccggcttgggtaactccggcacggtggggtgcggcgggtactcctcctcgagccaccgtgccgcgctgctcatggagctggacgagagcagcagcagcgcggcgaggaagagaaccgaggaagacatggcgttcttcttaaagaccatgctggcttagctagctatgctacctcactgtgtgagctagtgtgctttgatggtttggagaaggcaggcaagcctggtatttatagtgctaaactgaacattaatcaagatcaataaattaattaatgcatgattaattacaggagctagcctgctgatgtgttgattaattacttgtaggtaggtgaactgcactccattggttgttcgacctgtttcgatgtgtgagtgtgatctcccctgagccctgatctatctctgttggcatgccatctttgtttgtgtgtttatgcatggtttagtaagttgggaaaaaatgagacgcaagtgagattggttggtgaatgcagtatctagaattgtgtccttgcgtggccacatgatattgcagagtaagtgaagccgtgcatgacaaagactaaccaagcactatattatcttccaaaaaaatttgacaaagttctttttaagacaacaaatagtagtatatatattagctgtacgttgcaggtaatgctggcgaaatgcttagctttgccgtttgtaagcagagatatgaatatcggcggtaattaaccggccggttaccgctgatcatgagccggtaccggctgacatctgacataacaaggcagaacaatctagatttaaatcgggagaatagctaatatggtctctaaagttttgctcctgggttattttagtccttaatcttttatattgtccaaacaaatcctttaaatttgtcatgtgggctaatatagtccttggtcccaccaaaatcgccacatggatatgccatgtcaccttcctatgcaagatctatatgatttgtctaatttacccttacgcataggaaaataaaaaacaaaaggaaaaagttaaaaaaatatatggtatgtgtaagagtaaaaatatacctcaaaagggtgaaaaaagaagtattttttttctatggttatgtctaattcatccttatatttatttttctatgatatacgtaagggtaaattggacaattcattatagattttgcatgaatgatgacatggcatatccatatgatgattttggtggacccaatgactattctatgctttatgacaaaggttaaggatttctttggaccatttaaaaggttagggattaaactgatcctacagagaaactttattttttttgaacggaaaaagggcacaagattgtgccttttcattgaatatagaaggagaaaatacaacccctaagggtaaagcaaaaaagactttaagctataaactatacaatgcgtgggacgaattcgcgcaacctttttgcccctgctaaggcccacaggccagcctcctcttttatttttgctaggagaaggcctaccgccatctctttgtgatcgaaaatccgccgatttctctccttccagatttcccggactactagtaggatgagggaccgaaggcccttttttgggatgttgggagtatttgctaggctttcccaccattggcggactgaccgggcttcctcccactgggacggctccaattgatgatatcccacccatccggcaacgtggtgccagattctctttgtgtatctgcatgtggcgacaagatgcaatcccgtcttagcttcgcaacgacagagggggcaatggccgttgttctgccaacctcttattgcaagtcggtcggacgtccagactctattctggatgatgagccatgcatggaatttgcatttccccggggcccatgctttccaaatcaaagagttgaggtttgtacttggcgcccccaagcactgtgcatgataggccgaagaggctgtataatggccattgcatgtgaatttccatacaatctgatccggctcttcactaacttactgcacatttcggaccgctttcctacagagaaactttagggactaaagtagctattctcccatttaaatcttaaatttgaaactccactttgaaattgtatatgtgtaagtacattaacgtgttttatatgctgctggatctatggataaaaaaatatgcggtagtcattccaatgtttaaaaccaaaatttttaagcgattatgtgttctgcccttttcaagtcggtgaggccattctcttaagcaacttactttgttcttacttcaacaccaaactttataatacaatgacaggcagagatttttgtgttcgtggagaatggacaacgttagattcgcagcgtggtagttgttgagtagttgggttatttgctctgattttcatcacttttttagaaaaaatcttttaagcggaaatattgcatgacctttttaagtattttcaactggagggtatacccaatactgtaaatcttttatactaggtttgttttgctcgagaaatgtatagggatcttccggctagcttcatagggtggtgggctagacgacctcctaattatttaatattaaattattccctaatattcgcgtcttttaggtttgttttgctcttgaaactggtaacttttagttttgaggaaaaatacattttttttttgtttcggagattgtgttcatatgattggacttcaaagccggtagtcaattcttacgtttgctagaagtcagacaagagccaacaaagagagcaacaaagagagcaactaaacggcaactaactatcaaattaacatccgtgtaataaacggctatatatgcaccaaaggagaaacatagacttctagaaattaatccaaacaccagataatgaaagtaagatcttaccatttcagtcatgaaaatgtgccattttgaatatctggttcggtctttatgtacagatttaaccgttaatttctatttcaaaatatttttaaaaaatctcataaactcataattgtatgaattttttttattttcatacatcaacctaagagttgtttttttatctaatcaaacaaactcatagtttgaagtgtgagaacaaaaaaaaaatactttggtgaacagtggtgttttttttttgacaccttggtgaacagtggtgttgggctaggctcacgggagaggagatacgtcagaaaactgaaaaacggggttcttttgtggccagaaaaatatattttattgacgtgaaacatgcatgatacctcctctgttcctaagtatttgtcacgatatatttattatcaccgttaaaactttaactagtactacctccgtttcaagttataagacgttttcactttgatcaaagtcaaactgctttaaatttgactaagtttgtagaaaaaaataatgatattatcaacccaagacaaatttattatgaaaatatattgaattattgatttaataaaactaatttgatattataaatattattatatgtctataaacttagtcaaatttaaattagtcaatgaccaaagtcaaaacgttttataatctgaaatggagggagtaatatttttaaatagacaggctattattaacgaaagagtaatgtttattactccctccgttccaaaatataggtatttttggaccctgacacaggctccgagatactactttgaccaacaatatctataaaaataagatgttttaaataaaaattaagagttgtatattataatagtttgtttattaataaatatagtaacatcaattttacatgattgatcttttttttaattattattggttaaagttaaaaatgtttgacttgtcactatgctaaaatgtttatattttgatacggactgagtagtatataacttatattttcataatgtatcatccttttacgtatttgtcgttttttttaaaaagaagatacgaatggtcaaagttgaaatatgaataataactgatgacaagtacttgggaacggataggaagtacacaacatcagccatcagccagctgaatctctgaatacaacaacgagagtacgaaactctgaaacatcacgatcctactatatcacatcacaccagccggggctcaccacgaacaagatcacacgcaaaacgtcctacacttcgcacacccacgcgaatttgattcagatcactgactgccacacgcctgcacggggtgtaatctgatcgtcatttttcatggcttggcctccggctccgggaagtggaactcgggcttcggcggcaactcgaacttgggcaatggcggcagctcagccttgggaatctccggcacctccggcttgggcagctccggcacggcgaggtgcggcacctcggggatcttcggcagctccggtttcggcaactccggcacgacggggtgaggcagctcaggcaccttgggcagctccggcagttcaggctttggtatctccggcacggcggggtgtgccgggtgctcctcctcctccgccgccgccgccgccggcgcagcctcctccagatacctcgccgcgccgccgatggagctgcacgagagcagcagcagcgctgccgcaaggaggagaatggatggcttggtatggctggaagccatgtcgaacggtttgcacttaacttagctgatgaactctgggtgagtgtgtcagtgagaggttactaggcactagctgatgatcacttgatcagtctgtgtgaagatggctgggtgagaaactaagaagacgatgctggcatttatagtgatgaatgggagcttagatgcatcatcaatttgcaggagtctctgatctttggtggctggcagcagtggcaggtgatctgtattttggtggttgtttactatggtctgtgtctctgatctctgatgatttcagtttcatgtactatggtttagttggttgggattattgagaccctgaatcgtttggttggtgaaaatgcaagaccatctatgtctagtttaggagtgtatatacacctgcactaaggacctcaggactacagctgggaatgaagcaatgctgacaacatgtttgattgtttggttttggttgttctgaagtgttgaaaatggacagtgtcatagatatttttgcaaggcttcctttttaatgctcattcaacaaatttccaaatgaagtagatagttaacacttcaattaaatgctgatatgagtatgttcagtagcaagcaagtttagcttacatacaatccagttttataaatttggatatgagtaatgctactaatatttaggttgaacactttctttgaaaaaaaaaagattcaggctgaagatttgaagattatatgtgtttatttgtattgaaaatactagcttaacaaatcttgctttaagaataaaaaaaactctcaactcccaagcacggtcagtactacaaaaccatgtcataagtttgggtgcataattcgcatgtcatatttccatgaatttttacaacaaacagttaagtttcctacaacaatacacaatagaaaaaattcctccaaacagagctttgaacttggcttgcaaattaaattgtattggtagtcatttggatgtaatcaggacctggtcctaggactaagggcttgtttgcttgctgccctcagattcgcgcctggctcaggcgtcgatgtcaggcgttcgatttcggtcgcctgcggtcggatcgacctgcctgagcaacggtctccaggcgagggcagcaaccaaacagcccctaaaagcccatgtcgattttttgaggtcccttaactacaaaatcagaaatgtgtaccccaaaactctctaaaaccgttcaccggaggtccctcggcagtatttttacccggttttgctgacgtggcatcctagtcagcaaaaaaattaaaaaaaatacatgggacccacatgtcagctgcacatcttttttttttcttctcttttcttcttctcctcttctctcttcagcgagcgcggcagccacaggcagagcggcgtgacggggttctcctccgtggaggcgacgagcacggccgcggcggtgacggcaggttcccagacccggagccagcgcgttcagccggagcagcggctgctacaccgacgccgcattctccgccgcgcgctcctcgccgccgcccagatgctgctgctgcgcctgcgtcgccgccgggctcaccgtcagcttctccttgatcgctcccgtcaataaaaatgtggacatcattattgattgctaggagcactacgtgcttgcagacggcgaacggcacgacggcgccggcgaagcccgccggggccgggccgcagctgaagctgctggtggacaagcgctcgcgtcgcgtacgtgctgtacgcggaggcgcgcaaggacgcggtggacttcctcatcggcctcctccgcgttcgtctcattcgtcgaggccgacgccgacgtctcgctggaggagttcggtgactcgctgtgcccgccaatcccttgcgccggcgaactcttgaccctgccggatagcaactccgccgtcgtcaccgaccggccactgctctaagtgcaggtacgtacgtcgtcataaaacttaaactttgcaaattttgcaccatttgtattgtacgtgatctacgtgttcatgatgccatgcatgtaggtgacgaggctgaggtgtggcggcttcgtgttcggcacccagatctgccacaacctcgtcgacgcggccgggatcacgcagttcttgcaggccgtcggtgagctcgcggaaggcgcggagcgtccggccggtgtgagcgagggagcccctcgacgcgccacccgccgcgtccggcgtacgaccaccccgagtacgagccggcgtccgacgaggccagcgacaggctccgtccaggagacgagctcgtgcaccgcagggtcctcttcggccccgacgacgtcgccgcgctgcgcgaccagctccccacgcgcctcggccgcggtgctcgcgcttccttctcctcgagtccccgggcccagaccgccgctttccgctgcctacagctgccgacgccgcccttccgcctgctccggccacgcgccgccgcccgctgccgctcgcccgccgcttgtcgccggctcgccgctgcagccgcgctctcccactgacgccgcccctccacctgctccagccgcgctcgcccactgcttgccgcgtcggcgtcgtcaaccgttggctccgggtctgggaacctgtcgtcgccgccgcggccgtgctcgtcgcctccacagaggagaaccccgtcacgccgctccgcccgtggctgccgcgcttgctgaagagagaatcagagaagagagtagagaagaagaaaagagaaggaaaaaaaagtacagctgacatgtgggccccatataatttttaaatttttttttactgactaggatgccacgtcaccaaaaccgggcaaaaatactgccaacggaccttcggtgaatggtttaagagagtttaaggatatacatttctggtttcgtagttaagggaccttaaaaaatctcgctattcagtcgaggggcctctggtgaccttattcctaaatctatttagaacaagtgcctaaactaaaaatgcaatggaagaaaattctctgataaatagtattttttaagaagcgtggagaaaataatccgtggtaacgattcggtcaatacgcagaaaataacggggtgcacagttttcttgtaattaatccattctcataatctcattctgttccttggaataaacattgtgagttattagcaaaccagggagcatatatacattataaactatcaaaactcgaactgcagactcaaagaaaactctccattatattgatttgtacatgaatataaacacaactccatggttaacctgtaatcatgtactgatacaagccagtgtagatagtgaatacagaatacgtaaacagtgaaccatcgcaaataaaaaccacacacaagtattattcagtacagataaaatggcgcgcgcgctatacgcggatgctctatctgatcgctcgttcatcatggcttggcctccggctccgggaagtggaactcaggcttgggcaatggcggcagctcgaccttgggcaacgatggcagctcaggcttcgggagctccggcaccgcagggtgctcaggcaattcaggcttcggcaattccggcacctcggggtgtggcagttcaggcaccttcggaaactccggcacggcggcgccatgcggcagctcgggctttggcagctccggcacggcgaggtgcggcggcagctcgggcttcggaagctccgggtactcctccttgggcgcggcctcctcctccaggtagcgagctgcgctgctgatggagctccatgagagcagcagcgccatgaggaagagaagcgaggaggacatggagttcttggaagccatgtcgacgatcgaaatgcagttaatttctagctcgtctcggtgtatcagtgacggtgagagagctagttctttgtgtgatgggttgagaggcaagaggaagctggtatttatagagcaaaaatttaaggaatgttagcttgctgaatgtgcatggaagtctcttctgatctttggtgcttggtaggtcatctgcatcagtaatttggtgatcaattggtttcctaatatatatttgaggatggcttaattagctgggaatattcagagtttcaaacctgattgatgaaatgcaccaccaaggcaccaactaaatctagccctttataaaaaagtttgtacacgtgtgcagtgtgatgtgggatgttaatgcaaagtaagatcaatcgtgcatgtgataaacaacagctaaggaacagagcaagtgagactatgctaccgtcccagtaagttctgacaaaatgtctgatctggttgctgaagagagtgtcaaaaatagcagtaaaattctccaactttcttttctgactctgcgtggtttggcgatcgactgcatgttcgagtaggagcttacatagcacactagtgatcaatcggtgttaggtcacctgttcaagatatctgcacaaaaaagttcagggatttgttgataaaatcactacaaggtcaagctagtcgcttgtcagtttcagtgactgatccaaagcctccaaaccgagctgaaaaaccaccattcctctgtaacagccttcccgtggacagtgaaagaagtgaggaatctgaacacattggctaaggaagaagttgttctgaaaacgatggcttattcagtgtagtgttgaaggtagaaggcgctactgcaacctatctgctcctccctttgatctctttaacttgcaggtttggtttatggttgatagctaggctcatcagtgataatacaggacatggaaaatggaactataatttgtaccacaattgtacctgcagtttctgcactatctgtacttttgtacgtgctgcaacctctcctactccacgtaaagtatgacctgtttccaaggtactaaaagagcaccagctagctagcttgcaaacaatatttctaatattgtagattaaacaactgaaagtggtccagctgaaattaacaagagaagagacggtttacaatcctggaggccctgctgcatgctctgcacattctagctagtcagaaaatggtgatttgtggatttaccccttctctattaatataaaacgggaaagcttttgccttccttcagaaaagaaaaaaaaaacaagaaaatggtgatacagctaaccgttccatattgatttcaggttcagtttacaacaattaactgtggtcagatctgactagcgagcttaatttgcggaaaatgacaaatgtcatattaaaatgtgcacaaattaacatcctatcggcctttatccatgttgattcaacgatcaagaagccttttctttttggcgaacacattgggaaacatgatgacagatgtaatgtaattctgaagaagaaaacatgaagccatacagctctggaggactattctttcatcatgcggtcaatgaatcgatggcaatgatgactgatgaatgcaagtgtgtgctcatatacacacataattgaatccatttattataaacaaatatgaatatatgatctcacaccctcagagaagagatatgtgagctgctcatagcaacaaactcagcaagtaacacacatctacacggacgacagacatggcatgcacgccgttgatacaggaaagaaatacacaaatgaaacctaatgtagaatctggacgaatcaatctgaatggacctcttggtggtcatcatggtttttgccctcccgttaccaggaggtgcacctcaggaatgaccggcagctccggcttcagtggccggcgctttcttccggctatggtgaaaatgggatctcaccgttcggcaacggtggcatctggggtgcatccggctttggtggttgttcatagtactctggctgtggtggttgatcaggttttggcggcatgtcaggattgggtcttggcggttggtcaggctttgatggcccattaggattaggttgtggcggctggtcaggtttcggtggcccattaggattgggctgtggaggctggtcaggtttcggtggcccatcagggcaaggttggggtggttggtctggctttggtggcatatcgggattgggctgcggtggctggtcaggctttatcggcccattaggtataggttgtggtggttggttagggattgatggcccatttggattgggttgtgttgattggtccggcaccgaaggcgcataagaattgggtgacccatcaggtttaggcattggaagcatatcaggcttcggtggcccattaggaatgggttgtggtggttggtcaggctttggtggaacattaggattaggcagtggtggcccatcagatataggttgaggtggctggtcaggtcttgatggctcataagtattgggcaacccatcaggtttaggcatcggtggcatatcaggctttggcggcccattaggattgggttgtggtggttgattaggatttggcaatggtggcccatcaggtttaggttgtggtggctgatcaggacatggttgtaccgggggaatgggtggcccatcgggtttaggcatcggtggcacatcgggcttattcatcggtggcacatcaggattgggcagtggtggaacaccgggtgtgggctgcaggggaggctgatttggatttggcacaacatcaggtgttggcagcagcggtggcggctgatcaggctttgggtaatcgtagggtggccaagccgcttcctgcaggattctcgccgcatcaccggtgagcagcagggcagcagcaagcagcaataagagcagtgacgaagtggacatggctatcttgcgagcagccatggctagctagctagctcgcaagctaactatgctaagctcaggaagaagaagatgtgtttgagctggatcggtgatgagaagccgatgctggcgaggtgtatttatagcctcgcggcggccagaatggtagctatcgctggcaatgcatgcactgtgggtgcacggttgggcgtcgcgtggaggcaagctcagctgcgtgttcgtgtcactcacactcgttatttactcctcgctgcatgtacaccgtccggttatgtacctgccaccgtgtgattgcatgggtttttggttgggttgttggaaaagctatcaagcgagagatatatcgtggagccgtacgtatgaataggtgtgcacacgagatcatccactgtatggattattggagcccagtgccccagtatatgttactgtacgtcgacgagatttaccgtgagatcgagcaaccaaatggccggagacgagatcgatgcatgcgtgcgtgcttcttctccgatgcgtgcagcgctaggcctccgcgtgcagacgagatcgtcgtcggcgccgtggccgaggtcgtggtgatcgtgaggccgttgggctgaatatgggctggatgagaaaataaagggaaaagtacacgcaaggtccctcaacttgtcagcgaggtacaaaatcgtccccgaaccgcaaaaccggacatccagcgtcccccaacttacaaaaccggtcacaaaaggtccctcggcggttttgaccccggttttgtcccacgtggcggctgactcagcgtgggacccacgtgggccccacaggtcatggagaccacgtcagcaccctctctctttttctcctctctctctctctccttccttcctctcgctctctgctctcg

SEQ ID NO: 74320 - DNA, 16600 bp, Oryza sativa
  unsure (1)..(16600): unsure at all n locations
ggaggggttaagggaagcaagagatggagtggagggggatgtaacaatggaggccaagccaaggaagaacactctagctcacctcaccttcaactcctcctccttcttccctcaaatttaaattagaagagaggcaaagaaagagagaggggaataagtatcaccaaacaacaacttcactgatactgctcttttgcatgtttctttctttctttggaatagcctcctctccctgattccttctcactttcccaaaggctctctccattttctggagctttgtagtaaaggctctccttttcttttctagtacatggtgctcagaaatcagtggagttactgtttactaactattactattaactgctttgagctaggaattgagtagagaaaagataatctctattactactaatgacaaagccttacttcaggtattcagaatgctgccttgcaacatggcatacctgttgtactagtaaaagtcattagtactacatgtcttggcaataatgatacaataatgccaccgtctgcccctgtaatatgttctactagtagtcttcttctagaacagatgttatcttatcttaaactgataaaagtcaatctctatttatctacacatgcatacacttcttactggcacaagctgatcagaagtttctcatcagtaaagatattcagcctgtacaacgactccaacgacatgctgaaatcttcctgtccaaaagatagaaacaaaaaattggagacaccacacattactgagatgtaaaccaagcttggtaatcgctatgatgattagcctgatgaaagattctgtgtatacggagtacctgcttgcaagaacgcaaagctcgagaggaatacggattccttgtgaggtgggtggcccaccactaactgcaagagcagcctgtcaaaattacgtggctacccctctgatggccactgtgctgtatattagctcctcttccttaggactaggaagaagtaggcgcgaaattctctcttgcacttattattttcttatttttttaaaaaaaagatactggatgttgtactaagcaatgatttttttttaaaatcctaattagtgagaagaaataatcgattgctataggaaattcaagtctgtgaggcagagtttatacaataccctctttattccaagaaaaaatgaaaactaattctaagggtccgttttgtagagtttcacctcctaaatttaattgtaggagttatgtacagagtagaatcgtgcaacagtctaaacccagctctacttctcagttcattttgtgagaacgctccacctagctttacttccattttaggtggagttgaaactgtttggtccaattccaagaaaaggtggagttggagatggagtcatgtcaaacagactctaaagattatatcatctttaaaaattgtttctttatagaacataggacatatataataatatcatacaagattttggagttatagttaagttccaaaaatctacagattaataattcgttactactatatctctttgaataatgcacgtttacttgataaaacaataataatactttgttcaaaacaaaacaaatatccttagaaattgtctttagctacagttggggctggtccaactaggcagtgtgcagtggttcacttcacttcaaagccacagcttatgtcaccatttgcaaaataaagatttgacctaaatcccttttgcatttcgacctttttctgccacagagatgatctacatgccttttctctacttgagagaatcactgtacagcaacttgacaacaagcaaacgagggaaagataatttgatgaccagtccagcaggtgtttgaattgacaattcaatttcaggtcttccccatcttgaatgattgttttggcaatgcctatcttctactgtcttttcctcttgttcttcttggggtgagatgatgttgtcttctgctgctgaatgtaattatatgaagctactacatcttgacatcttgtgctcttgtagagctctagtatttgagcactggctattggaccaaattaataactatgtccttgtgaaagctaagaaaaaagtagtatcagacttgtcaagtccatcaccaactctctcagaattttgtctgaaatgtgccaaaccatattcatttttctcaactttggtcaatggagatgacccaaaaagaggcccatttctaaactagtatagtttacactacttatttgtttggtactttggttagagttgggttggtgaaccccataaaccaagcgatctgtctcacatctgaagtgcttccgtcaggaatcatgcaaatgaaacccagttgattaggtgtgcatcatctgtctttgttgacctatatttgcctaattctcttagtcacaacaaacacacctgttgaacaccaatagtaatgacctttgcatcttttcccccaagttctgaattttgtcagaataaaagatgttctcctaacttcttataaacaaagggtattaaagcatgtgtgaagttttaaatggtagtgtgaatttgttgcacctgtttttgtttagtcctcactttggcacaataaataaatttgtgatgagatcttatgtaagacagatagagaagtatcttttgatacaaggagaggaccacacagtagctaggtagcctaactaaattttgtctgaagttaaccctgacatgccaaacctttgatatcctacaaaatgaaaaccaaaaatacgtcgcagagtctcgtagatgaagttatgggttaaactttgccattttttttttgtccttttgctttgaattttgtttccataaaacatgacatgttgtatgtacttgtctatgagagcgagatagactcaatgcaatagattgatctcagtaatgcaaagtacatgtatagacatccttcccttatctattcaaccgacttataaaaacataatcggtagagataacgggagagagatatcacacatgccaaaacacataacaaactaacagtctaactcagtggccatcgtgtgcatgcagttcagactgaagcattactagctttgaaccgcagcctttttttttttcttctttgaggactacactttgcatgcgtatggttgtattactgttgagctacacacactgacacgatgaatactatatgcagtaaagtatggttaggcagcttgctttgatggaagcttgaagatcgattaggtgctcccttttaagcctgcaggcttatcattacgatgcagcctcatcgtataaatagcatcagcgtctctttcgaatcagcagatttttgggcgatgtgcacagcagaaaaggattagaactaccagtagcgccccattctttcagacaaacctgtaataagtattcgcttgactattcaaatcttcaggcttcagagtactacatggtacgactcttaattactttgcgactgtcaggccctgattagcaacattgataccctgaaaatggagtggccaaatcatcgtaagatgaacaacatacagataccaacgtaagactgcagtgaagaattcaggcaagcgtcagacgtcatatgtgcatacagccatacactggggataaaaacattatactgcaggaggcaggcatcctgtatccacagtatgtctactatcctggtaatgggagacatacggtatatggaagcgaacgccaaaatacattacatcctacatatattcacatgcatatacatgatggctacgttacttacgctggatagatcattcatgaagcagctagcttgggattgcatcgactgttcttctgttgaatggagaaacagcaattaatcagagatgagaacgcacagcagatgtcacacactcgtgtctgccacatgatctgaatctcatcacggattcaatccaatcagcccccatgaatgtctccaaaggaagaggtctagaggccccaggatggctgcaggtcaaaccctgcattatgtagtatctgaacaatcgatactgttctctttaatttagtttttactgcaggtcaacgtccagtatcatttgcagcagttggtttggcaaactagcatcaagttttttctgattttacaagggtcaacgaggactcgcaaattcatactggaactccactgttcgcctgccagatgccagatcgatcggctaatgaattgcctgtggaatcagaaaacgataatctaatcctgatttaagtaaagctatggactttatttctagatatattgtgcttgctggactctgcccgcttgattatttggcctcacgatcttgatccaacggtttccgtgagcccaacaggggtcggagaataactctccgaacccccgcgtggcctccgcctccgacccatcttgaccgcacgttcttgatccaacggttcctgtcaactcagcagggtacggggcattattctccgaagtccgaaccgggcacaatttttgacaatttgaccctttgaaaaaaataattttacaaatgaactaccgcaaaaacttatttcaaaaatgatcctccaaatcatgtggcgttgaaattagacacccgttgatgcgaaaaacacacaatggcctagaagatcttcttaactcctgtgcaggttcaaaatcttgcttttaagtccaaaatcttacttttaggttcgagagtgtgctagttgatttgatcctacaatcaataagaaagaaagacaagaaaaccgcagttaaatctataaacgatagccgatcggctaattgccgatgtcatattataatcgatcggcgataatgactgaataaaatagaactaaatctacttgatcggctgtaaatattaacaacatataatctttacttcgatacatatttaaactaagtgattgggatagatcggtcgtcatgccgagacagtataaatcacttaagtcaaaatatatactaaagtaataattatataaacgtttatagcatagccgatcagataaatccagcatgtatcggttaatactccgatacaactttataccaagatattaaaacaagcaaaatatattaaacgagaagcctaatatactctaatgcgataagatcttaatataaagggcagatttagcataacaaccaaacatatgagataaaatagctaaatcagttaagatcggcttaaactccgacactatctctattgatgatcatggaacaggctagatattacaattatagatagaacttaatagatcgaacccaaccgatgcagcattaagcatagagataacggtaaaatctaaacaagataataaaaatctctaaaagatggtagatatacgatataatctaaattaacaacgagatctaactctatcaggtactttctaacagtaaaaaccaaccgatcgcaagttatatagtgtaactaacagagactataaagtatatacgataactcgacgaattacacgaacaagattagagtgtcataaagatggaagcactaatcccgagaatgcagaccgccatgacaaatttacctctagttgaagatcgaattgatgcagctcaacccgaaagtaagaactcgtcgaaatagaacgaaagtaaaaaagggtggcgatgcgccgaaagtgttattgaaccgatgttgtctgattacaaaggttcgggtaatatttatacccgagatacataatatgtccttaccggacacgagtcttctatctaacaaactctaagatacacaaaatctttacgacagacttttgcccaaacatatgtctaaggaaattacataaaatatcataattaatagatacaattgcttatttgagagcttatctctatcgtggcaatccttgttaagcacgtcgatcgattctagaagtagtctcacaaccgtctttaagaaaatcggctgtcctctgtccgatccatcttagccgatgcagactccagccgatgcatactctgttcttcgaatctaactcctcgccgaatccgcttcgattccagcactgaacctggtttatatcttacaaattttggtcattaacaacacctcagcgccatgtcaactggcgctgaatgccgtaccaccgtggatgggaggctaagtcagcatgccaacatacattcagcgccatgctatttggcgccgaggtgtctaaattcagcgccacacgatttagcgctgaacaaaagggttagttttgaaataagttttggcggcggttcatttgtaaaaatagtttttgcaaagggtcaagttgtcaaaatctctcaacccccgcgccctctgacaagatactgtagcgtcgaagaactcagatgtgtctcatcatgaatttctgcttgtttttacaagaggttgtttggccttgattccaacactgatatcatttcagagttcagatgagaattgtacaaggagattaattagcggaggattcaaaaactggtatatatctttaggattagaacttgcaccagtgtccgacacaactgtaagaagaattactcttttcaccgtccaaatcttcgggcttcagaatactacagctgcagggttatactccttttttttttcttttgttccagttacgattctgaaatcctttgctattgtcagtccctgattagcagcatatattttaccctgtaatggagtggccaaataaatcatcgtagctggacaacataagactgactgcattgaagatacagatcataagccaaaacgttcaagcagcagcagctagcctgggattgcatcgattgttcttctcttgcatgaaaaatcagtaatcaggaagaatcagaaaacactgcagaatacacatgatctgtgctatgccctcttcattgtgtactgaaaccgaacatctcagcagtcagcagtgatcgaagccaatcaaaacctgcattatactactcccctcttccctaaatgtttaacgccgttgatttttttaaacatatttgaccgctcgtcttattcaaaaacttttgtgaaatatgtaaaaccatttgtagacgtaaaagtatatttaacaataaatcaaataataggaaaaaaattaataattacttaaattttttgaataagacgaacggtcaaacattttttaaaaagtcaacgacgtcaaatattttgggatggagggagcagtatatctcaacatatgacgttctttttaatttcgtttttatcactgcaggtcaacgtccagtatcacttttgcagcagctgggttggcaaacgagccatcgagttttgtctggttttacaagggtcatcttggactcgtaattcatactgaagctccactccagcacaaaacactgaacggatcggaagagtatgtttgttaacattgttgcacaaaaggcagaacaagcttgtttactattttattgttgttagttacactgctgcagatcgatcgtctaatggattagctgtggaatcagaaaaatgataatctaattacatacaaactgcacatcattacatacaaactaagtttaatcaattttaactgatcaaaatcgctcaaaaatggtaacacagccctgtgtactgtacacggtagcttgtcaggtcagaacagaataaacagagccatcatggtttcccagcaagtgagcaaacatcacccaagtgcgttcgtcaagccaaagtggttacctgccaacacaactacaactagaatcctaattatgcagcgctgaagcttttttactaatacaatgatgcagaattccaacaacttctgcaacttgaaatcttgcaacacacgggtgtgaaaacccagacatggtgctcgtcagaattcagatcatgtaaatacttttcacaactagaggagaggtaaggtgaaaaatggtagtaaaggtgttctagcttggagctgaagtgaattggagagttttcctttttgtctgatcttttctgaatatgcttttccggagaacctttccatggatttgctgtctgtatcctagagaaagggcaggacctagatagtcacaaatagaatgattgtatgtcaagctaaagtgatgttcccaactgaaattttaccaaattacttttgacattgaacggccaagaagattggaacccaaaaccaaaatcaaattaggaaaaggaaaagttgacccactcctctcttctcttcagttcttcacaagcaatgaagcaaatactagtaatattacgacaaaaggacatccgaatttggttgtgcgcctgctaacagaggccgaagatgtaaccattattattattattttttaaaaaaaggacattagaattgctgtaagtttactgctgtgcaagtacaacccttacgaccagagctgaaaattgtgcatttttttttctgaaaacctcccgcttgctcaactgcatcaattgacatggttgcaaaatctgttccaacctccagcatagacatcaggctgatctagtgtacaaggaatgtcccccccaccaacagaatatggaaacacacagaacaagacatgtacataagaaagaaacatgtccagctgaacaatcataggggatacagaacattgctcttcatatcatagtggggttttgcccaaattttgtttgccattaggcattagcctttacaactattccctgaaacataccatgtataccacggaaggaagcactcatccacctagatcatctccactgcaaaatggggctttgccccagtgcttcaccttcttcttttcctaactattacaggcaattgctatactagtctgaatgaccatagagactgagctcgtcatggagagcagtctactggggtgatccttgaccctgatggcagctcggacacctcctccctttgggggcggtccgcaaaaagcatcaagaggaggccaagtgttaagccagaggcaatgagagccaggcctgctgagaccaagctgaggtcgcgccatataggagggcagtactgcgaagcgatggagctgaatgtgttgcggacgaacttgcagtcctggagattgagcatgagaggggcataatggtacagagcatagcttacattggcagctaaaacaagctgactgtatatctctggagttatggttctggggccagagcacaaatctgagtcaggaactgtgcatgtatagttcagccatgcctgaaaagaagaaatcattttgttatcaagcaaagcttcacaaatgaccccatctagtaatcctaaaataaaccagatcagcaagagtcatgcatcagagaaaaacttcaattgaagccaacaaattgtgaaattagtaacagaacaatgccaaaacttactgtggttgcattatcgaaggtgacctccctagacttgcactgccgatcagtcaggttcgcatcatagggagaacacaggtaaggcatgaactgcccaggatgtttatgatgtggccttcgatttgaaagagcagatatagccctattaactatgcctacaagaattaccacaacatgtttactctggtacaaggtttgattggttgtgctttcatctacacatggaaggatgttgctgagagctgtctctgcttgaggatgttgtgcccattcatccattgcttcacaggtatcctttgcagcactgttgcagaaagattataatgttgttaatactaaacagtgaattgcaacctcataaaaacatatttagttttgggagggatactatcaatgctggttcatagcatatgaacatgggtgacatatcaaatggcaagcaaattcattcttttcaaatgaacacatagcacatatcaaccgacaagcaaattcatcatcgttgagttctacaaaaatgtttctactaaatatgtttgtagctcttatacttttaattaatgaaactgtgggcttacctcctgattcacggtaaaagaagttctgtttgattcatggttccataccaaggagaaaattagaattgtaagacctcctagaattatttcgcatggaaagaaggctattcgtaacctaataatacctgttcaatatcaggaaaatccctagaagaatgaagagagttgccactactgtccagcataaggtaacaaatctgtaaaattcaaaaagtaagtggtaaaaaattactgcactaacatgcccactctaatacacagtactttgtacatggccacaaagcttacacataaactgtacttctttgtccatacagctccaaaactgcaaatgtgaggaataggttgttcaagtagtgagtgttaacacatctgagataacaaaaccaacaaaaagggcatcagtttgactaacagaatgaaattcttaccatatcccaagaatgcaagaacaggcatcaacgcagctatgcaaatcaaagcaactgacctgtagtaaaacaggaattcaaattttcagttgaaggcatagcattactaataatgtgctagcataaatgaatgcaatgccataataaccattttgaattttgattacgcttcttagcaacacagtgccgtcattttgaagaaaagatataggcccacagataaatatactatatagtcacatgaactattattcagtcagtgactttcaaagtcaagaaaccagaggtaaacatggcaagaatagtttgaaacgtacaagttatggagaacttttcttatccttctgtagttttctgatgtcttttgggatatagtatcagccgctttatttaagtccactttcaaattgtcaatttgcccttgtacatctgaaggaagatagagtgctgccacactgattgtctttgcaagcgataagtaatcggtaacattccttagcgtctgaatggtgaaatcagattgattcacaacaaaatcgacagtgctagtagcttcttgtccgaatttactctgtccacaaaagaggataacagatccagccctggtacaaaatgtaacattggtagatattagaaccagtagttatgccatcttagaactcaatagtggcatggagtagaaaactctatttaaaccagcgatatcccaatcagatgaactcaaaaagaaaaggaaaaaatgattattagagagttagcacattacgttaaagtaaatatgaagaccacaagcaacacaaggcgcagtatatctgcatgaaaatcattttctttgtctattcttgatttccaaaagcagcttgcagctacagcaattccaaacgaaataaaccacccagcagcaagaacaaacccagcaattcctgtgaatgaaacagactgaaacaaacttgattcagctaagatgtaggcagaacatgggcattaagcagaacgaagagtataacagttcaatcataattaaaggcataggccagtttaacttcaaactatgccatacatttttcgactgtagagtcagtgttttcctgttctccttagattaccttgtaaacagtatttacacagttcaaagaaagtgagacaacactgtcatatcatactaccgcaaatttctcaatgtttttacatagattttttttggggggatttcacaaataccttaaaaccaaacaaaaaagaatcaagtaagtttatccatgaatggtctataagttgtcctgtaactggctactgtatttggacaagtagaaataaattgtccagactgaatttgtagttcatatatagcctgtactgatctatactatcatattccaacaaccaacataaatactagtatcgtctacttgcatatcatgacatctctaataaactagagcttcaagagtataaaacttttagtgtcttgaattcttgatagcaacacataccgcccaatagtgcttgttagtgatgttccaccctcctccatacatcctaaggtggtcaagaacatccggccgccgcgtcctctcctctgccagaaccagcggatactttgcgatggggccctctgctggccctgccgccgagtccggcatccctttcagaagccccttcgcccatggtcccaagttattcacttctgtagtagcagttcacacaaaaaaggaagaaaaacaaccgtttagtaccagtccagaatactactagctgataatatttaaccataactaccatcaaagttctgcttgcttgtacaaggcaagaagcaaatgaaaattgccacttggttgtaatcttgtacgataagtaaagcatcgagcttcacatttataagcataaattacgaaaatctagattctgtttgcgcatgaaccagtgaacgaaagtgccgcttttacacagaaagatgaaagttctaccactccctaggaagaaatgcttcgtgtgaaccttgtgacttcacgtgtaagtaaagaccgaattgtagccgtcgcagattagagcaccgacatgataattaaatactggtacccagtgtttgacttgttccaaacgagatgagagaatttttactagtggaagcgaatcaccaaaattagcatccctgaactacggggtttaaaaaatcaactaacagacggaaggagatctacccggcaaacgcagtaaaggggaagcaatatggcccgaacgaacgagcaatcaccgccgaatcctccggaacaatagccgctcttttatgcagaaattgagcaaaacaaaagccggatttatttgggcttgattctccgaacaaaatagagcatatccgatatagaaatcgaatgagatgagatcaccctaagacgctgatggtttcgcagacggcgacgaaaaaaattagtaatatctgaacaaaaaagcgcacatactgatactagacaggacaaacgtagcaccggcgcagtggtcctgaacagcagggtgaaatccacccaaaaaacacagctccaatcagtaacaaaatggattgaaacggatgaactcgacctaattaagctactcatccgatccccctccgctcactccactccactccaccgatcgatcgcaagtcgcaacggagagatagaatagaacgagagacgaatcgcaggaccactcgccgcaaaacagctcaagcccacgcacctggcacgctgtcgatccccttggcggcgccgccgagatcggcgagcgtgtcccccgacgccacggccgccgccacgaaggccgcgaccaccaccaccgcagcgcccgcgcccgcgccccttcttcccatcaccgcatctaggttcgtcggcgcgcgcggcgaggtcggggcggcggcggcgcgcgcgcgcgtaacggcgggagtgcgagcgcgagtggacgaacaccttccactggactaagcccgcggcgtcggtcggtctcgtctctctccctgtctcgggttagttattaccgaccccgacgcgacggtgtggcgggcgaaacggcgtgtgcgtttcgcctgggtgcgcgtagcgggggagacgccctgcccacgtggcaggcggtcggcgacacgtggtggtggcggtccccaccctccagtgagtgtcgtttcggtgcgcgtcgtgaaaaaggacacgagttgagttgagtgcggtggtggagggtggggccctgtagggatcccttgcggcgtgggacatgtgctgcccctgccgctgccctgccttcgaggttgtatacgaagaggctcggttttgcgggttaattacgcggggtgccatgaggtaccatagcgaattagcgatcagatcaggggtagtttgggaagtttgtcacgtggaacaggcgtctctgggtggcggccccacctgcacgtgtctgtctgcatattgctttgttggtgtggagttgggtagtgtggcaaatactgtataactgtacagtgcctttcttgtaaaaatactagtgtgtggtgccattagctagctttccttcagttcagtgcagtgcaggtcaagaaaggtgttgctgattacgcgttctaatttgtgttcttaattagtggtagtagcagtgtagcacctacttaactttgttagtgatgagtgtatactatagtatgggccggatgggcgctaagcataaatatcttggcttccttttacnnttaattgtgatatttcttttgcgaatattctgttctcaagaaagagttgtggtgcgtgagtggggaggcgcgataagtgtgtctgtaaaaggatgagattcgactccgtgtagacgtgagcagccgagcacgtgcgcggcgtgcgcgacgtgcgcgacgcacgagcgtagcgatagccccggatccgtgcgacaatcgcaaggtactgacgtacccaaactgtacagaatatgaactgtttagtttacctctattcctaacttttcatcacattatatcacatcaaaaactatcctacatatataaacttttgaaccttttcttcaaactcctaactttattcaaacttttaacttttttttcaagtaactagacacatcgaatgggtgctgctactagtgttcgctacgtgtcattgcctggttgtctcgatcttttcgttccttccggatgttttggcacccctgaccgttctcatcggtggatcggtcaatcaatgcaaattagtaaggcccagttaattcgcgaaatgaaaatttttaggtgtcacatcggatgtttgaccggatgtctggagggattttcagacacgaatgaaaaaactaatttcataactcatatggaagccgcgagacgaattttttgagcctaattaatccgtcattagcacatgtagattactgtagcacttatggctaatcatagactaattaggctcaaaagattcgtctcgcaatttcccccctaactgtacaaatagtttttgtttttatctatatttaatgctttatacatgtgtttaaagattcgatgtaatgtttttgagaaaaactttctggaaactaaacgcactctcactccttatcatttcggtcgcatgatgatgttgaaaaacatccagaaacaaaaacacgcaaaaggacacatcagactagctagcgtgtacgtacgtgtacggtgtaccggtgtacacccacggaaagtacaatcaagagcaggagtgatccttccattattctccaaatctttatatttcgagtaatagtacaacaaatctttagatttcgagtcatcaatatatgtaaagatttaaaggtatgatatgcaaaaactaataatattaattaggtggatcgatcataaaaaatagtataacttcacgcagcaaaaatgagcgtacctatcattagcttccttgtggaaatttgattaggtgttcgtaactaattattctttaagcgcaaattactatatcaataacaagatatgtcagagatattcattggagtcgcgtgtgtttgcaaaggtgagtgtgagggtgtatatataagtgtcatatgcgtgtatgtgttaaaaaaaaactcatgcaattataactatttttttttacaaaagtatgatttagaaaaatagacatgtcttaggagacacccacaaacccttcgaactcatccatgatccatgaagcttcaccgctcaagataatagttaagctcctttgggttcatttagctaaggactttcatccatgaagaagagcatgaaagggtcatttgggctgggccaatgggccaatagactaatttaagctcaagggctactgcagcagtgtgggccatctccatgaggccggcccctatatagccacggtccaaaggcccagttattagcttaatcctgttatcttgtcacaggaggcggcccataaattaatgagctaaagtttacacaaacttaaaacccataaaatccatcacggcccatcccttgcaaaaggcagtctttcaagcccaaagtccacagaaatatatgctgatagattattaagctattcatatcaatctcggttcggccttctttagctcatagattcgataagctaaaataatctatcagcggattaatctcatgactatttaggagcagctagctagctagaactaatactgtattgcggtcatggcacggtcgatcgatagcgatcgagatggatcaactagtaattagtttgttattatatatggtcatcaagccatcattttctcttttttttttgacgcgaaagccatcattttctgatagcgagttggatcgagttgccactggctagcgagcatgcatatgcagtagatacagccatacaggagtcacaactgaattaaaggatatactccgtatataagctagacttgtcgacggattgagatgttctacgctttattattagtctaatcaccatcatatcgatcatcagtagtagtacttcgaccaaattaagcgatactaatttacagattcagtgcatgcagaccaagctgggtgaagatgatctcttacctagtacagtacagaaccagacattatctgtgacgggctgacggaggccggcgatttgtcaggtattcatccgtgtcagacaaaaaaaaaattcaaagattggaccttttttttttctcgagaatgtgaagattgggcttcacggctacgcctacgctcattac

SEQ ID NO: 74321 - DNA, 16361 bp, Oryza sativa
  unsure (1)..(16361): unsure at all n locations
tccttttcagtcttactatccgaactttttgtcccgttttcttgaattttggtcttttcttttggttcttgcttcgtttctggtgcagtttccttcttgacctggagaatcaaaattgccattagtcactgtgagatgatgattcgctttatcaagcacccggtaatggagtttgcaggtttcatcagggaaaagttaaattatagttatccgttcctcttgggtcttaccttgttcttttctttctgaagtagctctctgacaggatgataagctgccgtcacgcaaatattctgaagaaaaaaaagtacagatttaatatttcagagagtgacgactgaataaatcttctttataataccaaaagtccaaaagcagtgtacagaccttcaagtcactgctggtgtatccttcagtcattttggcaagctccttgaaatcaatattttcaaccgtctctttcgacaacaatgtcttcagaatcagctctctactctccaacgttgggaggccgaccatgattctatttaacacaaatgactcataaaaaaactcatctagagaagctgaatttaatcaaatagaagtttagatacacataaacgaaacatacctgtgctcaaatctccttatcaccgcatcatcaaggtcaaagggcctgttcgttgcagcaaggactaatatcctttcgttggacttagacaagagtccatcccagtgagccatgaactcattttttactctgcgggatgcctcattttcgctatggttatctcgtttccctagcatgctgtctacctcatcgatgaaaatgattgctggtgcaagtttagcagcaaggctgaataaggcttggatgcacttctcagactccccgtaccattttgatgtcatactagccatagagatgttcaagaagctagctcctgctgcgtttgctagggcctnnnnnnnnnnnnnnnnnnnnnnnnnnnnnnnnnnnnnnnncagaacgcccttgcatggcttcaagagaccacctttgaagaaatcaggtcgttgaagaggaagcatgacaagctcgtgaaggcattctttgatatcagccagtgctccaatgtcatcaaatgtcactcctatttcattggctggtataaccgttggtcggatcttcttttcatactcattgtctggaacgacctgtaagttaagaatagcaaaattttaaacatgtaattaaactaggaaaattacttaattataacttattgtagttgaaacaatgtattaccatctctgtctcatcctttgcttccactgtatctttcccaaggtcgttgctctcttggaatatgcgtaatccatgggataagctgtgaaagtgccatgttagcaaaagcgagataaagcaacaatggaccacctcaaactcaaagtaaatttagctaacctctccgaagatatgacaagattcccgtttctgtatttagggttcttgttattcatcagatggtaagagacagatggggttataatttcttctaagtaagccacaatgattttacaatcatcatctgcattgatcgagctcaaatcttcacactcaagattgttttctgcgagcacttccgcgatgtagttttgaacgacttgattattgttattattcgaatcttcctccatctgggtcttccatttctcaagaaggaccttgtctttgggaggctttgtctccagaatacaagggaaaagagcacacacagattcttcaatatcttctctatcctcatcatcatcgaggaattgtgaaccaatcacgattacccgtccagatagttttttcaacattttctgaaacatacagtatgctttttctgaacttccaagcaagtcatcaacatcccttatgtaaagaatgactggactgatttcagaagcagaaactataatctgcaaaagccatccaatatcagcttgtacaaatagggcacgtaaatttggactatactgctgaataactgagttaccttgtaaagggattgtatgagaaccttctcattcaaactccagcatggtttaactgatgctgcatcaaaagagagggtgatctacagatagctaaaaactaggcaggttaggataactgcagatttcagttggaggaaccctcatgggcaggcacatttgaatatacaggtaaatgaggatgttgggttgtctgaaactagttgaagctggcaacatatgcattatacatctaatgtgcacatgtgcaattggggcataaataaacaagagagcataaaaaaatggatttcactcaccaaggtatttagaagattcgggatcatggtccttctcgggaggtaccaaggataactgaacccgtactgaaggtgtgttatgaggacaacaagtgctgcaaaagcaatagcataaaatgctcagaaaatcaatatctaatacctctagttgcatatccaggcagagatattacctagtcctgagatcaaggatgcctgtttcacggctcaatggtcctacattagtgtttcatgaagacacagtcagaacatcagaaaagttggagcatgggcatcgcttcaaaatcatgattgagagaaagaaggataaagcattgcagaaagtaaacaggcaaagaaacggtgagtgcacaacaggaagaaacagggtacctgttccagttggttcttccttcttgcgaaacagattgaaagctccaaccaaactagacactctatcgaaggctgcctctgtcatggatctctcacgggtctgtgttatgaacagatcagaattgattaggtaaatcatcagacaaatccacgccacttcacaaaattgtaacaaatgctcctgttcgaaaaaaactgcacattcagcaactctactagctaaattgttcagtgtggacagagtagactaggttctatcctcctcaagtaccccgtttaagttgtgcagaggccggaatcgtaaaacgctattccataatctaaagaaaagtacccattgtttcaacagggacaccatgttttactttgactcattaaggaaaaaaaaaaggccaaactgataaacagaaatgaaaatcctgaatttcccatgtcgcttggtatatcaaccaaatgtgctatacaagatggaactaccagttaccacctagaaaaagaaggcagaaataggatacagacctgtgtattgcttggaccgccgtacttatgatggagctgcaatggcaatcgggaaaagaacagtttaggatcataagaggccagggcgacaacaaagctaaaatttctcaaattgcatctaactgaccttgcacgcgaagtcgatgacatcgagcagcagcaggcgagcactgaactggtttgcgagagccttcgcgagcgactgaaggtacgcctctgcaacagagaaacagcggctgtgagaaaaaaaaaagatcgcgcttttggcgaaaacgaacaacgcacattgcggttcaggaagcggagggcgaacctgatgggccgcagagcagtatggtgcggctggacgcggagaggacgcggatgtgattgggcaggatcgttgggctcagatgcacgaacgccgtgctggtgagggccagcttcgactgctcgctgcaagaaaaccatgggaaacacatgctcaattagccgcccttcaccaaacaccgcattgatttctactgacgacgcaacgcgtatccatgggatcagtaattaaatcatgtgatcctacccgaaatataccagcaaagtcataaactaatcgataaagctaccggtcaaaataagggaaaaaaaggtttggttttttttttccttctcccacattggattggggggtttttggctctgaggattcgcatcgacgacgggacgaacctgaggtagtacgggaagtcgtcgaaggagacgccgacgtcgcggccgtccaccaccagacaccgcagctccgcctccacctccgccgccgtggcgccgccgccagtcgccaacccggtcagccgcgacgagacgaggccgatgccgacccccaccccgacgcccacccccacggccgacgcgatgatgctcccgtgctccatgtgtcctcctcgttcctcctcccgccgccgccgccgccgccgacacgacgaccacacctacgcggaagccgacttcgacagcggcatgcaaaactttcaggggcgcggattcggtacgggtgcgatcgaacggcacagacacggaggggcggtatttatagagaggagggttggagagagttcgggtcggtcccgtcgcgtcgcggccaggatcgagccgagcgagcccacggcacggggcacggcggcgtcacggggcaggagggggtggtgccgattgggattgggacgcctcgcggatgccgatgccgacgcggatttggcccaaaaaaaagaggggtgaaatttccggtgcacaaacacctctcggcggcggaatctcgttgtcgcggatcgagtggccgattcctattgtttatttctattatttcgctatactagatagacttggtctatgtgtaaaactcaagtctatgtaaaattctcctttcatcactagggtaaaagtagcaccttttttttctccgccttgtaactccgtcatgccgtcattcgattccctctgggttttttttttctttttaatgctttctgatttggccgaatgttaacggtgacagaatagttgtacgctttagcaccacggcagattggcgaaaggcgtgtgacacttgggccttgggctgtcaacaccaccaatagcagagacgcgtgggggcggcggtattgatggatgtcatgagatcatggtttttgccgagttggggaccactagttcgcttctcgcttccttttcgagcgtaacgcagacaaacgtgcatcacggctggtgtttgaaggttgcgagatttccctttcttgctataacgtctttggatggttgtatcaagactattatgtgacactgattcttattcatcgaaagttcgaaactaccgttggttccacacttccactgtttaaccacggcgggagcaggagcgacccagcccagagacaagtcccgagccagcctatgctaatttctcagggtaattctaggcagaggtatcttccttgtaactatgagggtgtttgggagaggtactaatagtccctctctccaaaaaaataagtccctagatttagtccctctctcccaaacactctctatatatctcaacatgacatgatgagtagtcggacttctgatcctattcaaaaacatcggacggtgtttcatggtttcttcgaattgtgttagcatcgatggcaaggggtgctccctgtgcaccatctttttctgaggcagacattgtgtccctttcttaagaatcagtggacgacatggcatgatccacatggcggtggacccacgacgaggtccaatcataaccatgactagtcgagcgtgtctgaagaagaccaccgagcaatatggcgatgcgacccttttgtcacgtcattgggcttaccacccctagactctcgatggttgaatagctagctcgctcaatggtctccctcagccacacctagttagtcatggttatggttggatcttaccatgggcccattatttgcgtggaccacatcgtatgtcaatcactattaaagagatgcaaattctgtcactctcagataaataagagatgaacattacatatctatgcctgtgaagctgacatacacgctattttttaatcatctatcgtcatggatagccgcaaacctatacaataacccctgtgtatgcatggatgaacttcatttcacttccgtatttgttgatctaataatgacactacagttgcccatgacatcatcattatttttttttaccatgcatgacatcactatttcactaagatgatgtttaatagagctcctgggtgggtcgggggctttaccacaggatgaggacatgagaactgtggcaaattacgccgacaggatgggatggccactatgaagggaaaaggtgaggagggcatggctagtgtgcttctcgatgtgattaacggctaagctaatataacgtgaatggcatttaagaagaaattttaaaacagtggcgaccagataagaatactactcccgataatataacaacctaaaatcaggtgaaacatttcagagtacaatgaatttagtcacgagcttgtcaatattcattgtattataaggtagtgtttggttttgggactatgtgggatgggatagaaccatccctgatttttgagttgggatgattccacttacatgtttggtttgtaggatgggatgatcctaaatttttgtttggttgaagggacgaggggatcaacgatcacctgatttgcccccacagtcctccccatcgccggaggaagagcaagaggaagagctggcagcgagcaagagcaagagcaggaagagaaccatggcttgctcacctccccatcaccggatccgccgctgcccctcgacctcctcctcgcactccgccgccgctcctccctatcgccgaatccgccgccgccctatcgtcggatctgccgccgcccctcaacctcctcctcgcatgccgccgccgctcctccccatcgccgaatccgccgccgcagtcctccccatcgctggatccgtcgccgccgccctccccaccactggatccatcgtcgccgagtcccccgccatcgctgtcgctgtcgcccgagctgtttgccgttgctctcgagggcgagcgcgcgagtaaggcgccgtcacgccgttcgctcgtcccaggtgggacgagttcgtccaccacattttcccggatcggttggacccggatctgagaggaatattcctctctagggaccaacccatcttactcacccctcaaccaaacacccttaaaagtgggttcgtcctatcccatctcattattgcaactaaacactacctaaaatgttccatccgatcctaaattgctatattatgggacatagagtagcaacttttaggtcaaaaataagaaagcttgccaagtttgagaagaaaaagaaaagatatttctctattaaatagtaaagataagagttaaattgtctcattaaattgactatatttcaactgattaagtttttctttggtggaacataccatctgaatttaagtaataaacttgatagttgacatgagtactcgcattctgactttaccaatcttaagacacggggtctagcacccttcctagaaagacccgagcttatttggaatgatttggggggagggggggaggggggcaagtaagggtagggtgtagtattcttctctactctgccactgtttctagccaatagaacacatgtgcatacgcatgcgcacatcacacacgcgtgcgcgtgcgcgtgcacggcaatgatgagatatgctagtgagcgccggtattaaagggttgtctcatttattacaggatctattaaggtaaggtaagatatgctagagtgtctgaatttatactgatatttttagaagtaaaaaagttgtctcatttgttgcacgatctatcaattgtttaaaggttttctttatagtacttccctaatatatgtcgtttgaggtatcacctatagaatttatgggacccatccttttgcttaagccaaatgacatatttgcaaacgaaaataatgtgtgaataaaacttttatatttatatatatatatatatatatatatatatatatatatatatatatatatatatatatatatatatatatatgtttttagcaatttaaaagcaaaagctgaaaaataaacttcgatgagaaaaaccccaaaattatatcgttgataattcaaattttgactgataagcataagcgaaaagatgaggttatgtactaccatataattattttctataatatatatctcgtgattaccagtttgtcactagaaacatacttttatctcttaacacgtactctcttcgtcgcataaggaataggaaaacttgaaaatgcgtagtacactgtgattattactagtaccttagtccttatccggtcagaaacaccaacaaaaagacatataaaagagagataagtgcgatattctgcacaagcctccgacgtggcagagcatgcatgtggaaacctttccgcaaaaggctccgacgatgatgtacagacggactccaacattcacctccaccatccaatgaagtaacaaatgcaacgaaatttcgcctgcaatcatccatgttcttccatcccaagtttacttgagggatcggaagacttcgtttgtcgtgtaggtttcacatgcgtacacatacaccgaatccctatcacctatcatcaccatcaccccgatgctatcctacagccgcccggtcgtttacctcctcacctctcttgtgcacgctaacatacaagtagcttgttttaatattacccgcgacgaccagaacacggcgagtcagtcagtcaacgtgatacggatgcgattttctcctgtagttgagtagaaaagctaggaacagagactaagttgggtgtcgtgtgtggtggagtccaccatggatccatgatgctagcgctgcttgctaatcctgcaacgtttgttcggtgcgtgtccacggttgttgccccgttggagcttagctagttggcgaccactcgatcgacatccgatcaggatgatatgtgtcatacgtggtcctgcctgcccctgtaaaaccccatagcggcaagggccatcgaccgaccggccgcgtccgccgtacgtactacgttcgtgcggccggcctgccgtctccggcaggaattctccgccgcgcgtggcgggtgcgcacgtacgtacgggcgcggccgctggcgttggcatattggcatggtccatcgcgcggacgaaaccgagtcttcgctaccgtcgctgttgcggtggggctcgtatacagttttgtgctcgtttctccctccgatcgagtgcacgtttcccgaagcaacgatcgtctttcatttggtggttgttgtcatgttgggctcgcaagtgggggcggctctgggagattgtgttctcttgggctacaatacgctgggccaccatgaaagggaggtcggttttccggtatggatccggacctggcctggctggcccagcatgtcatatggtccatggcgcggtgtgtagtccagcgaaaaccatcacccacccatccacccaccgcacttagggttagggacgcgcgtttagttaagagccatgtcactaaggaacgcgttaattaatttgttggtgaacgattgaaaagccataataacgattgcgttcggagttgcggtttgtctgtatatccaaattaagagttttgtataggttgcgtcaactagagtttggtgcccgctcgcctaaatagatatataggtgtctgtttaaatgaagtcaagcgtcaacaacaagaaactggagtgtactctctccccgtatcaaaataaaccaatatatcattggagggaagtaaaacttgatgataataaagagatgctcccctgcgaaatcacgcatgattgcaggacgggatgcttcagcacgacatggaagctccaactgattgtcgagttctcgatttaattaaacggagcacgggagcaggatatctcctaacaggacggtggtatatgagaccggaaatggaccctctgacttattatcctctgacttagagtgacttttgaatccacatattagtgacacaagttaaaaataagtaagtttgaggattttaatccctattagacgtgggacgttagctagatgctaacgaacagttgatctcaactcctcaagtcgaagtcacggtgttgtgactttgttattccctctgcttgcatcagaggatctgcgttcacggcacgcgcgcatgttcggccatgcatgtgtgcacggtgcaggccctcaggccacacgtacgcggtacgcgttaacagctcgatcgatcgccgtcgcgtgtgcgggccggacatctgattgcgaggttggcgatagatgggccgtgtcccgtgggcgtatgtgacgagatcgctaattagtttttttcccaccactttcctttttttcttttggcacatatagttttttttcaggttaatttaaagtttacgcgccaaaattttataagttaaaagtttatatattcgattcaaatttaaatttaaatattttttatatagaatatatatatatatatatatattttatacgtacgaaatttacggtatatatttataagttctatgcacgtgtataagggtattattatttttattttattttctaacttgttttttattaatttatggtgcatgaggaggaggagcgtgggggttagggaagggaggggggagggggagggggagggatcgctgtgggtgatcatccgcctattagccctctcccgtacgtgaggcgtggactagtctcagcccgcgcgctcgtctccacgagtgtttcggcagctctaatgtaacagtctatactatagtaatggtggtgtctattctcacatcattcctaccattaacatttggctcccataatatatattattacaccctttgaacaagtcctctctcatttcattataggctcctcaaattttaaaattatctacttgtataataagaaaaatcatagtactactaagactaaataagtaagctagaaacttaatttgttttctgttgcaactcacggactctaggcttactagctaattaacgtacccttacgtcacgtaggatcaagttatagtgctttcacagcctactatatagtccttagtttttttaaaaaaatgtgtattaaaacttagtccatcctatctaacccttgaattttcactaaaatttgagacctatttccacaccctaagtacagtatgcacgcttgtccattctccctactcatgagggagggacacagtagataacggtatccatgtcgacccggtttaagacttaattgtttgacttatgcttgtgcttttaagctaaattttgaattttacaacttaattttaaatttattcattttcttatcatagtttattttacaatatttatttttgagtcattaagaacacgtacacaaaagtattactcgcaaatacttttttatttgctaataagctgtttagagcatcaccaaccgtatctctatattctatccccaaataatttttatgggaatcctaaataaaatttaagatataaaaatagtgttccctcaaacagacttgctaaaactgacctcctaagaactaaaaagtggacccatgaaaaattaccaactgaaattggcttctctctccctcccatgagatcataccagccacgcgtccactgatcgtgctagatcaccgatcggtgtcggccctctctatatgatatagcatgatcgatcccatccagtggcgtagctacctaggtggcactgtggtccatggaccacctaaaaattttatcgagattaaaactatagtatatgtgctagttaatataataaaaattatatagtgtactacctattaaattgacctattacatatagatggaccacctttactctaaattctagctacgccactattcccaactccagttcccctgtagcttcccttgttctctgcatgtcttgtgtcttctgctccttgcccttgctgggtaatcttcattccccttcaaaggaacaaggaaagatagccaaatgctatggtcaaaaccttaacacctataggaaatacatcaccatttacttcctttaaatatttgttgttataatattcttgttcaggctgcaacttgcaaccatcaacaggtctgctgttcctccctggtctttgtcgccaaagttaattgtttgattaataagatgcagctagcacaattgtactggttgatcatacaatttactgcaaaatgacatggcagtgggtatagccagctgctagctatactattgaccttgctctaagtgatttcatcatctaaacaccagcacacatcgcggttggctaggaaagggaggagccaacccaactcgagagtcaggcagtggggcaccaggctgattcacaccggcgcctcgaatcgaagcggcagtggtgcttgggggagcgatgacggctgtccactgccaggcttcggctgaagtgcagttgccaccatatcatgcgccgccacgaggaagaaaaattgacactagggaatcatgggggagctacagacttattccagccagccacgggaagacaatgctggtgacgggatagatcgacacggcggtgtacgagagcgcgaagaggagaacatgtcgccaaccacgcgcgaaggagtgaagtacgatgtattgggaggcagacctcgtccctagaagtggagagcaaacaatccagaatcgggatttccaactattgggagcttcgctagggactctgttggagtcattttttgaacaaaaatctgattggaaatcatatacagacactattggtgatgctctaaacaacgtgacacttaataatagcttgtcaagtagccttcttcctggaataatgctatctttttctcgatcgcttcgtacgtgcctaccacatagctgttctaagagatacttaggttgtgttcttcccctattttcccaacccacatctctcatttttcgcacgcacgtttttcaaactgttaaatggtgtgatttataaaaaactttctatatatgaaagttgttttaaaaaaaatcatattaatccatttttcaaaaaatatagttaatacttaattaaccatgcaataatacgtgctttgttttgcgtgccgggaaggaagggttccagccttagggtgtgttcagaatccccctttcccaactcacctctctacttttccgcgcgtaagcttttcaaactgttaaacgatgtgtttttttaaaaaagtttctatacaaaagttgcttaaaaaatcatattgatttatttttgaaaaaaagctaatacttaattaatcatgtgctaatggactgctccgttttcggtgcagatattttagttccaaactccccacagcgaacacagccttagatactcctactctatatccattcagtttttttttctttttgaaaactataaccattcgatcaatcagcgattcaacggttacacgcacaagtaataaagaaaacaacgtacgagatctagtactgcgtacatacacggagttcccaaatgtttggcgatcttatctgggccgtgctttgtggacgagagcaactattcagatgtactctcttttttcttttcctttggaatgccagtacaaactttatatagcgtgaaggaatcaattgggctgtgtggacatgagtagatcatgggccgtattcgccgcactctgttggtactgtggtgcatggctcataagcttgccagataggacaggtgagaacgatacgagacatcacaactcgatcgcaagttggcgaaacgaacggtggaatgggcattcgaattagaggtggagcatgcgcactacactaaagtgcaataagctccaaactaagtaacaggctcatcgtttgtcctatactcctatatgaagtccaggcgttgctaaaaaacaaaattcaaaacttagctttgaagttgattttaggatgtttttcacgtagttttttatattaccttttaagtcaatcaatggtacatatataagtaagtcattggtttctaatcaactcatggctaatcgatggggcttttgccgcgctgtgctcgcctagtcgccttgccgttcatgcgttcacggttggagctttggtccgattgggtttcacatctttacgcaagttaggtcatgtttgtttcagcttataattattataatctgaattattagaagtaagctgaaacaaacaaatagcttattatctataaactagattactataatatgataatctactctaaaaatgtttttttaattattggatggttaacagctaacaaacatctaataagccagagaaacaaacagctaacaatttattctatatcggcttattataattcagcttatagtaatttggatcaataatctagattacaataattttaaattgaaacaaacagtgccttaaatgtagggccgggttaagacggttttaattatttgaatcgaatttgtggactctaaaatcctcacgtgtaggacggttctcaaatatgaattcagtaagatcccaggacatagtagtactagtaatttgttattaggtacttgagttattttgtaattttttgaataagacggacaattaaacgttatacatagaaacccacaactgcacttaaaatgagacggcgggagtaacaaactctttgaaatattggaatttcaaatgtcgatgaaaattgcccaaaaacctgtaagagcaaataaaaattcaattaatgttcccagaggaatctattctgcacgctaagaacatattctgcacggtcagctccagcacagtggcacagcatttcgcgtaggcatgaagtcctaaaatactttagtatttttcatcttttaagacatgactaaatctttttcatacccgttcagcatggataaaaatcaaagtctctagaatcttcaaggctcccaaaaggcacgacggaaaataagcaaaaaggtggtaaaaaaaaagaagaggatgcaaggaaaaaaaatcctcttgaacctcggaacgtgccatgtgatgtggaccgcaacatattgtgttccgtaccggcgatgtgattaagatggttttaggtcaaaattaaggggcccattccgtccactacgtgacgtccagatcagaggagatcacgcacctgttctcgtgttggcgtcaccacacatggaaaaggagaatacgagtatcacagaataaaaacgagaggactaataaatagtttactgttctaaacatggtttattagttcgtgagtaaatgtaaacaaatatgacccagagagcatcacttgttggaatttggaaagtggcttgactagttaagagctatgacgtgcagtactatcggattcgtccaagtctctctctctgttttttttttgggaaaaaaaatgggggtaaaatgagtgttcgatctgtagtacccaccgtacgcatagtcgtcagtgtgtgctacgcgtgctacagcggagactggaaagttgcacgctcaaccgtgtgacgaccgtaagtcttcgggacccaggaaagtgaattggattactacatcgatgatgggagtccaggaaaaatctgttcgataaaaaagaattggccactctctgttcgccagattgtattaggcaggtgaatgtaggtacaaagcacatattccaatcgtacgtatctgcaacagcattacaggtgcaaaggtggttagttctgggtaattttgttcgattgttcttcttttatccttgtaatcaagttgcaccgactgaacagatatgtacgtagaccattatctaaagacaaaacagataatgtagacaatgcaattattctggcctctcgatatatgcctcaatgtactaccttgctgctagcgatggatctgattaaaatgattattttgtgctgtttgggaattctcggtgatgcctcacatctcatccataataaatttctcggtactaccttgctgcatgctgaagtctgagtactatactccgtacttcataattcataaacttcattggcagattaggtcatagacagcgaagcggtgcggactacagaaacatatacagaggacccatgtcctataatcatgcatgaaaggaaccaatcactggtggagaagtgctttttagttccggttcgtaacccccctgtagtcccggttttccaaccgggactacgaagctatctttagtcctggttcaaatcgatctttagtcccggttgcacaccaaccgggactaaagattttttttcttttttttctgtttttaatattgaatattgatttcacaccatcccctcccatatccaaatcatcacatatcacagaacatctccaaatcctcaaatcctcaaacaaatcatctccaaatacatcacaaactcttaaaaaaaattatatcacagggttctaaaaaattcatcacagattcacatctcacacaaaaatgcatcacagattcacatctaaaaaaaaaatccggccggcggccactgcccgcctcccctccgcgccagccggccgg

SEQ ID NO: 74322 - DNA, 27447 bp, Oryza sativa
ggcatgctcctgccgccgctccccacgaggacgagggagagcgaagaggaagagaaacgagagccgaaagggacttgtggggcccacgtggtccccaccatctttattttttagctgacatgtgggcccacatgggccccaccattcttttcttgatttatgtgtgagactgacatgtgggtcccacgaagtttattatttttccggatcaaattgccacgtatgtgccacgtcaataccacatcagatgaagaccaagtcaaatttgccacgtaggcgccacgtcagctaaaaccaccctcaaaaccgccgagggatctcatctgcactggttttgatagttgagggacccgttgtatctggttttccggttgaaggacgagaatcgaattcgttgacaagttaagggacctcagatgaacttattcagcagaaaaaacaaaggtgcatatgcttggttgctctgaatgcatttttttttcacaagagcttcgatgtatcttgaacggacattgtgttttactgtttacatagtttagatataatatgtttttttactaaaaatacaatatttgctaatcttaaaaaataaagcaggtgcagatccagaaaatggagtcattgaggtcactactcaaatataatggtgtcaatacatatataagagagtaattcttgtttctatagtgtattagcaaagctgacatcaatgcttaacactatggatccgccactgttggtaagaaatgaacgtgctctgcgttcacccatccaaaaacaaattgaagagctgacacggtacggtacacaacgtggggacaaaaaagaaaaacgagttcagaacatacggcaacgctgatgcccgatcgaccgctttatagttgcattctggctggcatcttgcgaaccatgcggttcatgcattcgcgttatattaccagcgtaatatcatcatcctgtgtctctgctgccttcgtactcggtgaacggcccgagctgcgtcacatatgttcgtctctacacgagtgtgactcctcattagtcatttacacgatcctttcaaatggaaacgatccaagggatttataaaagtcgacttgtcctttgtgttcggtgagcagctagctggttgtggtggtgcctctttatagctgaccgtcccaaacgctagctcagaaacagtttaacaaaagcaaaggaatatatcttacgcatctcctttttaattagtcgacactagacagcttatctcctatcgtttctctcctaacccgaccaaatcagcaaaagtcatgcgcatcaccatgggggataaaatataaacaaaacgagatatcataaatcagatgcccagtcgttttctgaactctcctccctgctccgcttcttccattgcattgcatcttaattctgactcgaacttgtttcgtggctcgtaatcacaagcaagatgtctcggaagcaagaaggcgtcgtagagagaggaggagatggcaaggtggtatgggacatggggagctcgctgtacgactcctacgagctggcctcgctgtgccgaatcctggacaggcacatcggcaccgacctgccgtcgttgcacggcgagccacggcaggaggggctcgccgccggagcgccgccgccgccgcctacggagaggaacgggcagcaggtcgtggtgctcagggacgaccgccgaggcaggaccgggaccggcaggaaggtgacgctgcgaacgctgttcagggcagcggcgtcatgggcgatcaggcagaggaaggcgcatgactgtgcctgtgttggcgcagctaccactggagcaatccaaccggttgtctctccgggccggccggtaaaactttgatgttcgccgttcgcgtcagttttttttttctttttttctgctggcatttctatatgtttagtcagtttgtttctatatgtttagtcggtttgttgcaatctgtgcagcttgtaatgtatcttattctcttctaaatggttgttgatcatggagcaacaatatctagtccaacggtgcacatcaccatccgagctagcattgtgcaccacgtgttatccttgttagataatgttagttagtttgttatagagatagattagttctgttaccgcatgtactttcttgtatctatctctatatccaggattgtctcaggttgttgagattaatcctatcctttgtacacgccacggtagaggctctttctgcctatatcaacaaaggtgcggccccgtacaggggttcaacgcttctcattccgttttacatggtatcagagccataccgatccaatccaatctcttgagcgcgacgccatggcgagttcgtcgaagaacaataccggcaaccccctagttggccagcccatatcagagaagctaggaaaatcaaatcacgccgtatggaaggcgcagattctggcgacaatccgaggtgcccgtttggaagggcatctcacaggagatgatcagccgctggctcccatccttcgccggaaagaaggagaaaaagaagttgtggtcagcaatccagaatatgaagaatgggttgcaactgatcaacaggtactcgcatatttactttcctccatgactaaagatctgcttgtccaagttgcaacctgtagaacagtagcgtcggcatggagtatgatccagggcatgttcgggtcaatgacccgagcacgaacaatcaacacgcgactctccctctccacactgcagaaaggtgacatgaacatcaccacgtacgtcggcaagatgcgtgccttggctgatgatctgatggctgttggcaaacctgttgatgatgatgagttgatcggctacatctttgccggtcttgatgatgagttcgaaccggtgatctcgaccatcgtcgggaggccggatccagtcaccattggagagacctatgctcagctaatcagctttgagcaaaggctcgcacatcgccggagtggagatcaatcttctgtgaactctgcaaaccgcagccgtggacaaccacaacgcggcggcagcaggagtggtggcgacagcaaccgcggccgaggagctccaagcaatggcgccaaccgcggaagaggaagaggcaaccctagcggtggccgagcaaatgcaggaggaggaactgacaatcgacccaagtgtcaactttgctacaaaaggggacacacagtacgtgattgctggtatcgatatgatgaaaattttgtcccagatgagagatttgcagggacggctgtgtcgtatggcgttgataccaactggtatcttgataccggcgccacagatcatgtcaccggcgagcttgacaagctaactgttcgtgacaagtaccatggcaatgatcaagttcacacggcaagtggtgcaggtatggagattagtcacattggaaattctgttgttaaaacccctagtagaaatttacatctaaaagatgttttatatgttcctaaggcaaacaaaaatctagtttctgctcataaacttacttctgataatcttgccttcatagaattatatcgtaaatttttctttataaaggatctggccacgaggagaactctgcttaggggtcgatgccacaaagggctttatgctcttccatctccatcctcgcaccaccatcaagtcaagcaagtttatggagtcaccaagcaatccttcgagcgatggcatagtcgtcttggtcatccttcctacactgttgtagagaaggttattaagagtcaaaatttaccatgtttagatgtgtctgaacaagtttcagtttgtgatgcctgtcaaaaggctaagagtcatcaattaccttttcctaagtctactagtgaatctaagtatcctttggaacttgttttctcagatgtttggggccctgctcctcaatccgttggcaataataagtattatgttagttttattgatgactatagcaaatttacttggatatatttgctcaaatataaatccgaagtttttgataagtttcatgagtttcaaagtcttgtggagcgtctgttcaataggaaaatagttgctatgcaaacagattggggtggtgaatatcagaaactccactctttctttaataaagttggcatcactcatcatgtatcgtgtcctcacactcatcaacagaatgggtccgcagaaagaaaacatcgtcacattgttgaggtaggtttagctcttcttgcttattcctctatgcctttgaaattctggggtgaggcgttcctttccgctgtttatctgataaatcgcacacctagcagagttctccatgatgtgtcacctttagagcgattgttaggtcacaaaccagattacaacgctcttcgtgtgtttggatgtgcatgttggccgaacttaagaccatataacaagcataaactccagttccgctccactacttgcactttccttggctacagcacacttcataaaggttttaagtgccttgatccatctactggacgtgtttacatttcagagatgttgtttttgatgaaacacaatttccttttaccaaacttcatcccaatgctggggcaaagttaagggccgaaatagctctagtccctgaactagctgcttctttacctaggggtttgcagcaaatttcttctgtgattaatactcctgaaaatgctaatgtgtctaatgagaatatgcagcaagattctacatatgataatgaaccagaaacggagaccgacggtgcaccagacacggtctcagctaacgcgccagcagagtcctcgggatcgccgccgattaatgaaccagcttctccgttcggcgaatcggacagcgccacggcgtcccctgcatctgcacctgtcaactcggctccgcatccggacgctgcagcctcgggatcctctgcgccacgggggagtacaagtcagggaggaactccttcagtcgccacagatgggatccacacccagccacgacagtgacaggacaggaggcacagcgcccgcgcactcggctgcaaagtggcatccgaaaagaaaaagtctacactgacggtacagtaaaatggggtatgttaacctctacaggtgagcctgaaaatttacaagatgctttacaaaataataattggaaatgtgcaatggatgctgaatatatggctttgattaaaaattaacacatggcatttagtcccaccgcaacaaggtagaaatgttattgattgcaagtgggtctataaaataaagagaaaacaagatggtagtctagacagatataaggctcgccttgttgcaaaaggatttaaacaaagatatgggatagattatgaagatactttcagtcctgttgtcaaggcagcaactattagaattattctgtccattgctgtgtctaggggatggtgcctaagacagttagatgttcagaatgcttttcttcatggtgttctagaagaagaggtttatatgaaacaaccaccagggtatgagaacccttccactcctgattatgtgtgtaagctagataaagctttgtatggattaaagcaagcgcctagggcatggtactctaggctaagtggcaagcttcatgaacttggcttcaaggggtctaaggcagatacatcactattcttttataataaatgtagcttgactatctttctgcttatttatgttgatgacattattgttgtaagttcaaggaaggaagcagtttcagctcttctccaggatcttcagaaggagtttgctttgaaagacttgggagatctacattacttccttggtatagaggtaacaaaaatcccgggtggaatacttatgtctcaagaaaaatatgcttctgatttactgaaaagagttaacatgagtgattgcaaatctgttgctacaccgttatctgctagtgaaaagttaattgctggtaagggtactattttaggacccaatgatgctactcaatatagaagcatagttggggctttacaatatttaactctgactagaccagatattgctttctcagtaaacaaagtgtgtcagttcttacataatcccactacagaacattgggcagcagttaaaagaattttaaggtatattaaacaatgcactggacttggtcttaggatatgcaagtcttcttctatgatagtaagtggatactctgatgctgattgggctggatgcttagatgatagaaggtcaactggtggttttgctgtttatttgggtgacaatcttgtttcctggaatgcaaagaaacaagccactgtttcaaggtcaagtacagaggcagaatacaaggctttagctaatgctacagctgaaattatgtgggtgcagactttgttgcaggaattaaatattgttagtccagctatggcacagttatggtgtgataatatgggagcaaaatatctatcttttaatcctgtgttccatgcaaggactaagcacatagaagttgattatcattttgtcagagagagagttgctaggaaacttttgcaggttgattatgtgtcaaccaatgatcaagtagctgatgggtttactaaagctttacctgtgaagcagctggaaaatttcaagtacaatctcaacttagggaaagttgtgattgagggaggatgttagataatgttagttagtttgttatagagatagattagttctgttaccgcatgtactttcttgtatctatctctatatccaggattgtctcaggttgttgagattaatcctatcctttgtacacgccacggtagaggctctttctgcctatatcaacaaaggtgcggccccgtaaaggggttcaacgcttctcattccgttttacaatcctccttcttcctcctggtgttggaaattcgttgatcgagttgaaactctcatccttcatcatgtgctgcagaaactaacgcgtgcacagatgatggatgggtgtggtgtgacatgaaagtggatcaatgacacgcggcacatttaggggagtgtgtcgtgtcttgacttcttcatgcaaaagtataccaaccctgtataaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaagcatctttgtgcggtgctgatgttgctgtataattggctctgtatttatgttctggttggtgttatgctgaatcgctgataagtgataactagtttagccttcgggctggtgtgttcaacaaaaccggtatgggactagtattcggacccggactcgcgtcggactcacaggctcacagccggtagtttccatataaagccgagaccaaccacgcacaatagcagcagatcgatcacgtattcacgtctcccgtagtcccctcttcatcacacccggagaagaaagcgatcgaccgaatcaagcgagaagatgcaggccgtcgcgcgggccgcgtctcgctggtgcagccgctcgctgctttcccggccaccgacggcggcggcggcggcgggctagcgcggctactgcggtggtggtgatgtgcggtgccgatgcgccaccgccgggacgggcgagaccctcgagacgattgcgacgaggctgcgtcggcgcgaggcttacaccaactgtgccgccttcgctgtctccggcatcgtcacggcacaggtgctgcgctactgtgatctcaccagcggcgaaggaaaatcgcgtgctcgcggtggaggaaaatcgcgtcctccactctacatccacctggtaacaggcgttgttgggctagcattgatattcaaaagctctctttgaagtggagatctaataatgcttttttagataatagttttttcattaatccgatctctatagatatacacagccaaagagacctaataatttaccttctgttcttgtgctcactgttattgttcgtctaacaaaatttatactactagtgtgctcgttcttactacgcgttttgtacaagagaggactggaaagttggtggagacacgtctcaatttctattctttacctgtttaagccgggtttataatataatacatacaatttctttcagaacaaatataatatatatgttgcacttgcatccaactaaatagacatttattttcaggactatattgaccattcctctctccaatttataccgcatttgaggcctaaaggacctcaatttccaggactttacactgtccactcctttctctagtatataccacatttgatgcgtaaaggacctccacacaagcggacatatacgcatctaaccaaatctattgtgtttctaagccgccacatgtcaactctcgtaaattagaaaaatcttaaaaattctgagaaacaaaagcatagccgccacatgtcaactctcgtaaattagaaaaatcttaaaaattctgacaaacaaaagcatagcatatctagtcatttattttcacttcaaccgatgggtccactattttagtccacactactatgggactaatcttgaaaataaatcagcatatcattacaacatatcatttttactcgcatttgagaaagttcaatgtttggtctcttatagtattagcacaagtatgaattgccgttgagccgcttcttattatcaaagtttcactttattactttcaactagttaacttttatgcttattgtactttggaccaccttaattctctattttctagcaatgtttagccttacttttaggtcaaaactaatttaattataaaacttttatgtgttcgtagtgatttaaaaatcaatgctgaaaaagaaattacgttgaaaatatcttaaaatcaacatcaaaactaagattgaaaatttaaaatttgtttttttttctttagcttattagacagccaatgtgtggttcttagcaaagataagtctcccatatagggaggaagtttgctgatgtgccagattcgacttaagatcgttgatgtgttaaaaagtggtttaggagggtcaaaattaggacaaaggcaaaattacctagtccaaaatttaaaaagtagaaaaaaaatggtttaaaacaaaactttgttaataaaagatggtcaaactttcatatactcttaatttaatatagagggaaaaaattattatgttcattttgaattctacgaaggaccacaattattgcaaaaagaagatacatatagtacgatcttgatggtccaaagtataacaatatagattaatcgatgaagtggtatatagaataattgtacactatttattaaatctcattctatttataaatcgagctttatacaataaaaaatccactagcctgttttaaaaggacaggacagcgaatgttggaaggccacaatttaacccccgctgaggagagcattcattgcaaatttgcaacacatgcttttgcatgacaaaataacagtacgatacatggaaccttctcttactagcaagaaaagctatgtgccagaatctaagagtacgcgaaaaattcagtagtctatttccaaagacaggaaatggatttttttttccatcgagggacatctttcgttttatgcatgtgttaacaaccaaatttggtaatatcggcatcggagaggaaaatgggatcgaagcggaatcaaagataaggattgtcgtataaacagagtaagaatcggcgggagtccgaatcggctacgattaggatcggctaagtctgggtcagattgggttaaataattcagccgattccgacaatacgacttgtgtacgacatcgggttcaggttaatgtgcttcaagatgattaccacgcacggatagagtcctgggaaggcaattgtatctattaattaggatattttatgtaaattccttataaataaatatgggcaaaagtctgccacaaagacttatggtatcttagagtttcttagagataatagtcgtatccggtatggacatatcttgtaattctcgggtataaatagactccgagtcctatgtaattgataacacacacgttcaatacaatttcggcgcatcaccacccttttgctttagttttattttgacgagttcttgctttcgggttgagctgcatcggtttcgatcttcaacaagaggtaaaacttgttatgacggcttgtatgctcgggattagtgcttccatctttatgatactctaatcttgtttatgtaattcgtcgagttatcatatatcttacataatctctggcaatatcactatctaacctacaatcggctaacatccgttagtagagggcagccgattaggttagattttgacgttgatctagattatataagatatctaccactctatgaaacttccatcggtttgattgtctagatattgtccttcttttcatacttaatgctgcatcagttgagtttgatctattaagtcgtgcttagaatatagatctctagcctgccttctggttgtcgattagggtagcatcggagtttcagccgatcttatctgatttagctatatttgttttatatgcctcattaacatgttaaatcttccctttacgtcaagatattgctatatttaagtatattaagattttgcttgatatattatacttgttttaatatcctgatatagagtagtatcggagtattagccgatacatgctaggtctatctgatcggctatgctataaacatatatagtcccgttattaatatatatttcgatctaagtgatttatactgtctcggcatggcgaccgatctatcccaatcacttgatttaaatatatatcgatataagaactatatattggtaatatctacagccgatcgagtaggtttagttctttattatctatctataaccgccgatcgattcacatatgacatcggctcaaaaataaatgatatgtcatcggcacctagccgatcggctatcatttatagatttaatcacggttcctttgcttctatttcttgttgattacaggatcaaatcaaccggcatgctcatacatccgaaggcgagctttggatctgcactggagttaagcagatctcccaggccacgtgttttctgtcaacagcatgtcgttcaaagttattaaaaatattttaaaaaatatcaagatatatcaatatatgatatattttttcacaaacatgcgagttaaaattcgacttatacaattcgaaacaaaaataaaaaatttgaccagtcaaatttgttatttttgtttctacttgtataagttaaattcgaatttgtatgtttgtaaagtgacatatcacatattgatatatcgtactttttttttctaattttttgataactttttaagtaacatgcaaaaatgaaggaatatcccttaagggatgaattgagttttccccaaaagacaaaggaatggatgttggaagaccacaatttatacctttgctaacaaaacactgattgcaatccatgcataagaaagacagaaaaaaaaaactgcggtacaacgcatcgaagctgatcttactagcatgaaaaaaacccgttcattttcaatccacaaggattcctaacacgtgggatttcgttccacgcaaatgagtagcgtgcaaaacctccattgatatgcccctgcaggttcgggttcccctggcaaaaagacgctgtgctacggaaggaaagaggaaagaaccgtctccatcgaacgcgttctacccattaaactcgatcacgaacacgaacacgagagcagcttgcgctgctattctgaggccatctcgggcgtcctccggcgggcggtgggagcgccgttggtctggaggtgatcgtcgggcttcacgccgagcgcccgccttgccgagtgcggagtcctcgccgccgtgttcacgggtttcaccttcggctgtggccctgcaagcgaaagtatcagcccaatttatcatctcgcttgattgcgctagctatgatatcgatgcgaaatgatgtgaaattgtgaatgatctaaaggttcttgcaaagtgaagtgctttctggtacggtgatagctactccaacgatggcaaaatggcaaatcagatatgtagatgctggtgtgcaagaaacatcggaacggctgtaccataaatcagattatccgaatcactttttgggtacggccatccatcatatcatacgccatcttaccaaacaatgcatgcattccatttgatgttctacaggaaaactgtataaattttatggattttcagctgaaaatcatacgttccaatgaattctatttgcagttcatggaatgagatttaaaaaatgtggtaggataaatacctgcttgcctgggcgccttgccgtccgccttcttggccgtcggcaacctgccgtcgctgctggccggccgcgaccgcagggtgccgttcgacacggcggagaaggtgtgctccggcgacattgcaccgaacccgttctcgtcgccgtacagcgagttcccgtcgctgcccgaatccgaggccctgtccttggcgacgtgcacggcgccggcggccttctccctctccatgaccctgtacgcgaacatctggaacggcacgtcggcgacgcgcggcgcctcgccgccacgctgccacgccgggagcttcttcagcagctgcgcctcgatgtcgaggtagtcgacggccggcttgggcgcgtcgtcggtctggccctgctgctgctgctgctgctgctccgggttcaggatcaggaaccgcttgacgtaccggaggacgcggcagatggaggcgaacgccagccgctgcgccgggtcggcgtgccagcaccgcttcgtcagcgcggtgaggtacttgggcgcctggaacgggaacagcggccgctcgccggcgcagatgttcttgctcgtcttgtcgccctgcaggtggttgtcctcgaacggcaccttgccggtcagcagctcgaagcagatcatggcgaagctgtacacgtcggccttctcggtgcacctccccgccgccgcggcgtccgcgacgccgtcggacctgagcacctccggcgcgtaccagatgcaggagttgtcgttgccgttggcgttgccattggcggaagcttttgcgccgccggctgtgatgccagctggctgcccatatccggcgaccttgacatgcacgtagccgccatcgggttggcgcggcttgacgagcacgttggaagggttcagctcgccgtggtttatcctcttcgcgtgcagatactccatcccgcgcgcgatctgcagcataatgtcgacggcgacgacgagcgggaacgggatccgccgccgcgggcagctcacctccttgacgtagctcccgaggtccttggccatgagctggtccatgaccacgaagtactctttcttctcctcgtcgtggaagcagtacgcggcgtgcgcgacgttcgggtgcgccaccgaacacaggagcgcgacctcggcgccggcggcatcggtgtccccgatgaaatgcttcatcgcaaagctctcccccatccaatgcacctccttgagccggccgccgagccgcctccggacgctgtagtcgctgccaagaaggacagatgccgggtgcagcttccccatcgccgcggcgaggagctcggcgaggcggtgctcgtttttgctcagaggtttcgacgccgcagggcctttcatttcgtcgaacatttgcgatatcacccatctgtcctccttccacgccatgtccatccttgcaacgagctcttgggagaccagatatagcttgccgaacgcgtgctcgaacagcttgggatcgagcatgtccctgtcgtacttcctggcgagcaccagccgccccctggcgagctcgtccgggtcggagccggcgatctcgccggcggcgtcgatggcctcgagcgcgacggcgacgcaccacaggacattgtggaggtgctgctccacgcactcggtgccgtgcgccatggccgcggcgcgcgcccaccagctgccgcgggggtccaggcactgcctgacgtacgcctcggcgtcgcggaaggcgcggtggagctcgcggagcggcgcctcgatggcgcgccacttggcgccgcgctcgtcgaagcggagctgggcgcgaacctgccccgtgacggcggcgagcgcgcgcgcgcaggcgtcggcgaggaggcggcactgccgcgggttgatgtggaggtcgtcctcgaacgccatgagcgcgttgatgctacccaccgcctcgccgagttgccggagctgctccatccctatcggcgatcagccttgcctgccgataggacgatggatcaagtgcgcgcgctcttcttgattgcttctttcttcctctgcttctttggatggcacggattgaattcctttcctgacaaggataaaaaaaaagggaagaaactgatgtcaaacgtgcgaaattttcatccaaagtgctttgatcggcgtatgaacacgaacttgattgtggtttgatgatgacaccaaaaatataaggtaataaatgcagaaagtaaattttatacatttctgaacattttacagttgttgtttccatctgtttcttccagcctccaaccattttaggaacattttggtgtgaaccgagaagcatcgaatcagcaaaacaaaacttcatcaacactgcacaattcagtacttttcatctgaacggaacatattcaaacaccaaataattcaacgaaataaactaaaaaactattcaatccatcaaacacaaaaaaacatactgtaggaaacaagaaaccaaaagatgaaatcgaaacaaagaagattaaaaaaaaaacatgcacatgaaagatgccactgaaagataactcacacaagcttgtaggatcgcggcaccagggcagcagtctgaaatccttatccgaccatggaccggcgtcttgcttcaaggatcggccagagaagaaaagcttaagagagaggtgcgagagctctgacgtagagatcccgcaagagagacaacaaggaaagggggaggagtctccaaagcaaaaggaggacgatgaccaggatgccgacgaggagaaggagaagaaacaagaagaaaaaggagcaggaaagcgccgttttggaggggcttaaactgcagggagttatggggagcagcaaagcaaacgcggccgtttccttcctgaatcgtgcgtgctgctgctaaccgcgagaggtttttcgcagccccatttttaagcagcacacagcagttgctaaaaagaaaaaaaaatctctcccgtttctttcttttttttggccatcgctgtacattgactggctaatactagcacgcaggcgaatggtgtgctgtcactggcccaaatgctcaattgttgcctgaacttgctgaatttaccgtgatgagaagagtttcccgaataggcgttctaggtaggtttcacatgcagaaattgcatggggtgtgagccgtccgatcatgcatccaacgggctctaaccactatacacaatacactaacacttaagtattcagtcaggttcaggctgttttgagacttgcgacaggttgctctacgctgtttgctttcacaaactgtatacgtgatggtggataacgtagccgtcatcgtcaggtgctcggtcgcttggcacgtctccaatgccgcgcacgaacggggtaagtgtgtgctctaactaacggctttgtactttctgctggtgtaacctcctctcctaccgcctttcagccgctgatacaagtagaaaacgatgctgtacactgactctgtggcacggcactgaccgtttctcgcgctgacgaccaactctgaactctgtaccattgaccggtatgatttaaggtatttaatttaatccatgccaccacgcaaaaaaaaaaatcaaatatgtcaacgttctccacttctcctcccagaaataatgggagagaaaaaaaaactatcggactatggaactggagtagattatctagtgaagcaaatatatttagttctctctttggtgacattttgcgttgcttgtcacggcgccacttttcttgctcacggcacgattaggccgccgccgccgccgccaccgcgccgagagcacaatgagaggcagcgagggagcgccacgtggcggctcacggcccggacgacgtgggggagggggggaggccggctaggttcgttggtatccgttgcggtagttgacgcgtcctggtccggtcggttgccggcccaaccgcgcaagaactgccctttccgtgtggttggcaggcagcaccaaacacaacggctcaggtcacagaaaagtcgcgcacgacgcaccccggatcaatttatatttcctttttctgacttagctcggtcagcagagtaggtacaatagcaaactattagccggctataaacatattttaatgtaataaaagataagggagaaaagcagcggactatagatctatagccagctgtagtacggactccaagacacagtgtgtatgactggtggaaccatatattaataatatagtaaacaactattatatgaattggctattagattgactatagataaattgaagctagtagtagtggactgtacacttgctctaaccgctctggtgcgatcacaggcaaccaaatggaaaaggatttttgaggatctgccacacaatagtggtttttgaggacacatgaactacgccgattccaccatactcatggacacatgaagtggcaggccattaattagagtctgtttagtaaggtttaacttttaaatttaactctaggagttgaatttagagtgaagttatagaataatttgaattcagtttgacctatctagttcattctctgttactagtatcttatcgagtgaagctggaactaaagctatactaaatttgtccttgttcaagcttctctaaccacattgagtggttaactacattgtaatataatcaatgaaactctatgtaaaaaggtactttcgaattcattctggagaaccttattcgtacaatggatgtcgttggatttcctacaccgactcttagcttgtcgatagtagtcatttgctatttcacaccttccgtagctgcatatgggcaagcgggcaatcaatttgcagttcagttgtcctctgatgataacttcatctttgacgcggttgctatgtcactactaggaaaacgatttttcatggcgttggtctataattttcgctgacggaaaaataccaaaaccgctagcaaaattgtaacgagggggtaaggggcaccgaccgccagcgaaaatagatctttgctggcggtcgcgttataccagccgccagcgaagatatgtctattatcgctggcggtcacttaggtgcgccgccagcaaagatggataattttcgctggcggttgtgttatacagaccggtagagaaaatgcaattattttttctggcggcccacttaagcaatcaccagcgaaaatagattttcgctggcggtagaaggacagcttgcatagatggaccaccatctattaatatagaccacgtggcccaccacccacccgtcccctctctccagctcccctccctcccttctctccctcgcgtctctcctccctctcttctccaccgcctccggcgccatccatcctcaccaaccagctcctcccaccccacagtcggcggcgacggtttaggcgtgacgacgacgacgcgaggtgggcgtgcggcggcgacggtaggcgggtgggcaacggcggcgggaggcgagctcgggcgcggcggcgctcgggagcgggcggcggctcgcagggaggccagatccgctgtcgctgggccgcggggaggccggatccaccgcctccgtgccgcggggaggccagatccgccaccgtcgaccttgctccgtcgtcggctagatttgattttttttctttttgcatgttgttccagatgatgcacatgttttgatctgtgtaaatcatgtttgattgtgtaaatgatgtttgatatgtgctgatgataattttgtatttcatgtttgaatttggaaatgagcagcgaatctagatgttgatttgaaatttgaaattaatgaatcactgggcggctgcatgagtattttcgctggcggctgtcttaagccaacgccagcgaaaatgtatttttgctggcggctggcttaagatgaccaccagcgaaaatgtatttttgttggcggtcaataaccgctagcgaagatcttgatcttcactggcctttgctacattttcgctggcggctggcttaagatgaccaccagcgaaaatggatttttgctggcggtcaataaccgctagcgaagatcttgatcttcactggcctttgctttgtggcggctgcaaattccgccagcaaaaatccaaaatggccgcaacgaaaaatggttttcgtagtagtgtgtgatgtcacacacaacatgtaggtttttcaccaactatagaaggtgtgtttctgtgtgttccaaattccaattaattttctttgttatccatcaaacaaaccgtgatcggtaatacatagtcggttgaactacaaactatatactaattggttgtaacctctttgaagtagagaccgaaatacactccattatccctactactataaaagggcagtcgtatctttccttcatcacattgcacatacaactaccccatcctcaagaaaatcaggaaaaacaaatcaaacgattggttaaaaggaaaatcagaaaaaacggttgatcttagagcaatcggttagatccaatcccagtatactcactcatatcacatgagccagttgcaatgcacgggcggcaaaacgtagagaaaaccgctctgtctctaaaaaaaaaaggaaaaaaaaaaagaactcttaacgaaacaaacaggccagcttatataaatgctactccattaaaggcccaaagccacgaccgcaaattgggcccaaaggcctaaccgcgttaacctgacggcccaaccaggcgaccgctctctccgttttcctcctttcttgcgacttccacctcattcctccccctccgacgactccgatccgtagagatggaccggttccgaccgctcaggcggatccaggtggaccccgagcccgccgccgccgccccgcccccgccggcggcggccgcggcgaacggcggcgcgggggaggacgtgtcggcggcccccgcggcggggctcctcatggcgtcaagggtgcggcgccgctcggcggtgtaccgcgactgcaagggcgactacatcggcgtccccaacgacccgtgcctcaccaagatcctctccaagcaaggtgccccccgcccctcccgtttctttggtcggaaattcgtgtgctgtggcctgcggggtgcgatcttgggttggtaggttcggatcgtgcatgttgcggtggttcagttgcttggatctgatccgtggcggaggtgtgattttcttttacccctccgatgtggcagtgctagtttggataataaatttgtcgtgaattgtcaatcagctattaggtgttgattcgatcgatagctccatatacaagttaagcccccgtagcaaagtgattttgattgtgcgatttgatgtgctgaaccatgcagagattagagctgctgtgcagtttctctctgatttttactctcttgagtgacatatagaattggctaatactgctcaatagttggttgacaacctgatttgatgcaacctagctgctaaaggcgttttaaatcattcgtttgcgtgaatgctgtactagtttctaatcattgatgtttaagagcctattgtagcgtgaagaatcatctccaagcagaggaaattgtttgcggcacggcaattgttggttcctgctgctaaatatgttgtactatgcacagcatatgatattctcactgtaccatgttctttttgtatttagcatcaccagatttctaaagcaggtcatgacctttgatacattgcaggggacaacaaagttctgtttgcagataaggtattgaagttcactcaatcaggaaagatgaaaaggcgcatccttgtgatcacagattttgctctctaccttgttgatcctgatgctgatatattgaagaggaggatagcgctcgcggctgtcgataagctatgtataagcaagctcagtgataacttctttgcaatcatcgtgccaactgagtatgattgtttaatggccagcactagaaagaaggaaatagtggatattataattaaggctattaagagcaattctgaatatcagcctcaagtggcttcttctaacaggtatatggctacggtctttgtgatgaagctttggtatcccatactattaaccataggatgtactctgaacaacatctcacatgtagctaatttttctgggaatgcaaacgtatgagattttaaatcccaaaaacacttggaagttagaactgctattgatatctattttcctattagcatctactttatgagagcaaatgccaactgtcgtgataacattattcgtgattagttgctactttttactgaacctctcagcattggttagtgtcgttgggttcagtcttctgatctagcacctcagatgcctttagacatttactgcattttgttgccagtctatgatagtctaatttgtcaggttcttctctctgtaggtttgaataccatgctgctgctgaagtgattaaagaagttgagtttgaggaagctgaaggtatgtatctcatccttcatgagcgctagatgatatcatttgcttggttattgagaaattggaataggtctattgtagtgattctatgagttctacactcaatcgtgtgcattttcttccggtgccattgctgatttttgtttagctaatgctggcgatctatcctgtttccattaaaatttaaaagaaggatgcaatgcgttcttagatgttattgcttcatacttgacattagattcgaaacacttttgcttgatgaatgctcacgttgctgatttttcaatacaggaggcgttaaaactaggatcacgcacaaggcgaaggcgaagtcatgattgagaaattatgtatgattgttccctgtaaaatgtatagttcttcgagtttcaagggattcttatcagcgctctttatgcaaagttcaaacagacaattctttgatgtattgtgccttctattttctctgatgtttctctgggaaaaaaaaggtgacctgtcgctgactatatacactatcgctagatttttctttttatcataggctattgccacatgcttttgtgctattggaatttcgattttggctctgttcgttacctggagttcccaactcccccatctcattttccgcgcgcacgcttttcaaactgctaaacggtgtgttttttgcaaaaagtttatatacgaaagttgcttaaaaaaattatattgatccatttttttaaaaaaaattagcaaataattaattaatcacgtgctaatagactgcttcgtttttcgtaccggagggatgggatcccaactcaacctgtctgttagagtcttgacggctcactcttttggagaatggaataatttattcatggctagctctgtttgtagtcaacactgggccacataaccattgatacaatcgagaccaaagtagaaaaatggaatatgtggccagctgttaaactgttccagactttggcacaccacctttgatttgggacgctgttccaccaacttatatgccataaaatatctgcaaatggtgcgctaccacactgtataacaaaggctgtccgtccaatgtctgtccagatcaggggagaagttcatctggagcactgcttcttatttaatagtaattcattttttttctgtataaacaacacaatcacaaccaagcatggcaaattagatattgggtatagatgctccgtgaaagctgccacgcaactccgcgaattaagccatgtttaagagcgtacagctgatctgttatttattagtcgtacaaagcatgtatggaacggccacttagatgagatcgtttcactctgatttcccagagaatcactaatcaccttttgattaagtaaatgacccctattgagtgagtcacttgtccttgctccgtacttgcctaggattagaacagcatgattcaacgaatgtgctatcaagtggcaacgtttgcatgagaaaagtcactgaactatatggtttcttaaaatattcattcaaggagctcaaagagaagtgtgctttggctagctagtctcgcgaacgcgtcgtcgttggctcgttccagttccactgcacgcgacgccacaaaattgcatcgcatattcgcatgcatgcatttttctcgtttccagctaattaaaatagcaaagtccacagtctactgtattttagaaacacgtatacaagtcattgaccatacaagaagtacgtcttttccagcaagcgtatacactattttctctgatttctttttacgataacataatacatttgtcttaaaatatagtaacttagtactcgattaaatactacataatattatgaataatgttaagtggtatctaataaaatgctggattaccatatattttattttaatacggagagagtatcggttggaggagggatctgctaaagtttatcacacgtcgagatcagtagatatgtgccctttttcttcatcctccagacagatatgtgtctattggtgctacagaattccaccaactggatcctaccaatgagttactaccctatcacgagcccaaaggccatcatactcccatgcatcatgcatgaacctgaacttcctgaaagaacggggagaatattgcagagggcgaccacgatcgaccacataaccgcggggaaagaaaatatcactgttgatctatctacgatctccacatatccatccatcctttctttctatcctcggagaaaatgatggaatagaagcgacgaacacacatcactagccctgccaacctcacgaacacaagatcgccttgacagggacggccaccttcgcatcgcaacacattggcctcccttttgatgcaaaccacttgtgaaattgtgatctccgccttggagttttgcgatgaaaagaaaaaaaaaagagggagatgaaaagaaaaaaaaaagaggtagagattgattggtcaaattgcgttctggtttgcttgctaatccgagcctagctaccgagattttcagtaggagtaatcgttaagtagtagtaagtagtacttcctccgtgtcataaaaaaccaacctagtactggatgtgacaaatactagtactacgaatctagatataactagacatatctctgttcagatttattgtactaaaatatatcatatgcagttctagatttgtttttttgacggagggagcagtacctaaccagcgttcgatggaatgtaaccatgcaatattcaggccagagtgatggaaatacgagttgatggcacaagaaatagtggtagtgatgctgacagcacaatatccaaccaacataagcacatagccttatgatatcagttgctctttcaccggttccaatcaggttcccaatttcattagaatttcgtcgtacaaatttcgaagctctcttaaactgcttgtttttttttctatcgaattttgaatgaaatttggcggagttcattcagaattcacgaaatttgacatctcggtagtcgctgggctcgcattttaaccccagaacggaattgtgaaccttgcttccgacatggtgatgagtagcagagccatcactctctggctctctcgctcatgagaaaattcaccaatggataaaggtaactgaaagtatatgaaacagtaagcagtatatttcttgtccgggatcagagaaaggagtagacagggcagcagcagatagacaggcaccatgtgtatcaacagcaacatatacagtacatgtacagaaagctaacatggaaatctgcacatttacagccaaagatcagatcagccagtttttttttcccttctctgttgccatcttgctatcttttgacaaaactaagaccttggcatacatactatcaaaatattatatccaaaatactttccaacacgacaagatcaggagctttttggcctacagagttgccaatgaaaggggttataattttcttgcatatttcttcaaacgataactcagcatatataaagtagcatgccactttacacaaatgcagatgccacacggctcatctgcattgtttgtgcgtgggttgtggttgttctggggtgggtctctcctctggccgctacagctttcggctttggcctgactctaatccacactaagagatatcctaagcatattccttggagattgggtgagcaaaactgaaatagttaaagtgttctttcagtaatgccaatagacatgcatgccaaatggaattttagcatattccttaggctatgtttgatactacgggtatgtacagattggtgtcaaaataaaccttagcaaaggggctgttcagattgatgctattttcaaccatacatttttttaagttgccaaaaaaaatctacgtttagtttattgccaaatttggtaatacataacaaatcctgtcaaaattttagcaatattgttatcttcccaaaattttagcaatgccaaaatttggtaaaagtttattttggctacaatctgaacaggcccacaatgccaaaattttggcaaattggcatcattgccaaaattttgataggattggcttaataatattgccaaaattctatacacatagccaatatttggtaacaaattaaacgtacccacataattgtcaattttaccaaataatgatatggatgaaaatatcatcaatctgaacaagccctacaagttggaaattaatcctccatacaagtaaaacatagcaacttattagtacataagcaattaagtattagcttaaaaaaagtgaaaatagattaatatgatttttaaaacaactttttatagaattttttttaaaaaaacacattttaacattcggaaacatgtgtgcggaaaacgaagtagtaaaggttgggaaatgttagtaccgaactcaatctaagtactactacctctgtcccaaaataaatgcaaccgtgggtatccgtgtccaacgtttgaccgtttgtcttatttgaaaaatttatattttttttaaaaaataatcatacataaaatactattcatgttttatcatctaataaaaagggtgaatagtcaatacggtccctaaagtttcgcttcgggctcaatttagtccacgatgtttcaaatcgtccaaacgagtcttccaaattaattatttgggttaatatagtccttggacccaaaaaagtgccacgtgagcacgccaagtcatcctcgcatgcagcggtatgaataaaatgaccattctacccttatataccatatagaaaagaaagaagagacacaaacaaaaaaataatagaccagcccaagcctagcattgttatggatggatggcagacaaaggaattacacgatcaatgcttggctacaacaatcataagtgacaattctaaaacgatcatacacatgtaaaacatttatcttctttttttctttcttttatatatggtatataaaggtagaatggtccatttcattcatacctctgcatgcgatgatgacttggcgtgctcacgtggcactttttgtggatccaaggactatattaaaccaaatgattaatttgaaggacttgtttggactatttgaaatcttaaggactaaactgagcctgaagcgaaacttcagggaccgcattagctattcaccctaataaaaataaaaatagtaatcataaaaaaaatttcaaataagacgaaaggtcaaacgttggacatgaacgcaaaactgcacttattttgggaaggttggagtactaatatagtgcactgtacattatggatccacagctttttactccatttgacgataattttttatgtttaggacaagatttagttaaattcttaaaactttatacatcaataatttctcaatggttagaaagaatgagtaaatttgcctttaaaagtagtataaagtaattatattttataagattattctaatacaagatcaatcgtcaaatttatgcatacctttttttattactccctccatattttaatgtatgatgctgttgactttttaaccaatgtttgaccattcgttttattcaaaatttttgtgaaaatataaaaatatttatatcatgcttaaagaacatttaatgatgaatcaagtcccaataaaataaatgataattacataaattttttgaataaaacgaatggtcaaacgttggactaaaagtcaacgacgtcatacattaaaatatggaggtagtactaaaatataccgaatgatgcattcgagaagttatggatggttgaagtctcaaaaggttgccagaaacttatcgtagatgtcatatatctatggaccatgagtgataaaaataatctaacttcagggctcctttggaacaaaggaaaaaggaagactttgaagtattgaaatcctttgaaaacaattcctatatgattgtttggaacaaaggaatgaggcccataaaatcgtttggaattcctaggaattttggaagaaatttaccgagaggcaagatcttatgttttctctccttgtctctcagaattctcctatagtgctaccaaacaacaaattttgcagcctactatggaatttagtgagacatgacatcatattactatttctactatctgtattttcaaaaatcacgcgcttcaaaaagtcctcactcttttttctccccgtgttattgattccagaaaacaaaagaaacaaacgagtttcatggaccatgcatctctactattataaaaaaatgaacatgtttttgtcggtattttgctatatcatccgtgtatgagtcagtttttaagtgggggatccact

SEQ ID NO: 74323 - DNA, 7332 bp, Oryza sativa
aattctaaagactgatacattgcacaaactctgaccggacgagacgcactgtctcaaccgtgtcgtttgagaagcactcacttagttgctttcagaaaagagttcaaataaaatcaattgcaaaaacaacagcctttccttgaagcctgcattaaacacttaattcccatggcttgctgagtactcccgtactcacccttgctctatataaatatccccccccctcagttgctgaagaagatgaagcggatcctgttgatgaggagttcttccaggagcaagccagctacgatgagttttagggtttcggcctagttcccaagtcgcgcctgtgttgattggtccaagtcctggcttccgttttccttttgtaatgcagttgtgagcttgggatctgtccgcagcccaacatgactgtacctctactctataataaagagacctctgttgctgtgatattctgtcttcctgtgataccagcactatttcctgggactggtatcgattaacaggttaatttggagcgtcacgggctagttccggtcggaactagttcggggcgtgacagactccctcagtggttttgaaggacagtttttgctaatgtggcgatgttgtcctagtcttagtcccacgtgacgcttacgtggtattagaatttaaaaaaatatctatacgacccatctgtaattcacacataaaaaatattgtgggccccactgaccatgtgggccccacatatcatcctctctctatcttcttcctcatccctctctctcccttctctctctttatctcccctttctcttcaccttctctctcgtggcgcaatcggcgggcaggggcggtgacagcggcagatgatggccggagcggtggggagggcgggcgctgcagttgcggacctgtaggccagagtagcgggagagggggaaggtgatgtggccccgccaggctacttccctctcgccatcgacctcgcccttgccgcctcctcctcatcctcctcctcccggtacgaactctgcgctcgcgccgaggggtggactttttggtggtgagaggggacacagagagtgggtcatggtggcactacaagaatcctgttaatccgtgatgaaaaatatctgtcacggatcactagaaaaccatcaccaaacagcatctgtgatggtttaagaaatcatcacggattgagcgtcatggattgacatgcgtgatgatttgtcgaaaaccatcacagagtaccagaatcggtgacggttttaaaccgtcacgatattgcccaagacctagttagtccagcccaagcacatttcctgtgacgaaaaataaccgtcacggatgaattgccacatcatcatagatgcttgcatggttgcttacatggatgatgacatggacactacctcagcccatttgttaacaggccagaatcaaagatgggccaattttggcccaatttcagccattttcgcagcaatttttcagccttttttgcaagcccatttcagcatactgcagcccaaattcgtcactaatttttagcccactcttcagcccactactgcagcacatatagcccatatacacagcccattatcaaacattcagcccacatacacagcccacaaggaattattgtagcagcacattaaataaaaaaaaaccttatgtttccatccaacaacatatcacatgaattttcatccagcatcacattacacaagtcttcatccaacaacagttaccatacaaaagtgcacacagctaataacacagactcaggaaatgcatacaagtccagcagcttgattcatgcagcatgcagtagcagcaaaatgcaagtagcagcaacaaaatatataccaccatgtatgacttaacttggtcgaaattgacttgacacaagttagcagcagcaaaatgcatgtagttagaggcaaaagatatgcaccatgcatgtcttaacttggtcgaatttgactgagcaaaagattaagttttgcttccatctcagattgactcctcttcatctcctctcggtctttaatccttgcctgctcagattcttgcactttgtttgacaaatcagccacctgtgcacgaagctcagcattggtccttttctccgcttctagttctgtctcagtgctctgctcactgaatctaggctgggcattatggaaccccacattcttcaagaaccgattcttcttggtgttctcagcaagcacatcagcaacaacttgagccgctgacttaagttcttcaccttctgttgttgtagatagcttgttttccatccgagtctagcaagaaagtagcaaacatggttgatgttgagagaattaaaaataagcactacaaagatcaaagtctgaaaattatcttacaatagcctcctgtacaacaggggtgtagcattttttttcttgctgtagtggaactccttgaacaaatcaaatgcattaggttcttcatcattgtatttgtcatcctgagaacaacatatatgcattaggtctagcatgaattaagatgttacgaaaatctgggcagctactgttcaattgagaatctaaaagaacatgttcaactaatttctagcctcatttgttgcacacagtcacactatgttttccacttagacaaacaactgcaacagaggtctttcactgcatacacagacataaaaacaataacttttaatctattaacacactcaacttagacatagatggaaacctaactcatcacctttcacacaatgtattggcatcggatcagatatagtgtccttgaacattccacaaactaatggactctcatgaacataacaacatgagcatggacatcatcttgtttaggctgaggcagacgtatttaagcagtagcttgttcatacaaaaaattatatggtgcttaaaatggcccacttaccaaattttcaacatgaaccatgtaggcacgagatccggttgtgtgatggtacttaacattccctcggttttctttgttcttttgacacatctcctacattaaagacaacaatacatgtaaggttggtgatagattagcatgcacaaggcatcaatctggttttgcagagagaacataccatcttttggggactcttccatgattctaggagttgagtccactgttcattactcatgaatttgacaggagaagtttttgtaaccaaatgtagtggaaaaggatcaaaatatttttgcttcagcctgtatctttgttggcgaactgcggacttcatcatctcagtacaagccattttaactgtatcatcctctatgtttatgtcaaacttggcctaatcgaatggaagaacatttatagaaaagaatatcaattcagtaatttatggcttaaaataacaaacaatggatcttctattgagactaaatgtggaaaggaccagagaatgcatgtacctttagttttcctaagaacagattaacgtacgcagatgcaggtttttccttgtatagcttccaatgcgggagtataggcacatggttcctaactatgatgttgcattcagttgcaaactttgcagcaacaagaggaaccactggccttatattcccttcagttatgacaacttgcagcttgccacggcacgctcggtttaacctttggagacaacgtcccatattatttccccggtcccttctctccactccccctagttgtaaatgtacattgcagttgaaattaaaactaaaattattgaggtgaagcaaacattgatccaagatgatcatgaattgaaagctttgcatacaaatattgatcaactgagacaatatgaaatatggaaaatagatgaacaaactcaccttcgttggtaatctggttgtggtcaccgtgttgagtaatgccatcaactacatcagccacaagggtgttgtcatcatgctgggtgaagccatctaaaaaagggcagcaagtaagaaaagcattcatcatacaaacaaaacttacataacgacagtaagaattcatcacctccattgtccatatggttgtgctgattatgttggtcgatagcatcatacccggtggtcatgtgagtgttgtcaagtaaaaatgtgaaaattggtttcattaattttttttattcttaaaactcaagttaatattttcaaaaggtaaacaagcaataaacttagatcagcaagttaaacatttttatagctgactcatgttaatggaatgtaaccaagaaatgtggcagtagaactggccttcaacagcagcctgtgtgtggtcatctaagttgccatcgagatctccagcgttagcttgtgatgtagctggcatacaaatatcacttggtatgagacttgcatcttgttgggcaatgcttttctttaaccttgtaactttaggagtcatttgctctgcataaactctcttgcgagaccgaaacttgactccaccagtctggatgcttgaagttttgttgttacagttcttgcgagtcttctccttagagcactgctggaaagaaaagcatggattggtcaacatagtattacattgaattaggaagaaaaataacaagttaagacttgtcaacataaaggaattacaacctttgcattctcatcatcaatctaagggtggcggctggaagatgggttttggaggatgggtggcggctaggtttttggaggaattgggaagtgctgtttcataattaccgatgtacccttgagaaattttctgatggaagtgttctctatattttatattttatgaacctaagggtagtaaggtaattcggactgtgaaatatttcgggctggcgcacatcaagcgcgccaagccgcttgggcgcgcgggatttccccttatcctgaaaactcaaagcccctgttttgtttggaaccttctagatgagtatatattataataagtcttatatttgagatttgctactatgtaaaatttgttccccttgaatgattgaatctgtctcattccttcatactccattaattttttttgttggaattagaaaatcaggttagacaagcaccatatatgatacacatagttcatcatgttatgatcccttatgttgatgattattatcttaaaaaaatgttgataatgattaataaaactatataggtgttgataatttcccaattagtgcttctagctagtaagtggtataaaacaatgcatgaagcaaatttgttcccttgaatctatcttattccatcggtattagtcatattccactaatctaaatttaggaattaggaattttggccaaacaagccccatgatcccattactttttcgcgaacacgcaaaaggattgcacttcaatatgtacagagtttatgttacacaacatgatcagccgggaggagacagcacaccgtactaaacctacggagcgaacgcacagagtcaatgttgctttctctctctagtgctgaggagagagatgcgaattttttttttgatatttttttcgagtctcggagcacactgcaaccaaccatagaaattcttagctcaaacggacaaaagatgaagcatgaggaattttttcaaagttctatccaaggggttccggagcttctcgcctagaaaacataattttgtaagcggaatttggtagttctaatttcactgaacccggcaaagcggggagaatcggatgtaactttttctgtagatgtctgtggatatattatatgtctaatttcgagtccgtatgaaaaagatatgattgttttaaagaaggtcagtcgaatcaggcactaaaagcactaaaaacaataggtcactcgcccaacgccaaacaaggcgatccccgatgtccggcgagagctgtatgtgaagcaccgcacatggtttatcatgtcatgtggtgctgtacatatcctaggtgagtggtgcatcacgattatatttttaaaaacatttttaggctcaactagtacccatcacaaagtgtctactattataaaaattgaagatgtttttgctggtactttggtatgtcatccgtatatgagtcgtttttaagtttgttcggttttgaaaatacaaatccgtatttgagtcggtttataagtttgtttgcttttggaaatacaaaaggaaccgtataggaaatctctataaaaaactcgcacactaagtaagttgagacgatcggattccttcacccgttgcaacgcacgggtattttttctagttaataaaaaaataaaggctcaactagtagagactaaatctgtagtttcattgacacaggcaagttgaaatgccatttaggccaacaaagaatcaaaacttgaaaaacggatatgaatagtttggcatcgaaccaattatacataaattccatagatgaacatgatctcaaatacaaattgaggctatctgaaataatagaacatatggtctcaaataagtagaacatggtctcaaatactaattgagccttacgacaaaatattaaaacataaaattcaaacagaactattcgtcgtcactatcgacctccataactgagtcgtcttcttcgttaaaatactccataagtgtgtcatcttcttcatcttcatcttcatcaccaatgacattcacttctttgctagattctttcatcaaccgagcaatttcagcagcttcaaaaacagggccacgctcatcatctctatttaaaggcgtatcatatataatgctagaaactggtcggcgtggatcctcctcatcatagcactcgtcttcttgatatgcagcagcactaacctccatctgacttacgttataaagatgcctatggtcaaatgtctgtacaacttgccaattttcacccagctttgtatctggcaaatagaaaaccttcgtagcatgagtggccaatatgaaacaatcattcttgtaccacaaacttccaacattgatgcttttaaaaaagccatcatctttaagtgcagtcctctttccatccagtttgaaccagtcacactcaaacaaaactacggacctctcctctaagttatagtccaactgaattatctcttttatgtttccaaaaaaatcaattaactgaccattatgtgtagcttgtgacattactccactattcagtgtcttcttgttcttgtcacggttaactgtgttaaaccgcacaccattcactatgcacgaggagtattttctaactctcaaatcaggaccgcatgccaaggagaagatatcaacatccacctcttctggatttgtactatgcttcttcaaaatctgccacatgcatacaacacacatatatta

SEQ ID NO: 74324 - DNA, 674 bp, Oryza sativa
  unsure (1)..(674): unsure at all n locations
ttttgatagatgaagccgggtataaaatatccattatctaaaaaaaagatgttgtaacccatcgatagtgaatcgtttgtactgatttcatctatactaatataaaaaggaggagttgcccccctccaatgctacaggccaaatcacccggattaatctgagccgtccatccgcgcacaacttttttcacctcacgatttggcacccgaggattgcacgcgcgaagacattgctcctcatccacccgcagccccgaagaccgcacctctcctcctcgctcgctcctcctcctccccgcgtcctggcaggagctcctccccgctgccgccgctccttcgcgccatgccgtagccgccgccgggtccttcttctttcccacctccgggtcttgcttcttccccatccccaccgacacggccgacctcttcgctcatgccttctncctcctgctgccgncgatctgacgcatacttgccggagctctgccggagctccgccggactcttactcggagccgcgccggagcaggcctcggcccctcatcaagtaaggtcctcaataaagtcctcaaatgctgtctctttcctaaatactaatcttctccgtacgaacacgatctaaaacaagtgaccataattttccatttttgtgaagttgatatgtttctatgcgct

SEQ ID NO: 74325 - DNA, 553 bp, Oryza sativa
  unsure (1)..(553): unsure at all n locations
gcgatcncnnattgaanttttgattccagcttggtaccccgccttccgctgatgccgaccccaacctcgatgcggccgccactgccggcgacgtcacgccggcactgccgacgacgtatgccgatgccactaccacgtcgccgtccccgccttgacatgccgtcaggctgagccacaccgtcgagacggcacgccaccgtcacgccgtcacggcgtcgacacgccgtcgtcgcgccacgccggcacctgtgctcaaagtctgtttataaaaattttttttggtggcggggggccccccccccccggctatgaggtgtttgtttcgatagtgaaccaacgtgaactttacgagaacaacnnnnnnnnnnnnnnnncnnnnnnnnnnttccnntgcgccgcctgannnnnnnnnnttnttttnnngggtactatcccattttnnnaatctgagggtatnagaacccnacgtcaccaacgtgaccttaacttaattntactaaccttaccnaattnccctccctaactaaccntnccttaactnnttttactccct

SEQ ID NO: 74326 - DNA, 931 bp, Oryza sativa
  unsure (1)..(931): unsure at all n locations
agggtacattgctcggcttgcccataaccgaggggccgctatttgaataggttttactctgatcaagggtgtacatctttacccacaaaacacatcttcctcaggtgtaaccacgtgccacataccaccacgggtatacggacggaagacgttacatagttcccaacccatcctagccataaacaagagtgccgacccaaccccacctacggcggaaacccccgggacaggcaggcaggattgagccccctagcagcaggacaccagccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataagccaaccattccatagtgtccaaatgatatgagaattcccaaagtctaaagttataaaaccacctaatgttgcctaattaatcagcgaagcatctacctaaattcatactagtggaaccataaatagagtacccactagttggggtttttgttatcctagggtgaacaaggtaataataacaatagcaataataatgtcataacaaaggtaaataggcatggctaaataaaacagtgataacgcgggaaattaaataaagcggntatgcattaatttaattaaaatattttataaactgggattcatatgctcaaggatgatgtgacttgccttgctcagagagacgg

SEQ ID NO: 74327 - DNA, 1521 bp, Oryza sativa
  unsure (1)..(1521): unsure at all n locations
tgcacagtgcacctatgtgtggatgaaaatggaaaactgggagaaataaaaattggatggtgactcatttttgtatgaccctcctccttttactttattttggaaaacatggctttttcctatatttatctttttttttcatgctcgagaatactttatctcattcccttttgagcgttgttttcatttttctcctttttagctcatttctcattggcatcaaccattggaggagataccataaatgtatggagtctttatagaaattcttcttgtggataatgtcttgccagaaacaacgtaccgagcgaaaaaatttatccatctcctgggccttgagatacagaaaatttacgctgacgaaataattggatcctttactggggtgattatgcggatttggaccaatgtccagtatgcgaggcttctcggtataagtgtggagacattggaagtaatggtacaatgaataagaaaagagtcctggtgatggttgtatggtattttctaatcattcttcatttggaacgtatgttagcaaacaagaagattgctaagttgatgcgatggctgttggtatttcttaacgacattactagaaatataattcccagcaatggcgcataaatacttctggtatattatggttacagagttcatccctaagcgcacggatataccattgtagcatttcaacccgagagtattctaagggtatcgtatttattttatcccatgggaaaatcatgtagagagagcttgactaataatttatatattacttgtgataatcatattctaaacaggggttaagataatccaagggtagagtgacacacaagcatgaactactcatcctcataataaatcatctaagctaagtggaacgaaaagagaaagaaaatatgttcctatacttctattatacatagtatacatacattctagttaactgatatactagctaataccctctatccgatgccctcctggtacttcgagaagccaccgctgactgctgagttccttacgacagcccgtcatgaccatacaaccggagctaaatatggaggaataccctccccaggaaattaacttaggattatatactggcgtgggggaatacccgtactgagctgtcaccatcaacggcccacctctcatctgcaatatataaccccaaataatggtatcccgtaatctagacaccatgtctacaataccagaagcgcgtctaatatcctcatccccccatagagtaattgcataagcaaacattatacccgcaccaaagcatctcccagataagctagcggtatattcagtatcacatggacataatgtatagtnggctgtcgggtgcgaagcgagtgtctatcaatgtgtcacacggggggggtgggngnngggggaacaaagagacanatgacggaaagagacagatgcagtaaacaaagaggaattatgagcggggtcgaggtagaagaacgcgaggtagacgcgatagtggggtgcgcgggg

SEQ ID NO: 74328 - DNA, 11864 bp, Oryza sativa
  unsure (1)..(11864): unsure at all n locations
cagaatattttaagaattttggagagacggcacgaaacatncggttttgtttgagtacggatggcataaatccttttggagagatgagcagcggccatagcccttggcccgttccgatgtgtatctacaccctccccccctgtctatgcgtgaagaggaagtacataatgatgccgattattattcaaggccccaagcaacctggtaacgacatcgacgtgtacctaagatcactggtcgaagatcttaaacagttgtggaagaaggaaggtgtccccgtgtgggacgaggacaaacaggaggagtttaacctacgagcgctgctgttcgtaaccatcaacgattggcctgcacttagcaacctattcggacagtccaacaaggggtacaaggcttgcactcactatatggatgaaacagaaagtacgtatcttaagcactataggaaggttgtatacatgggtcatcgtcgattccttgcagcaaaccacccggtacggaagaaaggcaagcacttcgaacataaggctgaccaccgtacgaagcctaaacatcgcacacggggcaaatatattatgcacacgaagcctaaatacatatatattatgcatgtatatacatataatataatataatatatatatatacatataatatatgtatgcatatatatgtattgaaacatacatatgcatggtttatatatatatatatatatatatatataaaccatgcagcaacaggggcatgcaaaaaaaaaaaggtcagctcgatctggactaaagatggctcagccacgtggccggctgagccatctttagtcccggttggtgttaccaaccgggactaaagatagatctttactcccggttatttcacccgggactaaagatagcgatctttagttccggattggtactcccggtttggaaaccgggactaaaggggggttacgaaccgggactacaatgggtttctccaccagtgatttccaaatatatcggttggcttattcaccgaataagcgaaacgatgggccgttagctagaaaaatgcggtcaatctttttgttggggtctggggagagatgatataatagaaaatcggtaattgtgatgggacactaatttagttatagaaaaatgatctcactaagatgaacttgtccattcaaaagttaattagtgatccctttctttgaaaagttgttagtcgccgatataccttatccttgtaatcacggtgatataccttgtaatcacgttaggcagatactctgaatcgctgatgtagtgttcagattgagggtgtgttccgaactttcaacttttccgtcacatcatttcaatttcaaccaaacttctaattttagcgtgaactaaacacacctaaactcggctttatactcctatctattactcccttcgtcctaaaactattgttcatgtccaacgtttgaccgttcgtcttatttgaaaattttttatgattagtatttttattgttattagatgataaaatatgaatagtattttatgtgtgactaaatttttaaaaaaaattgtaaattttttaagtaagacggacgattaaacgttggacatggatttctaaggctacacttatttagaaacggaggtagtaattagcagtatccgaagaatatactggcttgtcgctagctctttgatatacggccctgtttagttcgcgaaaagaaaatttttgggtatcacattggatgtttgaccggatatcggaaggggttttcggatacgaatgaaaaaactaatttcataactcgcttggaaaccgcgagacgaatcttttgagcctaattaatctgtcattagcacatctaggttattatagcacttatggctaatcattgactaattaggttcagaagatccgtctcgtgattttcatgcaaactgtgtaattagtttttgtttttatctgtatttaacgctccatatatatgttcaaagatttcatgtgatgtttttgggaaaaaaattttggaaacaaactgggccagtctcccggaataatgtatactgtgcaacagtgcaagtgtaatgtaattaagatgcatggatggaaatggcacaatagtcaacgtagacaggggttccaggagggagcagaggaacagatatacgacaaggactacctaccctgttagtagtaagcagccactgcaagatttatggtaagataatatgccaaaatgatcatctactggaccatacagtatgccaatgttggtgagagcggtcagaaacctgcgttaaatccttactggatacacgccctgcaataaatccttgtttgtcttgttcggcaacatgcatttgcaaaatgaagtacagtatatacattgatgcaggaccgtccagtgtgaaactacatcatcatgatcagttagcttcgggaaattaaatactgactacaatacatgtactcctccgtaaaaaaaaaagacaaactctatgttttcgtgtccaatgtttaactgtccgtcttatatgaaatttttttataattagtattttcattgttgttagatgataaaacatgattaatactttatgcgtgagttatctttttaattttttcataattttttcaaataagacggacggttaaatattggacatggaaacccacggtttatttttttagacgcagggagtaggacagtagaaaaaaaattataatctgttatatccaagttattttgggtgctgctctcagctagtgagaaagttggacgcagatactcagtagttagcgagaaatcagttcgaagcagataaaaacacacacaacgtgcgtgctaacctcgtccaagtagcttagcttaactccttaagcaagttaggctctgtttagttcatggaaagaaaatttttgggtgttacatcggatgtttgacttgatatcgcaagaagatttcggacacaaatgaaaaataatttcataactcgcttggaaaccgcgagacgaatcttttgagcctaattaagacatcattagcacatgtaggttactgtagcacttatggctaatcatggactaattaggttcaaaagattcgtctcgcgatttccgtgcaaactgtgcaattaatttttgcttttatctatatttaatgctctatgcatattgtcgacgtttgatatcgcgactacggtatttgtatagtatgtggatcgttggtactagggtatatgcgagattgaggtaaaagagatgaaaacaagggtttttatacaggttcgggcctttatttgacaggtaatagccctactcctattggccgaagccggtgttgctcctttattcatattaatcacacaaatacaatatttgggataacctatcttgccgtcgtcgacttggcggctagataaccaactcgtagtcgacgacagggtagtcttcctccttaagtacgaaattgtcgagattagagagggcgctagatcccttttgccggcttccgtaggcaccgaatggagtatgtctaggcttatatatgatgttgatatccgacggcgtgtgttggcttgtgtgtatgttgtgtcttatagctttgtggcgtgtcccctctcctcgtaggggattgtatttatacccatagatgcccccttgtccaagttgaactaaggagataaatatggaaacgatccgagtagtccttgtcattttcatatagaactctttttgtcattccttatccgaaactccttttatatttgaggtttgtttccgtataagatatgatatgtggtggaccctgccgagatttagccaactactattaggtatgtggtatccataaccctgacagtagcccccaacttcaatgcaaatgaacgagttgatgttcttgaccgaagagcttggaacaactattgtcgtgctcattggaccgttctcggtgagatcagagatagtgctagattccccttatcggcctttgtaggctccatattgagtttgtctaggtcccgatgtcgaccgagaaggtatggagcatgcgactaagtctcccgtcttgctgtatcaagaatttggattgaagtcaagaaatttcgtctcggtgggtacaccatcactttattccatattccttctcgagctccatcaaccattctcgagtaatctagaaggtgcaaagtctgcgacaaagccttgaaaatctgacttgactattctaatgtctgactttcctaaaatcaatactcaaaacataatattaaatagaaatagacctcgagcgaatgctcaaagggcaatatgtgtggaaaaattgaaaatctgtgtgcagtacgctcgctagagttgccctcagcaaacagagtttggtacccttcctagccccaagctgtttttatggaaaagccatttttcacaaagacagcttgaatcttataacaaaccatgctgaagctgacaaatcctagcccccagctataaagttggaaaacttaatttccgattacacggcttgattaatacgcatcgagtgagaacacttacatgaccaggttttacatggtccttcggctcttagaatctgacaagaccttacacatccgtttagcactcttaccttaggttttacatggtttctcggaggcttgtcagatcagcgtaaagggacaataggaccgccttcatgacaaggcgatataagaaaagaggatcaccggacaaatattgcacatataaacacttacagaagttgacgtatatgaagtgatgagacgatttctacaccgggtgaagacgaggtgtatagttgtactcaacaaatcgtagaggtagtgggagaattgctacaccgctggtcgaaggccagttatagtcataactcgaccactggagtttaaggtgcgagaggtcgctacatcctcttagttgataaccagaagtgagtatctctcgaccgtttgaaatagaggtgcgaggaccgctacgttgctggttgaaagactagtcgtagtcgtacctcgatcattagaagttgtggtacgaggaccgctatgtttgttgttatttcttaacgacattactagaaatataatttccagcaatggtgcataaatactccttgtataagggtgaaatgctataatggtttatccatgccttgcggatgaactctgtaaccataatataccaggagtatttttacgccattgccgggaattatatttctagtaatatcgttaaaaaataccaacaagcatttctggtgccgttgccggggattatatttctagtaatgttgttaagaaataccaacaagcatttctggcgccgttgccagggaagattcataaaagagattacctgaactaatattttatatttacctctttataatcactgccctttgcaggctaaccttggctgttttcacttttgttgtggaaacagggtagtgcatgactggtttcaacttgccagaaaatttcaaagaaaatccagaagctttcttccggagcgttaggctgcgagtcgctgctccgcagaaaactctaccgacagagaaaccagccgtaccaacactaccgactttcaagattatggctagcaagactctccgcgagttcgctgctccctctgctgacaatgtggccattgggccacagatcaacatgggagatgtggatttggacttgaagtccagcctcatcacgatggcgtaggctagcccattctgtggcaagcttaatgaggatgccaatgctcatctgcaacagttcctgaagatctgtagcacgcacaccatcaagggcgtcagtcctgacgccgtcaggctatggctgttttcgttctcccttctcgggagagcgaagtagtggttctatcccaaccgtgctgctatcaatacctgggacaaatgctttacggcattcctctcgaaattctttccgatggacaaaaccaatgcccttcgtggaaggatttcaagtttccagcagacaagggacgagtctattcctgaagtatgggaacgtctgcaggagtatgtggccgcctgtcctcgtcatgggatggacgactggctgatcctgcagaacttttacaatggactcacaccgatgtcccgcgatcacctggacgcggcagctggaggagctttcttctctaagacggttcaaggagccgttgatctaatagagaagatggtctccaatatgggttggagcaaggaacgactccagacccgtcagtgaggcatgcataccatcaaggagacggcgttgcttgctgccaagctagacctcctcatgaagcgattggacgaccacaacaaaaggccacaaggcatcgtcaaggccttggactcacacgttacgtgtgaggtctgcggcggcacgggtcactctgggaatgactgcccggaaacccatgaggaggcgatgtacatgggcaacaacaacaacgggtaccgtccacaaggaggttagcggtggaaccaaccacgcccatattatcaaggaggtaacaacaacggtaatttttctaaccagccttccttgaaggatctcgtttttgcgcaagctaaaaccactgatgcgctaagtaaaaaactcactgccaatgacaagatccttgaaaatataaatgttaagctagatagctttgcttccgcttttcaaaactagctaagcttcaataaaataatggaaacccagctagctcagttagcatccttagtccctggaaataaaactgggaggattccggggcaacccgactcctccgttgaaaatgttaaggcgatcacgacgaggggaggaaagtccactcatgatccgccataacctaaccctgcaggaactaatggaatatcaaaagaagcgccatctagtgactcggctgacaaggaagttccgccagaaaagaccatgccgtaggaatactgcgagacacggttgttgccgtttccccaacgaagtaggaaaccgtcagtggacgagcaattcgctcactttgttgaagtaatccagaagatccacatcaacgtgccgttgttggacgctatgcaagtgccaacatacgcctgttatctcaaggacatactcaacaacaagagaccactcccaacaacggagatggtcaaactgacggagcaatgcagcaacgtgatactccacaagctcccagagaagaagaaagatccagggtgtcctacgatcacctgctcgatcggggcacaacagttcgaccaggccttgtgcgaccttggagctagtgtcagcgtcatgccaaaaggcgtcttcgataagctcaacttcacggtgttggcaccaacaccaatgcgccttcaactggctgattcgtcagtccgttacccggcagggatagcggaggatgtgctagtcaatatacgggacttcttcatcccggttgacttcgtggtgctggacatagacacgggaaaagtgacgccgctcatcctgggacgtctattccttagcaccacgggggccaacattgacgtgggaacagggagtatccgcttccacatcaacgggaaggaagagaagtttgagtttcaaccaaggacggaacaatgctccatggtcaggataaagtacgggtcgtatccgcagaattatcaagtggtcaaagtggagcaacccaagatggacagcctggtcaagtttatgcaaaatttcctggagaaggaaacaacgtggcccaagaaccggtattataggccgtcggtaaaaccacccatactggccaagaagctagagcagtcggctcagaggaagccgctgtccgcaccaaagccaacgaaggtgtggagggagaagccaaagatgcccgctccatcacctccggagatgggtagaaaatccgcaaagtgaactgaaaggaggtacggtcttgcacgtcggactttaaatgacgcgaccttcgccaataggtaaattggtatgtatctgcatctttatttccaacaatttgaatttttgcatcatcgcatgtttgaatttcaaagttgcatttaggatttttgaggtttaaggaaatttttcaaatgaatttttcagagcaaaccaaaataacattttcatcgaaaattcactgtgccacgaccacactgaccgttggattccaacggttgaaagtgggaccggttgggcccaccaggggtttggccgaacaccctggttcggccgaaccggccaggccaacggtcggctgcctctctttttgaggcaatggctagtgggtcccacatgttattcatgaccgttgtgggtaccctataaaagccagccggccgggagagggaactccacaccatttcaacacattttcattccctctccaaagtttgctctcaagttcattcaagctttgatggattccctcaaattcaaacacttagttgcatatatgcaagttgctttggtgaaactaatcggcgggtgaaattcttgtcattcctaacccccgtcgagttagtccattcttgctccattgtgcagaatgtggaggcgattgtctcgtctgttaaaggggtccggctcttcatcaagtcatcatgacgagtctagtcctcgttcgtcagctgatgtctcgatggaagatgccgaagctccacgacgactcctgaaagacatcgacctcgaccttgtcagtgattgggagagagaagcttactacatgctgagcggctgggagtatgctcacacacgagaatactcaccggagctgctgaaaaagataggtatggatgttgaatttcgttctatttggaaagttattggttggcagagatttgctgtggtagatgagcctggttttcgttttcttactttgcaatttctgtgcactttgaaagaaatagaagatggaatttcctttcgctttttccataaggagtacacacttacatggaaaggcttaagtacacttcttggttttcacgattcctgtaaaatcgatctctagaaaggagtttctgggtttgagaaaaataggttttgggaaaatatttctagtgctccaatttgcaagaaacatagaacgactgatatccataatcctatgcttaggctcatgcacaaatggattgctatgactttgtttcctcgaggtgatttgagacccattaggggggatgaattgattatcatgtttgccatggttagaaaaatcaaaattgctcctgtgaagtgtatgataaggcaatggttagaaagtataaagttctctgctcctgttgagtgcacttctctgattactcggatagcaaaagggctaggggtcattagcgatcaaattgcttttatctcagctgctcatccgtgtattgatgagacttatctagtgcaagggcatattctgaaacatggagaagatggatctttgatttactttttccccggttgtacaaatgaaatcccattgccaaatgcggggtatcatttgtacaactgccatgaactaaccattcccctgcagaccatagaagaatctagtgcaggtggagcatatagtgagacgcgcaacatgacaacgaatgaacgagaatgttcatcatcctcaacacccgtaaagatgtatgtggcaggttgggaatcgactgtggatgcacccggatggacccaagctccacgccacagcatcagagtctcaacctgggcgagtgccagtgaggaccggtggcgtgcgcctcatgacatccaatggggggacaattaacctcccagatcaagtggtgtgcctccatctccaagtgaatggcgctcaagttcctctctttgggacttgggtgaaatctctaggagaatggacacccttaatatgcagacgggggagatccagtgcaacctcacggaacacatagctcaaacgcaagaatgacaacaatctgctgatgctcagttccccaacttcaacaacatgatgcagcaatagcacgatgaccttcaagcgtactttcgctttcagggattcaatccttatcaaggaccctgagtaaaagccaagcttggggggagacatctctccccccactgaggtaacttgtattacattgcatatttccctttccaattgcatatttgctttccaattgcatcttataaaaaataaaaacaacataaaaatttgcaaaaatagaaaataccaaaaagataggataggtttgaggcatgctgggtaagacaagctagttctctttgctgaaatgatgaatagttactctctcaaagattaaatataagtagccaacaattattcgggaacctgaggtaaatgagctgcacttgctgatctaagtctaagatgttgcgagatatgagatagtaaataagagttgctatgatcctgatactagtttaacttgaatttcggttgttttgtttttcaaaatgataaattgagagttcctcatttgatataaattcctaccagagccaaaaatgggctatcatgattaaaccttatacattttggttgcttgccattccattgaactttgtcaaactcttgtgacttgtgtagatacttctcatgctctatgatcaagatcatacacccacatatatgcacatgctaaactcctacattgggagctaagcaatattccattccattcccattttaccaccatcttgaattctccatgctttcacgtgctttcttctcctaaagagaatgtcctttcgaaaaaaaaagaggagggaaaggcatggttataaaaaataataataataaagttatgctccatcaggcatgaacatgatgttgaaaaaaaaatgtagccatgccctctcctaatcaataaaagaaggatttttgggagaagtaagcataaaggagaagcatttttctttattttttttcctcatgtagcattttcatcatataccacacacacattgcacaatcatgatcttgagtatgtttagttatctgctttagtatgagtttttgacttattaataaatgtgaatgcaagtatgccatgtttgatccctacctagctccacatatcaaaaccttagagtaggaatcaaaaaggcaaattggtaaggaattcatattgatacacttggcgagactgagtgaatcaattgaggaacttggctttcttttgcaaaatcatttgaaaacttctggaataagagttgaataaagattgggtgattggtgctctaattgctgttttgtctttcaaccgcgcaaggcaaggagaaacagagtctcgtggaaataaggggtaagggtaagccaccgtgccaaagattatttaatctgagagagagtacatataccttgcacctgtatctttgagatatgcagcatagtagcaactcctgatcaacaagcaagtctttgtttcctttcttccttcactcgggacgagcaaaggttcaagcttggggggggggggggttgactactggatctcctatgatcctacatcagtggacacttaagcaggtgagccattggttgtagtgttgtcgaccatgagtgaactcatatggtcactgttagtcaagagctgtattaatattacgtcggataacgtaaaattaccttataacggatgctattgtattaatccgcatcccaggaaaaggtcggggtacacctaactaacttgattcaatttgcacatctttattatatcgataattgttcattattacaaagggctatattgccgtgccatacaaaatttacttttattgaatttgggggctacggttacattttcaaaggcgctaacttgggtttattctaatacttccacctaaacttgtttttcaaaggctgatttaactaatgtggggtgacagatattgctc

SEQ ID NO: 74329 - DNA, 19972 bp, Oryza sativa
aaaatggagagagcctttgggaaagtgagaaggaatcagggagaggaggcttttccaaagaaagaaagtaacatgcaaaagagcagtatcagtgaagttgttgtttggtgatacttattcccctctctctttctttgcctctcttctaatttaaatttgagggaagaaggaggaggagttgaaggtgaggtgagctagagtgttcttccttggcttggcctccattgttacatccccctccactccatctcttgcttcccttaacccctcccccaaaaatcccccccccccccccttgccttaaccccaaccccaaatccatccttccaagcttcaacttctctggagctttgctgttgatacctggacaaggtaaagatttgcccctttttttatttgcttgttgttgtttttagtttgctattaagccgccagaccattggaaacagcacttcgccttccttctgtgtttcctgcatctcttatctctcttggtgagttcttggttttggctgttgaattgttctcttgtttttctttttaatcttcttggtggtgttttcatggcgtttctttgattcagcactactttcttggtactgtaaaatgctagtagcaaccaccctcttgttctagctctcatcgattagtaaacttgtttcccttccattcgatgaaagccattttcatccaatccatcatgttatgctcagaaaccagaatgtgtaggttttgcctgttcttggtgcaattgctgctcgggccaactttgtccatcggctagcagataattccagttactaagtaactccccatctcttgcggttattatcatcacggagcaatcggttcctgtcagttcttaccaaaatccaaaagtcagcggttgcatttcatccccctcctgcaacacacatacctgacgaactcctccttggattcttggtgttctcctcggccattacactgttttttttttctcttaggagcatagattgtagcaagaattgtttcaggctgcgcagattgcgatgactgaaccatggagtgcgttgtttgcaggattaatgggcgaccatctggcattgcttgtggatcggctgctgacggagtcgacgctggacgcggcaatcaggaagcaggtggccgatctgcaggcggagacggtggcgatcgactactgctgcgacggcgacggcgatggcggctcggcgaggaagatggtggagtgcaggatttgccaagaggaggattgggataccagcatggaggcaccctgtgcttgctgtggcagcctcaaggttatggcttttccttggctttgtgaattgtttattctgtaattctgatttgttaccgttatgaaaaatatatccttttttcagatggaaaatttggtcttttggtctccacttttagtgggagaagataaattagttaattggtgtccatggttttctttgtggtcactttagatttctagttctagaggagtagttcactagttattttagataatagtagttcactagttgacttaggatgaaaattgttgacatttatggttggggttagctgcagtaggttcacttggttgtgtactatcatacatgctaattaagtatgcgaaaaaggtcaatcctggatttaagaaaagttgttatgaaaaatcagctgcatttgcctcgatgtaacttggaagtcactgcctcgtattggccttcctatttgatagtgatgttgctgagaaacaaaacaaaataaggtgttggtgttctttcgaagtaagggaaatggaggaggctatctgtgaccttcaagcaatgagtggggcaactacccacattatctagcaaggtcaaatgtagttgaaagttcagtaaaacattctgaattcggtgctgtttgttgcttcttgttctagcaaatgatactgtaatataatgaatgtatttcagttggttatgcaggtgaatttttgcaagatattaaattcttagcttctcccttgcagtatgcgcaccggaaatgcattcagcgttggtgcaatgagaaaggcgacaccgtttgcgaaatatgtttgcaggtaaaatcatcttggttcaactatgcattctttgtagccttgtggaactgtttatagtacagacaaatgtgtttgatagcgatacgatttgaggacatataaaactgttcaagcatgcatgggctaatcctctgatgtgatatctctttctgcagcaattcaagcctggttatactgccccacagcaactgtttcactatggaagtataccgatgaacttcaggtactctcttggggatcctaagtgataattggttgctgtgcctgactagtcagcatctgtaaattcttacatttttcttctgtttctttccctgatccctctacagaggaaattgggagattgctaggcaagatctccatgattcccagataataacaatggtgccatcggagcgcgacttcatggatggttatgaggactacttacccattaggacgagaagcagcaccctgtgttgccgaacagtcgccataattgtgagattccttgcatctggatagataaatatcctttaatgacaattatctatcacccagttcaatcctggctaattcttgtgtttcctttctgatggaattctgtccctgtgattgaatagttcatgtcactcctggttcttcgccacactcttcctcttatgattggtggggatggggagtactcgttggccttattctcggtaagatcgatgtccaaattgagtttagatcatcactgcaaaaaagaattatcacacttatcttgaagatcaagctcctgactgagtgtctgtacttctgatgggggtaaaagcttcttgtcttgaggaccgccggaatcctatttccaatcttggtcatggtgagagcattggcaaccttccatcgtcgtcgtcgccagcaggtaattccatcactgcatgatctgccattgttggagcctcctcaggtgcagtgaaatgcagtcctaatcctgctcagttagcttgagcaggtctacacctgagcagagtcctccatcttaaccattcatagtatatgctacaatcttccttggctggatcataactctgggatctagatcacttaaccctgcaggaaagacgggaaatgtatatgacttcgtcagacagcgaagaggaggaggattattcagataccgatcctgcacagccaattcattctcagacacgcctggtaccaatctactgacacgatcaagaacgatgccaaaaaaattcaaaaaaagaagaaaaaaagaagaggaaggtgaccatatgtgacatagtaaatgaagatagtttgaagccactcgcttcaaggtgcccttgcaagaatgtagtggctctgtacatatgagaaaggaacagatcgctaactaacccaagatgctgtaacttgagcttctctagtactgcaagcaagttcagctacccactataagtattgaaaaggttgttattattcagattacttgcaaatggaaggaaatacacgtcgttttctggatccatccacttgcatttttcattttacaatcgcaatcattttcgtctataacagtagagccagaatggcaattaggcattccatggctatcatcaactcagatcgtcaacccatgtacgttattgcctgatcgattggtgaattgttgattcagctttcatagcacagagttctgcatatctgatgtaatagtgttgcttgtcacgctttcaaaagagtacatccatcaagaattcaagacataacaaagcaacgttacaactgaataacctatctggcaaagtagactatcacccgaagagaactagggtaaaggggatacacactgggatggcaaagttagggagaaaaagagagagcatacatatatgtttcagctatgcgagaaagcaacggtcgtgatgcaggaactatccacgatggggtacgtttggacatggtcgatgtacttgaacaccgcagtatcactggcctgcgcaccttcggagcccatagcactgagctttctctggttgaagctctctacctcctggaccaactcatccttggttctgctacatgatgtgatgacctaaacacatgtgaaagtagcatcagaggcttgacacattctttgtcctaagccatcttcacatacatggctttcaaatagttactgtaatggtgaaaccatgtagattacacaggattattaaaagttaaacagaacatcatatgtagatattaaattggtaatttccgtaggtagaatatgtaaagcaaatagtttcaccacagtaaactgttcgaattttgttgcaagtgagccaccatgcaacacaaagatatttgggttgaatgtggtggaagtactgaccagtatgccaccaggagaaaccagccctgcaaccgactgccaatacatcattctgaaatggagtaaattgaaaatagtttaacacatggaaaccaacaagcagtgtgatccatgccagtttaaacaacctaagcaattgagagtaccaagtcactcctaaatattatgcggtgtatcaaaatttatgataatttaccatgagggattaaagcatacatcaacagcttcgcacgcattacctctttacaggtccatcggggtgcaacccaatcgtgtccagagttccttcatccatcacaagttcaaatctcctctccaactttgactctaacacatcatcaacctgcaagagcaagattcatgtaagctgaatcagctctttcctcctctttccgctttaaagctctttgttcaagggagttgataattagctgtacaaccttgaaagatgttgttttggtatctaagatacaaccagaaggtcatggatgtgcacattatacgttaaagcaaaataagaacatgaaattgtgaagcatacagatacaggcatatgcaccaaatggtccagtgctcaactcaccaagaaattaatgtgctcaaacccatcacggatagcaagattacgagcaacctcaattgcaccttcactgtggtcgatcccagtcagatcagagaacctgtatatggacatatcagtactgtcaagaggcattaacaattcaacagagtgaaatacatagttgaatgtctcctaatttataaaaatactccaagtcaatagagatgtttctcccaatctacaaaacatatagctattcgagaaaaagaaaacatgagactgtgctagcatgatcctttgcttaacagcaaaccagatgcagcttccaagaataattatcaaagggcatctcccttcaatttacaaagatggccagattttaagcatgtgatagaaagaccattgggaaattgataggtctgcttaactaaatcaattatacttgccttatggtaccaaactttacaactccaaattcatactctaattatatagaaggaacacaaacacaagagagaaggagcacaaacgcaagagcaaaagaatagacaataagtctatttcagggctgtcagaaaacgttaagaaaggcatctcaacaccaatacattgaagttgacaacaataacagcattcacattaaagtaacctttggttggagaaatgcaaatggaagattgccatttcatcaacatacccttgctttgcaagctgttgcgagagtcgaccgctcccagttcctatgtcgagtacactgcagctacgcaaatccttgttggaacataagtttttcgtccagcttacgaggacatccatgttctccgtgccaaacctacatgcatacaagttagactttcatcataaccagcgatataatgattgaagcagaaaatgaagattttctgcctttttacccttaaaatggaacattgctgcaaaaaaaaaagtagtccatccatagtagctagtagatagggaaaagacaagtctaaaagttctgaatttaatttggccaatgggcagtgggaaccaggcaaccttagctagaagacaacactcgataggcattggctgttatcgaaactacatgttggtagatattactataatgctaacgtgttttgcattccctagtgaggcaataacttagttatgttccttgttattcccatcatgttgtgaacaaagctacaacaaaaattcgatgaggagatctacactctatccatatgtgcacagcaggtgaagagaagaatctgaccagtcatctgtgtggctccgttcttgaaaattagcaaggtattctgcataagaaccatcctgatgataattcggcaggcccagcaacggcggctccatatcggcggagtctggcacgtccttgtcaaagctgttcgacattcacaacgccgagtcaggtaagcataccaaaaatgatcatctcttgaggactaaaatgtaattaccgagagatcgttggactaaatcgcatgatacagcgcgacagaacgcccccctcttcttccccccaacacaaggaaatcagatcacgggcacaacaaagcaattaaaccgtagaaacggatcgctcttaacctgaaatctccggaggggttggcggcgaccgacgccgtcgtggcggcggcggggccggaggcggcggcggaggaggaggaggaggaggcgaggaggacctcggcggcgtcggcgtaccgctgctcgtcgtcgagggtgctcccgtagtcgctcttgatggaccacgagtccgccgccaccgaccggtcgtcgtcggaggccatctcccccgggggcccggggggtcctcctcccgcgcccccgccgccgccgccggtcaccatcctcgacgggaagatctccgggtcctcgggcggccaccgtatccccgccatgccgcgcgcgcccgacctcaaaccctagccctagccctagcccggccgctgcgtcgcgtcgcaatttgttcgcgtcgtcgcggaggacgacgaaaagtcgacgagtgaatgaatgatgcgaggggtgggggcttggaagaagggtcaatgacaggtggggccctggctcgattggcccacgtgtcggtgtgagagccgattgggatttgcagcggggaccgaggagaagcgtcgggtgggcgggaattggtcgctgatttgtgggaccaactaaggatggggaccatgtgacagtgggaccaggtaaggtataacggtgcaggccggatttcgcgggaagcgtcggctgttgatcggaaggaaggccgttggtcgttggggcttgggctgattttttattagtggaccgggccgagttttaaggttagatcgttcattaataagccgtgaaaaagataatataaacgaattaattaaaacataatttatgggttaaaattttatatttacgttccttttttagagggttatatttatgttctttagtgattttaaaagctaatgctaaaaataaactacgataaaaaatcacaccatcaaccctgaaattaagttttaaattttaaatttttgttgcgcctgataagccaaaagacaaactatgagagccttaagaatgagtaaaaatcatcatggatccgccggaaatttcaaagtcgtccgacgaaattgtccccgtttcaaatacggcagtttggaatttaccaaatcaaagcagaaactatctgaaaaatctacacccagaggcccttcctctgaattgactgaaaattctaatactaattaattagctctgatttttttctacatgatcacagagagctagtatacaatgcactggcatatctaatgatatctcattgtttgcttgaaagaaacatggtgtggtgcatgcaaataaaaggggcccttgaaacttgctccctccctttgttgttttccctgcaagttgctcctatgtacagctgatgcccggtcacacacagagattatctgtgagtatcctgcaggtgcagagtagcatacagctccaactccctcttcatatacagcatatcaccttgttctctacagcctgtgtgccggctgctcagctcaagttgttatagtatagtaccccactcatgacgcaatcaatcacatttaaggatcattctctttcttctttctttttgtgggggcgacatcttgcatatttctctaaaaaatgctgaaaaaaaagcagtgtcattggcgtatttatcaaaattgagaagtagattttggggaacacatacccagggcattttgctttctggtgacaaaatcccaaacaattataggccaaaaaaattgaactttacagaagaaaaaaaataaaaggaaaaaagaagaagaaaaagataagggaaaaaaatagctagagctagctaatgtacactcgagagccagctcaagctagctgcctaacactagcaaaagcaatccgcttacgtctccggcgatcaaccgccggtgcacggcacctcgtcgatggcctccagcctcggatgccacgaccggtgccgcctcacgccgccgccgccgccgctcggcttgactccggcggcggcggcggcggcggcgtccggcgcggcgtggagctgcaggctgagcaccggaaagaacctggcgccatcgtcgcttccgtcgtcgccttcgtgatccgtcggctcgctgatccggccaccgtggctcccatcgcggcggcgaccgccgccggtggcgatcctcttccacgacgaggaggccgcggtggcggcgtggaagctggagagcgcggccatctcctcgtcggtgagcacggagtagagcatgtccatgggcagcaggaagtaggcgcgccgcggctcgaggagctcgtccgccgccacgccgggcacccggcagccgacggcgaggcggccggagtcgcacacgaactgccccgggtagtccaccatcagttccgacgccctcaccggccgcgcgagccgcgtcaccgtgccatcgacgtggatgatcttgcacgccgtcgacgacgagccgcccgccaccggagccagcggtatgcacgacggcgtgatccccatgagaactagagagagaagagaatgagaatgagatggtgatgaagaagcaatggaggagatggtctatatgcaggaggcacaagttgcatattggttggtagtgcagggaagaagacaagcaaatgattagtgtgctgtgtaaggggttaggagcagcttgcttgattatctaatgctaatccgatttaattatctacgacttagctaggatcaaccgatcaaaaatggccatatgaccgcagtttggatgcttaaaacgtggcagcgagaggggccgtcaagacaggttggcatgcagcaggaacaagattagtggcatcaagctaataactagcggattgacgagagtcttttggtgagatgtcactgttcttaactagcatacggtcgagatgattatatatatatgctaattccatccaggtgttaacgctcgcttaagcaggatgttaataattatctagccttttggggaaaaagataaacttggttttgcaggctgctgcttaggatatggacacattctggcagtgcccgacaccaacgaccacttttgctaagctagcaagcattgagttggaagccacaaactgaactaaaaactattatgctttctttcattctttctttctttacagagtaagccagctgaattgatgggtcaattgagtgataaacataatagtatttgcagctgaagtgtcaatggcagagttctgaaggtatatgtctgcagattgcagcattagtgattagttgatgctctgcagtttaacagtccacaaagcgagggggttaatcctgatgcttcacattattcagtttgactctgaaattaatcaaggtttataaattttatcaacttcaaaagtattgggtgtttgagagctgacatgtttgtgttagcaaaaaagaaaataaagatgtaggagtattttataacttaaacacagtgcattttttactattattctgctgctctaggcaagcaaaagattaaacaaacaaatagattatacagcattaagatgtgcgtgttgctaagagaatacgacgacggatccagcttgcattcaaccaacctaactaaaatctgaggatctggcatttggcccctccatatattcccaaatctctgcctcttgtgttcagtgcttgtgacggcaatcaaggagatggaatcctaagagaaatgttaatttatctgtttatttattcgctcttcagcaatgcaagagttcttttttgcttttgaagcaatgcaagaggtcagtatctcaaatctactcatcattctgaaaatcttgataggtgttaaaaaaaaacattttgactgacttaagtacactagtataaagtatgcaaaactggctcatgtgcattctaactcagccacatgacgaaacatgtcgaaaaatttaaattataaaaaatagttttgaattaatccagttatttttcatagttttctatttaacccgctaagagtagaaataagaaggtgctgcccaaaatcattttaggttttcgtttatttttgtatagcttattatcgtagcttaaccaattgagcactaaataaacacgatattatcatgttttttttctttttacaggagatgagcctaactttctttgagtgctcaggttcattttatagtctagcaaaatttcctctctttttttttggtcttttatttgttgttaggaaaaggcccatcaagatttcttgggcttgtagacgactagtactattgaaagtaggcccattaagtggccgaacttgtcgaactgggccaagcttgtcctcgtgtgcaggcgaaaaaaataaggaaacccgaaggactcctcccacgagatcggacggccagaagaggcccaaccccacaaaccgacggctagagatcactccacgtcgtcaggaataacccccggaagcgggccgcgtcgtatttcacttggaccctcgcaaccctaataaacccctcacccccgcgccgccgccgcctccactctcctacgcttccaccccccattcccatcccctccacccagatcgccgccgccgccttcgcctcggacggccgtacggcgccgtccaccgcgcacgtctccggcgatctacaggtatcgtcgccacctcctagcccccggtctctcatcatacggtggcttccccccgtggtggattcctcggtcggttccgatctgttcgggaggtgggggtggggggtcgttgttctgtaggttatggagcgttggtggtgttgttttttgtgggtggttcgaggtgaatcggtgggttgattcctgattttgctgtttgttttggctgtgatgaaggtgtagatcgcttccggagacatccaaccgcggccatggcgaccttcgcgaaacctgagaacgcgctcaagagagcggagggtgagtcccctttggatctgttatgtttatttaggggaccagttttcactgttttgtaagcatggaattcgaaaagagcggtgtttgattcctcccgtcatagacaaattaacagaccatggctggtcgttcaatcttacagaaatacttgttgattcgttcgtgctagttcttagatgtgttcaattatacatacttcggaaaacattttatttttactgatgatggccctctgctctacttcagagttgatacatgttgggcagaagcaggcagcgctacaggcgttacatgatctcatcacttcaaaaagatacaggtcatggcaaaagccactcgaaaggattatgatgaagtatgtggagctctgtgtagacctgaggaagggcaggtttgcgaaagatggccttattcagtacaggattgtctgccagcaagtgaatgtgtcatccttggaggaggtgataaaacacttcatgcagctttccaatgagaaagcagagcaagcaaggaaccaggcgcaagcactggaagatgccctggatgtagaagatctggaagcagacaagcggcctgaggatttgatgctcagctatgtcagcggggagaaagggaaggaccgatcagacagagagcatgtcacaccatggttcaagtttctctgggaaacatacagaacagttcttgagatattgagaaacaattcaaagcttgaagcattatatgctgtaagctattctatctgtgttccccttattcctgtatacatactcttcacacatgacatggcatttcatctggctgttccattttgtgtacacaatcaatgatcttaatcgtgattgcctcgatgctgcgcttctgcccgtctagtgtcttcaaaacaataatgtgaataaacacacctaattcaccgctctactgccataccaccaattggatttccttctagtgctattatagtactcttggtcatcattgttcaatcacattatcatatgctgtattattagagttcctactttaactgcttcatatttttcctatgtcatctaataaaatagttgtacactatgtcattatcacattattatggcttaatttggtaatggtgccagaagtttaacatgatgattcaattaccataattgcattctctctgcactatgtctgtttatatttatgcagatctctgtgtaattgccaatttggtttaggcagattttactcctgtttttttccagaaccttaaataaatttctgaattgtgaaattgatttcctgcacatagtcttctgtaccaagtacttttgcatttgccaatgcatctaaaccctttttaatctctcattttgcagatgactgctcacaaggcttttcaattttgtaagcagtataagagaacgactgaattccgtaggttgtgcgagataataagaaatcatcttgctaacttgaacaaataccgtgaccagcgagatcgtcctgatctgactgccccagaaagcttacagctatacctggacactagagttgaacaactaaaaattgctacagagctctctctctggcaggtccgttccttatattttttaaccttttttatgccaagtgaatcatctttgctgtatgatcgtaaagctttgcttcttgcaggaggcctttaggtctgtggaagacatccatggcttgatgagcatggtgaagaaaacaccaaaaccatctgtcctggttgtgtattatgccaagttgactgaaatattctggatatctgattgccacttgtatcatgcatatgcatggcttaagctattctacttgcagaaaagctacaataagaacttgtctcagaaggaccttcaattaatagcttcttctgttttgcttgctgcacttgccgtgtcaccatatgaccataaatatggcgcatctcatcttgagcttgaaaatgagaaagatcgtaatctgcggatagctaatctcgtcaacttctcccttgactccaagcgtgagaatagagaagtggttagccctccagatctttttcaaagcaaagaatattttgaataattttatttattatcttcctgacatatctcctgtcaccattgcagccatcaagagcatctcttttttctgagctggtatgtgctgaatcctgggtccttttatttatcaaactattctgttgagttttgcactctcgtcagttgtcgatgggatagctgacatggatagttcattcaattctttttgtcagtattatagggttggtagggttgtatccagtaatttgtactccatttatcatgcataattgaatttctcttcttgtgcttgcttgacttgatatttataaatttaggctgccaaaggtgtcattgcctgtgcttcacaagatgtcaaagatttatacaaccttttggaacacgattttcttcctctggatctcgtatccaaagcacagccactgctatctaagatttcaaagattggagggaagctttcatcagctcccttggttccagaagtttttctgtcacagtaccttcctgctttggagaagttaacaactttaagggtgttgcaacaggtatgttcaatggcacactgtacaggaagtataagttctcttttctcatgatcttttacgttattctttggttaacacgtggtttatgcacccttttgttctttttcaggcttcccagatatttcagtctgtgaaaattgatatgctctcaagaatgatcccattctttgacttttctgttgttgagaagatctctgttgatgccgtgaaacacaattttgttgctatgaaagtcaaccatttatcaggagctgtccattttgggaaaatggtatgtggtttagttcctcaagtctgttggccactttagccttctcagtgttcttattggtggaatttacttttttattgttttatttccctgtaagcatcagtatagaagttggttgttctgttcattgtggtatgcatatttatcctcgccaaattatttcctctaaagttgaaatattcatagagaccatagtttgaactgatggccaagatacaattggtacatgacaaccactattttcattcactttcgacagcctttgtagtgtagaacaaaaatgtgttgactcaattgtatatgctgtcttaccactaagacttagggcatggttctttgtgcctctgttacaatatttgtgctatgtgttggaaccagcagatccttgtggcagagtgttttccatgataaaatattgtcaacttatttttgccactaactggttcatgtggcttgtttttaccactgggtttatggaactggcatttagccctaggtatatttgccaaatcgagtgtattgtatgttatttgtaataaaaaagaaagtctgaagaaaattcttgcttgatttattttgcttcagattttaaactaggtgtcactgtcgtagacatttttggtaatctggtaattgtacatagctgtaactcgcattctcattctcaacattatatttaactatgttatattattttttattttttagattttcaagtgactatgtagtgcctgatgttggtatcttttggttttaatacgttctagtttgtttgcttttaatgccaaatatcagacagtactggttcttgtgctgtcaatttcgggacttcagttttattaattattaacctgtgacatcaattttattctgactggtttctgtttgtaggacattgaatctgattgtctcagtaatcacctaagtgttttggctgattctctaaataaagcaaggagccttatccatccacctgtgaagaagccatccaagcttggtgaaaacttaacgagtcttgctgcagtagtggagaatgagcacaagcgtcttcttgcgaggaaatcaattattgaaaaacgcaaagaagatcttgagcgccaaatattggaaaaggtgtctatttggtactgttcaaagtggccaactctgtgaatttctgcttatgtcatattctctcttttccaggaaaaggaagaagaaaaaaagagattgagtgttctcaagaaatctgcagaagatgaaaggataaggcttctcaatgatgtaaaattgagggaacaggagaggatccgtcgacaattggttgaaaaagaaaagatagaggcagaagaactgcttcagaaacagataaaggagatagcaaagagaggaggaaaaaaacctgtccttcagggggtgagaataattagtttccaatcattatattttatttattacgctgactagttatttgttgataatgtttttttttctgtttaatgtattgctcaatttatatttgctcgatatttcattatatatttctttttgtgtaaggcattatatttgttgtgaagacttctgtttcatcaatatgcttattagttatgtctgtttgttcagtccaatattgattcttttttgtcttaactgctcagaaattctagtggagtagtagagggtgtgctaatatgctgttttttatgttttgtggctaaccattatagactacaagaacgcagaacgcagatgatatttgaatctttatattctgtagtgtcctactcttgtttcatattaagaattgattgtcttctccgaagtcggaactataaagttgtactatcccaagccaattacagcttaatatttgtttctccacacaggccctttatactttgaatgttttcattgcaggaagttactaaggaggctgtgatggaattggctatgaatgagcagtttaaggagcgccaagagatggagaaaaaactacagaagactggtaagcaaatggattacttggagagggcaaaaaggcaggaagaggcacctctaattgagcaagcttttcaaaaacgccttgaagtagagaaaatccttcatgagcaagagcagctggtttgtttctcacaattccttgattgtcacattacaatagcatatgattacttaagctcacaaaaatcactattaatctcttcttgtagagagagattgagctcagcaagcaacaccatgcaggtgacctgcaggagaagaacagactttctcgaatgttggagcataaggtaagcaaatacatatctgtattcagaccagatattcttgcactatttcatcttctttttagttaattgaaggaccaaatgtcccactgtaattaatcctgtgtttttccgaaaccatgttttgcaattccaagcataacagttgaaatacttagtatattatctgtgcaaaggtctgattagatacagattaatttaacatataatatgtgctatacttgctgagaatctaatattggcatgtcttctttggctatgtgtgtgttcacatgatttgagcactagacatttgaatacaccaggcgatttgttcctgtcagggaatagacagctgtcttctctccttcgcacatattttaaattgccctttttgcttgcagaacattttccaggaaagaattgtccaacgtcgtgaagctgagtttagtcgtcttaagaaagagagggatgaaaggactagtcaattgatatcatcaaggaagcgtgaaagggatacagtgcggaagttaatgtactatcttaacttagaagagcagcgcctccaaaggctccgtgaggaagaggaagctagaaaacgtgaaggcaagaattcatgactttgtgctttgaaatacttgttcttatcttaccttattagattagattaatttacactgccatatatcgtccagctaattttggaatttcttgagaattagtgaacattgcttgttgaattactgtgactttactgcagtatggacctgtgttacttagggcctgtcactttgatgccaaaaaaaaccttaccaaattttggcatagccaaaatttcggcaacttgccaaaattttagcaggatttcttatatagttaccaaaatttggcaacaaactaaatgtagccacttttcttgcaactttaacaaaatttggtaagattgaaaatggcatcaaagtgaacaagcccttagacaatggatagctttaaaacttaaaatgttatttggcatcaaagtgtgatttgcttgtgcataattatcttgcggatctttttttttttgcctgatgcaatgaaatcaaattctagcttatacatattgttgataatgatttcaccttctctgcagaggaagagaggagaaagagggaagagactgagaggaaggctaagctggatgcaattgcagccaagcagctgcagagagagagggaactagaagagaagaaggaaaaacagagaatggaagctctcatgggaagaggagctggagctgctgagcctgcacgcactcctgatgctgctccggttgcacagccagctcagccggtagctgcaccggctgctgctgctgccgctgctgcaccagctgctggtaagtatgtcccgaagtttaaacgaggtggtgatggtggcagtagtgctggcggccagagacctgctgtggcacctgagcaagaccgttggggttcacgggatgatcgcccacgtcctgatatgcgtccgctccgccaagaggcaccccctgctcgcgatgctgctcccccagcccgccaagatggtcctccaggcacatggcgaccttcaagatactcaagttcatcatcttcctcaacctggagcagcaggcgcaactgaagccgtctgctttcagatgtggactgctagggtgagattttttgctgtccagggccattgctgagataagcctgtgaaacatggttgaatgtttgactgtttgcgcatcaaatgctcgtaaaattttggagttaggacctgcttcagggcaatagcacctttcctaagttatgtcaaatgttatttcgttgttgcagttactccattgcacactggattgctactcgttaagtttgtccaaactttggcgctgttagtaatactggaatattgcccttgtctttgtgtctttgttcgtttggtcgttgctacaagtacatcgcatttcttttgattatcatcaaactaatatgacttgttgatcttgattaacaccaaactcggatgaagctttgacgaagagttggcggaaacatgaatcatggtggtgtaccccaagcaggaacgcactgctagcagttggtagtttgatgcactgggatttcggagctcgatttgcaccggaaatacaaccttacctatccgcggtctcctacgttgctcaagtaaagcattaacgttctccaatgttgctcaagtaaaacattaaccttgcatagaagtatgagactgccaatctgtttgaccttgcatagaagtatggatggcaatgaactgaactgtacaacatgaaatgccatccctctacatcatgccaaaattcgatgagtgttgtcatttttggcatcccattggctttgcccagtaaatccatctggtaatcagaaactcggaatggagttgggaggcaggatgcgttcgcttgtctccttttatcgcacgttctcgatccaacggttcctgtgaataccaacattctaccaccccagtttcaaattttttttttcgaaagaaaacgaaaagtgaaaaaaaaaagaaaggcgtcggcaacttgagttgggcaaagagcaaggttccacacgctgtcactgccgtgtgggccatccccccccccacgccacgcgctctgctctttctttatctagtcggtaggctcggtccactccgcctctctctctctctctcttcctcctccgcgcgccgccttacccctctcctccttcctcgacgcggcggctgctccagatcttctcttcccctcgcggcggcgtctcccgtccaatccagtgagttctcctctcccccccccccctcctctgcaccgcttgctgcatccatccacttctctcctccccaactttttttttgaattttttttcttactagatagattcgtggtgagggcttagatcgcgtggtgcggattgctcaggctccggatctgtacgtatagacgcgcgagccgcgggagattctgagtgggtggctaggtttttgtgctgtgcgtctagggtttgggcgcggttcgtccttgttctagggttccctcgcaattcagatctgactcgtcgctggaatcttcgtggggcttcggtttttcaaattccgtcgcctcaccgttgccgcgaacacccccccgctagggatgggaattgggcccagactacctgtgggctatggctatgccccgatatgcttttttgtgcatatatattcccatcgagatcagggggcgactcgagaagttgcttgctgaaagctacgtcatatccgctacgaattcacacattttctcttgttgtttcaggtgaactatcggctcagtaaaaggggaaaaaggagggatcttttctggacatttg

SEQ ID NO: 74330 - DNA, 82412 bp, Oryza sativa
aaaaaactcgcatgctaacttgagacgatcggactcctaactgcagttcattattttctaaaaatatatatatccaagcgaactcgcacagtgaattttatcttaactaaacaatataacaataatattattaaaatagaattcaccagttgcaacgtacgtgtatttttttctagtaaaaataatatgtttggactcgtccacgctacgcccatgctttgtccaatgcttttcactatggtagactccaactcctgccatgtctcatcctgttttctgtttttttattttacttgaaaaaagaatatgagacaagctagagattaaaaaaaaacagaaaagggaaaaaaaagaactcgacaaggccttcatggctgtttttcacataaagtgatccccatcatcatcgacatgtccagcgtgaggaagattcttggtatcgcgcaacataataatactaaatgatagggggaaaaagacccatgtgagcggaggaaaatagtaaccttgaacactatatcaacttatttagctttaaactctcaatttagtcaagagcgagtacaattagataatacaaacaggttataaaagctgccatattaaatttgtgctaaaagtgaatgagagaggatgcagtacgtatctataactaactattgtattagtagctaggggtgaaaacgggcaagtacgattgaattatgacattcacatatcataacccatattatcttttaaattcagagccgggtacaggtagtaccgaataacatatcactcatcctatatcctatcccacactatttccttccaattggattcgggaacggatatcaatttgtatctctaattcataggtattaaatataataaggtaattaaagtattaaaagagatgcatcaagaaaaaaaatatataatattacatgtgagcacgtaaaataatgattaaccaatatttttattatgttttaggtggatttataataaattttcatacatattttataatacgagacatacgggtatatacatgtcttcccgtatcctaacccatattttcctaacaaattcggattcgaatcgggtaccctattttttctctcatattcctcccgcaagccttgggtcgtgcgggcggtcggtcgggaaatacctgcccctatttgactggtttaaaattatgtgtcttttttttatagcgagcagtattattgatctagttcctagaaatttaaacagtataaattcatatattagttatatgtacatatcttagggcgtaaatcacacaggactctcggataagttatttcaagagtgtttccattggtcaaataaaatgttgttttacgatttatcagtggcctgattttttcttatccgtcaggttagtcacctatacttgcacaggttatgcaccaaacttgaacgatataaaaaactgcaactctcgtacaaatgaagtgcaactttttgcttgttttatatttttggattaatctacttaaatttttatgtttatataaaccatactaatttttagtttcgtaatggcaaaaatttacagggaagcctttttttaaaaaaaactttcaggttagaaaagtacttgcttcaccacaagaaaacaattatcatacgtgtgagttgttgatattggtctaatgttaagaaaagagagtaaaatataggtctggtccttaaacttagactaagaatcttaacaaggaaaaaaagtcaattgcttaacaaataatctttgagttaaataacttagaagagggtttattttaagaatattaaagttgaaatttaagaataatttccaatccccttaaaaaactaaaaagaattccaattgaaacatgatatatctgttttgtttcgaacttccaagagatgaggcatcgaagaagaatatgctccagcaggaacccgacgccgctcactttttactccgaatttgtccacgccaatccttaatatattttttttaacctgtcgtgttggctcatctgatttggacgttcaaaagaattaaagaattactaatactagtacatgcacgtcgagaaagaaagatcttggaagtcgcggatgaatcgctttcagcgtatatataccaatgaaactgaaatatttactgtaccgatgtggaaagagttcattgcgatatcgccaagtacaacactgaaacaaatcttaattttgttccattctttttttgcttatcttgtggcgccctaaaagttttctaacaaaatcacttgaaatacagtttgtgtggctcatgcatgccctcgtggcacaatagtgcacacgaaaacgctggctatgaataatgagaaaagcataatcaatgacaaacgtcctgctgagtgcgagtgatgacaagggaccggccgtagcaccgttttcgcgaaaatcaagcaaaaattgatagtttccaaaccaattttaaaaaccaaaatttgaattcaaatttagagtaccttgaaatttgagtggtttcaccaaaatttctagtgaaaatagatttgggacctaggttggcaaggtcagttttcatgaaaatcaacccgttcctatcagtaatgaaaacccttcattagcaactcaatttacatatcaaaatgaaaaaaaaacatgagaaagcattgtcatttttctctatatcttgcccttgtttttaacatactcttgccatgaggtatctctcttttataacaaccatgtatgtactttttgaagataatgttttggcctttatcttaaaaaacgttgcatacaattacttatagagcccgtccgcaaattacaaatcgcatctcaattaaaaaaaaaacttaaaactctagtctagagagagataacttctattgttaaaccttaatactctctatcccaaaataagattatttttactccctcttatatttataacaaaataagtttatctttgagtaatcatcgcatcggtgtttatgaaaaatataggatgaatgtattggaagtagagaaaataggggatatttgcattatgatttaataaaataaaggtattttttatatttgtttatgcgtgagatgtagctactcctatcgcgatcgagcggttgatgatggactgattggattcgcggctagctattgctagggcaggctctcgtagtagttagctatagctagcttatcggatcagccaaggattggcgtgtggtaagctcacgctagaattggagagcaaagataggagcagaatttgttcggtcgccgcggaaacacaaggcgaaaagggcggtcctggattgctgatcaacgggagccatcggtgttggtcacaagggtaaacaacacaaaggcacgtactaatatggccttgtttagttctaaaaacaaaaattttcacccatcacattgaatgtttggacacatgcatagactattaaatatggaaaaaaaatcaattacacagtttgcgtgtaaattacgagacaaatcttttaatcctaattgcgctatgatttgacaacgtggtgctatagtaaacatttgctaatgacgaattaatcaggcttaataaattcgtcttgcagttttctggcggaatctgtaatttgttttgttattagactatgtttaatactttaatacttcaaatgtgtatccatatatttgatgtgataatcaaactaaaaaattttccccaactaaacaaggcctaactcgcgtatgtacgtttggcataactatgatctttatatatacgcgtgcgaattgttcaccgtgtacagtgaaagttgtccggacatcctaatacgacaaatccctctttcaatatacgacgatattgactttaagatattagttagaccatctatcttatttaaaaatttgatgaaaacacatgaaaatatgcttaaagaaaacaagtcacaaccaaataaattacttaacatatttattttcgaagaaagataaacggtaaaacgttatatcaaaattgaacagtgttatatgctccattctcggatttcatattgagatatttgatttgagattagaaaactgggaagaagaaagaacatgttactaacgtgttatgctggcaataaatcacaccggatcgatgagtggcctctacgcgtgacacggcagtcgtgacagacgagtgaataaaaaataaagaaaaaataaacgaaaagtaagcgcatgtcatccaatccgagccaacggacgcggcgccctgccgtccggacgagtccatggtccaattcttgtctgttaaataatcatggtggctgcgaccaaaacagatcaaaactagtacacgtcacaaaacaaaagaaagagattaaggtgatgtttgtttgatgtctaacattgccataactagttaaagtatagtggcataagtgtggcttagaaatagttagccaaaatgtggcaagcttaacttcaaatttaagagtatgacatgtgggtccttaaggttatgaaagtgtggcataacacaattgccatagcgagccaaacacatacctaagaaattgtggcataactaaagtgtggcgtagcaaagtgtggcaaccaaccaaacagccccagtcccattactactaggtctacctccttaaaaaaattggtttattttgaaaatatccaaatttatgtatgaaagttaacatattttaggatagagtaattaattaatgacgtacaggtactaaaacacctttcaaatttttattacgtgtactagtactggcaataagagtgtacgactgtacgagaaatctcatctggtaatcccaaaaacatagcagtgataactcagctgaaaaaaagaaagtaaaaaaaaaagtacttccaaaacaaattttttcaccctgccacattaaatatttgaacacatacatgaaatattaaatatagataaaaaatcaattacacagattgcgtgtaaattgtgagacgaatcgtttaggctaattgcgccatgatttaacaatgtgatgctacattaaacatttgctaatgacgaattaattaggcttaataaattcgtttcgcagtttttatacggaatatgtaatttattttgttattacacaacgtttaatacgttgaaaatgtatccttatatccgacaccttaaaacaattttttttctgccacgccttagcaaacagacaggcaggaggggaaaaaaagaattgaaaagaaaagaaaaaaaaaaagaaggtggcagcacgaggccacgagctttggggggccgtgggcggtgggccccgccccgcatcccccgcccagcccagcgcaccacggacggtggcgaggcgagggcgcctgccgcccacgtggaccctgacgccccgcgtgacgtcgcgccccgaggccggaatatgacacgcgggcccccccttcctccaccaccaccaaacggggcgcgcgtcggcacgccaccccacacaccacgcgagtacgtacgggacgacgcggcgcgcggctgctcgacggcttcggttctgagcccagcgcgcgcgccgggtggtttggttggttggttgggcgaagaagcgatcgaagccgggggtgtagtacgctcctcacccgactcgtttccgtccgggcgccgcgccgcgccgcctcgcctcctaccgcacgcacccccaacttgcgcccgcctacgctcagcgcacccgtttgagtgtacccggacgggaacctgggcggataaatggtggccttttttggatggatggtgctgaaagggccaggttcaatgaatcttcgattcgtgcgtgctggagtatactgtacagtgcagatcaggtgccactagcaaatgtttttgacaagtaaggtttggtttggatttcggtgattgcttggagtggcgcattcttgtcaaatgagatttaatatatacatataagatatggattttttcatgtggatgcaaccgtttctgttttcacgtggattcttgctaaatgagttatcctagtatattttttttccattgttgtgttcctcataaccaacatcgccttgtttggtagccaccgttacaattgttaaaagtcgctaaaagctgtagcacttataaaactgttgcaaccgcaaaatatcgtctaaacacggcctatattggatttttctaaaaaggcatgattctactttgtttccattaccttttctctaataagacaggtatatgcatctactccctccgtactcgtaaaggaagtcgtttaggacagcgacatggtcttaaaacacaactttgacttcttttttctataaaaatatttattgaaaagtgatatatgtatacttttatgaaattatttttcaacacaaatctattcatataatttttatattttcaaactcaacaacttgagagttattcatgatttatattcccaaggtttgacttaaacattgtcctaaacgacttcctttatgagtatggagggagtactaatatttaaaatccacatactctaaaacttcatttttgttataaacaaactttatattcgaagtttgcgaaacattcatatgtgattaaaattgtcgcaaactttttgttgcaagaaataaattttgttaccaataaatattcattatgtttttggaaggatgcatatttcattgaaaagaagcaactttcctccaaaataacatatcatttccatcatgttaacgcgaaaacatctattatataattaaagaaatagaaaaaggagcctccacgttcgctctcatggtctagaaattctcacattaatcggagaaaaataaaaaacagagtccatatagaaatacaatttagaaatagctaaaattcagaattaaaaaaataaggaatattaaaagaggagactagagtccatatagaaatacactttagaaatagttgaaattcggaattaaaaaataagaaatattagaagaggagtatagagtccatatagaaatataattaagaaataatagaaattcggaattaaaaataaggaatattagaagtagagtatagagtccatatagaaatataattaggaaataatagaaattctgaattaaaaataaggaatattagaagtagattatagagtccatatagaaatataattaagaaaaaaaatagaaattcgaaattaaaaaataagaaatattagaagtagagtatagagtccatataggaatttaaaactaactaaaatttggaaaaaaaaaagaagcctccacgtttgctctgataacattaatcagagaaaaagaaaaagcagagtccatatagaaatacaatttagaaatagctaaaattcggaattaaaaaataaggaatattagaagaggagactatagtccatatagaaatacaatttagaaatagctgaaatttggaattaaaaaataaggaatattagaagaggagactagagtccatatagaaatacaattaggaaataactgaaattcggaattaaaaataaggaatattaaaagtagagtatagagtccatatagaaatacaattaggaaataactgaaattcggaattaaaaataagaaatattagaagtagagtatagagtccatatagaaatacaattaagtaaaaaatagaaatttgaaattaaaaaataaggaatattagaagtagagtatagagttcatattggaatttaaaaccaactaaaattcggaataaaaaggagcctccacgttcgctctcatggcctagaaattctcacattaatcagagaaaaagaaaaggcagagtacatatagaaatacaatttagaaatagctgaaattcagaattaaaaaataagaaatattaaaagaggagactagagtagttattacacattagtagttttgaaaagttattgcaaaatttaaaattatgttgtcattgtaatatattttataataatataatgagaaaagatatatgcttttatatgagagaaaatataatgatgctagccgcgcaatctgcgcgggccaccatgctagttagcttctaaaacatgagaaccgtccaagattataagcaacaccgaagatgtaaaaaagctgtaccaccattcgtacttagacagtatgtcgtgctaggtgcaaaactaacattcacattcacgaccacattcaccgccacgacactggtatttttaatgaatatttttggcacttttttcccatcgcgtcccatttaggtgcacgcccgcggggtggcctcagcgattttgtggtgcccccgtgctgcctctccatctcttttatagcaacaaccagcgtatgcgttctcggtttttctccgcggcgctttcaccgctctctctctctctctctctctctctctctctctcctccgcttcttcctacaaagccgtgggcgctgctcgccgcggcgggtctctctcgcgcgcgcaacaacagcagcctcaaaaccctagctgccctcgcgaccgggtcagggccttcgattggatcggccattcggttcgttcctccaggtgcgcgggggctatcgaatcctctgttctctcttccctgttcatgttgattttttttccgagttctttttttttaaccgtttgatgcagcggtgggtcggggctgttagtttttttttgtcgtttcccctgctcaaatctgtgtatgttcttgtttggatctcgtagagtttgtttcgaagctttctgggcgattctttttttgaaatacaggttggtgttcttcgcctcagcctcttgtaaatcgagtgatttctcggtaggttgtatttttttcctttgcgatttgtaatagtacaagtttttgttcttttctttgtatttacaaggatctttttgctcttaaaagggccaaatttttatgggttccctttatttggacggtctgtgttcattccggaccttttccttttgccctcttttatggtttctgttcagggtgagcaatttggtgatatcgccaccaaatttgatggtttggtccttttctctcatggttctaggtcctttttatgaatccttcactgcaggatgtgcaaattcatctgatatgtttcagtttctacttgtttggggttacttacgttgatttgatgacaccactcgtaagagtggcaaatagttaattattccatttgatgagggaagtggaatatcatttgcagtgttaatctgctgtgctaaatggcactataatatattatagtataatactcttaatattttcggtaaaaacaaaactctttagtagctgatagaaaatgtcacttagaatagtataataggtataatgcctttaatagttgatacttgatagaagtgagtgtttagtggcttcacacacctactgaagacatttgtttgtttcgatggagactgcaaaactgatagatgggctatctagtattagttctaatggaatctgaaaagaatttggtgttcttctaattaccctgtggctaatacctaaccagttatgctgcacaataccatggggtacaaataacctgacttatatattcgatgttacatagattttgccaattccctcctcctatttactttacaaataaacgaaacagtgttatatacaagtatttgatataagtcgtaatgttttgttactgatattcacaatatgcttttttttgcaggatattgttggtacttgcattcctccgtctgttattcaagaaagccagtttacactgagagaaccttgctttatttggtaccactcacctttcctatcttctattttctgcccagagtagctacaattttcttcattggaccattggtactcacatcgttaatcatggtttcacgttatatgcaacgacacactaatctcagttctttgtgctttcaataacaagaaaatgtgttcatagtcgcggttaaagttgccaagagtaataacttgatatggtacccatagtcagggttaaaattgcgaagctgttaggtttagctacctgttaagtaagtgaaaccattcaattcagtccagatggcatctaccaatggagcccaactttgagcattagcatgtccataatattgtatgcatgaaaatgataccgatatagaagtatacattataaaagaatatcatcaatcatagtatttgaaactttcaatcttttgttaacatatgcatgtaaccactaatggttaaagttaattgtggagacactaatgtccgaaatgattcacttacagacgaatgcagtatatttgagtaacggaatgttgtacatacacaaggatttgctttaaagatatgcaaacattgaattgaatccaaattaaactgtaaagaccatttaccatgtgatctactagtgttgatcatgtcaaaagtccactgaattttttaaatagattttggtttccctttgttcttcaactgtcatgatccttcactattatggccctctgtagacattattttcaaagcattgcacaggatgagattcttgactgtggcttaactttttaattagcaggttcattggccttttgttttgcctgagtgaatgcaattggaaccttctgggtagaagctgaagcttagtttggaacttcatcatactgatttcatactcagaaagtggcgagaaatggatcgtgatgatatagctggtttcgtaagtggaggttgcaaggccttctgagttttctgacgaagcagatgataatagagttatgatatacagaagtcaggcaactggttcttttcatttactatttggttgacgtttgaagtttgttaactggaatggacaaagcatcatgtggccttgggtttggtgatagtatcaactccttagacacgtcccgtcattggagcactgttcagcatacttctgggcttaaagctactacaattgactattcaacgtattccagtttttctattgcaagctcaaaaacactaaaaaggaagcgaagtgctatggcaggaccagaaggtactggaaacccattacttactttgggtttagggcactcaccaagttcatctgacaatagcaaagttagttctgccacagcttatgcaatgtctccatcttcattgaaagaggctgatgaggagtcatcagctgatcttggcctgaattttgagctttgccttggcaatgatatggtacattgtcaaaagaaatcccctgttggtgctgagaattcaccattgacaaactctcataaattggatcttcagctgagtttgtctactggatcacctgaatcagctgtcaccaacacaaatatggtgtcaccgattattcacggtggcttggagatacctgttaccaactgttcaccagctattataggggaaggatctgtaccctgtacttgggttttcgagaagtcagtgatttcatcttcgtatgcctctgaagcaacatataccttcccattttcgaaggtacccaaaacaggggatgctgctatgtcttctccagtcatatcgtcaaccttggtaacaagtatgaaaagcccagttgcctgtacttctgggtcaattaatccccaacaacgcaacagtatcactaaaaactgtcagtttccaggatgtgttaaaggagccagaggggcatcggggcattgcatagcccatggcggtggtaggagatgccaaaaacctggttgtcagaagggtgctgaaggaaggaccatatattgcaaggcccatggtggaggaaggagatgccaatttcttggatgcacaaagagtgccgaagggcgcacagaccactgtatagctcatggtggtggtcgccgctgcagtcatgatggttgttcccgggctgcacgtggcaaatctggcttgtgcatcaggcatggaggtggcaaaagatgtcagaaggagaactgtatcaggagcgccgaaggtcattcaggcttctgcatctctcatgggggtgggaggcgttgccaatttccagaatgcacgaagggtgcacagggaagcacaaagttctgcaaggcgcatggtggaggaaagcgatgcacattctcgggttgcaacaaaggagctgaaggcagcactctcttttgcaagggccacggtggaggcaagcgatgcttatttcagggtggtggtgtgtgcccgaagagcgtgcatggcggaactcaatactgtgttgctcatggtggtgggaagaggtgtgctatttctggttgcaccaagagtgctagagggcgtacagagtactgcgtgcgccatggaggtggcaagaggtgcaagtttgagggctgcgcgaagagtgcgcaggggagcaccgatttctgcaaggctcatggtggaggtaagcgctgctcatggggccaggttgacttgaacttcggtgtcggcgcaccacagtgtgataagtttgctcggagcaagactggtctctgttcagctcactgtgctttagtccaggaccattgtgtccgtggtggtacattaggcgctgcaaccttccagttcgcaactgatgccaaattcgacgagatggaagtcaccccagtgaagggagatcctcacgcgcaggcaagcagcgacgaccagtctcatctcggtggtgctcatcctcctgctgtaccggcgatcacctcggatcgattttctgaaggaagagtgcatggtggtgggctactggccttactttcacggggtggaaaccatgcgaatgcaggtaactcaaagaatggcgcccttctaccatgatgacatgggagtgagattctcttcaagaaattggtggctcgcagttttgatctgtttccaagagtttgtgctgtgacggacgggaaaaactagtgttttcacatttcaccagatgttcttgtgatgcttggatttgttgttatggccctctcccgtgtgctatatataaataaggagctcgtagagcgtggagtaccgggctttctgtcttccgtgctattgtagttgatgtcgttgaactgcccttctgtcagaattcatgtaatcttggtacttcgtgtttatttgtattgtcagtgatttgccttgctgctttgctgttggaaaattgtcgtgtatttttgttgatagattatatatattgccttttcgttgcaagcctagctgttaatacgctcgtttcttgttttacaattattgcagctgatcgttctgttctttcttgccgaagaggctttctcatagatacagcaaggccataatacaattattttttctttgcaatttagcacggacagttgagtggaatctcccgttattgagttgataatcttcggtccagagaatgacaagaaaaagtatgcgagatcaacacaaggtccggcgcaaagccaaatctacagaatctaggattgcaactcgatgtcctggatgatcacacccatcaaatgggcaaatttacaaagcctcgaacatcagcggggcaggacaaaactggacaaaaacaatcacacccatcaggttgcgaccggttaggacattagtcgaggcaaagaatgaacaaaatttcctgctgaaagaatcatcgccctaagtatgtggttaagtgctaccgatctaccgtcctagtatcattcaagctaccagcgtcttctggcggtggctttatatacctccctaaagttttttgtcgagctctcttcttgattctctggatcttgtctttgctctgctgcttcctccgctccttctcctgctgcctcatgttccgctcccgctcgtacacgccttgccagaacacttcgccggttttcggccagagccacctccggtcaggatgatcctcgtcgaactcttctgccaggtcctcgtccatgctcttcagagtggcgagggagaaccattggattgacatctgacctctcctgccgttgagcagatgttgctcctgcatcgcaccagtctcggggtctacataaaccatcctccttgaactgtggaatgcccaaacgtttacgatcaactcaagaacacgggagtaacagtgttggtcctgtgcaaatcaacagagcaacgagacagaattagagaaggccataaagaaaactaatggaagtataatagtatccattcgaactctcactatgttttgaaattttcagatctatacatgacactacgtgtgagcatatttcattgaattcagctgaactgcgctgcaactgaaagaacattaaaatgaaatttgtttcatctaaataaagtaagagatggacgcaccctgtgaagactcaatatgcaatgccctgtttcatgatgtttgtcgtacatttgtgcatccagagcatctacaaacattctggaaaattgcagcatatcagtagtggcaaccaagtagctaaaactgtactacctccggtcacttttatttgtcgtttcagacaaaagttttggcttattttctttgtaaattccttgtctcaaacgtcaactaattatgaccggagggagtagattataagacaatcacattgggtggggtataaaagacgagcaatgcagctatataacaaatcaattgaagaaaaggctatttagatgcctaccatgatgctactatagcaagaattactttgaccacatgccaattgaaattgaaagagtttactttagaccgcccaatatctgcccaggtaatcacaggctacgctgtaacatttgaaagtattcatgttaacattcattgccaccacaccaattctgcgtactttaatgttatacgtttcagcatattgttaatctctaatttcagtctctacagcaagcttatcactgtgatacaaattctaattttacaagtttttaaaaggcaacagtagttggtggcagtgaatcctattacactttagtctttctaaatattgctaatttcatatttccatccctaaaactcaagtttatcaaggaaaggtccatgattacaaaatcatcacatatacatatcacagaaatggtaatttgcaattagaacaatgtaaaaagaagttaagtgctccctataataacaaaagtaacaataatgtgaagtgtgttcactgaaaaaactctttgtttcaaacaatattatcacatgtacgattcatttttctctagtagaaagataacaggcatttagctattttgagcaaatattagtagcagtgttggtgtacttgtgctttgaaatgtatacaccaacagttagctagtgacatcttccacttaatactgctatgttgactattgaattccaaaagagataatgtgcaccttgagaacattacaaattccaggaatgatctcgtaggcaaaacccagctttgcatcacagaccaagtgtctccatcattaggcattagtggcagggtatgcaaatcatcatcaagctgcacgccatacatcctttgaaaagctttcagaacagctgaccttcaagatagtaattgtgtagtggattagttcatccataacagcattcagttcagtttggcagcatcatcggaaattctatatgatgaagctaactgcttttggttggaatattgatattcataaacagaaaagtaatgaaaaaagtcttgcggtttagtaataatagtagaataaacttatgagttatgtccaatccaaacaaaatcattttaaactggagcatttgtaatactggaattgcagtctatgcagcatgtataaatggttaacctgcaattcccagcattgatcgcatcacagaaggaccagaaatcttggcttgctaggttcctttcatcttggtccatccgaacccaaaaatagaaggcatctccatgcttttgagtttgaatagcttccaaaagtgcagtttcagcctttttcgacaagtttgcctgttcagtataaattgttggcttaatcattatgcaagacctctctgctttgcattcttaaaaggatcaaagcatatgaataacatggttaaccaatgattcattcatcaagtaaattcatgatttaccaatcatacacgtcgattaaaattaagggggcttaaatgcaaataaaatttgatcttctacctttcttgctgtcactctccacgactgaaatcctatccaagaatttttatgaattcgatcaatcctgttggctagagcaaagaaagctccaaattcaccaagaatatctctgtagtacccattgttcagcagtggaagacgagaagaagcatcaatgtcatctgcgccaggccttcgaccttttgaagactaatcaaaaaaataaacttcattgatcaatgtaagtcattggaatatttggaaacagtcaattatatttggctagccatatatatgtttcatcaattacccttttatgatacatcattcttctcagactttaggataaagtttagatggattagatatacagaagcttgagagctaaatggatttataattctggaataatcccctcaaagattgagaaatcatgaggatctctccctcctgaagtggctcttcaagccacatgcgacagtttgcaagttatctccaagttaacatttagaaatactgttaggttttcatcaaaagttggaaattcccactccatattaggtgaacatatgtaacaagtcatgaaatcaggtatataccagtttagaaaggagtggtccaaaattttggaatctacaactactgctctttttttcgtttataacatcagaaatggtttcaatgaactcctagttcgaccattcaggtaaagcgcaaagagacaacaaaaacttaccagaccaattccacgataaagggagcttctatgcagaaagggccaagtcccctccccaaagaaaggttcgtatatagaaagtggctgacctgtccgctccagctccttatcatctctttcatgcaagtcattcttcatcctctctactcttttgacatttctatacacttcctcccatgttccatgaggctgttcactcctctctttcagctgcataatatcaatccatccacttacttgcaagtgttctttccaaaactgtaaactgcatgtcaaatttaaaagcaattgcatttgtagtttgtacttacctcctcttcttccaatctctttttaatgtttgctatctcatctgctctctcttcctcccatgccataagagagaacgtatcatcaatctttgatgcattactgtgatgatcttccatttggttgctgcgccacttctcctctagtttctggagtatattgtagccagccaaagtcccattcatatggtacaagtgcttcacatcctcaaaaagatgccatttccactcttgtttcaaagcaacaggaatctccccagcagttaatggggttagtacttcagcaggaaacttgataacgttttccaatagcacagcatacccttcaatggtttctgaagccataagattcttggcatggacctttccagctgatgcaattttttgccccagaacagatatcttcccatttgatactgcttgcaatagaacttgtgttaacttgccaatgttcttacttggaaaaagaagtgcattcatcccatcatcaatctaagacatcaagataaatgtgtcagttagcatcttaaaatctacaataactggtatttgagctgacaagtacaatcctgatagaatatgatatgtatccgtgaacatacatattttctgataatttcaaggtctggagctataaccagcttctcaagacacatagcttggactagcacactcgggaaggattgctcgttaaggcaagaaccatatataacaaggtcagatataccaaggaggttgtccttatcttcagaagcaacatgttccactgcaccccttggaaagccaacatttaaagaaacagcctataataatcaaacagcacaagcaattagaccaaattttaaagctttaaaacttctgaaaagcaaatttagtgaagaaaggcagaaggagcgctaaataataacctcaagggccatcctatgcttctcagttacgttttctgccaagattctcactttgagttcaagttgtgtgctattctcagaaggatactgttgtaacagagaccctactgcttgtaagacaagtgcttcttccatcaaaaaaccaccatatgaaaattgactaccaacaatagaaattacaaaatcactcggacttaaacccatactgactctcacatcttggtcataacttttggctgaaattctatcttgaaatggtactgcaggggaacctggaatcacgaaatagttaccagaatcaaatgcagcatacatcacctgcaggatgcaaatacagttaaacagtctatttttaggtcgtacgactatattcaatgacaataagttatatgatccaaaagtaaataccggcaatacatagttggggaaaacaataacattcgccctactgaaggcctctttccaaccatctaagatctggatcattccactagaattatattcactaatacgatgagcaagagaactttcttgaacattccaaatgacgggtatggatttgaaaggctcctgcagaagactgtagatagtctaaatcaaacaatagattttgtgtaaactttaaggtatatcataatgctaaacaaatcaacaaacagctatagaacctgttgtttcatacctaccttgaaaataccggtcttgcttcaatagaatttacaagtatgccatcatagctgcagaaataatgcaaataaacctgatgaggaaatgattacgaagtgaggctgaggccacatgttatgcaattgtacaaagcgagaaaaaatgtattgcaggatacaacaaaatgagatatatacttcagaaacttactctagccaatctacagatatatgtaagtctgtgtcctcaggtaaaaggtcaactgtgaccccgatagttctccaaatattagtacaaggaccatccttaaatgtgaaaacctgcaacaataatttgtaaagggggtcaagggcaaaatcacaaaactattttttggcgaaattatagatcaaataacaaatgttaggtcagattctagcacccaacatgctacggatgctaccagtgtcagaaactcatgcataatgttctcattcagcacacttctcttcattccaacttttttttctttttgcaagccagaagcccagaactgacatattagcatatgcaacttttacattactggatactatcacaattcacacatgatggaacctgaacttattgcaaagtatagaatgcgataacaaaagcaaaagcaacaatatacccaacttctacgataataaaaaaactaacggaaaacataacaagagacacaggttgcactcatttcgttcgaccggtaagttcactacgcagtaatgaattcagagcgaaccagttcagcacgcaccttcatttcgtagcccatcgcctctagcaccgaggcaacgctaaccatctgaagctgcattgcaccgggagagagatccccaaacacctacaagggagtccaaacacaaacagcgaacgaatcaaaaaccccacgtcgcgagaagaaacttggcccaaatcctccacccacaacaccacacaacccagctcaactcctcaccatggcaagtcgcggcttccggaccccgaacctcctcacgggattcccgagcttcgccaagccgtcggcctcctccctccgctccctcgcccacctctccctcagcctcgtcggctcgaacgccacgccctcgcctgtctccaccaccccgaggccgcggggcagcagcgcctcagctccccctcccctcccgccgccagctctccgcgagggtagcagcatcgtcgggcgctcgaagacggccgatccggggaggaaggcgacgacgaggatggtgacgaagaagaaggccgcggcggtgccgatccactggaggtagtccaccttctcgaacagcaggaaccgcgccagccgggatctcgcgctcccccgccgcgtcggccccaccacggagcgcagcagcggcgacggcggcggcgggtggccacgcttgtatccccccgcccccgcacccgcacccgcacccacaccgccgccgtcctcgagggaccccatggctgctacgctagggcttagccgaagccatgaaccagtagtagcagcagcaacagcagcagcggcggcggcagcggtggtggtggcagtcgactgtgctggactcgtgagcagtacaagtctctctctctctcttctctcctctccgcgaggcgttccgttcgctttggtcttggagatggggatgggaggaggaagacgaggaaggtggtggcgtttaaggcaacgcgagcgtggcgaggcgagctcgcggccgtccgatctcgatccgacggctcacggcgggggattcccgcgcccggagcatggaccccgctgtctcgggaaccggatggggatgggggccacacgggccacggccgcctggggctccgcgcgctgtcgccaactcgcctcgccggggtaggtatggcaggtgggaccacgcaccgtccgggccccagctgcagtgtctgggtaagcccgtgtagcaggtgagaaatactactcgcggctcgggcgggggtcacgtttcggtcttttcgacgagatgtttttctcgagcagcgctgtggtggaactggaaggtgatggaaatggaataaataattaatccgggcttagtaagataattccgtgtcattatcgtttcttggcacgcaatggaaaagtgttactaccacgaactaaatcttgagaggaaaggattctgcaggtggtggcggcagctttgattggtccgcccgtaaagtttttcagcggggtggggtacacgggggtttagatctttatttttcggggaaaatgaggctgtgactgtgaaagctcagcacagccacagcagaagcgtttctgtgaccgaaaggcggaaagatcgcaaccgtggccgtgccaaagtgtggatgtgcaggcggccggccgatgcagagcgcaatggcggctggagaatgtgtagaaagcatcgcctttgtagtttggcctccctgggaaccgaggaatttagcggaaatttcaaaagaaacaaactaatttctgttaaaagaaagttatacaaaattcttgtgttctaaaggagactttttttttagaattacacagtacaatgcagacactcacaacgcacgcgcattcatccctatgaaaatatgcacgcaaattctacccctacaagcatcttcgaagactgccggcaaatcctgaagagattgacgaagtcaccacagacgcctcgctgtcgacggatacgtcgcctaccactgaaagcacaagtcagcaagaatatactaacatggattcaaacttaaagagaatccgctggaaatttataatcctgcagctgtaagtgggcattttagattacgcagttcattgtctttgggaattaagaggattcgctcattagactaaactaagtgggacggtacggtttgggcgttggatgcttagttcttaatgacgttagcgactaacggagtagcgtgttaacacgtgcaaacaaaatcttcatgggtttcctagctactaatggccaatatgagctggagaatataagcatgcaaattgcgcggtcatgtgcgtgttgaatgccaaagcgtgcaaagaggaggacctatctgcacggcagctgacattgatttgctcatttgcatagtggtagactggtagtggagtgagattttggacaaaaggggctccatcacaagtaggctagagattgtcaccatctcttaggcagcgttctagagggtgagagagtgagtttgtttgtttcgtttttcgcgtacacgtttcccaaactactaaacggtgtgtcttttgtaaaaattttcaacggtgtgtcttttgtaaaaattttctacagaaaagttgctttaaaaaatcatattaatccatttttaaaatttaaaatagttaatactcaattaatcatgaactaatagctcacctcgttttgcgtatcttctcagtctcctcaatcccttcttctcaaacacacccttagatctgctcgcactaaaaccactcatcgtcgagactgatgtatccgatcagtaatcagtttgctttacaatcaagtaaacagtcagtttaatcatggcaatccaagcacaataattaagcattcaacaatgcgctctcccatcatgaacgtgtactgtagatcacaacagtctattcaccgccccagtcgtgtgctgcagttctagaccaacggcagctcagatgacagtttgcaacagaatgcaatacattctcagtttctcacaggactggtcggaataaggtctcctttcaagcggatgaattttggagaattttttttatgaattgaactaattcatgcaaattcttgtaaaattcatgcttggttatttacgacccacatgtactaatcatgcaaagttgaaaatgtttgtggtaaactaaccagtaatatcaaccagaccaccaggacgctaggaaaaagcaaatggagcaggtagggcaataccccacaggaatcaaaatcatatggtccattctccgttgtgctgtttctgaaaaggcaatcatatttgatttatcgagacaaagacaccaaggcgattgacccacccctcttaaaagttgccgacacttgtagttcctgctcagcggcagaaccacaaatcgcggacaccggtggcaaatatcagtatatctcagctccgagcttatcctgcactgtagcaaaattagcttgtggataactctgtatatccagtgattctatttcagcccagtcctggtcagcattccacgagaatccaagctcatgtgctgggaacagatgctatcaaacatcaatgaacatggcaattttagtatgggactcaaatatgagaccaaatgctatcaacgagattataatttttcttaaagaaaaaaacatatgttagttgcaaaaagggcatcagtcttacaaagttacctcatccattccaaattatagggcgttctctttttaaagtaaatcaaacttgataacttttaactatttatcatactaaccatatacatgctaagtattatgcatgttatattactagatatatattttaaagtactttcatgtgatgctaatttcatatttattaggaacataagttggaataaattaatggtcaaattatatcattgaagaccgtataaaaaatatagagcttataatttcaaatggagggagtataatctaacaaagaagcccagtatcaaacagttattaggcacaatgagataacaggaacttagaggaaaaacaaactcaagctaatgcatcaaagatgtataacaatgcacgactgaaagtgacgtgaacttggtacaaaggcagtaaacattttcttttgtttagttgttgcatcatccttaatgtccaaacaaatggccaaaacgaaagaacggtgatattttatacttggacggcatgtcaacacatgggcatctgacactggaacaaatagtttcacaggtgatctggtactaatctaattaatgttaggtaggttaaaatataataccagcgaagaagatatgctacaaatagcagtaactgcagcatattcatcctagttccaaacttgaataaagacagatgcaacgtactcaagaaagacaaatggacaaaacaccttgaacctactctggcttttcttgtaaaaccaggtggcatgcctttttgtttttgttttgtggatggatgaaggaatacagctattaagagtaatgaataaaattgaattgacctggtcacgaatcgtgatattcctacaaagacatggccaacaaaaggagcaacatagcttgcagacaaaactacgatggtacaccatggatcagctgattaaaaaaaatatctgacaattggccattgttaagcaacaggctccaaaacttcagtaacacaaccttggaaaagtgtgtcatatctcaagctcctcgtgacatcaaagaaatgagctacagcttcttctggtgtttttacaagaacaccatggcccaagtttagtatatgaccttttggaccagctgatttgacaaccctgcagagcagaagattgggtgaagaaccattagcagcctccagtgctggttccagaaatgtatttggaatgtaatgaatgagtagaaggttcagtccatcaacagatacaactcctactagaccacaaacaaatatcaagggcttaacagtgagcatagctgtatttatacatgtttcacatttataccacagtataaaaaagcatgagatttgaaattgtgaaataactatatggttggtacacctaatccatccaaaatatttaatcataactgagatctgtaactatatggttggaactatatggctgctatttaatcatatatctgagatctgtggttggatccttaccaccaaatccatcctaaatatttaatttgtacattaattctctttcttgattaagtcatactatccagcacaccttgacaccacccacctgacacccagtgatgccacccacacactgagcgaaaccaacctcaacacctcctcacccctcctggtgcccatatccacatcctacacctccccctctagtgtattttcgttttgctttattttcttggctgtgcgttccgtgcgcaagctgactagtaataataaaaatgcatggtgttcatctattacttgttctataatcaagagtttaagacattcaagggtaaatgctgcaaaaaaaaaatcattcgtaaaccacaaaacacagatcataaacgaattcacttgcgcaaactgtacatatatgaaccaagttaatcaaagatggcagcactagaagatgaatgatatgagtgccataatcacatgatacaaaaacacagtgtggacaatttggagacctcactgatgaagcattctcaaatgtaagtattagaaacttaaatgaacagaaaatgaaaatgcacaatgaagttttaactaacctatgaatttcatcggtcagtactggtaatggagaaaatagaaatgctgggtcaacattcccctgtacactaattttgttaccaaggcgtctccttccatctgccatatccactgtccagtcaagaccaataacatcgactcctgtgtccgtcattcgctcaagcaagcctccatttccatttatatagagaacaagtggtacattggggcattcaatcttaatcttattcacaatctgccaatgaaatggttccatgaaattcaaagaacagaatgaacaacaaaattcaaactcacacaaactttacaaactggaatgttttggagggcaagatgccaagatcaatgggaaactaagtcaatatgcagtcttgcagatcagctaaactatagtgaaacattgcattcaaatgcatgtatatgacaacgtgaagctagcattagcattttacatttgtttctgattgcttacaacggattggttctttatgcactccttgtttatttatgtgtttcttcacaggttatgtagtaacttgcaaccataaccataccaagctcgaatgcgctgccagaagttgtgtggaatccaatcaattgataaagtatttgtttaaatacatagaggcatatttctcaacattttaaagaacttcagaaattttagggggtatgctcattgatgcagtactatacattgtagatccaacctgattaaccttagagcagccacccatcatgaaattagtcataaggattaaggaagcaaacaggaccgagaaaagtaaaagtaagctacctgcttgatatatggttttgaccactgctcccacacatgaggtggaagttgtccaccccatgaatcaaatatttgtatacattgagccccagagtttacttggtaaataatgtattcagatatggcgtctgcaaggtgagacaaaagtccccttaacacatttggtgctgtgtggcacatgctctttatatttgtgtaagtgttggtcatccccccttcaacaacataagttgcaattgtccatggggcccccacaaatcctagcaaagcagcttgtccatcaatctagagggtagaggagaaagtgagatgtatcggtaccaaaataatactggatcaaattgcataggaaaactgaatttaatccaatacactctcacagaatgatacttatacattgttgatgttcccaaacagttatgaaattggagaaaaatatacaagtagagcagacaccagtaaccaaattaccaatgtttggtcacaacctggtctaacctggtctgcaactcactggttgctggaaggatttaagtgaatcacacaatatcatgaatcccaaaaatttaaaacaactattatcacaaacattcaaatcaagcatagtaaaggagcagactctggaaataagcatgtgatcgatgtttagaagagacggtgcagcaatgataggtccacaaaaatgtcaagacttccttaacttgcttagtgtttatgaaagccaaattttcctgatatttaattttagtcagttgtcaggaacggcagaagaattactcgactctactaatgaacaccgggtaattccactaccgttttgttttgcagatgctacacagcgggcttgataataattatgcactattgattccaaatcaccttagtctataaacatgacacgctgccagcaaatacgcatactatatttcagcaccacttgcaccaacattaacaaaattgtatttatataagtaggtgagtttagtggcgacaatacaacgccactagcctaacgaagtagctttcgtgaatcagctaactacgccagcatagaactagaatgtaaaaaaacctctatcccctattagcattttcataaaaataatgctgaaccaaattttacttgaatcctgtaaaggccaacacagcttgtcgttttactttcacaataactgccagctcatataactagatttacattgtaccaattcatcatgagcccccaaaccgagtttcatacaacaaattttaacagaaagggggttttccataccacaaaaatggctgcgcattacctcagtgcgtagaatcttgagcgactcaccgacgaaccggagcttctcgaagtcaatgggggtgagctccctcacctgctcctcggacctcacgggagactggatcacaggccccttggagtcggagatatcgaatggcaccccaatggccggcagcggcgtgagtatgtccgagaacaggatgacgccgtcgggcgcgaaggcgcgccacggttgcagcgtgatctcgacgatgagttcggtcgtctcggaccgctcccggaacgaggggtggcgcttggcgagcgcctggtactccgccatgtaccgcccggcctgccgcatcatccacgccggcggccgcggcagcccgtcctcgcccctcgccgcccgcaccagcagcggctcctctggacatgcgggaggcccagatgcaggtcagattagggcgaaaatggaggaaaactggaggagagagagagtagtaacagcagggcggttggttttaccagtggaggaggcggttgcgagggacgcggagatggcgggaaggccgctgcgccggcggtgggtggtgcaggaggaggaggaggccggcgccgcggcgaggaaggcggcggtggccgtcgcggagatcatggcggtggcggcgacttcgcggcgtgggcttaggtggctgttttgcttatctaatcctgcttggggtcgggagtttgggtttgggtggagaaggagcaactgctggtgcggattccgcctccgcgccctcgtggcctcgtgggccaacggggaaggacctggcatgccaccgtggctagtacgaagagaaaaaaaaactcatttcaagcctttatttattttgtattacaaacatttcgaataaggtccctttttacattggccctaatccattttgttgccaaaatttgacccttttttggacttttattacgtggcattggacacccacaactctagcaacatactccatgtgttgctcttatatgtggaaactttttgtaaactagtacttcatccatcacaatttattcatcacataagattttagagatattctcaaaaaaattattattttaacaaaataccttatgtttatttataaatgtgcatcgtggaataccatgcatgcgtgcaactatatgcgtgtagccaatcaatattaacttgaattggttcaactcatgcaacatgtagcgcccgttccgtcatggcgcctagcgggaaaactatctcttaaaaaccctatttgcgaaagctgtttctttgcttgtgatctagtgtccgtgccatctcagatctcaaatccccgatctatcgtcgaattcaatcccgaatccaaatccttccaaatcaatccctccgcaaaagtctatttcgcctccctcgggttcgatgggccgaatccctctcggcccatctcccatctcctctctctatctccctctctctctccgctcgcgcgggcgtgcgcgtgagccgcgccgagcgcctcctccctcccctcgctcccccctccccgcctccatccctggcgagcaccccgcccgcgaaatcggcccccgcgcgccgttgttcgcgcgcgcgcccgcgtggtcgccgcccgtgccacgcctacgccgtctgcgtcatccggccccgcagccctgccgcgcctgcccgcgcctgtcgcccgtgtcgccgcttcgctccacaccgcccccgccgtcatcgccgtcgtcatcgcccggcccccgccactccacgcgctagcctccaagggacggaggcagagctccttctccctctgccgcgtcgcccccgctcccctcctccttttctcaaagaggcaacgggcaagccccctttctctccctccttttcccttttttcctcccgccggcgtcatcctccctccgccctgtcgccgatttggccgctagccggagcgccagctcgctggcttgaccgtccaaagtcggttcccctctcccaaaccgacattgccatcctataaagcccaggcgccctccctctcttctcctctcgttgtcccatcgcctccactccattgtcgccgcctcccgtgctctgttcgccgtcaccgtttgtcgtcgcgcgtgtcggaggagccgacacgagcgaggacgcggaaggggactccgggcgcgccctcttcttcctcttccttggcccgaggccgaaacgatcacgtttcgcgccgtcggctctcgtcactgcgcccgcccgcacggtagtgcatccctccgttctccctcctcgttccatctcctccccttagactcgggtagtagcacgagtagcctcttcgtagctagccagcgccgccccgacctttgccgtcgctcgccgtgtgctcgccgctgtcgccgcccgagctcggaaacgcctctcgtcgccggccttcctcgatgcgtttcctcctaatccggcgcaagggacggattcccgtagccgcgtagatgctctcgccgccgggaatcggcccctcgtgacctcgtcgccgttttccccttttctctccgctggtggccgccgccgcaatccgccgccgtcgagctccctccagcgaatccgagccgttggctcgactcccctcgtcccgcgcaacttcccggtgtgctctctttcgcctagatcgccgtgtttcgctccgccgctcgccaccgccgtccgccgtccgttccggccggcgtcttcttcaacctcccgccggcccgcgttgctgccacgtaggcgccagctcggccaagaccgggtcgagccgaccccggtcagccgctccctccggccccgctcgcgggcgcggtccaccgcgagccgtgaggctgcgcgtgggcccgccgcatccgcgtccaccgcgaaccacgcgcatgcaccgcgccccgctccacaccctagcgccgcgccacgtgctccctccgcacggtgagccgagccgctggcaagcgggtcccacccgggaccacgcgagatggactcggtccaccggcgccctctctctcccctccccgcgccctattgggccgtgtcctcttgggccggccggcccatttagctcggccgagccgccccttttctctcgggccgcgccctagccgcccgagggaagtctacttcccctccatcttccttttcttttccaaaagggtttaattaaatcctttttcctttagaccaaaaatctaataatcttagaaattcaatatcttcccaaccgtaagtccgtttgactctgttcaacttccaaaattcctcgaatctcgagatctatctaatggcacgctgagaggtcattaatagggccttattttcgccgtttgttgagttgtcccgtttcgcgtgtagtttcggagcccgaagacccgcagtgcgaggatttcgaggatcaagctcaagatctcgagcaaggcaagccacctttgaacatcttgagcctataattgaacttaattatgttgcttgaaaaatattatgcattgataggatcacacttaatctgcttgtcccgtctgcaaggcagattggcggacctacctattttgttgcattgatccttcctctgttaattgctatatcatgttcccttgtaaccacatagtcgtgcctcggtaatcgtgcactctgcacgagtatcgacggtcgccttcaaacttaaaatctgaaaaacatattgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggatcgtttccttggaatttcatccgaacataagacaagtacgaccacatgggtggaatgggacacccctggctgagtaactagcttatcaggggagccttgatgccgagagacatgtggattcaccggggtggtgtcggggaggacccccgggcttcctggcacagtatggtctgggacctaacctgttgttggtctgggacccctctcgtcggcatatggtaaacctgtgtcggctttcgaaaatgccttgtcatgaaagcttggaggtctcccgacgtggctgatccccacgggctgggtgatccaggttagtaatgtcgtgtgggtaaagtgtacccccctctgcagaggttaacaaactattcgaatagccgtacccacggtcatgggcggatgtgaggtgattcctagcgtagttttgttttactactgcttgtgaaattgctgttgtggaaaggggatcgatgtttggaaaatctgcagctgatgggatcagctaggctcgggtggccgtttgaaagttgtaggcccgggtggccgtttgaaagttgttggccgggtgccaatcttgaacaattcaaaagactgatacattgcacatactccgaccggacgagacgcactgtctcatccgtgtcgtttgagaagcactcacttagttgatttcagaaaagagttcaaataaaatcaattgcaaaaacaacagcctttccttgaagcctgcattaaacacttatttctcatggcttgctgagtactcccgtactcacccttgctctatataaataatcccccccagttgctggagaagatgaagcggatcccgctgacgaggagttcttccaggagcaagccggctacgatgagttttagggtttcggcctagttcccaagtcgcgcctgtgatgtttggtccaagtcttggcttccgcttcccttttgtaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagtctcgctcggggctagttcagggcgtgacacaacatttaaagtgtaagttattttttattggaacgaaacaatagagaaccgccttaaatcaatttcaaaatgatgaatgtttggtgtcctttcgttgctctttgtttatggaatgatcaaaatgggatggatgggactatttgagatggccaaaaaaatatataaaaggtttttttatagacaatatggctcaccaaaaaaaccttcaaaatgattattttcttgttttagttcaattcaattcttccatgaacaaaagaaagaggaatccaaattactcatgaagcatcaaggttaactaagctctggggagctttggtgctttagattttttttcccaagagaaaaactactgtcaaacatttgacatgctcaaaagtttcaaggatgggattaaacttgtgttagtggaaattactaaacacatgtaattggaaggtgaaaaacaagaaactgttcaattattgaagatttgtgaaacttgtccgattttttttaataaaacgaatgaccgaacatatgtcaaaaatgttaactgtcttatataaaaaaatatagtttatataaaaaaatgaagacagtataaaggagtataacacagataatgtttcggatgaaatcggttatattaaaacctactgggaattggcgagctgagagcgattcggagcggcgtgttcgtacgcagaggcatccacgtcgcccgcgagcgctgggaggcgggcggaatccgcgccctctcgtgcgtccgcgccgtgcagctcccagccgttcgattcgtcgcagcgacggctaagatcgatcatcgtcaagagtgtggtggcaatttttcaaaaaaaaaaccctccgttgcattgttaatgtgtttagaacccaagaaatacggtgcgacgttgtggtcttttacgtataagccctccataaccaagaaaatcttacatgaagaagagagaaatctaaaaataggaccgcgctctgaaaaacgagcatcaaagggcttttttgaaaaacaatatatacctataccccttcccccaaaaccctagaatcattgctttccttcccctctccgccccattgacgccccgcgccgccgcttcattctccagcaccaatcctcgcccctgtcggcatcgaaaacggagggaagtgcgcgtgctgatgtttaatcatgcgatgccaatgatgtaagcgcccgacactgccgcgccctgctgcccgtcctccattacctctctctctctctccttgccgttggttcctctgagctcaagctcgatggtgagaggccgtctccgtccgtcggcgacgagtcagtctatctggctttcaatcgggttaggtcttcgtcctctgcatcacctcgtcgtcgatttacctgtctccacaatccaagcccattctgccttcagatctggtgacggctgccttgcagtagccggatttggcgagctcggggggagggggaggagcccacgacgatggtggagctgaagcggatgacagccaccgtggtggtgtagactgattggcccaggaggcggacgcctcgagcttgcgagaagatggcgtcggcacggtgttctccaaggtgggggtccccctcgcgcctttctctcgcctgctttagacaatcacgagccgcctcgcatcgcctaccgccgccgctgcatcctccgtcctcccctcgctgcttcatctggtgccgcctcccataatccagaggagggctccatatggtggtgcagcgcttgatccggagcagctctgatgttggacacgatggcaagccaagggattttaccaccagcatctcctggccaccctcatcacccccctgctgcctcctctaccatctcctgctttgaatcaggtttgtccaaatcttttgcttgctccttatattccatcgatctgtttctctattcttaattggactatatccattaggaaaaaaagttgtattagcttattgctaatcttctacaagtagaataatataggttggtttcccttgctctagaatgatctagcatctgctgttatgcatgcttggggtactgcattttaatagttggctgaaagcctttatctagctttgcagtgtaatgtttacattttcctttgatcaatttcagattttttttaaaggaaacaatacacggtgtactcaatctctgaatgatgaggtcagtgacaaggtaccatgtctattgataaatttgtgccacagtttcagatttcataccgaactgtgtcgataaacctgtaaactcctcaccatcaaaaaatattgtaaagataggggactaaaacatatgcaaaatagttaatatggacttatatttttcagccgcctaagattttctgagtacaccaatcatccaactgaattttgaatttactctaagtaccagatgtgcagggtgttcattacacttaagattgacacttaccatttattttgtatgcatgcatgttttatttttggtcatgagctcagagaatcgatcattccttttctgcatggtcaacaaggcctttaattgctagcttgctgatgatagtctagcaatttggtccagcacaaaaatgttaagtttatgaggaatctgtttatttggaaaggaaaaattgttgttagtcatagatggaggctatagcccaaactaatgtttttttctaaagaaaagatttctttaatttagtaatatactagaaaatagacgtggctttgccgcataatggaccaaccagtataaaataatccatctgtttcatattgatcaacgtttaacacaaattaaaattttcaaattgatcatcacccccttcgttagacatgtaatattattgcatttaagcatcaaaattgagtttgcgcatgaatgtaggaatttgaggtagtaaagctatcatttcttatatatggggctcagaaggagttaaagtgtgcgtgtttcttgatttttccctatcacatacttacattaaaatgaaatataggaaagttaatactttttgttggtctaggtgaaaaaagttatataataatcaatatggaatgtagggagtctgatacgtacacctaatttctttatttatttaatgcctcaaatgatgaaactttacccttttattcatatattaatttaaagcagcaagacattgaattcatggacataagttggaagtcgaatatatgcgcaaaaattccaaattcctatgaaccaaagtaatgaaacggcttattcccattttatctctcctcacagtggcggagctagaaagatttttaaccctaagcaaacttcacttctagtaattgttgtataaatttcatcatcaattcattcaataacatataaatttagtggagtttttgtcggtgagcatgcgcggccacctgggctagccaggcggtggctccgcccttgcctctgtatgtctataaaaatcgagaaaatctattattttaataacacaattcgaatgcatctgtctataaatgttatgcaattcaaatgttttctcaaaggatttttttcttctgtaagaaaatactgcattaagttttaatgcagatatataagtttttggtagtagcatttttttatggtgagaaataatgcattacattttgaatgcacgtgtatactactgtgcattcaaaatttgcacgtgtatattactgtgcattcaaattttaagttattattaagaacattttttccttgtgcaaaatgtacatagaacacaatgcatctatatatgatgctgtaaagataaatgtattctgtgttttctggcaatgtcgtacatatatttgccttttgagcaattcataagtgttgcaatttaaatctaaatttaaacccaagcaactagtactcatggtacaacaattttcaaaaagcgggagaactctgaaacaaaagatacattaagagcatattttgaaacgaagtacaccattttttttgttgaagaaatcattactacgcaatactctgcaatttgaatgtactttgggagatcatattttttattacatttctgaatgtttgtatgcactactatgttaaaatgattttttttgtgatataaatgtatctgagagttcatttggtatcagcataatatatactgttcatggaaatgtatttcacttccacattatcattttttaacttctgtgaaaagggcgtatggaaaatgtatatatgtgcaccttggctctaccaattgggtcattgagcatttgttttttaacattattttaaatcatgcatcatgcacaaatacttgtactccatttttgcacagtggtttgtatacgcatgcaccgtggtgcagtttaaatttgaaatggccccgtcccaaagacatgggtcccaagcctaacaattgaatctaatcgcacagtttctggaattacatgccactctacaacactttaactgctcattggtataaacaagcacgtatctcaaagcgggctaaatggtcaggataacaggtgcaactgcagttgggtgctcatcggcgtttccgtgtaggaaatggtgcgggagagagcaaggtgacacgtggcagattttcacgagaggcgaagcttgatttatatgacgctacgtggcccaatctctggtccgggttaaaaccctgaaatcggtattaaagaaagatatgtgcatactttggagggtgaccatattttttcctcatagttcctagcaaatatatagaattgtcctctttgtttaaacttaattgagaagacattatgacaattttcaagttaaagcactaggggcttcccatttggaggtgtgagtccccttcacctctgtttctccttgacgcgatctacacctttctttttttggcttccaaatcttctatggtctttgctctccatcctgatttgttgtatgcttcttctgtgcaatgaagctaacaaaaagtccaaagcagagctttgcttcagagattctaaattcagttattttagctattgtaacatgtaatagtcatttgtttattgtgttcttggctcaacgtgcagctctccaattatgttccctttttcgttacaacaattcagtttaatgtggacccaggttctagaatgttttatgtataatgtttttagttgaataaatatccataatccatatatgactatgcataatttccagtgaagaaagtactattgattgctactacaaattaatagtagtgtcatgctgtaggtttaggattcaaggaataattggattgcgcttttgtaaggtaaccagagttagatagtagttatcttctttctgaaaatgatggcagtgccaacatccattatttctaaacacacatttctattctttcagttcactcccatgatactgaaggatctgattctgattgcaaactagacaattcaagggtataccctttgttttctcctttagagaaggaaactctgaaagattttattcactatcggaataataatagttgttattctttgttacaatccttacaaaaataacatggtagttcttactttatacactcaacctatttgtaggtatgtttagcttgaggatttttcattttccaaaaaaattactatgcattttatattgtgttgttgtaggtttgtagaggtaaagtcgatgttctttacagagtttgccctacttgcaaggtgtggcacatctttctggccgatctcttacaagttatagttatgtggcataagaaagatgtatcagtttttatgtatttggtcattggattacgaatgatgtctgggagattttataatgatacaacatatggagtgcaggttttattttttagattcatctccaaagagacctgcaagatctcccttttgaggtcatgaagctcccctttcttgcctccctaggcttggggcctcgactccctctccatcgatggaaagctactgaggcagccagccgacagaagacatagagttgatcaagaaacaacagcacatgcataacaagtgatgattgttcttaaaaaaaaagacaagtgatgatagaaatctaaggatgtttgggcatatgctatgctgtatatgtattatgttatcgtttcattggtttttacctgtttttcttttaactgaaggtggttggtatgtcaactccgctgctaccacaaaagataatcttagcatgactataaaaccccgatagagcgcgcatcgcgtcgtaatgtctagttttgtaaatggtaagggagattttacccttagccgtcgctggcggcagcgtccaaccggaccacaccacaatacacttgtccgtggcacacggattcgctgtccaagaaaatatccacgccgagtcgctagtcgtcaccacccgccgcggcccgcgagcagaggaacagcgaatctccatcgacaaccgcgaccgcacccacccaccaactccccactgactccgcaaccccaccaccaactccccactgactccacgaccccaccataccctggaggccgggaccacccacgcgtttccaccccacccccacccccaagccagatccgaacgccacacgcgatcccccgccggcgtcgccgtcgcactccgtccgcacccgatccccactgtcacaactcgcaagtcgcaacgcgcgcctcgtcacgcgataaccgcagcggcgggtcgcggtcgcccctcggtcgtctccgcggagcgcgtctactactcgtgcgcttctgcttcctgttcaaacccaacgctccaccacatcgcctgcgttccccaccccgactgacccagcctccagtagccatgggcaaccgcacgtcgcgccaccaccgcgccgctcccgagcagccgccgccccagcccaagccgaagcctcagccgcagcagcagcagcagcagtggccgaggccgcagcagccgaccccgccgccggcggcggcgccggacgcggcgatggggagggtgctggggcggccgatggaggacgtccgcgcgacctacaccttcgggcgcgagctcgggcggggccagttcggggtcacctacctcgtcacccacaaggccacggggaagcgcttcgcctgcaagtccatcgccacgcggaagctcgcccaccgcgacgacatcgaggacgtgcgccgggaggtgcagatcatgcaccacctcacgggccaccgcaacatcgtcgagctccggggcgcctacgaggaccgccactcggtcaacctcatcatggagctctgcgagggcggggagctcttcgaccgcatcatcgccagggggcactactccgagcgcgccgccgccgcgctctgccgcgagatcgtcgccgtcgtgcacagctgccactccatgggggtcttccaccgggatctcaagccggagaactttttgttcctcagtaaaagcgaggactcgccgctcaaggccactgacttcggtctttccgttttcttcaagcctggtgcgtgctcgaggcttcactatctcattacagaggaatggatcgcgagatatttcattgttccagtgtttgacttcatgaggattttgggtttacttagatcgagttgttgggtttgacaggtctgaaagtttcaccgttactagaattaggggctagatgcaacgctgcaagtgccattatgtttatacttatagatgttccagatgcagtgttctagttagcattggatccatccaccttactccactatagcttgggcaatctctgtgtttgcgtttaccgagatggcattgtacatttgcatgatttgcactttaggcactggatattttccccactggtagctaaatgctggcggcatagcatgcaagatcttcaaaaatgcactcagcaatatcagaaatgccatctgaacttagtgggtgaagcttgactcttcattatgcagaaatgttggtgacggtggaggattttgttgttttagtgtttttcttttacaatgatggtgggggattcttcattctgaacttggctttatttttcttacacttggcatgtgcaaactgagtgctatatgtcccgtagggcctcgttgctaagtgctacaagatctattgcactggaactcgtggttatggacccgaattctttagtatggaacaatgtctttccaagtaaaaacccccagtatatgaaagaatggaaaggtgttttcgttcttttcttgtggaataagaagcctcataccttagtggaaggaaaataagattttttttttcaattaggtatttgaccaaataggatcgtctggttcctatagaacctatcactaaaatactcaataggactaagtggaacgaaaaggattttccttgagatggtaaatgaaaatgcctattgtggatgttgcaggggagcattttaaggaccttgttggaagtgcgtattatgttgcacctgaggtgctgaaacgaaactatggagcagaggctgacatatggagtgctggcgttattctttacatccttctttctggtgttccacctttttgggcaggtgaggtgacgtttgccgcttcttatttcagtcaactttttttgcttctgttgctaacatagatgttctaccttcattttttcagagagtgaagatggtatatttgatgccgtattacgtggtcacattgatttctcgtctgaaccttggccttcgatatccaatggtgcaaaagatttggttaagaagatgttgcggcaagacccaaaagagcgccttacttctgctgaaattttgagtaagtccaccatagctctttaatggcattcttatcaacagaaaaatgcacacttgtctagtagttcagtagcaaattgagatcaaacaattcttctggtttcttcctattgtactttttcatgcaaaagccttgacctgtagctagtagttactgtagtatctcagagcgaagacgctcacttttactgtcccatttttttttaaagagtattcgggtctttttaatagataatttctgctcttgtttctatataaaccgagttatcatttttactgtttgcaaatatagttaatgcacctaatactttaaatatacagaccacccatggattagagaggatggagaagccccagacaagccacttgacattacagttatcagcaggatgaagcagttcagggcaatgaacaagcttaagaaagttgcattgaaggtgtcttctgagtatttattttcgctgctaccaactagtattgcatcattagataattctgacccttttgtttataaaactaggttgttgcagagaacttgtcagatgaagagattacaggcttaaaagaaatgttcagatccttggatactgataacagtgggacaataactcttgaggagctaagatctggtttaccaaaacttggcaccaaaatttctgaatcagaaattagacagctgatggaggcggtatgtttttgctctgcaggcagacacttgagctttcaattgattttttttttagataatggaatattaatatcccagtcactgcacccatagatgcacaaaactataatcacttattacaagttttccacagaaagcgaaataaattaaacataaagcagcatcctgccgaagtgtttggcctttacttcggagcgcccgctcatggcttggtttcctatcgctcctatgtagtggtcggccttaaaagtatctttggactctggcaatcatgtgtgactgcggagcgcctattgcgtgcacgtgcgcgtgcacggcgagagagaatactagttatgctttgcccaaagggaccggaacagtctagtctctagctacctagcttcggctatttcaagtgcctgctgagcttcttccggatcaatgttagcagctgatcctacttagaatgaagccacattaagcttaatgtagactgagacagtaacaacatgctcatttgaaaggaatggttatatggaagaatttgagtatttggcagtagcatgtatacacaactgttctggtggttccagcacatgccatcatatcattatttccttgttttcccaaacaggctgatgttgatggaaatggaaccattgactatgctgagttcatatcagcgacaatgcacatgaacagattggagaaggaagaccacatacttaaagcatttgagtattttgataaggaccacagcgggtaacttcaaatcgattttttttgggtcttgttctatctgttgtttgttagttctcattaatttgctaattttaaatctctctgagcagatacataacagtagatgagttggaagaagctctgaagaagtatgatatgggggacgataaaacgattaaggaaatcatcgctgaagtagatactgatcatgtaagtatattccgtaacacatcttaaagcaagctctttgataacaaaatgtgcatgtcccaaccatcctacaaggagaatgccaaagatttccaatcctaaagtacctttcttaagtagaatttgagctcaaacacaggctgcgaggcccatttattacagtgctaatttttccattttttgttttcacaggatggaagaattaactaccaggagtttgtcgccatgatgaggaacaacaaccctgagattgctcccaaccggcggcgcatgttctaacttcctttacaattgttgaaagaatactgtttggacatctttcctcattatattccaagaacaccccttaagaggcttgatcatctgagatccatacacctgttgccagggcttggacccatttgtactcaaatggagttgcgcgatatatcatttgtagatgcctggaccatcatggatttctgagtgctgctttgttattcgttgcctcatcattcaatttggagtgtaacctcaacgggatgatcagttcaactgctcttccgagcgtgttgcgacttgtgactatatgccacttgatcgtttgtattagatcaggtgttgtaaaacagattttagtgataagatcaggcaaggttatattattctggagaaacagtttaatcttgcttctgaatttcccggccgtatgagaacgtgctattcgagctgaaaccgttcgatctgtccagcagtattgctctcgctgttcttgtcaggacaaaccttgcgcttgcgcgtttactggagtttcgctttgcaccatactctcacctcacactgcgcaaagaacaatttggtcatctacagtatttaactatttatctaagcacgcgtcataaagcaaccaatagatccctcatttccgagcatgcttcaaggaggcaaaaattcagtagtctgcttttcttttttggctttttttttcttctgtacaaacacatcatacaatctacatgaatgaaaatgatggttgacatactccttttacatccacttatactgaaaactgttattctatacccatatattaaacatttaagtcatcagaaagatgacattaacattaagatataaaaactttatccaaaagattcatctctagagcactaatatacaagacacagacatattgtagatgtaatctgaattccgtggttgtacttcgttgtgacagggctggacaaactggaggcttgaaattgatcaacgaacagaaacgtttttcatctttcccgacttgtgcttgacaaagaaagcagctagcatacttttggtacggaggggagccttttggatttgacgccctcttgggttgtcaaaagaactaaatgacgatagatgcctgacaccaggttgatcctgcaaatacagaacatgtgatttcacattagtgggaaatgataatttgaacctggaaaattaagaattcctagagaatgtaatgctcatttgcaagttttacagcataaaaatagtcaggtcttaaaccactcatcaagttgtttaccttcatgccaacattatgcatagcaaaatcagagctggccaagtttgtctgcagatgcttgggcaatggagatgttgatggttccttacctgaaacaaaagcaattccaaatgaggtgttagccacctgtacaaatattataaactatccagaagtctgcctaagatacactcagtgccaatcatgaaagtaaatcacactactggggtgtactaagcaataaaagcaattaaatagaatggtggaaaacctctcgatgcaggttttgtagcctttgtttcttctaggctgaaaaaaatagagacaacagaattacacaggaagaatcatagagtaagcgaccaacttcacaataggcaaaatagagctggcatgcttacacaaattcagattggcgtgctccattggttttggagtttttctctgaagccaaatgccagaaaagggtttttgctgaagagaaaaaaccattttagtgcaggtactttatatcaagatttaattgtgtgctgagtgccaagaaattgcacctgagggataaggtctaggccttgagtcaatatcagcatcagtttgcatctcagagaaagcctgcattcttttgttcgccaaagctgagctcatagagaaaaaatagcaagttaaattaggtgctaatagtttcttcagtagagaattacatctttttttacacgtccttactcggtacaatgtaatgtttgtgatgtcttgtggcggttccggtcatctgctgctgcctaatgccttctttatccgtgtaagtttggcaggtgaggacttgctagatattgagcaataagaatgtcagtttaactcctggtctgcatcaacacaaattcctgagttaaacagcagtacctggttcaagcatgctactttcagctcaagagtggaaacttctgaagcctgttgttcatacaggtctgtcagtttgtaggcaactgtgccaaggtggtcaaccgcattcaccaaagccctcacagcataatccttcaagttgtctagaaccctgacataaataagcatatgaaatcagatcagactcccaatgattgtcacattttcgtgtactcaaatcctagcagccagatgcagaaaatgaacacaaccatttgacagcaagtgatatgcagtgaggatatcagaacttagtacaaagtagactgaaataaacaacggatggattattgcaagtaaactcaacatttccagaccctatgctgcaccaagattaattatctaccagtgtctcggtaagggatcgttatgaatgcaggaatttcgcatgcaaaaaaaaaaattcagatttcgcaagaattatttaaggtccctgtgttccaactcgcaaatgtggcccaagtttctagttcacaagtaatttcctcatccatttctgctatttgtatatgctcagctaactctgaactgattcaccatttaaacctactacacaccaaccgcaacctttctagcaccaaacgagaaactatgtggatagagcaatcataaacaagttcatggtcccatagtagcatcaagcaaccaataatttgcccacacgcacaaattcttgccacaaattttgcctgctagagctgggattcgaatcgcagtagaaacgaaaacgaaaacaaaaaaaaaaactcacatctgcttctgctcgctgtggaggtacgacttctcgcagtactccgacgccgagtagagctgcggccgcaggttcttgagctcctgcgcgacatcagttcaaccaaaagaatcaagaactgcaattcatttcagagaaagaaaaaaaaaacgagcctcgcggcgccgcgggatctctcccggatccgggtccccggccggccggcaggcctacctggagcgccttgacgaagctcttgctccgctccatggacgcctcgtcgacggtggtgggagcgggacctcccccgccgccctcctccccgaccccggcgaccgcgaggccgccaagccccgccgcccacgcctgctgctgctgcatatcccctcgccttcctcctcccgagtcgctcgctgcagttcttgttcggtaggaagccggctacttagcggcgggggcaaggcacgtgaggaggaagcaaggaagcgatgctcctcctcctctcctctccctgccggcgcgcggcagcagcagcaggcaggcaggcaggagaagcgtatcggtgggggtggtggccgcgtgcgcgagtgggagcggaggcaggtgggggcgcgcgcggatggcgacggcggccgcggcgtggtggtggtggttactggtcactttaagccgctcgtagtaggagtaggagtcaatgcttcgcttcgcttcgcttggcggatggcggtagcgagattagggaatcgattgcctccttttccgcctgtcgatggatggatcgatcgaccagctagcttgcgtggttcggttctctgccggtggatggatcttgattcttgcggccactagaaaaaggcgcgtgtttgtctctcctcgtcatctcgacgacgacgacgacttggagtgaggagcgcatgatttcgctatggccacccaggctatgagagcaagtttcacggtagaggtgatggtcatatggcctggcctgtttggtagagctccaaatcctaaatttagttacaggagttgggtctagagtagagttgtggagctacctaaatccagctccacctctctagtttattttgtgagagagctgaaactgtttggctagttatagctctaggagaagtagagctggagctggagctagagctgtgctaaacatgcttctaattttataaaaaaaatatgactattagggaaagacctaatatcaaataaatagagctaaccagaaaaccctataggcgtttctcctaattttacacacaccatcttcttattaattaggagatagtttatacgaaataaggaattttatggtccttcagaaatctcttttaaatatgtgattcgaattttgggcctacaatatattcggattagtttcctaatagaagttgactattaggattagtttcctagtatgactctaagtctttccccactaggactcctagatttctcctatatatagggcctgtttggttgggtatttcaacttaccacacctcaagttagcacatgccaaaagtgtggcgaacgaaatccttgccatagctttggctcaaaaatgtgtggcaaagcagctagaagctgcctaactttctttggcaggctaaactatggaagcaaaacaaacaagggctaagcggttgtggctgactaacatgaggtgcggcattctgtggcatggatccaaacagccccatactcttgtaagccgcacggggagggtgcgacagtccaatgtaccccatgcgtttgtatccaactcctctgtagtgatcattgccggtcggcgcccgtggttttttcctgcaaaggttttccacataaaattcgtgtctccgttgtgtatctattttattaacaacctcgaggtaactaaattttactctaaatttttttggtactttaaggtactcagtgcctagaggcaccaaatattacactagaaaatatggtacctctaggtacattattaaggatgataaaattacccatacaacatattgcctctaatgcacttgtcccaatatactactcataccttattttttttaattcaatccattgatttttttcccttatctatctaggagtttgtatagagactaccctttacataaggggtggcaactcctctctttctttctttttttctcttttctatctcattatgtaattttagagcctcatcggtatgcctaataagccaaagcaaaagggcaaaatatgaactttcaaacttgattttgaagcattttcaatgtaatttctttttagtattggtttttaagccgttacgaacaagtgtataaaaatttacctataaattaattttattccctaataagtctaaacgatttattaagtaatattggcaacccatgaggctcttacatggtactcccttcgtttcatattataaaactttctagcattgcccatatttatatatatgttgtctagattcatatatgtgattcattagtgtgtgtgtgtgtatatatatatatatatatatatatatatatatatatatatatatatatatatatatatatatatatatatatatatatatatatatatatatatatatatatgaacggataatgttagaaagtcttctaatataaaacggaggaagtactatatcaaacaagaggtatgaggtccatagtacttgttctgaggagggaggagcaatgtgtcctgggcgtttgggccacttggctgtagcagtgcagtggtagtactagttcttgggttggagtaaactacaagctgcagggtacaagcacggcgagggagagctgtcaaggggctgctggagattagtccatgacagtacttatacctcgtaacagaggttttaactatgttagcacagtgagtgtaaaagagtacggggcctcctttcaaacgttgatttaaaaatgtatgtgatctggtaccaaacctcttaatgttaattcgtattttgaggaaaaatataaactctaaaacaatggcttttctaggtagtgctggtcgtggctactgcatattacaagaagaaaaagagtattgttcaccattttatttctgaaatgaactggtttagagcagcagctaccacagcgaaaagaaacctaaaagaaacaactgaaataacataaacaacattttgttcaatttctacgcatttcaatgtttatatacactgaacaacacaacagatgactagagcaacgaacagttaaatgaaagactagattgtcccatccttggtttcatcttttctcccttttagctatgatgcccttctagctcccatttcatctcttttccaccatcagcctagcctcttgatgtcatgtaactatgatgcggcgcacctaaccacgttcaagaaatagcgtagatgggtatgcacgagatcatggtgtttgctcgtacaatctttatttgctttggtatttgccttaacttgcatgattagttaagatttctataaaaatcctccattttaaaggacactcggctctatatattgtgtattctacgtactaatagaaaagtcaggtatttggtaaaaagcccaggcaacaaacaactagcactacaacccatgttttcacggcagttaatttccgacgatgaaacatggttagagcccggtcagccgttcatctagcctaagaaacggatccaccagtgagcgcatgttgcattattgaattggagtcctaccaaaaagtccaacgggacagtcggacacatatattcaactaattcaaagtccatgacttaccgcttaaaaaaaaattaagaaagcacatgggttcagagcaaagaaattttagcctggacagtgagatgatgccggaccctatgtacctgcagaaatagccaataggaaacaggttttaatttagatcggttgctgaaaaagcaaggaggggagtcctgtcccatgtttgttgcaagtacaaagtttccatggggcaaacccggtggttgccaggtagagtagttcatgaatgctcttggttttggctgcttgatggattgactagatgcatttaggtgcacctaatcccgcaatgacatttaagaactcatcaagtgcagctttcattgtcaaaacaaaaggggcatacactattagtatccgttactgttcatgataaatacatttcaattcatggagtaaaacagacacgtccaaaccctatagaagttgttccaaaccctatacaaaatctgggttgtgtttagttcctgaaaaaagttgaaagtttgagaaaaaattgaaagtttgaaaaaaagttagaagtttatgtgtgtaggaaagttttggatttgatggaaagttggaagttcggggtagttaggggtgaactaaacacggccacacggccctgatgatgtggaattccctagctcaaacgcatattagatctaagtggattttgaatggacaaaagtagttacacaaaacgccacaacttagttgagaaaacgaacaatatgccactctataagatgggtgggataaaatgccactcaatacaatgcaccggataaaatgccactcaatacgttgcctaccggatgaaatgccactttagagatttttgtgcccaaaatgcccctagagagagagagggaacagagggagaggggagggccggccgggcggcgtggaggcctctccgggcggtggcggcagcggccggctgggaggaggatagggcggcggccggtggggggatgaagaggcgacggcggtggaggcgacgacgcgggaacgcggcgagcctacccgcgcgttcgccaggaggcggcagcggcgggggtagggggaggatgaggaggcgacgcatggggaggagcgctggggagggccgggctggcggcgccggatgcctcgcgcggacagcggcggcggcagccggcggggacgacaggggggaggagtacagggtggaggaagagacgacggcgatggagcctcagaccgtcgtccccgtcgccgcgccatcctcctccccccgtcatccttccccacttcggcgccctcccccgatggagccggcactgtcgtccccctggcggcgcagtcctcctccccttctcgccgcccacccccgcacgctcgctgcccaccggcgacgagcacgaccgacgtcgttcgtctctcccttcctctctctccatagtaggggtattttagtctcaaaactactcaaagtggcaaagtatactgatgataagctattgagtagcattttatcctttgcactctaatggatggcattttatcctttgcaatcttgtggagtggcatattgtctgtttttttccaacttaattcaaaatttgagatatgccatcatgacccacatgtcattgacttatgtgggtcctacatgtcattgagatactgatggcatatctcaaactttgcaaaattataatgacattgttccaatttaccctttaacctagaactagaaggcatggtgaaactctagctgcagaaaaaaaaacaaaacaaaatgtgtcctaccaacaccatcccttgagggcaatggtgcatacagtacattttaaacttattcacttaattgtaacttttaaccttattaaattttggctttataaaactctagtagggtaacaaaccaaacatatgttagaaatcttagtagtttttcacatcagctatgttaccaaactttgataattctagatatttgcacttttcaaagttcaaccaaattttagtaaggtagagttgagagtggctacaaattggacaagtcctttattctatgtcaatcctaggctttcaattttgttttttttttgtctacgacaagatttaataattaccaaaactttaacgaagttgtttggagtgttccttttttttgggcaagatcaactagccctagatttgtaatattgtaaagaaatgaatgtcaaataatttttcaataccatttaaaaaaacaaaaccaaatggatgatagattttttacagggataagtccattttacacccccaaactcttatgtttgcctaaaatataccccgaactacaaaatcaggtataatatacccctaactatcaataccaatcattttacgccctcgagcaattttaagactggttttgattcatttgaacgccacatcagcatagtcccaccagtcaaaccatctcaccggtcacgtgtggagaggggcaaggaagaggggctgtgatgaggaaaatgaggaatagaaggttggaggcagccaatgagctccctccctccactccccgctagcccatccatgacaaggcacatgcaacggaggggggaaaagctacgtcaagcggcagcgcggtatctgacaaggcatcatcgcctggtcaaggacaaggtccagctcaagctccgcatccgcttcttccttgtttagctcgaactcctcatctcaaagcctagtcgccttcgctgaactcggcatccccaagtagctcgagctcgtgtttgtgctccagctcaaggaagtgaggcaggatgttggatctttagcttgtgctcgccaacgctcggcccagaatggggcagtgacaagggggcggcgacgggggagggtgatctagagctcaccggctctcagaagggtagttgggagggagagatcaagctcaccagcgctcaggggtgcggcaacaaagggggagtagagagaaggggaaaaaagcgctcatcgtcagccgctcttgaagcctcactagccgcactgtgtggggtaagagagacggaggagagggagaaaggaggaagaagatgaagtgggtgagccctctattgtttagatgatgtggatttattgaacagttggcatcctatgagatatccacgtgtagcaaaactatagtaaaacaactcgagggggtaaaatattcagtattgatagttaggtgatgcattatacctaactagcatggtggcccgcgcagattacgcggctagcatcattatattttctctcatataatagcatatatgttttcttaatgtattattcaaatatattaaaatgacaacataattttaaattttgtactaactttacgaaactactaatgtgtaatattcatattgtattttatatgcgtgttagttattaattatttttaatatcaaattttagttatttgtaaattatattcctatatggactctagactcgtctttcaatatttttttaattccgaatcttcgttatctgtaaattgtatttctatatatagattctagtatcttcttccaatattatttatttttaattcttattttttttattatttctaattatatttctatgtggactctaaactcatctttcaatattttttaatttttaatttcaaatttcagctacttctaaattgtatttctatattgactttagactcttcttcccatgttttgtttaaattccgaattttagttatttgtaaattatatttttgtacgaactctaaactctacttttaattttattatgtttattccgaattttaattagttttaaattcctatatggactctatactctacttctaatattccttatttttaattccgaatttatattatttcttaattgtatttttatatggactctatactctacttctaatattccttatttttcaattccgaatttcagttatttataaattgtatttctatatgactctagtctcctcttccaatattccttatttttaattccgaatttcagctgtttctaaattgtatttctatatggactctagtctcctcttcctatatttcttattttttaattccgaatttcaactctttctaaattgtatttctatatggactctagtctcctcttccaatatttcttatttcttaattctgaatttcaactatttctaaattgtacttctatatcaactctgtttttctttttcttcgattaatatgggaattttaggccgtgagagcgaacgtggaggctcatttttctatttctttaataagttaatagattttgtagctaggaggtgtatttagataaacaaaaagcttagggatgtaaaatgaacttattccttttttacctggttcatttgggcaatgaaccaaacatgcccataataaccgtagtcataatttaaccatgatggcttgccatgtacgaataatattgagcatgaagatacacatgtatggtcagtgtgagcacatcgtcattgaatgtgcccaagcaaggcctacacatggcatatgctatgctccacatgcttgcgctctcgtacacctacgcgtgcccacttaacccagtgtgtcagttttttttttaaaaaaaatacccagtgggtccaaggctccaagcctaatgaaaattaaaacgtttcaaaaaaaaataaataagagtaaatttcacgaaactacaggtattttggtcaaattatcagaaaactacagatttaacatgatgtattacaaaactacagatttaacactaattttatcacggaactacagatttaagataaaatatctcaaaactataaattttagtaacaaagatatcacaaaactatatgtttaatatcaattaatcataaaacttgaacattttcaactcaaacataatattagtgcaacgaatttaacccccaaaatatgtagttttgtgataattttattattaaatatgtagttttgtgataattagtcttaaacatgtagttttgtgataaatttgttgctaaatttgtagttttgtgataatttggtcaaagtatatgtagttttgtgaaatttactcaataaataattttcaccggttttctagaagaaattagcaaaagtatattattaccgctgaagagaggggagggggcgagttttatatcaggacttagcgcgatgagtgctcggctttgcacgaaggaaatcggacggatgcgaactcacagcactacagaacgaacttgcacgattaaataattaattaccatcataagcaattactccctccgttctaaaatataagcatttctagcaatgagtctggacatatatatgtctagatttatagatagaagttgttatatttgagaacggaggtagtaatcaattagccattattttttcatcacgtcgtaagcatttaattaatagctaatttatcctaagacgatttcgggccttgtggctgacgtggcgtctacatagcaggtttgacttggttctcgtcctaatataaaaattaaaaagtcagtcagtcggtgacaatggagctcgaggatggccgggaggaagagggaagaaggaggcgctgacgtgctatcgatcatggagatagagatgagggtgggacccactgacatgtgggtccaacttttttttttatcttttgtcttacatactatttaatctttataatttgcttccggtgccatttcaccgtcacgtaagacaagaactaagtcaaattagtcatgtaagtgccacgttagccgaaaccgtcatccaaaccacattggaatcttatttgcactggttttgactgttgatgtatatggtaatttggttcaggaacgaaaatcgaactcgctgtcaagttaaggaccaaaaatgaacttactccaatccacatcgttataccgcggatgggccaccatgggcctaatataaacgggtcagacattaactgcaaaagacaggcgacagaagcaaaccagaacgacaggacagatcgaacgttccctttatttcctgacgaaacaacaaacaacacctcaatcagcaagaacactgtacaattcctcctgatcaaaatttccctacgccctaatttacaccatggaccttggtcaggtccatgcgtgcagcccacgctggcaggcacgcttcaaccaacacaaggcagaacgttacaacctcgcaaggtgcagcgacacgagaacgccgacgaaaacgtgccaactcccgacacaaacgcccgcgccgacgccgacgctgggagcagcagccgccgccgccggcaagccgccggtgttcctcaggcggcctcccaggtgctgcgtcgtgcggctcctgacgctgtcgcagtcggcgacgccggccagcgcgacgacgccctcaaggccctgctgcttggcgtcgtagcagagcccctcgttgccgccgacgcggagcttcttgcctagccgccacatcatctgcttcccgaacgggatcggccccaccagccggttgccgtccacgcggagctcgctcgcccgctccagccgccggaagctcgccgggatcaccccggtgaactcgttgttgtccagccgcagcacccggaggtggcccagctccccgatcgactccggcaacgacccttccagccccatgccggagaggaccagcgtcgtcagcgccctgagcccggcgaagatgtcgccggggaccgtcgtgaactgcatccggttgtcgccgaggatgagcgaccgcagcgacgacagcctgccgagcgccgccgggatcgggccggacagcgcgttgtggctgaggtcgagcaggatgaggtcggacaggtcgccgagcgcgtcggggatcgtgccggcgaagcggttctggctgaggtcgaacttgagcagcgaacggcattgccctaggctcgccgggacgccgccctgcagcgcgttgtggctgaggtccaggatgcttaggtgctggaacttgaagggtggcacctcgccggcgagctggttgtagctcaggtcgagaagctggaggtgcgcgagggactggacggtggctgggatggcggatgtgaggttgttgccatggaggtcgagcacccgcagcgccgtcaggttcccgagctccggcgggatcgccccgacgtggccgttctcccggagcaccagcgaacggaacgccgggccgaggcggccgaggaacgccgggacgggctgcgggttggccgtgaagcatcggtagaagaagagcgacctgaggtgcggcagcgcgagcacggccggcgacagcgtggcccgcgccgcgtcgcacgccgggaaggcggtgtcgtcggagagcgcgccgaaggagagcgacacgacgtggtacacctccccgcggtcgggcacgcactcgatgccgtgccaccgcccgcggcacacgtcggcgatgcccgacgcccacccgttccccgtcgccgccatcacctcctgcaccgcgcgctgctccgccggatcggtgcgcgcccggtccgacagccccgtctgcggcgcgttcaccagcgccgccgacgacgacgagtccggcaccaccaccgtgaactcccccctgcacaccgcaaccagcaccgccacgacggccaccaccaccgtcgccgccgccgtcgcggagagcgcagaggccaccatatcaccttgcacgctcgtgcgacgcgatgcgctcggaagggtcacgaccgttgggaatttggagggaagagggtggcagaaggcgcaggttttatagtgtcagaggcgcgcgcgccgaggccgccgactcgcggaggccgcagtgttcgtggcgggtgaatgcggcgagagacgagtaaatggtggtcacgggatatgggggagaaatggagtaaatgaactgaggatttgcctgcattcaattggtttcacgggaaatcggaactgaacaatattgcgcgacatcctggtggcatggagcagtgagagcatgcctctgctagcaattttgatctggtaattgtattgtttcgctacaggcgacctgcggttcagcggttcagtggcagtgtaaacagttgctgtttgttcgatcaagacgttcgtgcgttcgcgaaaagatcaagacgttcgtaatctggagcctgaagttagcgttgtggatgaaaaatcacaagtaggcagtagttgagatgcagaggaaaggttaatgctgttcttgcagactgcagagtactaccatccctggctcactggtctacctgactgcatttcgttttactcccagctcgcattttcatgagaaaattgcaatattcggactacaaacatgggggcttcgctgttttgagactccgagtggatgataaatgggcccatctatgtctatgaaatgtgggtccagtgtcattatagcaaaggctaatgtttgcagtgtcataaccctattgatgaactgaaatgcagatggttatttcaagattactattacagcaagactgagaaataaatgatcaaatatttgatctttcaagccatactgacgaagacatgggcaaaaagaaaaaaaaaacctctgataagttattcttcctcgttgtcctatccaaatgtagaaattcactagttccttcctcttcacaggtcatcctgacgtttcagtctttcaggtttgcttgctgcactttctcagaccccaggtcttcagaattcagcaacgaggaaaacaaacgaaaatcaacgaagagaaatgagaagcaagaaagccaggtagcccaataagaggcccaaaggcctccagatcatatagctggctcaatgggctcagctatggatcaagaaacaatagttctccgttaccttacagctatatccatcctgaatccttgatttctgaacatacaatgatacaattaatatcttgtcccctacactgtattcagtacttcaagacgacactatgtgttcagtatctttcaagaggactattttcgttgcaaattttctcgaagcaattttgttttgtccccgtttttttcgattccacctggtaatctggtgtgccgcaaatgtgtagcctctgactggatacgcacctaactttgtgaaggggctctgaacctgagctaatcactaatggaccgatttgcgcgatctcatgcttcatgccttagccatgctgcccagtgcccatacagaattgtgactgtcacccacagggactgccagactagacaaagaaaactcatcctttggttgattactatcccgctggacaacactacctgaaagtacagaacaatcagcattaggtaaactttggagtgcagattaatcagccttgacagtacagtcgcacgtgatgacatcaattcttttatccttatttaaaggcctccttgcccagtcagacagctcgccgaaaatatgccaggagaaatgcacacatccaagggtccaaccgatgccaaacgtacactgcagagaaatgcagtcaaattaaggctgcgtgttctagaattgggaaaacgttcagggaattcatcattcagtcattcagtacggaggataaccatgcatgcagaaagtgtttttataaagcttgtttagcgtgttgcgacacacaacacattctccatctgaagccggcgactttgtcagttactacagatcagaccatcatcagcatctgctagatttccacaagaatttggtcgttcactgttcagagagatcggttgctgcagtgcatgtcaacagcatgtagtagtgcactactcgggaacgcactcaatgcgtgctaaatgcttcgtgctatccggctgtgctcagtccactttctgatttctgaaccaggaaacatcgtctttttttgtatgtatgaatcgattcaactaaaagaggtcgcaaacttgaggtccaagttatttactccctctgtttcaggttacaaaacgttttaactttgattaaagtcaaattacttcaagtttgactaagtttgtagaaaaaataatatcattttcaacccaagacaaatttattatgaaaatatattcaattattgatttaatgaaactaatttgatattaaaatattactatatttgtctataaacgtagtcaaacttaaaatagtttaactttgaccaaagtcaaaacatcttataacctgaaacgaagggagtagttgccaacttcttgtccccgcgtcgctctcgcgcgggcagctcgggggcgaaaccctagcctcccacgccgccacctcccaccaatcctcgacaccttgccacccctggagctcgccgctagaaaaccgggcggcaagccaggaaggcggcgacgtggacaaggcggcccacgaaactcgtcctcggcgcgggaggacggagcgtcgccacgacggctagagatggcaagggagcgacggatccggtgctcccggagatggatccggtgtttgccaagacggagacgcaggcggcggtggagcttggtcgcgagagcgaagatgacggcggtagtgctggatctggagctcccagatccagtttctgcggcggcacccctgctcaatcctaggcggggagcagccggcgtgggcagcggtgccgatggcgacgcgcggcaggaggtcgcaacggcgcggcgtggacaggagggcatggacgggaggtgcggtgcggcgtgcccgtgctggtggcggcgcgagggcgacgccggtggagtcactgtgacgccgtggacggcgatgcatgaggctcgtagcgacacgtggccatgcctggcaggggtctgcgtgaggaggaagccggcatgggtcgcttgggtgctagcagtagcggtggtgactgacgacggtcattgactgggtttgggtgctaaagggttggtgtggtggtccgacgatggtcgttgtacacgatggttgtgtggacctttgaataggaatcaccggtgaaagccttgccaggccatgggccggcatgacgacgacgccattaggtgtcgttccccttcttggaggcgtcgttttggcgttgacatctcctagcatcaagaacctttcgcgcacaatggtagccatcgatggactcctgcaatgtctccaaagccctacaagtctagctgtttgacgaggccttcgctgccttgcttccgttccttgctctaccgtgggtgttcagcattcttatttggttgctgctgggtagagtcagagctacttcattgtaagggtgcgacaaagcttggcaacgatgacacagtactgcaatctctttataggattgttgatgctagttgcgtgcaggaaatggttctttggtagtttggactgatgtccttcatgagtatcgtttctgtttgctctttttggcgttggagtagcattgcagtgaagtcgaagctgttgtgtcgcttgggtggcaagcttggcaacgataacatatgtgggctattgtgtcgtctctatgacaaacttggcagatgccttgtgtcggttccgtcgtggtagcttaggttagattagctgttggtgaggcgttgtaattatggtttgctcatttttcccaaattaactgggcactgtaaggtttggtctcgtttactccttaaaataggacaccttattcttaatataaatcgtcggtaatggcctgtccgttaaaaagaagaagcttgaggtccaaaattgagatgcacttgatagtgtagtggcaaaagatgtgtggtttcaaccctaaggtctcgtgttcaatatctaaattgctcacaattgttttataaaaaatgttcggagggatgtctctccctaggtctaagattgatattataaggtcgtaggaaaaaatgatcaaaattaattctcttattaataatataattcacatagctcacacatccgtagatttacaaactgcccgttcgacctctatatcctcatcatcacgaacttgctccaaggatattatactatatgtgatcgtattatattatattactaactactcgtaatgtccaaccatattaaggcgatgatctttgtcccaagacatcataatttaaagaatttatgtacagctaacgacgagatagctatacttggggtcgatttagggctccgccttgactctggtcaccgacggatcggtcacggtggtggccttggacgacaccgacgagtcggagtcggagctgggcggcttggagatggagagcacatactccttcatgtcggagctggatgagcggaagtgcgcgaggatcttgctgaacttgggcttcttgcgggtgatggcgatggagacgtcgttggggaagaggtccttgagcacgaaggcgtggaacatggtggtgaccagcaggccggcgacggtgacggtggcgatgccggagaggccgatggagagcgccctcgtcagcacgttggtcacctccgtcgcgtacgtgatcgtcgcgatcgccgcgccggtcatcgggaacgtgtacgcccaccacgccagcgagaatcggaatcccctgaagaagttgatcctcacagcctggtcacaggattaagacattgttaagtacgcatgcagagcttagtaatactaattaattacgtactgtagtagctagtgtgctcgttgcacgtaagtgttacgtaccagtgacatgtagaggaagagggcgatgaagtaggcgatgcgggcgccgtagtcgaactcgccgaggatcttggcccaggccatggaggcgacgctgggggcggcgacgaagaggaagaagacggggtggagctccttggggagggtgacattggtggggaggcgctggtagagcgtgacgaagaggaccatgtagtgggcgaggccgacggcgaagtagaagatggggccctcgcggagccccatcttggcgccgagcagcgcgccgacgaagtttccgacgatggagaggtggttggacgggttcgccaccttggacagccgccgctggccgccggacatccactgcccgtagatcttgagctccaggcagaagatgggcgccatgagcgcgtaccagacgccgtggtgcacctccgtcaccggccgcggcacgccctggacgaggaagaggcaggcgatccacggcgcgaagaagaagttggcgcggatcgggtggtagaactcccgccgcaccgcctcgaagtagaaaacgaccttgagcaggtagatgaaggagacgaaccccatcagcgccagcgagatccaccacagcacgtggttcaccaccgggctgacgtgcaggaacgacgtcggcggcgccgacgccagcgtcttccacagcatcgcctggctgctcaccccgaggcacatcccgaacgcgctgatcgggaaccgcagcaggaacggccacttctcgtccttgggcagcaccgtcgtctccgtcgccctcagcgtctccagctcggggccctccagggcgtcgaagtagcggtcggcgccggggacctgctccgtctcctcctcggcgatgttcggctcgggggcgccctcgccgttggtcatgtgctcctgcgccggccggccgcgcagggtggagagctgccgctcgaggcggccggagaaggtcttgaactggtcgaaccgcttgtcgcgcgtgctgtcgcaccgccgcgtcgtctcgtcgttcttggacaggtgcaggatgggctgcgagtggaaccgcgtctgattcagcagcagccgcggggagtgcgcctgcactcgccccaccgccggcgggtgcgcgtcgtcgaacctggtctccgccggcgccacgcgggcctcgtcgcggtggacggccttcgccttcgccgccgccatcccgaactgcgagaagtggaaccccgatggcgacgccggcatgctcagcgacacggagtacggtatctgcgcgccctcgtgttcgtacgccgccgacaccgacacggatcgtggagcgtacaccggcgccgggatgctaatcacgacgtccttctcctcgcccagcatttcgagttccttgctctgctcgctgagcgtggccgtggccgtggcgtcgccaccgccgccgacgcagtcgaagccgtcgatgacctgcgaggggacctcgatcagcagccgcgggagagcggcttccccggacgattgctcgctctccccgtacacaccaccgtccattctgatccggacgtcgttgccgaactccataccgttcacgaaacctgcacaccatacaacgacagattgactcgtttagcgatcaatctcccaagtaaagcaacaaaaaaaaaagcaaagttttaataatttctcaagaacgtaatcatcaagtaccgcagtaccagatcacacgccaattcggccgaagcacgggtgggcattcccgtatggcgatcctggccatatcaacctatcctacctacagttaatcttacctggatttctctctacttctctacacgcgttcagcatgcaccatcaaaacagttcacagctcgctaaacgcaaacaacaagtttttctcccgtacgcttccggagtttcgggctcgattttggctcagctcggcacggcgcgaccggtgctcgatttatagagacgcgcgcgagtaaggggaagcacgaggccggaatgcacgttggctacgatattctcctttcccgcatgcgcgccggggtgtgctactgtgggtgcatgccagtggagcggcagagcacgccgccggccggatgacggcgacgggacggtgacggccgttttcgtctccactgttcgtgaaggttcagtgtaccgccaataagcacatcgccgtcggcaatgggaaaaatgaaaaagaaaaataataacagttgtcttttcttgtcaaaattcgacacttcttcctccttgactgaaaagtaggagtaaaaaaaaaaatcttacagtctcccctggtacagtacagtacatcaaaaccggaataaatcagtcaataactaatcggcttggacaagcagggtacgaacgtacgatcggcctccgtcgctggctctgcttggtttgacattatgacatatcgctaattccaaaaggtttttcgttacagatatgagcccggagaccaagatgagaatgtgtggtcctagacggactcgtgtggaaaccgaacatgtacgaccggctataggcggaccggccagtacgtcctacacgattgtgacacacggacacatcaatctcagagatcgatcacgctgagaatatgtagatcaccagtacgacttttttgcggtcgatctccctgactccctgagccgccagattaccggaaaactagctgctgttactatgtgacgcaataaactagccatggaagaaaacaacatgcgaattaacgtcgcagtctaagctacggggcagcattggaccgaccgaaagtgttgaaccgggaccctcccccagatgtgaccgagagtcccccggacaccaccaaacatcttgcctggatgctgggggtaggttggcaagctatccatcgcgtacacgtcgttcttgcacagccatatctgagctagacatgcccatgcaacaacgaacagagaactgactctacaggacatgaggacatggacacccgtgctagaattagagcagcttctaaaaccaaattagacctctcaaagctagcgcaggcaaagataaacttcatcttctctaccgacagggatgacaccgaaacacgggaaaacgccgctgcagagttcctaaaatcatactatactacatactcctctgcatactttaccttgggcctaagaatctgttcgtcagtgcgacactccacggcaggatctcttacgatgtatgaagctggaactggaagaggatgaacacagatgaaagagctcgcaaaggaagcagagcctctagcccagcactcagcagaggaagctgcttgctatgtgctgctgaggaaggtgatagccgcaaccgcagctcaccgagtatatatagaagtagtcaagcagggcacccagggtgtcctcaccattcttaataaaagacggaaaaaaaagaatgggagaaaaaaaaatgagtgacctacagaatgaaaagagagaaaagaataagagggcgcagagacagcgtggaaatacaaaaggtggcgagtcaaagcgcgagcgagagcgcacgcacggacgaacaacaacccgcgtactcctcgggggggggggcccacgcacagtcgggcacagtctccctccccgtgcccccgccttgaccaatcgcgagcgaccgttcgcaccgcgcgacgaaaccaccaccacgtgctccctacgctttcctacgattcctccgccgccgtagcagcgtccccgtctcccgtgcatccgcgagcgcgcgagagaatgagagagatcgcggcgtagcctctgcttgcccgtgtaccgggcaccggccaagggggtacgagaggcgaccgcgagccggttcgtttccgagatgtcactggggcgtcgcgtcgaggaggaggggagagagagagagagagagagagagagaaaggaaaataaaaactgagggccgaggcgcgcgcgcgaccacgacggccgaggcaaacgtaacgtactcatcgtaccctctcccgagaattttgggaggagaatgcactggtgtcccatcgccgcccccgaagaaaaatgggtgagactgctacagtaacaggggcagtggaaagtagaaactgaagctctaagcgatgatgttttcagttggatcgttggaaaaatatgtagtgcaaaccacatatacagtgaacttccaaggtgacgtggatgaattttggacatcaatttctcgatccaacgatagtttccaagttttcactgtatatatggtttgcactgtatattttctctcgatcgtttacatcgtcctaggttcccacgacagctttcctcgcatctcgctgcttctgactcttctattatcagggattcaggggtgttcggagcaagttatctttttgttaaaagaaataatcaaactttgaaagaaaatatcactttcgattatgatcgatacgcagctgaaccagccggagccgtagtgttttgggttattactttaggggtgattgctttttggactgatctggaatattgtacatggttgatagttatttcgtcttaatttgaaaaaaaatagcaaaacttttcagtcgaggaaatttgtgcctgggaacaagggttcacgttggctccagaaaaataagaataatgttttcttcgtgcctgcggcaaacgacggtccacgtacatcattttagccggacaggctgcgtggtttcattagtctttggctacatggtcccttatgtcatttcaagcttgaaaataagtgaaagtacgattagtgcgtctgttgtgaactcattctgccattatgtcaaaattgtgattaattgtccattcaaggacagttcggaaaacgtgggacaaatctattctgatagcatatagttgttgtactctgtcctacacaatttttttaaaaaatcttgttaattaagtcctgataggagcttttttacttggtcttaaccttggagtacattttctagctgttttttttccggaggggagggggtgtatttaaaagtgttggtattttcaagaacagatttggggtaaactcgatattatctgcatatactgtagcagtttttttttcctcggtttgtcctgaatgagctttcactcagacccgaccttaatagtctatagttgtgtgttccatgatgcagtggacaggtctgtaatcttcctccactaaatacttgtggaaatagagaaaaaaaatgttgcaagctctagaaggaaatcaacagtctaacaaggaattccaaatccatcatgaaccaatcctttcaatctgtaccttgttcctaaatgaccctccaaacattcacgtcgcagtttttgtgtgaccaatatttaaatatgctgaaggaattccagcatgcattctttgaaaaacaagtggcacacatgaactccaatgcataggacctggagtactactaagttaattagaaaaatatacatgccgatttattttctttacggtactaactgcaaatgcataaaaatcagcgaagagtatgtataccctggagtactaattaagttagaaaaatatacataccaatgtctctcctttatggtactactgcaaatacataaaaatcagcgaggagtatataccgtccaaaacttagtacaaaatttatatacaacatcaaaaagagatggtttagtgtagtaagctagtatactagctactccctccgtttcataatgtaagtcattctagcatttatcacatttatattgatgttaatgaatctagatatatatatctatatagattcattaacaataatatgaaatgtggaaaatactaaaatgacttacattgtgaaacggaggaagtagtatggatctactatggagtatatgtcatacgttaccgtcatagacgtcgaccaacacaagaaggggacttattaattattatagcttgtatacttgctaaactcatatgaactgattaagcaacttaaaatctgctggcacttgtcaggcccatatatattttttaatgctggaacataaacagatctggatcaatttaaatatgaaagaaggacccttgagtcgatccatctttgaattcagcggatataaaaatacgtagctctccgaccaaccatacgcaaacaaactatttgaccacaacgtgaagctactatctctaattaatttattctatgtatttcggtaagactagtagtactatacgtagagacaaggtgaatgctactactacagtatcagagtcagactccgaagtctccaaggagcttacaatataattacttaagtattttattagtcgaaaattgaaaatgtgcgttctcattaaatattgttgccgaggttattttaggcggcaaaagccagcatgggaccaattaggcttctaatttagaagttacttagtagtttgctagtgctttggctttttagttacaaataagtatatggagtattttatttacgctgattccggatatccaaaacattttcagccaatcaagtgcttaaaagagaaaaatcatgtaattttaaatttagcctatagttctcttttaactttgaattttactaaataacctagaaatactatatttatctttaagaacggagggctagcttttttctttttccttagctgacaatgggagcaaggtcagcagctgaatagatccaaccaagcaaatatatactccggatcgacctagctacatcatctgaaacatgactagtagcaacaaaaaaatcacctacccgtacactatataaacatcagtggtagccgtagcttctatactagctaagctagcgtacgcagctagttgtggacagctatgacacgggattaacttaagagcaattgccgtacgatacacttaactaggctccagagcctggaagtaaacccagcacgatcgagcaaacagacaacaagccgaccaaatccttttgtgaaaacggactaataaatcgagaactcggcaagcgacaagcgggggccgtcctcatctagccatgcatgtatggtacaatacataccacagataaattagaggttcacgtccatgtcttatcgcgtaagcaaacggcagataaattagctagctatagctagcttagcggcagaggagttagaaaaactggggaatgaatgaagtcagtaagtaatatacttcggcgtatatccgtacgtacctggctagtcgccgcccggccgctagcctccaagcgtagccgccgctgctctgcggttaacgttgacgacggcgcggtgccctgcccgcgcgccagatgcgcgaaaacgacgcgacctcgacgacaaatcagcgaccacctgccccgctgttggtagctggctgcgtgtgcagttcttggctgctgctgctgctgctagctgctgccggcgccgccgcgagatcgctagagagatgccggattatggatgggattatttcgcggtgaatgcggaaagatttaagcgaagcaaaaggcagctagctagtccgagctaggcagtggtcgtagtgcttctcgcactctgggagctcgagacaggccgccgtttttatagggtagcttggaaaaaaaaggtgaactaattaaagtagttaattaacttaaaacgacgaggagaaattgaattaccacaactggtctcgacgtgtatggtggtgtgtatctgatgtgtgtttgggatggagggatggtttaattaggtcgtgcacgatggcagccatatgcttgccgatccttcgatctactcctacctcacgcacaaaaggaggatggggggccctctgctacgggagatatgcgtcagccagtcggcaaagatagtggccaccatcttcgtcagcggccattggtcagtgactttgtgatctgagctagtgccatgtaggaacggtcaggatctagccccggcccctatactaccacgcctgtagcctgtgctcgcgacgaggcttctactcgggcaggtgaattccgatcggcgatcgctcttcgatcggttggacacggacatagggccaaggaaaggttatcatcatcagtgattctttttgatgaagaggaatcatcggtgatcctgacatgatcaccgccaagtagtactcaagtgcgtcgtggagcgatgtgtaaaaggtggtgttcgtactgcgtgctgtactgcagagtgtgcaccgcaactgttgcaagtggggaggctagctacgatcgattgatttcgatcatgggcatgggtccggctcatgggttttcccggaggagaggaggctagcttgcaattagcatgcgccagaaccggtccaaaaggcgccactctgcagcctagctttggctttgtatgttgcatggtggtcaatataatgctgaaaatttgcctgggaaacacccgttttcagcccaagttggatcccatccgacccggcatggttagccctagcttgggagctagggatgaagattaagtgcgcacgtgaaacgagacaagttattagcatataattaataaagttttaattattaaaaaaaaataaaaatggatttatttgttttttatagcaacttctatatagaaaattttcacataaaatacaccgtttagtagtttgaaaaacgtgctaacgaaaaccgaggaaaaatcaggatgttgttgaagtttagaacaggaatatcgaaccatatgtgctagtgcggcgtacgtaacagccacggggagtacgtacttcagcgcatataacacgtcagaatggaaccaaattccaaggaacagattggacacatgtggtcgttaaaaaacagtacgactgtgcatttgatatgatcctgtgaaaattcaccgaaatgttttctccttttccttattctccccggccgaccgatgcatatggtgtgtgtgaaaatgcatgagaaaatgtatatctgcttttctttttttttcttgagatgagaaatcgtgtctgctttccgatggtaattaaccacactagctagctagtgcaccggcacctttccaacataccggcgcggccagcacggcggaagaggcggccggccgtcgcagttggaccgagacggccggaaagcacacgacattgtaaaagccacattgccattgatcgcatgccgcgcccgacgcgcctgactcaagacccgaccgaaagagagtcaccgaaaaccacttcgtgcgattcatcagtcgatctgtcgatcgggtcacaaggcggctcgctcacggaacggcgccagggacgccgtgtcgatcgcccacctgaccgggcgtccgcctgatggcccccgaacccggcagtggtcaggcgctgcagacctggccaaaagttggaaggccgcgcctggtgcgcgttgcacaaagatggcacgtacgtacagctagctggggagtagggttgatggattttttggcgtggaaaattgaccacatcgaaatatttgataagtttgtgttgcattagtatggttcaatggttgaaagctttttcggttgccttttatctgtttcatattacaagtcgttttaatttttttctaattaaacttttttaagtttgactaaattcataaaaatatttagtagcatttgaaacaccaaattagtacccttgaatgtaacattgattttttttattatatgtatattttgtgttggatatactactatgtttttttataaacttagtcaaagataaaaaaaattaactattaaaaaaatcaaaccgacttataatataaatcggagtgagtaactttttctctatttctcgttgaataaataatttatattttttatttatagaattaagagactataattgatttcaccagtatcagaataagtaaaacaatgactttatatgtttatatgcgagattgtttactagcagtctttagatgtgaagaacatacagcatgcatgttttttttttcgtgtgtgtgttagatgcagccatgcaggagtctccataaaatcaatgagttttctccttattttctatgttggcaatgtgaaagagctttcattacgtagtagacaaattccttagtttttactggttcagggttcacaaagtcattacttggatccaaaaccactacttagtggtttcatcagaattcatgaaaaccggtgaaaattcagatattcttctttaaaaaaattgaactttactttagtttgattttttttagttgaccggcttatatagcgcgcggtttataccatgatcttgtgaactctgctagtgtctcgctcccattctgctagctacgatacgaccggggcccggccagaacaggtaaagcaatcgatctgacccaacaacgccaacaagaagtgggcgacccaattaacctggccactggccagacataccgaaacagacccaggatcaaagcagcctagacgcttacttaatccctactatatatgaagctggtagtttaattaatcaaccatcttattctttctctgaaatatcatcgtatatgtctgcatgggatcccatgtagaccactagttccgtgcatgtggatgcacacctcaactagttaggtgattattaggccctggtttgcttgcccctgctttttgcacactttaaactaccaatatatattcacatttgtggtgaccagccggtgctttaacaaatcaataaagggcaattttagattaggactgggtaaatcgtaatggaatcacacgtaaacttcaatttgggtggtgcaaacccatgatgcaaagtaagaatgaaggggtgatcaaagtgccatgtggtattggacaagctggctatagcctacaggtgtacagtgtgtgttagggctaccacaatgttaaacaaaagaaggtaagatgcattgtgggtagagacaataactgctactgggctattgtgctactgccggtaacaaaataaagaacaatatttttttagatatgtgaatctttttgtgctagcatggttagaagagatagtttaacaatgattctttttaagatggaccccaccttaacttgcataagagcaagtttaatagtataataacccactactatctccaattcatctatagccaatctaatagccaataattgcttactacactattagtatatggttccacctgtcatacacacattgtgtcttggagtccatgctgcagctggctacagatctgtagcccgctgctcttctctctcatcttttatctcattaaaatatatttgtagccagctaataatttgctattgtacctgctctaataggcatagcacattgtgagctttgtaataactgttaccacctaaacccttggcccacattattatctagtttagtaggatacattacggttgcttgagaggtactaccaagaagtattaatatctgtagtgcaaattttggtattttttaataccaaagataataagagatactaaattttacgctataaaatgtggtatcttttggtaccttctaaaaactgtaaaaatcattcattagtaatacgtttgtctataataatatttcgccaaatcagatctcagtgacttgcaccctagctgttggattgatatctaacggttagggactcatcttcaacctcccgcacaagacatggaaaagtggagctggtggatgagaatactcactatcaatggtgactccctcgaccgcgcgagctgttggagatgcgtgggtggtgaggtagcccaagacaacctgccaatactattagagggtgaaggtggcgccacggaataggaggaagaggaagtatatgaaagatagtagaatggggtggcgatgaagtcttgttggcaccgatacatgcttgcaaggcgaagtgagtcaacgtgaatgacgtgcacatctacgatgagtagcggtggggtctaggtcaggagcaacgggtggaggaaatggattgagatagggttacaaagtgagatagggatcttgatacaatttaaaccattcaacataaataatggaataagattaatcatgcaactcatgaattaagaaatccaaaaacaggtggcgttaaccatatgtacaaatactccatttagtcttaaataaatagatgatatagttgcctttttacacatatatttgatcatttgtcttattaaaaatattgcatatcattttttttacttgtttttcatcgaaggtaccttaagaatgatttatatttttcatatttacgtaacatttttaaatgaaaagaataatcaaataaaaatcaaccatatcatttattaaaacctaatgggagtataataaagcgatcaaaacatgacgacgccgtatgcatatccgatggatatgatctacttccagcctactttccatcccgtgtaacggccggtacgtgtaagtgcaccatggaggatgagtatatattatagatctgatcgatcagtaaacaagttaagatgcatgtgccacaaaactcaattaattaattaatcgaacgtcatatatatcgatgcatgggtagcaagatgcatgtgaccgcacaaacataataataatactatacagtaatagagtactactagtggagtactacaatgccaacgttagtttctgcagatattgcaggataacgaggtgataagcagatacgtgcgcgtataggtgagggtcggtcgcgagggttgtggacaggtggcgtcccggccggcacaaagacactagcccatgcggcgtgtatatcgtcgcgcgcgagaaatcgatcgacagccaagctggtgtttggatccccgccacacattgcctcgccaaacatgcggctgccacaacagtttgactgatgtttggttaatacgtgagttgtggcagccacactttttgctagttcatttgtatgcttattttcgccacagctgtggcgattatttctctcgccacaatctctggcgacgccacaacttgatggctggtttgggctgtgaaccctgagcgtttcgtgcgacgagatatactaaaccggccgggcggcccggtgcgcgcgcgcgtgctgctcgatcgatcacgtcgcacttgttggtcctcgatcgtgatgcgttacaggtgcaaaagtgtacgtggttttgactggttttccacgggggaaaaagagcaggcgcgcgtcgagcggtggctggccgggtttgcgcgtggccgccgctgccctcgtcgcggccggagggtttcagggacgacgacggccgcgtgtatatgccatatagatatattatcttgatcatcgagagagattgcgagtcggggatagcaccgacaggcgagtcttggagtgcacacactgtgtgtacacatactcctacaggcgatggtgaagcacatgtttcatccaatctatctcgtagaatggcgtgtattcacgtgatacctgtggtcgccgtatgtacggtaggtcccctctgcgtacgatcgaacctgcccgttgggcccgggccgcgtcttctaacgacgagtttctgacacagccgtgttgaactggaaccacacagccgcgtcgaactgggctaggagtgggaccactccttcagatatgattgcaattcagtggtgtgtacacccgtacttagcaacaacggtagatataggctgtgtttagatctaaaagtttgtatccaaacttcagtttttttccatcatatcaacctatcatacacataactttttagtcacatcatctccaatttcaactaaaatctaaactttggatccaactaaacacaaccaacccaaactttcaatccaaacttccaactttttccatcacatcaacatgtcatacacacacaactttttagtcacattgtaacaatttcaatccaaacttccaacttcgaaagaaactaaacacagccatggcagatcaagcacccatatttactcgtgcttggcagatcaagcactcattccttgtgcgcggcgcgttccggtaaaacgacaagcgccgaagcgcgagctagaggcagacagccaccggcatttggcctggcgctttgcgtctcgtcgatgaatcccatgctcatccgcaggagatcgaagaactggtaccatgaatgctatccgctaatttcgccggaatgggacgcgcactcgagaatggatcgtgcgcagtagttgtacacggccgtcgtacgtacaacactacaccactagcgcgcggatggatgcatggatcggcaaaatactttccgtttcttttcgtgcccttttatcttcgctttttacgcttttgtctcacacgctttcgacgtcggatgcttgggagcaatgggggtgggagagacagagagatggatcgaatgttcagtgggtcgagcggacagcaacctctcatcctctagcgtttcggcgcgcggcgcccggcccggactctgcgcttttctccggtccggagaaagttccgtatcggaaatttccggcgcagatgtttttgcgtttcgcctttcttgttggtgtcttaagctagcgtttgattcggcaaatcaaagcatgcgaatgagaaaaggttactttcctattttagtaaattttagcacctaaagtttatacacctcaagtttacacatctaaagtttagagaccaaaagtttataagtcaaaagtttatatatccgattcaaatttgaatttgaattcaaatatttttttatatgtagtatttctatacatctaaagtttatacacctaaagtttatagacctaaattttatagacctaaagtttatatacttgtttcaaatttgaatttgaattatatatgattcaaatttgaatttgaatttaaatattttctatatatagtatttctatacatctaaagtttatacacctaaagtttatagatccaaagtttataagtcaaaagtttacatactggattcaaatttgaatttgaattatatctgattcaaatttgaatttgaattcaaatattatctatatatagtatttcaatacatctaaagtttatacacctaaagtttatagacccgaagtttataagtcaaaagtttacatacctgattcaaatttgaatttgaatttaaattgtttatatatagtatttctatacataaatttttctaactttttattttttaaaaaattttatggtgtagaaagagaagaaggggaggaggaaaggggagaagagggattatagggggaggagagcgccgggtgatcgcgcgcattagcagtttcgatggaatagtcggcaagtaaccacgatcgcttcgttggtccggccggtatgcttgcgtagggatcgtggtggtatatttgcaaccttttgactcggcaaatggacactattaataagctagctgggatttttttttcttttcttgcggggagctgggagttaacttagggtgtgtttagttcacgtcaaaattggaagttttgtcgaaattgaaatgatgtgacgaaaaagttgaaagtttatgtgtgtaggaaaattttgatgtgatagaaaagttggaagtttgaagaaaaagttgagaactaaacaaggccttacacagttacacgtgaatgggtgacctttgtcatcactcgtcagggcggacccagaaaattaaaattatactgggtgtgctcattctagcgatcacgctaccatatatctattaactaattaaagtaatgaaaaaaagagccccacgttcgctctcatagcctagaaaatagaaaaacctaagtatactaggattagaatatgaaacggacaagaataaacaaaaatccaaagatatataattataggattgtgtggaaacggacaaataatttttggaaaccgtgtgaaacaaaataaacacaaaccaatcgcactatagatttatatgggattaaaaaactctaatgaagcactatagattatggtcagtttagattaatggctgagatttaatcagttttgtaagcaggtttagctctcggtcatgtagaccagcctaacaatggtcatacacagcagtgtgaaaatcgagagggatcaatgaattgagatgaactaaattgatgcaccactgaaggggtgactagcgatcacatctaggccgcctgtcccgacagcatggagaggctaatggtctcgatggctttaagcaacacgactaatgcattttccggagtagtaaaaacaagttgattaagtttcacaaaactataattaccttcacaaaaataaagaataccaaaagagtctaagagtatatataagaatacaatttagaaataactaaaattaaaaatttaaaaataattaataactatcacgcatatacaatacaatataaatattacacattggccagtttggtcaagttagtacataatttaaaattatgttgtcatttttaatatattttaataataaaatgtgaaatatatatattttagtatgtgagaaaaaaagataacgatcctaggcacgcaatctgcgggccatcatgctagctttttttaaaagaaaacacccaattctgatagaagaattttggcagattttgatcgaatttttcaaagttctattcatgaaaaatctataaaatttagaacaatcaatccatgtcctaatctatctagctgtttttctttttccccactgtttctcttcatctagtccttttctcttcccttgatttgatttttttgacgattacaaaatctccagacaattcatgatcattcgtgatcattgttatattctattttctggtaggattttatttttatgtcctttgattgcatactacatcctagtgtttttccaaaaaaaaaattgggtatgccagtgccaaccggcaaacccctaggtccgcccctgctcgtcaggtacgtaagcttggtatgtgagagatgcaaatttaaataacgaaattgctaaaaagtaactgttgaattctttttcaaaaactttcaaatgtaactacagtgtaattatattgtagtaagttacactagaattgcactatatttatattaactacaatgtaactatattgtaatatatgtataacttacgtataaaattgcatatatatttttaattcttatatacaatttatattaatttatattgtagttatagtatacttgtggtggaattatattacaactatgttacatttaaaagtttgtcattcaaaaaaaattgcggcaatttttttatagtccctttaaataaaaaacactagaaacttcggtatgattgcggattgaaagatatgtcgccaagtattcaagtcaatgtgtaccacatgcatgtagtgacaagtatgttagttacaactcctgcatcacttatcggtagggtgactcaatacaatagccaacctagtgccatcagtgcctcattctcttgccgttaacatcattgtctctagggttccaatggtattactgatttcttcatccatgggagtggcatcctctcaattcgatcgacaagggcacatggagatgcggagctcgctccaaccatcggagcgtgcatgatgatcgaagggaatggtagcgcctgatcagcacttatgatcggcttacgcctaaatggaggtggattggtgagtcaagctcttcgctagtatatggtcatgctcaacctctaccaagaaacgaaccaattaccatcgaaggcaactgtatgggtagtgccttggtttatgattgaaatattagtcaaggaaaattcaaagtgccttcatcgagcacgatccgcctaggcctgaatggaggtgaattggcgagtgaagcacttcgctagttagtgtttgggttctgattctacaaaaacaaccaaaccaatgacaatcatttagaggtaactacacaggtggtgccctccatcattatttggagcgttactcgaggtcggttcaaagtggctaagatggttatggaagattgtgtgaggttttctttgattgtctttatggtgggtggaagatatcaacatgctctctttgttcgtggatgttagcgaggtactgagtggggtagaaataccggtctggtaattatctgggttgacggcattatcatttatttgttattttgttattaaaggcctatggacgaaaatccattactaattttaggttggttcgaatgatatcaacaacaaacgttaagtctttcttgaaagcgcaattatggagagctatataccttttcatcttacttataagagtgttagctgtcactagggaccatgatatttttgtgtcctcttgtttttttatgtgtaatgaaatgtccatttgcatcgtaaaaatgtgatactccatctagttataaatatttaacatttaaaatcagatctaatctaacttttggaaatatgagcaataataatttctcaaatgcttaatatacacacgtatggttgccttaaaaatacttgtatttccatacgtatgcttaaatacaggaatcagtttctcaaaagtaaacttgtcatactgtcacatgctgaaatactagatatagtttattgtgccaatatttcagcatcctgattcctgttcctgatgccatgcatacacgtatttttagtgtgtgtgtgtgtgtgtctatatatatatatatatatatatatatatatatatatatatatatatatatatatatatatttgctttgtagttttcttgttttttaattaagccgcgtagttttgtaattgataaacgttcttcctgcaacctatattataataattggttatatatattttttaagtaaagcatggatgaatttcattatctaacacaaatttgcttggttaattgggggaactcaccttaattacatgtcactgtgacaaagcatgagtcatctaaatcctaaatgaaccctgaacaagtggacagcgcgctaaacctcctactagaaattaaagctcctccttttttttttctttaagcacaacgctccgcatatcttttccttgataaattctaaataaaataaagatcaactttttcttgagagtagaaaagatcaacttgtagaattgaatagaaaagcgatatcaccttgttaacctttgccaatatatgcatatgatgaccttatatgcttcgactttacgtgacatgtgtatgaaatatatatatagttctggccgggctctacttatatatctatgtgggatatatatcagtatacataaatgtagatatagactagacaaataaagccctaaagcaacttccgtccattctgttttaatttcttttctttttttaaccattgttaccgctttttttttcacttctctttccggggacaaaaaaacaatgtgatgtagtatgccgttcgtgatcgactcgcgctctagcctttccttcacatgctatctcgtgttggtctactccgttcgtattcactggtagagaaaccatctttggtcggtcgacccaaattcacaatagtcccggttccattaaaaaccgggactaaaaattcactggtagagaaaccatctttggtcggtcgacccaaattcacaatagtcccggttccattaaaaaccgggactaaaaataatttttagtcccggttaataagaggaagatctttagtcccggttgttgttaccaaccgggactaaaaatcatctttagtctcggttggtaactccaaccgggactaaagttcatttttaggcccggttgattccatgtcaggccgtgtcagggccctaggatcttaagtcccggttagtaacaccaaccgggactaaaaacctatttttagtcccggttggtgatactaaccgggaataaaaattaaaacacactatataatccatagtaccgatcctcttttcccgtccacacaacaaactcctccctctatctctttttttcctctctaacttcttatctctttccttatctctaactcccctcctctccttcctttttttccttcacccatggtgcagaagcgtgccagcgccgcggcagcggcgggtggccggcgcggaggcggcgacgcgggggacggcgcggaggtggcctgcgcggcggtggcggcgggcggccggcgcgggggcccgcgcggaggcggcctgcgcggcggcagcccggggggccgctcggcggctaccggcgcggcggctggtggcggcggtgcatcaccggccggctggcgcgg

SEQ ID NO: 74331 - DNA, 23677 bp, Oryza sativa
aattcctgcagcccttctctgactttggcaggaagcaggcggcaagtggggaggggacggcggtggtaggtgcggcggggagcgaggaggagcgaggttcagcggcggtcgtggttggctacggcgtggaggacggcggaggtcgcggcgggcaatggtgccgatgacggcggtgggcgacagcatcgaaagcgtagaggacggaggctgcggtgagcggaggcggcgggcgccgccacgcgggggcagcgggcgccgtcgcgcgggggccggcgggctgcgcgctgcgccacacgggggccggcggccgtggcgcgcggaggagaggcgggcgccgtcgaacgggggccggcgggctgcgcgctgcgccgcgtgggggttggcggccgcggcgagtggaggacggtggtcacggcgagcggtggtcggcggctgcgtgctcgagctcctctccatggcttctcctcgtgctcctcctgttcctagttgccgtgtgtggggatggtggagatgggttgtggggggcccacaattggccagccaaataaagtggccaaatttggctagtggagggagggttttggctagccggatggcttagccatccggttgaagaggctgttggccggagcacgtttttttagctagaatagctaaaatttaacttggagagtgggatagagaggctgttggagatgctcttaggagacgaaagatttatacaggttcaggccctctcaatgagaagtaataccctattcctgtccagggattgatccgccgagtgtgttattgatcgtataatctgggagaaaagttgtgcctctagaggcacccgaacccctcattatatagggggaggagtccgtattacaagatacagctcatattactaacggaatatgcaagtaaagataaactacaatcataaccgactaggactatcgaatgtttaattattattatacaagttaacataacaaccgagtcctttactaaagatattctaaccgtatatggtacccctatacccagtcggatatacatgccgtgtgggtacgaggtatccataatctctacagtatgcacggtgcattcactaggaaccatccattcgtaacggttggagttgttacaatccgttggtcaccgatgtgaagactcatatataactatggacctatttgaaaaagccttaaaattctaagaaatagctgatcggtaactatcttgtgagatcctggagaagctgagcttttcattttctgaaatctacaactacaacgtctcagaatctaaaaaaaaaactatttggtagaacttttgatccttgaagaaactatagttgtcaaaagctactttagtcatccggtggctatgcacctgggccatcctctacaaaccgggacttcgggatactattgcggtggtatcacaacgtttcgaccaggtagcacaggagtttttttttttacccagaagcatgggtggcgacctagtctctacggattgataaccactagtttctatgttttgtgatggggaagtcttcttaggtctagtgtttttggctgtgtgaattctatgcagaggctgggggtggattaagttagaatgtatcatcttggtgtattttactgactattaataaaacttccattatcttttaaaaaaagttgtcagaagcttccattatacgtctctgcttctctgcttgcttgcggcgctcgtgatccggcgaaggggcctgagccgctgatcggttggcaacgcgtcgtccgccatggttctagttccagccccatgctaggtagctatagctagctgctgctgctgcgtcgtcatcgcgagcccctgcctacacggaccacgctgtgagtgacgaccgttggctcagatcagatggtctaggttttactataggtttcgggcacctatatatcctgcttgatctgtttggtttgttgagtccatcctcccgtctcctcctcgctggttccattcctgcaaatgcataattaagcaagccagccactgtttttcctagtacatatatagagacaggccggccgggccatccactcacgtgtgtaggaaattaaacggcgaaaaacattggatgcactcagctaggacaggggcacagggctttgatgtaagtttgtactacaacttggggaggatacagttgatccagacactgcggagaggtacaggacaacaacaggatatgtgtgagccacacatcccacacaggatggatgaacagttggatgataacttgatcgcaatccgtcccatttccaataatgttctcattccaaccaatcttacttatatcatttttttccagatttacaaaaataaaaaccctgagacagacaactactgcctctgttgtaaatcaatctatgtacaggacgatatctagccaaacttttaaagcgttcaacaatttatagcttcttaagtgcttaatttaaataagcaaaaatatgggtagatttggctaaaaaagtacgtacattgtatttttagagagaagaccttgcggcccggtttatattgaaagccacattacgtcatacggtagagttggtaatgggggttgccagtttacaaaagatgaacaacttaaccaagtgactcaacgagtttggagaaacaccatgcgatcatcatgcaacagggataaaacctgcagctctaaagtagcaagcacctgatgtctcttagatctattacaaaacaggaataatacagaacattagcagaggtataggctacccaacccctgttcttcggatcttcaaagcggttgtcacatttttcaacttctctgcaaccatttccatctccacaacatccttagtgtgacaaagggctctccgcagcaaaagagagatgattcgaaaaggtaggatcagtggagagtacaacggcttggatctggaaatcatattatttctagtggtccataataaccagcaaacaaccacaaatacagcagtaaaaactctagattcaacttggttagaattgttaattagcaaaaagaactcatcaaaatctcttgttccccacccaaaagaatctctacaaatgcaccaagttaaagaggccatgaggtaggtaaaaagaatgtgggtggtcgatacaagtgccccacctattgacaaaattctgagcactcccagttttttttaattcttctacacactgcattttcacatctctcacacctctaaaggccattgcttcatagagtgactttgtggtgtatagtttattagctgataatcctcagatcatgaggtctggtgaattgactagtacaatctcttcaattatatatgtgacatcatactttctatgtcttcaaaagatcttataaaagataaacaactagcactctttgttaccaactttgagattgtgatgtctcgttggttacaaatctaaaaaatctttgggtatgtggtcttaagggggcaaggatcatgccagaaccatatatgtcttccatcctctagaagccactatgaccctagtttcatccattttctggtattcagaattctttctcgaattgtgatcccttttgaccattacattgggaaactcctctatcctaaagatattttttttctcaacaactcaacacacagactattgtatgaggactcaattttcataactcatttggccgatagaacagtgttcagcattctagttttagtcaagccaatacccccaaagtcttttgggaaagccaaatctgtccacctcaccatgtggtattttccgccctgtttgttaccagctagtaatacctcgccataataacttttgatgtaatccctcgaaaacagaaggtacttgtaatatcataaagtattagttttataagtttactttaatataaaatttatggtcaaagtttaaaaagtttggtaagaacttatctagtcaaatatttatggttggcggaagtaaaagaaatggtgcgcattagagaaattacagagcaagtttaacctttatggtgtaaacgtatgtactccactatacagtggaaaataaaaaagacatttcttacaataaaaaatataacgacataaatagatagtcccttcgactatttgagcgatggtagagagggccatggaactaaatattccacttgactagagcccgatcgagaggaacagaaagaagggaaataggagctatggtaagctgcagggtgtgtgtcaccggggccagcggctacatcgcgacctgcctcgtcaagaagctcttggaacgaggctgcatcgtccatggaacattgagaaatcttggtacgtacaacgtactccgatccatctctagctagccagctagagacctctcccaatcactccctgtttccaattgttggagatatggagataatatatctgacaggagatgagaagaaggcggcgccgttgagagagctccccggcgcggcggagcggctggtgctgttcgaggcggacatgtacgacgccgacaccttcgagccggccatcgccggctgcgagttcgtcttcctcctcgccaccccgtttcagcatgaacccagcagcaaggtatacgtagtcacaagctcgatcggaacacgcaggaaaaagatatcaatgtcatgtcatcatgtgtaacgtgggtaatttgttgattttgcagtacaagaacaccgccgaggcggccgtggacgcgatgcgcatcatcttgaagcaatgcgagcgatcaaagacggtgaagcgcgtcatccacactgcctccgtcaccgccgcctcgccgctccgggaggacggcggcgaggggtacaaggacttcatcaacgagtcctgctggactccactcggccagtctcacccatacagcagcgacatgtcggctataaatcaagtaatcaaccagcaaaaaaaaaggttatttttaaataattttttttaaaaaacaacaagatatatattgtgataacataagttagtacaacaaattagccctacacttaaagaaagaaaataacaaattttcatttacagtgtatttttttgttattttagtttctccgactgcagatacacgttggaagaatgtgtgcttaaattgctcctaggtgtactaatatcaatgtccatcaactaatggggtgtttagattcaggggtcaaaagttctagcgtgtcacattgggtattatatagggtgttgcatggggtgttcgggcactaataaaaaaactaattacagtatccgtcaataaaccgcggacgaatttattaagcctaattgagatgttcaaacgttcgatgtaactgggtgtaaaattttgaggatgggatctaaacatgccttaagtattccaatactgaaaacacatgcttcctagcgaaaatattcagaatataaatctgtgcttcgtaggtttacgcatcatccaaaacgctatccgaaaaggcgctgctgaggtacaacgagtccgagagcagggcgttcgaggtggtcaccctggcgtgcgcgctcgtcggcggcgacgccgacaccacccggctctaccacctgctcagcgtcccggcgatcgtggcgccgctcatcggccaggagtcttaccacggcggactcaagtacctgcaggcgctgctcggctccgtgccgctggcgcacatcgacgacgtctgcgacgcgcacgtcttctgcatggagcagccgtccatcgccggccgtttcctctgcgccgccgggtaccccaacatgaaggacttcgtcgaccacttctccgccaagtatccggagatcacgatcaagctccgagagtatgtgtgcccatgatcaattaatcattttcttgttttctcttttgatttttgtttgtttgtttgtttacatggtttattaattgtggaaattgctatgcatatgagcatgctcgtctttaattgatctataatttgcatatctaaaaacatatctctggttgtatataagttgtacaactagattggacgtataatattactcattaattttatatgtgtttgtttgtgaactcgcagggtggtaggggagggcgtgagggtgggagctgatacaaacaagctcacggatttggggttcagatacaagtatggggtggaggagacgctggaaggtagtgtggaatgcgccaagagaatgggattgctgtgatatgcggctgttgcgttgctcgttggtgtttagtaatttgcgtatgtgtagttggcaccgatttggacccagatgtgtttgtgcctttatgctaaaaaaaggttaattagatccataccattattattttgctagttttgaaaaataccattataatttatataattgaaaccatatcattgcagttattctgagattggaaccatgccatgttatacatccttttgtgtaatgtattctcgtatggaccaatatgcccttgtcttcttccttcctcagctcctttccctcttgttcatcttctctctctgtctcttcctccctcaatatgcagcaggtagagcttgaggtcgtctcgcctcttctcttgtgttgctgctcgtccatggttccacggtggtccagctcatagcgattccacggcagggttcactgataggcaccaaaagagaagcgacggcggcagggtcagggcgtgcgcagccgtcgccactggggctgagccagtccaaggcgttgttcactcttcttcctcctcctcccatgtcgtttctactgttgttgccgctgttggtcccgtatggatccataccttcacgacgagcttgttgctacagctcgcagccagatttgcttgccgctacacagctcgttgtctctgtaggatcagctctctgacgtgccgccgttgcagtacccgccgtctccgagaccttgctgctgttgtgacgagctcaccgctaccgtcgggagtggtctcgtgcaccattgattgctagaggagagagacggggcgatgaacaccgccgaatcctagcccctcgcctctatcgtcaccggatccgtgaccccccgcctaccccccttgcctggacgcggccggatatccgcatgtccgatctgccaagaaccgccgccggagtgaggggagcaagcggagtcccggagcaatgcccgacgctggtgagagggacgccgagctcctgcttgccgagagcgagtgagaaagaatgctcctgctgctctacggggaagagaaggaggttgaagacgggggcatttctgtcaagtgtatgtaaaatatatagatcaatggcatcattacaattacaaacaaacaaaagtggcatattttcaattaactgaatggtaatggtaaatttcaaaacaagcaaatttatactggcatgaatccaattaacccaaaaaaatactacctgtatctaatcgatccaaaactgcgaaatattaacacgagataaccatgtgtaatcgagaaaaatgtattgttgttgcttggttttgcattgaccggtctgacttctagccctatatgatttggcctctagtttctctaaccaaacagaatccaaaataagatcaacccaactgtttcatgtcatctcaacctaaaggttgacagattttgtttgtttattgtaatatttttgtataacaagaccataaattaaagagattcattgttcattttttgtttatttaactcagtattcaacaacgatttgttaacgtgattaatatttcacttattacaaacccaacaacttatataaaggatgtataccttgggcttataaaaggatttcttcatgcaaacaatcctcaccgcctcgaagtaggccactgtgttgatgttgaaccagaagtcatccactcttccctgactggttttcgatgtcggcgatgcggggggggggggggggcggtaggaggctctgcactggcaggcggcagcagatcttgtcctcgtcgacaaagcagacttggacgaggaaaaaaattcttgcagcagtgtcgcaccatgcctcatgtgcgacaccgcgtagacagctgacgcatgcatccaagccttctttagagttgagccgatgtgttgaaagactcaaaacaacaaaccaagccgaaaacttggggagccgctgaccccccccccctgtctagggatacatcgagccatcctcttcccgtcgcacagccgccggcgggggcaccatcatctctccaccctgagatccactgccgcctccatgcgtatagcttttgcacttctctccacagcctaaaatccaatccatcgattccaatttcacgcctccaacagaagggaagaagaccatgaaagggagaagatgccagatctgttgaagcagatctgttgaagcgaccttgaagggtgattcatggcttgtctttgcaatgtatcttcttgaaactagatttggaattgacgttctcaacagtctagcacatatataattcgcagaaggggcgctgtcgatatatccacattactcactatcttaaccttctccaactattttggccactcgggagatggtgttgtttctgaatttctggtgtgaataaagctctttggaaattttagtggtaatttgctgagtgttgctgaaaatggtgacttgttacacaacttttttattatgcaggaaaagagaaaggaaagctagcagcggccagcggcaattgaggagctggagactctgatagtctgtccagtccaggtaggtggccgcacggcccgatcaccagttcaccaaccactccaagggctccgtgcacaccccgctgcatctcgtcgcagtatgggcctgggccgtaatgtgccgcagctaaacttgccagcccagcccgttctgatgagcgcgagacactccagcctatcgagcggtcactactcactagcagttggaatttggacagcagcagcagcggtgagcgcggcggcggcggcggcggcgacttgctctcctcctccccacagtccagttcttacaggagacgaacgccggcgagccgcctccgccgcagctatggcttccaggacgctctccgtctcctccctcgcctccgccttcgcctccatcccccgccccaggccccctcctccgcctccatctcgcatccgcgcctcccctctctccaccgccgccgccgccgccagtgacggcgacgccgccgacggggtcgacaccgtggagcagctcctcgttacgaagccccccgcctcctcctcctcctcctccgcgggaaggggccggatcgaccggctcatgaagctgcagcgtcgcgcggacggggacttcccccccggcggggcgggcggaggtggttcccttacctggacgcgttccgggcggcggggggcgtggagctgactagccgggaggtgctggaggtgctggagccgcacatcatggaggcgcggcgggagcggatccgccgcgccgtcgagaaccggagctactccgtttgcctcgtcgtggaggggctctctgacttcgggaacgtctccgcggcgttccggtccgccgacgcgctaggcgtgcagtccgtgcacgtcatctcctgcgacaacaacaaaaggtgcagaggtgaaaccaaaatgtttaacttactcttcatgacagacattgctattgctcggtttggttgagcgaagtagccaagtagggaactatgaatagttgtagagaatgagaattatactaatctatttggatggatggttttagtttgatcccatgaagaaattgttgttgtgaacttctgataatgctcaaccatctaatttcagcatacagtttgccagtttgcatctaataatattctaatacactgaatctgcaatacctgattacctcaatactgcatggtattattctttttttcattgaggtgcaaaataaatgagaaatattttttgtgacctgtgcattttatttgtccattcagtagtttgtacaaaaatggcagaaatactgaccggaaggaaatgatccctcatctagtcatgtagttctaatatccaacacaaagagagtgattccttatgctaaattttttcctaattagaccactggattggtactgaagaacacagaacatttttctttcttattagtttttttatacataaattctgatatctgattatctgaatgaaattatatacgtattgcatcctttaaaatttgtatatatttctcaacttgcaagaccattgaatgaatatacttcttaactattgcaggtatagagacaataggcatgtgagcatgggtgctgagaaatggcttgatatcgaattatggagctcaactgcagaatgctttgatgctttaaaaaagcgtggttatcgcattgcaactacttatttgggaaatgattcggtaatttgttgttgctcacctttttagttttcgctcgtattttgaacagtaagccaaaaaagagtgattgtgatcattacatgcattgtcatttgttatccgcagtgaaagacaactctttttttttcttttcaagtaagaacattttcagtgacttacatagacaagataaaaacatttgttgtaaaattaggctagaaaagccttgaaatagattggtgtgtggtcgttgccaccaccaatgttgttgatcactgattgcagaatgattattgtcatctcctatttgagagtatattagtgaccgtttaggttagaatgaaagatatatttatctgtcccaaatacacattctttagtgaattggtaacttcagccttttgtgggattttgcaacaatgtaatactacactgtcattttctcaatatactttttttccgctctgtattgcattgaaagatgctttatcatttactgatctaagtaatacagttcaaggaataactatgctcgtaatggatctgtaggtttgtgtgtacgacatggattggtcgcaacctaccgctattgttgtgggcaatgaacttatgtagggctcttcctcttctccagatgcacatcttctcttgcaatcatgttataatgagtctcaaaagtatttaaatggaatgatcagatacgatgtcctcttttctacttcatgtatgttgtactttatcattacttttctacatcttttttaatcactttggggtaactaatctgacatctcctcttgcaagaaatctgcttaatcatcttgatgtatgttgtacaaaatggtttgcttagaagttttcctattacaaactagaaatgccatgtttgtttttactacagaagttccaaatagtccactgtgaaatttatatggatttataccttggaaagtaaagagagtactcagtatatcacactaacttaggggaatttatttttcagtatacttgtggagctacttgtatattaactagccattctacttctatggcaggggcataagtgatgatgctttaaagttgtcagacttgcactgcagtgttcctatgaaaggcatggtggattcttttaatgtatctgttgcagctggaatccttatgcaccatgctgtctgtgatcgaatttcccgcatcgtaagtgtctcaagcattactactaaatataccagcaggaagaataaacaccaaattcagtttctgctagtgggttgaacttgtctccaaactcatatataaattatggaaatgtataacaaccagtgaagcattttgtcagttttttatcctgacgatttgcagttaatatatccaaatggcttgaatcatcacttgttagtttcagtttcagctcactgatggattttggaatggtctgaacttactttcttttaagaaatgtgtctttataaattcacttctctgttcattctgtccaaatattccttcaaacaagggcactgccaagtgcatattctgcttaaaagttctttgtaaaaaatgtataacgaatactatcttaccagaagtttttttttttttaatgatagggtcatcatggtgatctcttgcctgaagaaagtagaatattgcttgcggagttttatttgcgccacagacagagcacagctggcatagttcacgaatatgccaaaagaaaggcaggaaacttcatggccaaactttgacaactatcattatagttactgaaggagaaatatacacaacctaggtattcattcaaagagatttgctttggcaattggagtttctggctctggcatatcatttttgacagagcagctggtaagctctttcatattccttatagttttccttttgctgtcatattatcgtatcagcattattatcaaatgctggaaggatgccacctacaatttcttttgtagttcccagtgttttgttattgtatatttgtattcctcaaaaaatattggctattcgcctattgattgtagtcttctctaaaccaagttgatagagatggtgtggaatatgcattcttttgtggtttccctttgactgctcaacttctctcttaactcatctttgtcagattggtatccatttaacatagcatgtgtttgttaaatcattttttcatgggttctaaatatcctcttttgaatgctttcaggtactccctccgttttttaattgatgacgccgttgatttttttctcacatgtttgaccattcgtcttattcaaaaaaatttacgtaattataatttattttgttatgagttgttatatcactcataatacttcaagtgtgatttatatcttatacatttgcataaaatttttgaataagacgaatggtcaaacatgtgagaaaaagtcaacggcgtcatctattaaaaaccggaggtagtaccatttttctaatgtttgcacatggtaatctgagctgttgccctcctgattactttttcttgacgaaggctttttacggagaggaactatcaggctgcttgaccatcatggtgcctcaagatgatgacttcagaacagaattttttgacaggactatgatctatcagagtatcaagctatcgcattatcttaacagatgacattactatttcagtcacattgcttgctacccaaatttggaagttgatgcaaaaactaagatgttgttttggatgctgacatataagaaaggatcgatgcagctttctctccgttcgctagaaccccagttgataatttttagagtttaactactgccttttaccgcgatgtgagacactgcactcagaactcaactctcttagcgatttaatgtcatgttttctctctcggattgttcacaataacagagctagagggttattttttggttattcaaatactctgagcggttccagaatttctgggtttttttccccatctcttgccttagctccataaataaatgctggtactataatgaacaaatttacttgtagtattgccaatgtgttaataataacaacaagaaaaaaaaatgttccatttaatatgatcgatcaagttaattattatgcacagtacatttcacagggccgatcgggcccacgcccgtacgtgggcctgggctgcgggcagacaccgcgctatgtgggcccggatttatgggcctgacatggctttcggctgcacgaaagatatcgacaggaggggcgcgcctccctttgcaagttgccaagttggcaaggtgagacgctcaagtggccaagtgggatcggagcaagttgctgcccgtggccggcgcatctccagatatacggatataccatgctcccgtggatcactcgtggatttattttctttattttttttaatggtataggtagatttcttttttagataataatggtataggtagatacagaaccgattactatattaccatattaccactactattgttatagacatgcatatataactatatatctgtctaattaattaccatacttcctcagttacatactaaataaaattataagatttggctaacttatttttgaacaaacgggaggaaccaaaaataaacttattctgagatgaaggtaataatgacatttttgacaaaacaaatatacaatggatttaatgaaatttgttcttctacaaacttgtttgacctgaaagaagtttgagataggattctaaaagttctgaacaagtttgaccacatttaggactataaacttgatcaacttgaagaattctaaaatatttttaaaagaaattaaactaactttgtaaaaatattacatgagcgtactccatccgtactcatttttctgtcactattaagcatcaatgtttcaactttaatcaatgtaataacttttacatatttaatttgttattaacgaggctatggttccaagtttatactacatttttttttgaaaaaaaaggacgagtggtaaaagttaaaagtaaatggtatggagtacatgtctacacaacccttgttataaaaaataaataaataaaacgtctgtacaagttgaagaggcatcaaccaagttggtagcctggttgtaggagtatttttcttatattgtattaatttcgtattataatacaccaggtggatactaccttagtccatgccaaaaaaatgcctagtacatgtcgctatcgccataaaccagagagatggaagagatgcatcagcaataaacattgggccgtacgatcttgcctgccatttacttttactctatttaatttaacaagctgtagttaaacaaactcataaatatcctgaggtggcccccgctcgacctcatctcgccgactactagtcgccgactggcccaggggtaatctcgtaatccctgagtcctctgcctcgctattccactaataaatgtttgtattttcaatatctggagtttaagcaattattaattttggcatttgaaacgaattaattttggagtagtatttattcctgtctagcactggtgggaggaaagatggatttagacatgaatttttaaattttaatcgaacaaataaaagaaaaaaatgatataaacacaaaaagaatctcataaacttttacaaaacaatgttactacatttcaattttccataagaaccaagtgaataaatcaaatataaatatttgtttgaagcactccctccatcataaacaaatctttaacatcgagtatatgatttgataaattttatattaaaataaattaataaaatatactcctaagtttgtaatattatgtacctcttttcgaggcaagtctacctaaaaccatttatttgttattattttttaaacaaaatattaatatgtggaattttgtggtaccaaacataaaacaaattttgattggagggattgatatttataagaatttttaattactctctctttcaaaaatataaacctaagattgaatgtgacatagcacctgtttgaattgatgctctacaaaaatattgatagcgccaaatcttgatcaaattttgatactaccaaaactttgatagggtaaagttaaaaatgaactggtttgaaacaaaaatatgctcataagagacaagttcatgggcaaagatagtgtttaatagagatgtttgctttgctactctcttggtagggcaaattttggtaaagtagcaatccaaactactttatccgttgccattcaaattttgtctaacaatacttgtcactctaaaatactacttatcctatcactcacatcttatttaaattctttttcttctacccctcaacgacctttccattttcaacaataaattatttgataaagacattatagtattttatttttttcaaatcttaatatgttaaacaactagaaatatagatatagccctgctctaaacaaagtgaggaaaatggcgatgaccaaaatgcccccgttccccttccatctgtcgtctccttcccctctctctatctcccctcgcctcgcttcctctctcccccggcggtggctcggctggttcctccccgctccgcctctcctcctcctcctcgcgcggcggccggcgagcttggccgctccggcacgcacggttcgggcagcctccactccttcccgactcccgcccttcctcccgcgcgcgcgcgcgcgcgccgcgggccggtgtgaacaggttttgggaggggggcggcgcggcgcggccggcctcgctcgttccgccgccgccgttggcggttcggcaccggaggtattccttcttctctctcagctctctccctccgcttcatgagccggcggcgtggtggtagcgtggagatccatcccggcttagtttgattcggatttcttcgttgcgtggcacagtactaaaatcagtttttgtttctttctgaaaaaattgggggttatggtgaatcccacatgcgtggtttagtttagatcgttagaactgtccaaaatgattgggtatagtttagtacctgatctatctgtatgaaaggcttgaccatttttattgatttgttgcgatgttggtaaccgattgctctgcatgtaactgaaatgccaatgtgatgcaggactgaagggagtatgaggaggtgagcattgtagctggagtgattcggttgccggaaatggtgctggtggtgaagcagcaccggtgcatgcactcggcgagctgcgtttgcatcaagggacacctcagcgaggacgcgctgttcctggtctttcgtcacatgaactggaaccccaggctgatcgccgtgctctcgtgcgtgtgcaagtggttcgacgaggtcgcgaagcaggtgctctggaaggagttctgccacgccagggcgccgaagatgatgctggatttgcattcgggtggcagtcacattgtcgacgggaactggaaggcgctcgggaagcttctcatctactgcaatggctgcacaaaagggggcctctttaacaacattcatgtccctgggcactttgtgttcaggacacgcttttcgaggaccgcgggcaagagtttcctgccccagcagtgtaggaatgatgtcttatatgtctcagatccatgcgagcatcttgatcaaggggatgaaggtgacttgggtttcttccgtggtatcttcatgtcgttcgccacctcaaaggttaagaagatgttgattgagaagcgggcaaggttccatccaagcgagtcatgtccctactgtaaggctaagctgtggagcatgttggaagcaaatatgtcgccggggagttcttctgccaggcttggtgcttacgaggattctgtggagtattttgtatgcctgaacggacatgtcattggaattggtacccttctacctctgtctgattctgaggaagtaccagaggagtagtaatcaggaacttgaatcaggtgatcatattttacattttctcttttgctgtcttgcaaagtataactttgtttatatttactgaattgaaactgcaaagcctgactttttattgactactggtcaagataaatatataggtatcttcattatgaatatacaaaccgaagaatatccagacattttttatgtccattcgttgtcagcacatttcttcattctgaatgccaatatcacttttcatggttggatatctagaatgactaatgttcaacagtagattgtgtatgtcaaactgttacatgcttaagccttttgtattcaactcatgaatatatgtggcttgctccatatgtgataactgatattactcctagtagctccaaaagaattaactaacatttgttggaaactatactatagttactttcatgtctgaaaagcttggttgatgatctgggaatatagaagttgtttgtttatggtctgtttaagggttgggttatggggcgctgatagcctgatactgcttttgatgttgcctccctgtgtagagaacgggtcctgaactggttagctggaatccccatcctttttttacctgttttcagtagctagttgtccctgttgtttagttttcgtttcttttgtataagaccttgttatgttttggctttcttcaaagggccaggtaatgaaatttgcctattgtctaaaaaaaagcttggtagacattactaattatacttattctcatttgtttacatggttgtgttatgcagtattcatgatccctggaccgactctacctaatcagttgccactcttattgcattcttttaagggttaattagatccatgccactgtaactttgccaaatcaaaaaaataccaccactattcgtcatatcggctacatgccactgaaaatttctaaaattggaacaatgccactgccgtccctttttccatccacctctctcacgccatcctcatcccgtcctcatccccttcctcctttgttccatcgtccatctatccatggccgctggaggttgacgcgagggaggttgcgaggaggtcggcgcgatggtggcggtggaggaggaggcgcgcacgggctgccgttcctggtgctcgcgcgtacggcgttcggggtgcgcagcacgcacttgctggcggtcatcagcgtgctcatcggttgcgggtggttcggcatcgaatcctggatcggtggccgcgccgtgttcctcctcctgccgtccaggctcaagtcgtaccagccgctgctcgcgccagtgccaggcctggggctgcgccgctggagttcgcgtgcttcctcgctttctgggccgcgcagctcggcgtcatcatgcacggcatggagggcatcagcaagctcgagaagtacttggaccatcacgaccaacattcccgccaacgtggtggtgccggcaaacgcgctcgtcagcttgagcccgcggaagttcacgttcgccaaggtggcgctggtcactgcgttgctcggcatcgccttccagccatggcggctgttcggctccagcgagagcttcatctacacatggccgttcgagctctcctccggcaccagcggccgctcggctccccggcgacctataactctgacggccatgagggcaaggtcgtgcacctgcatcgtcgaggacggcggcggcggcagctcccgagaccgagctcatcgtcgagcacggcggcgtcgccatgtgcgacggtggcgacgccacgttgcgccggccgggcacgtagcagctgcggcgcgacgggggtgggtggatgtcggcgaccaggaagtcaccgtcctcgtcatcgtcgtggatctccagggggaggaactccctcctcgtcgccatcgtcgtcgttgtctccggcgagctcgaaggtggcttacggctggcgttggccgtcggccgcgacttccactcctcgacgctctcttgccgcggtggagcacgaggagcaagcccgggggaggaggcagccggcggcgtcggcctcctcgccgaagaagaggaacgaatggtcggccggcggatgggaggccgttgaagctcccggcggatgcggaggccgaccaggaagccgccgcgcgctcccgcacctccgcgacctcctccgctccctcctccactcccccgcgggcgtcgccgtacgtcttcctctctgacctcctcagccctcgagcgctcgctgtggccgccgagttcgcaggaagaaagaagagggaaataacgtgatatgacgccacatctgacgggggaaacgagacggcgtgagataggagatggaaaaaggaacggcagtggcatggttccaattttataaattttcagtggcatgtagccgatatgatgaatagtagtggtattttttaaatttagcaaagttgcagtggcatggatccaattaacccttcttttaaatgccattagaaccatgaatgctctttattaaaccatagtttgaggaactttcatattcaaaatgatccatgaagtgggatgatcttatccatgtcagcaatcttcaagttcattaattattgttttacaaagctgctagctaagataacaaagcagatgtacaatctgaaagtcaaatgcagagctatttactttagtgatagtagtatgaacagtggctagaaaatcaatctacaattgcttagcacaagtagttctgtccttctgggaccataattttcccaattggttgaaaatatgtttctctcaagaaaaaaaaacaagagtgttctgaacaagcgtttgttgctgacaggtttgcaagactgaaaccctggattcgtgcatgctgttcgttgctgaatctttggttgcgactaacagtgggagaatgcatgcgcaaggcgacctgcaggtctgcaggatgacaagaatggctttgcatcgcagtgttgttcttcctgaaactttgcatcagatggggaaaaaaagctatttttatactgttctctcctttatcattgatgcctcatccctgcttcccctaattgtaaccgagacaccaatctcctgtcatgtcctatatgttcacagcacgtaatgtggtgtttatttagcttaattggactgtcaaaaatataaaactggtgctcatcacatgcatttcattttcctgtctgttcctgctgcattacttttgagaattaaggcatgctggttcattgccatacatagccttgccatttttttcggtaatggcaaacattggtcattgcaaaaataaaaagaaaaattggctaggtcttcattcgttttgcaaccaaagtcgtattcccattcgtttgagcaactcgggtcagattagaaaatgtcattagcgaatgattaattaattattaatcattataaaatttgaaaaatgaatttactttacttttaaaataaaattcttacttataatttggctcggttgggtttgctgtctttggaacacccattctgtcctttagagtttgaaacgttttctttccttttttacttcgttcaccacaaattaccagggattcaaacattcaaaattttgtatgaactactttgtattatctcctctatttcccgaacccaaacgcagctttggacgcgagattcctaatgggcgatcgatcgccccgagcgatcacccctcctcatggttttctttttttggcaccgcattattttcctattttagtaaatttatgcatttaaaatttgtacacctcaaatttacacatcaagtttagaaacccaaaatttataagttaaaagtttatatatcctattcaaatttgaatttgaattcaaatattttttatatatagtattttctatacatctaaagtttatacacctcaagtctatagacccaaagtttataagtcaaaagtttatatatccgattcaaatttatatattcgatttaaatttaaatttaaattcaaatatttttttatatatagtattttctatacatataaagtttatataccttaagtttatagaaccaaagtttataactcaaatgtttatatacccatttaaatttgaatttgaattaaaaaaaaaagtagaaacactggtcggggcggggggagctgggggaggagaccagcgagacgacgcgacgaggcacgtgaggtcgagtcgaccaggatcgtttgatccgatgtagataaatatagagcgttggatggatttgatgattgaagtattacgtaataacatgtaaaattgtgtgtgtgtgtttttgtagaactatgtaaaattgcgttggtgattcatttgtgtttagagagctctgctcaatactctgattcatgtgttttcttttacataattctcacaaattttacacagatctgttgattcatgcgtgtttttttttagaactatgtaaaattttgggcctatttggacggttacctaccaatttttttgtagtgccaaaatacaggcaagttttggcactaccaaatttttggtaaggtaatattgtttttgatcatatttggtttgctaccaacctagagccaaaatgtgaaaattatagtgaagaatattctagatgatgccaaatctagattaggtattaccaatgaatgtgcttcaattcaaatcaaacacatgtactattcaaattaccaaaatattggtagggcatgtttttggtagcaattcaaatagggcatttgtgtgtaagaactctgtagctcttcccctcccgtccacgccctccgagagaattttgcatatgtacctcagttaaaaaccggcttcgctacaatgccatcgtttaaatgggattcgctcaaacgccatcctcaagatgtgggtgttcgctacaatgccattttcaccattggttgcaattccaaaccattttctactaaaataattttttcgcggaccgttttgcccctagatctagttgaactgaaccacacataggggacgctaccactgctgcctagacgcgccgctctcctctcagcgcgacgacgcgacctcctctaccgccatccatgccgtagccttccccacctcgcaccgtcttccctcagctcgccgctgccttccctcacctcgtcgacgccttccccacctcgccgccgcccaaaccgtagggtgcaccgggcgcctcttccctgtggtagcagtcgccgccgcccaaacagagtatgtccattgagacactttgtgcaatgcatcgggggaggtggcgtgctagcaggatggagacggtgttgacgaggaccaggatgaagacgacgccgacgaggaccaggatggagacggcgtggttggggtagctgcgccgccgcgcagggaatcggctctaggaggagaagcagctcagctggggagagaggagctggcgccgcgacctagcttttggaggggtgagttgttccaggggcaaaacggtccgcgaaaatattattttggtggaaaatggtttggaattgtaacaaatggtgaaaatgacattatagcgaatgctcacatctcgaggataacgttgaagcgaattccatttaagtgacggtatcgtagcgtagccggttttttaaccgtggtacatgtgcaaatttcttgccctccgacgaccaaaccaaaagcccgcccatttcccgaacgccaaaccctcctcccgaatcctcatgaatccgcacactctagggtagtgtaggaggtgtagtagggtagtgtaggaggtgtagtggagtactagttgtagcccatggggatcacggaggagcagcgccgccgcatcgaggccaaccgcctcgccgccctcgagaggcgcaagcgcttcgcggaggccgccgccgccgatgcctcggtggggtggaggctcgccaagtgcccaagattcgctccgcctcctcctcagccgacgctgcctcctcctcctccgcggacattgcctcctcctcctcctccgccgccgccgcagccgccggtggggttcaaagtggtgctggaggtgtgcggccccgaggatttctcggtggcggtggggcccgccgagggcttcgcctaccccggcgaggccgagtgcctccgcgccgtccaagattgcatctcttcggtacggttcatccgttcttcatccctttcttgataatatatatgctgctcgacaaactcggtgctttcttggatacctcggagcgtttctttctcaagatttcgttaatttttccccgtgtttcttggcgacagcttagcaagtccgtggatatttgcaagcatttcttgaaatatcactccgagaattcgg

SEQ ID NO: 74332 - DNA, 44601 bp, Oryza sativa
  unsure (1)..(44601): unsure at all n locations
tgtcgactgcatggcatttattctgggggtgaaagcaaatcgatgcatgcatctgtatgtacatgcatgtgcaattcaaaaacctgcaggcgcaggataaattcaaatagaaaagaaaacgtcttctagtaccaaacatgaatccacaaacttccaaacacattaatcaattccaccaaattacagcttggatccatgaactttcaaatttgatcccgctatttccacctggcgtggccacagcagctggcagagacgtaatcagcctaattatgcttgccgttgacattcccaagcatagttggtatcttggttctctctttttcctcggttaaattaaaatataggttgcaaatgtgcgaaaagtctcaaacttttcctttctttaaactaacctttactctaggacgcccctgttttgcgagtggagtagaacacgtcgtcattgccaaatgacactctctcttggcctatcttttcttaaataagttggattaatgtgataacgataagaatgatagtgtttgagccgtcttttcatgaagagacgaaaaaaataatcaattaattaattaattagcattgaaatgaataagtagtactatgtatcattgtgttcttggattacttcataagacgctcgatcgtgaaaatagttttaataaaatttcaacaaaattatgttcgaaacaacaaatatttgtgatcggaagtacttgtatattcacctttagaaaatagaaatagatataccatgaactcattcatacaacagccggatagatatacatcactactcatctagaccgttccatggactacatacatacgtatggtatatctttgctatttatattctatatatatatccagcctatatatagaggaaagaattgaatgagatagatattggagatggcctacagctactacaaacggtagaaaatacatgaagatagaaacgggtgagcattgaagggagagggaaggaattataaatggcaggcaataaaggccttccaaataggctcccttcatccctctataaaagcaccccttccccttgcaacctttcacccatcaacagcaacaaacaatagttcttttctttctctctctccctttgtaggtgtagatgttgatttcatggctcttctgatcttcgtgttctagtctctcagtattatatgcatagttgaagttttttttggttaacatagtatttctgaagcctctgatgtttgcttttgctattgcaaatcttctagttttgtttatgctatatactatatgtttcagatctctcttggtttgtggttttgtttctttgttggttgtttcttgaatatgtggttgcgttttggttatgaagtggagctcctttcgttccaatgaaaggtttatctgaagggtgatacagctgcttgttcatggttcccactattctatctcataggaaaagagataggcttgtggtttgcatgaccaaggagccgaatcaactccttgctgaccactctttggattgaagggagctctgcatcttgatcccatatagtagtacatgtcactactgattgcatgtcttatatatttgccccctgttcatgttggatttgattttttcctggttccccatgtgtagatctaatgatttttgataatgcttgtacttcaaaccagtcatatatagcacctgcatattcgatggagagatgatctggttttgcaagcttcgttgttttggcgttacttcagccactgttgttatttttaattacatgtaaaggtttcttatgtttcaatctgaagtatgatctctttagctaatcaagagattcagatttatttattttttgggtatcattgcgttgaatggtgtactttgcatcgctttattcccttgttggtgagatgttatgtcactgttgaattattccatcactgtttgtctttgcaccagcgtgttgtccatctgttgtagggacaagcagatgttgttagatcttgctttgctctttggacagtttgatctatctctcctgaacactgcttgtgtccactctttttttcccttttgctacacctggttctgatagatttgcatcagatacccttatgcttggatctactagccgctcttagtattttcattgcttcgtacaccggtcatcacatgttcgtctgtttatgtgtactgtactactcactgacagtgtgcagctgtggttatttggcctcactggcaaccgtgcatcatgctatgcatgttctctttctttggcccaacatatgctcttctttgttaattgctcttttttttgtagcattaacacgtcgagattgattctgatgcaaacatattaggtgtagatccgtcctggagaatggagattatatgatgtctattgtttggaagaagagaaatatggaagactgatgcaaacctttgccggcatggagtggagaacgttgatcaaagaaagttttctttagttgatgattgggttaaatcccaagtgtaaccataaaacaattcctgcttgctagtcctgtcattctgtatatctgaatgatgtttcacaatactcaaatgccaagttttaagatatttttttgtacttgtggattgtacttataaatcaatggataattaatcatttctaccgagaagggtgctctttttccttctatatggttaattccgaagtgtaacacaaaccattcctgcttgttatttagtccggcaatctgtaacactgaaatttctacacatagtcccctttttgctcttcacccagattgtttatttgaaaaatttagacagcaactggcggttcgtaccctatatcagtccattcaatgttatatatcttgcagattaccctaaaccgccgaattaaaagtagcaaacaatgatacttcccgacatctaccaaaaattatctaggtttttcgagttacagatcgatatgagtgtcagataagatcaaatccatttaatttactagtaccttgcatttgctgcgccgccgagcttgctatcttcgtggccggccggcggcgtggtcgacggcgatcgacgaggaagacgaacccatggccaactcatgtgtgatgatccgattcgtttgtgggtcgtctggttcgttcatctttgtttttatgggcctccatttgctagccggcccaaacagcgatactctccggttttcagctgctttttcacattttttttagcacactgtatcttcattgtagagactttatttctgattgatctcatgcccaacaagagccaaaacatgcgtgaccactaggtccatttgctagctcgctttttttttaataatagaaatggtttacatctctgattttcgctgaaggcgtacaggacaagttctcaacttctctcagaattataagttttttttgcgaggaccagaattataagttaagattacgctatcaaaagaattgctagctattgtgcttgaacaatattaactttgtcgcccaaaaaataattatacctatacacctggacaaatagtacttgtcaaaatgcattgtcagaatcacatttttgtatggagataacaattggtaggagtaattcataattgctcatatacaaaggaatattcatgtagacgaaatgttaatttgacaatctatatttcttttcctgtaattgaaacgataatcaaatcaaacattacatatactagtttttttagataaaattaaattagtataaactagaaagaacacaagtgtgatcatccatggttagcttggaagctaagcttctagtgttggaggttggagaggagagactgggaggcatggaggaggccggagacgaggacgaaggcggtggtcggaacgctcaccgccaccgctgccacgatcccgacgccgacgccggggcgggagctcatgaggaaggcctgcacggcgcccaccagcgcgcacacgtcggcgtcgtagctcccgtaccactccttctcccacgccgcccactccgccggcggctcccacccgctctccgccgccctcatctcgtggatcctccgccgcagctcgatcatcccctcgtccaccaccccgccgccgccgccgcccgagaagaactgatccgcgtcgtcgcgccgccgcgacctcaccgccgccggcttcctcaatgtcactgacgtcgtcgtcttctgtggtggtcgccggtatgggagcgccggtccagccaggcgaacggcggcggcggggaattgggagatcgccggttgcatttttggattccgataagaagaattgtgcagctagcgaatgctgtgatttgattcagctaacgaaattcgcgattcgattaaggagagaatcagaatcgcgaatttgaaatggattttagaggaggatggagagtggagaattggtggaatgcgatttgattgatttggagcttgggctggttgcttgggtttatatatatagtgcgtcgttgttggcaaaaaaaatttaaaaaaaataaaaaaacgcgtggcaagaacgttccaatggctgattccgtgtgattacctatcattttttttctgcaaaagttcagacattgtggcatccaggatagttttggtcaagataacattagttgtcttaacagaaaggagagctgttctagaaatgagttaaatttaactacaagctccatcatatcatgtcctaaaaattattataattcttctgttcttaattgtttcctccctcgacccctttctttcggcctattcaacatttagaatgtcgacatggactcttagagacattaggctgtgttagctggaatgggttgggaacactaattaaaacttaaatctcctgcatacgaaaaatggagtggtccattagcacataactaattaggtattagctatttttttttaaaaatagatcaatatgattttttaagcaacttccatatataattgtttttaagaaaacacactgttcagcagtttgggaagcgtgcgcatgaaaaacgaggcggaaggagttgggaattacgaacagagcctaaatgtgtgttcttttatccctttttataacttgtacctcttatttttcgcgcgtacgcttttcaaatttctaaacaacgtattttttattaaaaaaaaggttttacaggaaagtgctttcaagcataggaatttgaaacacgtcgacgtggctatgttcgtttcaagctgttaaatgatattccctctgggctgataatacttatcgttttagataagagtgaagtcaaactttagaatatttgattataaattatttttaaaatatttgtctttcaatatggttactatatgtatagattagtcttaaaaggtactttaataaaatcatatatttattaacacttttgtacatattataataaaaaataatggttaaagtagttttttttggaaaccgtgcccttatcgaaacgacaagtattatcaacccggaggaagtacgcttttggtaaaaataatctctaaaaaagttgctgtaaacaattcatttcccctcgtctcaaacgcacccaagagactaagagtcctttgaaacacacgaatttgaaagcacaaaaatataaagaacacgggtcacatgccttataaattcctacataaattagaagcacaactgcacaagagtatttcaaaacagtcgtttggattacacacgcaaaaaaaaaaagaaattgtagacatgtacaggaagagaaaaccatgagttggactttctcatgtttgttttagtctaaaattgtaatggaatgctttattccttaggatgttcatagaaaacttttaaggacatgctctttattccagataacttcatatgaattttatttccaggattcaaatgcttcaggaaaaactaaacagttcttttcttccaaatgagcctaaaacatgtttaatcattattttatattgcggattaacgtaggcggatataggaaattaagtgcgacacggttggatttggacgatagatcgatgtgacgccggtcggccgatatatatacgcgttgagagatcgagtggatcgaaattcgttggaaattgctgtaccatatcatgctgttgcttgcttgtactgatcctatcatgcatcattgtgtgaatatcctagccagtgctgttcatcaatagtgggtcaagttgtaattaagcaagcggccggcgattggctccacacgaaacgcgtttccttaactccctggtcttctgctccctgcagcatgcagctagctatcttcgctttgcttgcactacttttcttccagcatatatgcacaaattatagattatactccctccgtacttaaatgtttgacactattgacttttttaaatatatttgatcattcgtcttattcaaaaacttttgcgaaatatgtaaaactatatgtatacataaaagtatattcaacaataaatcaaatgataggaaaagaattaataattacttaaattttttaaataagacgaacgatcaaacatgtttaaaaaagtcaatggcgtcaaacatttagagacggagggagtactagcataagcaagaagcagcctagcataactgcattatgaccatttattttgtgctggaaggactgaataactaaatgatttatggtattttcttcgtcttataataaatttatttttgcttctcctatttatcttaaaataagtttatttttagtaatcattgtattagggtttatgaaaatatgaaataattacatcaaaaataggtaagtgaggaataattgtactcggatttgataaagtaagggtattctagtccttttaattttatatcggtatgtgtgggatgagtaaaaaaataaacttattttttggaaagagaaagtacttcataatattttagctactccttttgtacatccacccaaaatcctttatattatgggaccgatagagtactaatgaataaattaacttattataaagttaaaaaatatacatatttaaaacaaaattttaaagaagtttatatgtggaaagtttagtttaaaaaaattcccaccatttagaaattctgaaaatgtgcacatttatatatatatttgtccatgaagcagaaaagagcagcagagtatgtgacgaccagatcatcaagctaacccatgcgcacttgctactccctccgtttcacgatgtaagtcattctagcatttctcacattaatattgatgttaatgaatcttaatgttaatgtaggaaatgctaaaatgacttacgttgtgaaacgggggaagtatatagctaatcagccggtgtcgccgttcgtcggagctgagttacctattcataataagaatttttgcttgctcataattaaacgacggtgatcgtttactacgtacgtaaatgtcgttcgcacgcatgtgcaagacgcgtaaaagcgtatgcaacgcgcatttcgtcaattaattaattcttgtatgcacttaatttctcaccaaatgttagtactggcttagtcgtagtgtatcatgtaagtagcagggaaacgggggaacagcaaattaattaattggttggacgacagcttaatccctcgtctgaaacaaaacaaattaagcgaaagaaaacgaaagcttctcatcatttcgtgattgattgatcgaaaatcgttgtaaaaatgatctttttccaaaaaaagaaagttgtaaaattcttctagctaagaggaattttctttttgcaaggagataaaaggattttggaagatatatttcttctggcacaatatataataataataataatattggcattagctagctctgtcatcttttcattctttttactggagttgtggatgtcgccgtcatcgatccaagatgcattgaacgaaacgttgctccagtcctcaacacagcaagatatctcttcaatgttggcagctagccaatgtcgttttttcaagggctttaattttctcctggatataattgattagatcgatcggctagctaggctagctagctaattaatatgcaggtggatcctactatttgtgttttgtttgtttaattaatcatacaacaagatatgtttcatgtgacatactgcctgacgcacaaatggttgtataatttccatgccggtttattagttttagctttgaccatactgcgttatataaatataatcctagtatttgttgggcaaggtccattgaaattaatcagcagcaaggtcatctctgaagatcaagctcctgattatttgctggttccttcagagacgaatatatatacgtattataattccatatcgattattggatataatttcctgaagattcctttgagtgaggtcaaattgcacattttatttagcacatttgtttgactttctacattattttttctgacaccatctctccttccataatcaattatcaatattattgtacattttcccacatagtgagtgtctgatctacttcatgcgttggcacttgtgatatttgaatagtacttcatataggaggacatttccctctcatggctcttgtattacaaatctcctttgtttactgaaggccgcgttcttcaatggcttaaatagaggaaaactttttcgtttttcgtacgcacttttttggaactactaaaaacatgtttttaaaaaatacttccttcacaatgtaagtcattctagaatttcccacattcatattgatattaatggatctaggtagatatatatttctagattcattaacatcaatatgaatgtgggaaatactagaatgacttatattgtgaaatggagggagtatatatattaaaaagttgctttaagaaatcatataattcgtcatttggaatatatttatctccacttatgttttatcagtgttcaagctagattctgggcctgtttggcacagctccagctccaactccacctctcctggagctggagcctagccaaacaattaatttcagttccactggaaatgggagcggagttgggtggagcactctcacagaatgaactagagaggtggagctgggtttagaatgcttcacaactccactctagacccaactcctggagcataatttaggagttggagctctaccaagcagactctccatctcggacaactgtatccactggacgcatcggatatagacatattttgatatttaactttaatcgaaaccgtcatttagtgtacaaagaaagtaataagaacaaacacccttgaagataaatcaccgacaaaatcaggattgatggtaccttaatatttcctgtaatttttttcaccttggtttgtgagtgtatgtatttagccgtgtatattttagttatatagaggctgagattgttctatagacatatatatcatcccgatataattgattgagtttaataaaactttcattatcttataaaatcaccaacaaattaaatttaagatcaactacacaagatcagctgtgtatagcatatcattctatctacatttaacactgcgataataatgcagggttaattcctttctaacacactcttgtttacaagttggaaatcagtttcaggcaacattttagctgcaaggtagagatgatgatccggtcaaggaacgacgtggtgctgcaggagcacggcggactccgccgccagctgcgccaggtggtgcacggcggcgacggcggagaccggcacgccggcgaacagcagcgcggcggcggcgatggcgacgctggggcgggtgcccatgagcagcagctgcagcgcgccgacggcggcggacacgtcggagacgtacgccgggtagtaccgcttctcccacgccgaccaccccgccggcgcctcgtagttgttctccgccatcctcgcctccctcatcctccgccggagcaccgccatgctcgagtccaccagcgccccgccgctgtactggtctcgccggaaggcgcagcacgccgccggcgacgacctcctcgccttcaacgccggcccgcgccggccgagctcggccggcgacgtaagcaatgacatcgacgacgacatggccatccaaaaaccaaaaaaattgttggcaaatcgcagtagtgaggtagcaagtgatcaagagaagaagcaatggaacaaatgaacaatctctgagctgatgagaaatctagttcaaatgggtacatatatatataggagtaagcaaacgcgtgaagattaaaactgatttagtcatcgtctggaccaaccacgtggagacacgtgtgcccaaccaggaagtactagtccacatggcacattttggccggtgatttattcagggaaggaatcatggaacaataaatagtttagaagtaatcacatcgaatgcagcgactcgtcgcttccaaccaacaccggccatctcccattattgagttgaatactattactacgagtacttgcttgacaaaaaagaaaagaggaaattaatcattcagttgagttgatgtactgcttcaaagtgatgggcttgggcggctaattgttttattgccgcatgatttagtgatcctctcattctcatgccgagatgctgtgaagaaggtgcagcttctctctgataagaaaaaaaaaaagaaaacagttagcaattggcaaagaggagaaattatagtactatcatactattggctaagttgtttatcacatagcctgaatgctagtgcagatccctagctgccatcagttggcacatggtcaaggagatattagtatatggcatcatcagcaaagctactcaaatgggctcaagggttcaagacttgaagcaattgcagaattgagtgcctagaggtcacaagaaacacaagatgcatggatcttgaagtttacaacatgggtcatgattcctgatttatgctactgtcaactaaactacttcccaaacaccatatctgtagcaattagatcttataaaggcttcagagttctcggcttctagcaatgttaatctaagtgggtacaacaacttgatgacaatgcatttctgggcaactaaaaacgatgtgcttgataacaagacagtcattctgggaatggggataagtcttctatagatgcaagactatagaatgaaggaatgcttgctacccccaaaattatttaggccataatttcccattcagatgctacaaaaagaatattaactacaaaaagggccatacaactaatgctcaatatgatacaacagttacgttttctaattgcagtacatcctgacaaaaaatatttcaggagattaggaccattgtgtgaaacgtggttaatgctaatgtctcttttacctttgctggcaaaatgttgctggcagcacttcatttcacttccttaacttgctgcttattttgatcttcctcagatggtggtagaagctgctgatactttggcctgtttttcttcagaagaaggtaggttaaccagtaccagaacatcagaattctaccctgtgccacaagcgtgtctgcaatgcggattcctcctaatgaaaacctctccagggcctgccatagaagtaatgtgtcaaaagcagatcacttcccctccatagaagaaagatatgccaaaggttcacctttttacccaggccccagttacaattcaaggaaaattttcaattcagatttttaattgaatgtgatgataacacatgaatagtgtctgggccaattttctgtttgagtgcattatcattcaaacattaacttaggtcgagcaatatctcactggcacttaaccaagtgtgtgtctgcatttttgtaacagtaaaaatgtaaaactgccttttgcaggtccacatgaacaaccgtacctgttcaccagtttgaatgtcataggaatgctgttgctcaaattgcaaacctttgaactcattaatgcaaagcccttggaaggccctgaaatcaatggcaaacaaagttgaaatatagggtcattaactatcccacggtcccacctagcttaggagccaaaatatgatataaggaagagggttaccatctaattagggatacttttgggatccagcgaaaaatgacgggggtattatcagggttaacatagtatcctccaaatacaatgaaaactgtcataagggatggtccaagggccatggcggcttctgttgtaggagccatagctccaacagtaaggcccatggctgatgcagcaaatgattcaacagtcacgatgccacagaacttggcaaatctgaaagtgtagcatggaatgttgtttgatggagcataaacaaaatagtatcgaactatcgatattctactatttctgcgtggcatgtaataaagtgcctcagattcatttctaaattagagggaggataatacttacctagaaaatgtaggatgaagtttagacattggataaagaatggatccaaatatcaatgggaatgcagccccaataggaatttcagccaacaacttagaagaaaggtatggtcctagtgcataggaacctttggcccgttctctgtcaactatagcccgctctttcgggaaaactcctactgtctttgtcagtgcagccattgctgtgtttatagcagttaccttaactcataaattgaaaaagggacagatcaaaatcagaaaaatgctcagacacaatgaaaaagcttgtaccaaagtcaatattaggaagagaatgaatgtaagtccaaaatctgaagcatgtgcaacctagcaaattcaactcaacgagtcataaaaaatccaacatattctacctgaagaagtcccatcctgtcttgtatggaagtctgagttttccccattcgccagaacacagatccaaatatgattgctgaagcaacggacattcttgctctcactttgtttgttggtccatcacggaaagcctaaaacacagaaggtcctattccaatatcagacacaacagcgtggcagtaaatctttagctaaaccccatctaagcaactgcgctcagattattaatgggtacccaggcaaactataaaaggcttgaacattagtcagataacctcaaccacaatccaaatccttatagttccattagcaaagtgtttcctttttgtttacaatcaaccacaatccaaatcctcatagttccattagcaaagtgtttcttttttgtttacaagtatgtttcatgggcagttgcgtattacacctttttgaggcacagatttggcaaaaactaaatcatggatccaaactcaaatatagtaacatgttcgatctaaacctcctaaattcattacattatgtatatagtttactcaggctaaaagaatatgtaagaaaaacgatttttttgaaaggaagcctcacgagtatctgataacttccacagcaaataataaataaacatatcaacttgatttaaagaagcagcgggaagcagattaaaagaggaagctgcaactgagaattaaatgaattttaataaaacctgcatccatgctctcttaaacagcaaacggaattgtctccaccacccacgtctatgcttggtggtggacttctgaataagtttgggagaaaattcagagccttctggatttgtcagcgaactgttgctttcagtaattgcaactttattagaaaattcttcaatgaggttttcaatccttttccgtgatgactgcacactttcagcagaactataatcaacagaaatgagatcagccaagaactcagcagggttcacatgatctggacaatgatacctgaaaaatatgaagtaatcaaactcaagttattgataagcaataatagcaggcagaaaaacaagcagcatagcatattgacagtatacatagaatatagaaaccaacacatctgataatagataaaagaacttataaaagcaagataatctccattatggtgtgaacaagtacacaagccagaatctgcatgcctaattaaaattctgagtaaaattctagcataccgtacactggaattttggatagtgccactaacaaggacaaatatgaccactatcatgttatgcaccaaggtagtagagtattacagtctaaataaaatcagtacaatgcacacatcgaaaacaacaggaaatgccaagtaaaggaaaaggtgagcgaataccaaccccaatgatgcaaagtacaataacggttcctcttttgctggccccatgtatataacttctccctctgacagtagtacaatatcatcaaatttgccataaactgaacctcttggctgatgtatagaacatatcaccgtgtgtccatcttctgcaagctgtctaagagtttccatgaccttctctgcctggaacgcatcaagacctaaaaggatggcacatatgtgaacaaagtttatgcaatctcacttatgttttgcacttttgtcacatcaaaggaccaatgaatgcgctatctctaatcatggaagctcaacacttcagataaagtaaatgtgcaacactttgtccagaagggatgtagcttgtatatcatatcaagaatatattttgtttgcagcattcaatgacaaatctaataaggcaagtcccaataccatggtgcttgattaaagatgccaccaagattatgatatgtcatgtgttaaccattagagtagcagtcttagtacaagaaacatgcatcatcttaaagcaattcttgtggcatgagaaaaatgtggtgtatctattgaagccattttaatgcaactatcgcagtattggcaatctattttcacttgaatccggcatggctacaaattttctttttctttgcccttaggggctgtatttttctcctgctatatttaatgaaaaagcacattctcgtgctggttccaataaaaaaaagaagcatggcacaaatttacaaagaaacagtagatttgaagaagtgatcagaacatttgcttgcaactagtcatgtatttcctaacgaaaacattaagaggagatgagaatgcttattcaaccaaggaagggttaaataaacactacagtcaggtaaaagtaccagtagttggttcgtctgcaaagatgatagaagggctagcaatcagttcacacgcaagggagagacgcttcttttcacccccacttattccacgtacttttgcatcacccacaattgagtcagcacagttaacctacaaccagttataataaaaagaaataaatacctggtgatacaaaataaaaagggaaatacttgaacagacagcgatagatattatgtaggttctgcccatcaattgaaaaacttagcatacttgtcatctatctgagcaccaaaataacaatgcttttcatgtgtaatttgacagattttctccaccagtgctagaaactacaagttcgtatccaacatttgatgtagtgcactaaaaccaattggttcaatttcttcgaacattttaaccatcatggataactttttctttagaaagcagaccatataccatcatggataacttaccagcccaagacgaaacaaaaggtcattaacatagctttccttcctctcaggagtcaacgtgcggcgaagctgaagttcagcagcaagcgagagcgtttcacgaacagtaagctgtgagaagaaaaggtcctcttgcctcacgtaagcaatcctacacaaggaaaagcaatgagtatagctcttctctgtaaacctgactaaaaaattgtgaaagccaactgaagaagcatagcttaagcttacttatagccaccttctgagataggtcggccattgatgtacagaaacccagaaaggtgcaaagaaggtgatgctgtgagctgaccagcaagcacattnnnnnnnnnnnnnnnnnnnnnnnnnnnnnnnnnnnnnnnnnnaagcagcctccccgatttcgcctccccagacgcatttgacagcaaaaacctcgcctggcatgcagcacgttataaccattacaacaatcacccagagacgcgcagaagcaagaaattccgattattgatggcactcaatgtacaattctacatacagaatacacagcttcggtgtgttcatctactgattgaagctgcagagtgcagacggtgaaagtgtgaaacaaatttcgcaaattacttgttcgacgcaaattaatatacaattctacatacagactgcagaatgccacgcaattacttagcccgttagccaacagcggaagtgcgaaacaaatttcagcaacctgttcatctaaaatgtgatgagtcagtgccacatcgacaggtagggcccagtgtcagtctctcagacagcacgcggctctcctggctaatcctaagcagatgattttttttttctttccgtgcgcgcagcgccgccgaccaatgcgactcctccggcgagagggaacggaatggatgattcgaggcagagcgactcaccacgtcgccgcgcttgttcttgagggcgcaggtgatgcgggcccaccttatcgtcaccggaggcacgccgcctccttccccgccggcctccgggtcggcgtcggagtcctcgtcgtcggccggagggaggagcgccgggcccgggccggcgacggcgcggacgaacagcgccgcggcgagcgcggccaggagctggcccagacccctgacctccatctcgcgcgcgcgcgggggacgagcggagagaggcctgacgactgttctagaagcttctggaaggttcacgtcgcgtgcgacgaggagtgaagaggaggaagacgaggggggggggggggtttagcgtggagttcgtgtggtggtggttgctttgtttgttgcgcgaccgatgcgaatgggccttgggccttcttcgtcatgggccttttgcgtagtaggctgatgggcccacctgtaagtaacacccaattgtgctgggccttctgttgcagtgggctatagcctacaggcccatggctacaccttttacgtaccttactccgcagaggcgcggagtattagctgagggcttatttgtaaataataatagtaataatcacccaaaacaaatcttggagcggattggaactgcaaatttggtccatttttttcctccaattcaaaaactccgtcacgaattcataaatgctgacggaatcttgatgtagctgcactcatgctgaacgtatgtgtaaactgacgacaagtgagtgcacgcagcaattgatgccgtacgcacatcacatgtgcatctcagcagactcagcatctgtctcaaggaaaactagctgaactaacaaactgaagactcaagctgcaacagcatatgcagctagttacttacttggatggctggatttattactgatttacatcgctgaaaattcattctggccgatccaattttgaccttttcatgaatggagtgtattatcttggtcccaaaatactctctctgttcttttacagtatatgacgaccaatgtcatatattaaaggatggagatagtataacaacttttgctatatagcaaaaaaaaaaagagttgtattttttgaacggttagtaaaaaattaaaatgctactagctgcacagaaaactccaaactgtttgctacagcgaggttaaaaacgactctcaagtgagaatcagccaggttgtgccacctgacatccaactcaggagcttcagagatgctgctgatttcagatacacatctgctgaaaatgagagtgacccgtgactagtgcctaaactcaaagtgctactgtagtacagacagctcacggctgttagcaatcttcccatttttggatcgtccgagttattagcagaattgattgcaattcttataacgtgatttaaggagaggaccgacgagatttctgacattttggctttcagacagtggaagcttaattgcagttcgtcctggtcttcttggctggagtaactactatacttcagcttggtagtggtaagctagcttcagtaacaatttgtttgggtgatcaaatttgtttactccaagttggttaattagggaccagggagggtgaccaccatggagatcaaattgagatactacaagtaaacaatacccatcgagaccatgatagataggctttccaaacttcctagccagccaagcataatctgaactttttagtatctgtggaggcagagccaatctgtgggtgccacgtcacttttcacacagaggcagtacaaagtactacaaagcagagctggtagattgtagtacgtggtagatacttacttactcctaagtcacgaaatagtttaacttaatcaacaagagaaaacgactaatgagaagtaaagtccggatttcgtcctttatcttgaaaaaaacgaaaactaatgacagcgagcgaaatcgcctttctcctcaccaagctgaccactctctggaagcatcagcgccactgccaggtgggacccacgacgacaccctgccacgtgagcaagggccccatgcgaggcaagcgccgttggccccgtccgacaacgcaccttccgcccccgttactctgagccgagggacccacacgtcgactcaccccataccccgtacacccagccagaaagagcccactgaccggtgggccaggaggagagtgtgccccacatgtcagtgatggtagaacagaagggtctaggcgggcgcggggtacgacgtgttccgggtgtagaaagcgacagcgcccctcacaacgctcgcctccctcctcctccgtctcctcctttcatctcttcttctgtgtgtgcgtgtctgcgaagcgtgagagagaaacgtacgcgacgcgacgagctcctactccgatctccccgatgcgatctcgccaaaccctaatcccacccaccaccgcgccggagtcctagcgccgcccgcagccgccgccgccgtccggatgctgcggccgtgacctcctcctcctccgcctctgacatcccagccatgggagccgccgacaagtggctcctcccgctcgtgtcggtctccttcgtctcgctgctgctcttcctctccgcgctctcgggcttctccgcctcctcctcgctcttcgcgcgcctcccgccgccctcctacgtccgccgcggggcagccgcgccgccgtccttcgcgtacgtgctgtcgggggggagaggggaggggaggaagctgctgcggctgctgctcgcggtctaccatcccaggaaccgctacctgctccacctctcggccgatgcgcccgagtccgagcgcgtcgagctggccgccgccgtgtcgcgcgccgcgcccgccgtgcgcgccttcgggaatgtcgatgtcgttggccgccccaccgctggcacaccgatgggatcctcgggactcgcggctacgctccgcgccgcggccgcgctgctgcgcctggattccgagtgggactggttcgtcacgctcaacgccgccgactacccccttgtcacccaggacggtaaggttcacaattcgtgcctccgattagcatgatttgcttcggaacatgctggtttctgcacggccttgcccggatctagtactaatcccacgcttttacttttggtcgttacagctaccccagaattgcatttcgatcggaagcttttcttttctctgaatttgggatcaatgatgtcatcgatgaaaattagcaataggagcatctttgctagtttagtactataggagttgctggagctaggaaaaaataattgttttcctttacacaatatatgaggtgaacttggcttaagtggtagttaatgtttctcgtcacattgtacacttatatgcataataatataccttgaaaggaccaatgcactaggaagcagcttggtggtgctgctaggtttggacaatttggaagaacctctttgtttggagtacttcttttggacacttgtaccaaaagctgtcctaggtggaaatctaataccacaatactcaattggcatgttttcagtttctaggtgtcatctaactcaaccactcaatgacttattattttctcttttcatagtgaagttcctcaactcaatcatgacacatgaaccatggccattactgtcagtcttgagctatgcgactctatctgtgattgtttgtgatactcatatgaccgctcatttttgtcttgattgttttttctgacacaactcattacaacctggcatattgataaaccaggaccaaattactgatagaaagttggggaattgttttatgttatggaaattgcacagcattcatgcgatcatcttacatctgaataaccactatctgtataccaagatcttaatttttaagtcctcacttttataccattaagattagacaaagttggtttcggcattctgttttattttattgtgtggcttgttacaaacaactgaatgaatgggcgctacaagagagtgagaaggtggggaagggatagatcaattggaagttaacattatgtatcactgtgagaatgcactgtagtcttgtgtaggtttatcttgaatataccatttgaggctctgatactgttatctttgcatccttgctgtctcatctatttttcagttgcttcgcatatgcaaataattaccatgatacagggtgcatgcattgcagtctagttggtgtaaagtacacaagtcagtgggagtgtagaaaccttatctttcttctttgtttccaaagtcatcctcccttgatttcccctcctcaaattgtcaaatgtattaatctgcattgcacgtaggagccacacggtgttattgtcctctagcaatattatatacctgttcttagattgtgcaatgtaatgtggtcatgggcatattcttaaatttactttattcagaggctttatggtgtcctccttttaaacaattccggtactaatgatcacatgttaatacattagttttgagaacacacaaataccatgcacatttttgcatataaagaagaaaatgaagtttgatgcaacacggtgacagatgactgcacagcacattactattgttgtacctctagtgtgtgaaacaaaggcatgttccaacttagaaacagaaaagagtgacagtgaaaaccacagttacaccacttacattctcagtgctatcagaaccaactgcgcagcagctgatgcctgcgtacaccaaggagtccctcttgctgaatccctttcatctcttccttcatcaatctctgcttatcattgaaaaagcttgggattttctttcttcctttcttggctgcaagcaaaccaatgtaattaaccctttactgaactcggaattcctctatgggaagacaggcacattacagtgccatgttctcgtagtatagttaatagtataatacatatatttacccattcctagatctgaccacttactacgaatatctcgtatttttccttactaagtggagtatgtctaaactactagttccatatcgcaatatgtagtccccagatcttgtgctgcctgtcatttttttatctccttgagaaaacctactttgttgattttttttttaagaaaatcagttacgttctcgacttggcttgaaccgcttctatatattgtcaacctatcagttgtttagtttcgcatgtgatatttacattctagttgatgtttgctgcatgtacatatttattttcctgactgatatttcatgtttatggtgattgatacagcctgaaatccttgcttttcagatatttatgtttttttatgttgtcccttgctacagacttgattcatgtcttctcctcagtgccaaggcatctcaacttcatcgatcacactagtgatattggatggaaagagtatgttatatctgaacttataaataatttatctgcgcaagtattagtttcaccaacatgctgtgggtaatactgttacaggactcagagagtgcaaccaatcatagtagatgctggaatatacttggcaggaagaaatcagttcttccaagccacagagaaacgtgatactcctgatggtttcaaattcttcacaggcattttctgactcctttcacttcattttccttcgtttgatcaactagttctgtgattcatgggtttcctcacatacaggttctccgtgggtcattctaaatcgacggtttatagagtattgcatatttggttgggagaatctccctcgaactcttctcatgtacttcacaaacgtaatgctacctcaggaagggtatttccactcagttgtatgcaactcagacttccgtaactccacagttaacagcgacatgcggtatatggaatgggatgatccaccccagatggaaccccattttctgaacacgacacattatgatgagatagtggagagcggagtgccttttgctagaaagtttcgggagaatgaaccgctgctggacaagattgatgaaagagtactccaccgttggcgtcacagacctgttcctggtgcctggtgcacaggcagaaaaaggtggttcaatgatccatgctcccaatggagcaatgtcaacattgtaagacctggtccccaggctgagaagttccgcaaacatatgaatcagatcatagaggaatctgcatcaggcaacaactcatgcaagcaatagcagcaatgaagcgcgagatttcacttcccatgtttgaagcgatgagcttttctcattttgcatagaggggctcttcacgaacttcagcagttaacgcttccagagcgaacatttttgcacctgggttacaagcacacgtccaaaggtgagatgggtttattctttccagattttttggtaactgtcatggcttcaagggcctcactgcatagcgcatactagcttagttggaagtcagagtgctgatggtcggagcaccaaagctaataggcagtgtaattattagtgatcagttgaatgacttgtgcgactgtttatagaactgatggaattctgggtgctcccatacaggattgagaaaaatgaagagtgggtgatggtggttggattcttactgttgtggttaatacaatgctctttgcgcccatggcacctcactaactatttaatatcatgcattgccaggatttgagtagtactgtggtgggctaatcatctggtatggtatgttattaagagttctatacacacttttttttttgcggggaagagttctatacactctttaggaccttttggcatggttttgaattatgaagtgagccatgtttcactagaaaatctaaggcagtaaatgaatacgaagtgatttaacagactattacagtaaatgaaaatctaaggcagtaaatgaatatgaatatgaatattaagtgtcagagctgtaaccacagagacagctcagagtttaacagactatttcaggccagcaattgtggatgctatgttcttccatcttctgtttgtactcaactcaaaagcatgcttcacaatcagattcagataagtcagggatccagacgtacgcccggctccgagtgttacgaactccgaacaaattcaatcctgttacaccggttcctcgcgtcggcacgtgggtgcgaatggcgattttttttttacctatttagggcctactgagattagtgccattttcaatcatactattttttagcttagttgctaaaaatgtgtctacgcttagtttgttgccaaactttggtaaatacataagaaatcttgccaaaattttgacaatattgctaacttgccaaaattttggcatgtttattttggctacaactgaatatgcctttaattttttttagtaaattctacaaattatatgcactttggtcactacataaaaaaatacagaattaagaatatatttttcataaaagtacagatttaacataaagaaaaatcactctcgcccttcgcgctgacctcctcacagctgctctcgcaccaacctccatactcgctgcgtctggtgagatgagaggagaggacaggatggattggtggggaggtggataagtggtggagagagatgtgaaagaaagaagaggggagtaacgaggaagaagatgaatctgatgtgtgaaacccacgtgcagatgaggagatggatggaaaatgtgacggcagtggcacggttctaattttgtaaatttcaatgtcaaggttacaaataaacgaattgtaatggcatttatatggaatggcatatttgcactggcatggatcaaattaaccctaaataaacctaaaaattaattttagttggtcgcatgcaacacattttcttgtaaaatgatgattattttgaaaagaccttaagaaccttaggtgttgatcaaaatgggatgtgagtaggaattccatgtgagtagagtctgccaactcttatgggctgaaagatgtgacgcggcctaaaagaggccacagccttgaacgaacgggccgggccagactgggctgtaagatttgaggaaatcgcgtaggataatattagggcttgtcaagagaatttttcgataaccgctaatccccaactccaaggtagccgacacaaaaagaattaaaattatccactaaagaaggcgatacatcatccaccaaggtgagcaactttcttctttcaacgattgtttgttctcttggaccaaaatcgatctgcttcttctgttcttcagtcatgagtttcttgcgaggaaaacacgggctgtatgattagatgaagatgatgatgatcttaggatttagattaactgctattgaagtgattattgcgagtatagtccttaagatatgtgatcaatttgttctcatattggtgcttagcatcctaattccgattgggattaatttcgacagccctgaaatctctgaaacattctgaattctgatacgcttccaacatggcggttttacagatggctcgtgagaagaggtcgtgtccgagagcttcagagacgcagcagaacaattcagaaaagaagggaaaggtggatggtgagagtgcagctcgagacaagagggctatcactgtcactgtagatcctgaggttctggaatgtgatgtctgtttcggccctctcactcccccactttatcaggtaaataagcatatattgatccttcttcttgctgatcatgattccatttacaagtttgtttattagtatttactttgctcttcgtgttataagtttttcagtgtttcagaaaagaaactttaatcatgttcaggtcatatctgcattatctgcaaatgtctcaattcttaactctttgtagtagaacgtccagtgattactcattcagtttcaagtttcaacaaactgacacgaatatgtgctgaataatcatcgaactttgatcatactacaatattatttcagatttataggactgtctgaacattctgaaccagcattccatgcctgaacactttctacttctatttcgatactctccttacgacatcctgaattcttgagaatctgcgtgctataatattgatcacattgttcatgtcgttgtttgccatgagacgcgaaagcttaggaagacaattaagcttatagttgttgttaataatcatgcagtgcatgaggagagggcacatcacctgctcgacgtgcgtcgcggagatggggcaggagtgccagtggtgccgcgcgccggaggccaccaccacgcgctgccgcgccatggagcacttcctcgccgccctcgccgtgccgtgctccttcaaccacaagggctgcgccgccatggtgccctacggcgagcgggaggcgcacgaggcggcgtgcgcccactcgccgtgctactgcccgatccgcggctgctcctcctccccttactccggcgtgtccctggtcgaacacctcgagcgcaagcacccggagatcggccgcacccgcgtcgaccgcaccaccctctccccgctcagaatgtgccacggcgagccggcccggctggtgtacctcgccggcgacgacagggacagggcggtgttcctcctcgccgtcgaccggagcgaggcgccgcgaggctggtcgctgtggatggtcaggctcaaggcagaagaagaagaagaagaagacaagggggagctgaggtacaagatcatggtggccgccaatggcggcgtgctgtcgctggtcggcgagacggagagcgtggggcggctgacggcgccgtacagggcgagctccttcctgttcgtcccgggcgccatgctggatgctccccctgaggctgagggcctcctcgtcttcgtcgagctcaagtgagctcaattagcgctgttgcaatacgtattacaagttcattagagtctactgatagtgatatctccattgatgggatcatgcaagtgtgcaaatagatatacaattgttctgaatcgattatttgaaaaaaaaaaaaagaacaagctcaacagaggctataatggatgccttgtggatattggccaacagggacaagtccatcatataggttcagacttcagacctcttctcctgataggagtttcagatgctgtgctgcatgcaacaaaagttagcagcaattttttctgtattcgtatacatgaatctagaagccgacacgtggatgcgaaggttgtgccaaagaaaatactgtgacaagttgtgtgcattatacgatcctaactactgtatcatggctatatttataggtgcttgcgatcgaataacttgctttgaaagcatgcaagaacccaactatacatctttaggcgcaaaattcccatctttatggtgcttggtgccatgaactgaccttagtggcaatgaatgattattactgatctgagaaagcctacgatatcttcagacttgaggcatcaatatacagaaaatgacaactcaacacgacacactccctcaacatcatcttcttctttgctatgggtcttcagtgcaaaaccaaaagttcatcttttcaagggcaaatcattgagtagtacattgctgataagtgataacatgcgtaatcagtcggcttcttgttatcatcatcaaaagagacacaacaatcgtcagtagcgactgactggcacttgattgttggttgattgcctcatgttcagcttaactgaatcaattgaccagtatgcacgtgttatgttgcttgtttgtaggtagttagttagcaacaacaacacgagttaattgtacttataaatcacattgcaatcttggcatgactcaacagctcacttttggtgaaatgatcagtagtgaccgaagccaaaagcatctatctgcgacccaagaaaaaggtggtcagctaccccgtccattggagtggagtggagatatggtggagcagaacaagagggcgagggccaatggcgaggtcaagcaggagcagcagcaagaggaagaagaagaggttgaggaaggagaagtgagccaagaagaaacccaaaggacgggagctttccctctggtgaccatggccgccatggagcagacggaggaggagacgcagatcgacgtcaggatcgccgtcgccttgctccactgccatgcttgcctccaacctctcaagcctcccgtcttcaaggtcactgctctctgttgatctaattcggatgcaaagattcctatcttgatccttctttctcaccctctcttcttaacttctcaagactttgatagagcgaggcttgtgttgattataagggttaggttttgaacgatctcggccatgtttctttgttggcctaggattataatcctgtaattttttcctactctatctatcaatagaatttcacactatgttgtgcgagtcgttaaaaaaaagattcctatctcgatttaatttcttcttgttcttcttgttgttgtgtttgtgattaattgcagtgcgatgaggcgcatatcgtgtgctccggctgccgctgcggccaccatgggcagctgtgcggtggcgccgccgtgtacagccactgcgccgagctggacgccatcgtcgccactgccaaggtgccgtgcgcccacgcgccgtacggctgcagcagctacgtcgtgtacgcgggcgtcgccgaccaccagcgcgcgtgcccgtgcgcgccatgctcctgcccggagcccggctgccgcttccgcagctcgccagcggcgctccccggccacctcgccgccggccactcctggcccgtcgccgagatcgcctacgggaagccgcgcaagctcgccgtgccgccgcccgcccacgtcctcgtcggggaggccgaccgcgccgtgttcctcgtgtcgtcgtgcgccgtcggcgcgggcgccgcggtgtgcgtggtctgcgtcagggcgaacggcggcggcgacaacgcggcggcggtggcgcggtacaagtgcaagttgtgggtggaggtgcctagcaacgacgacaacatggccatgatgacgtcgatggtgaggagcagcgacctcgccggcgggttcccggcggcggacaaggggatgctgctgtgggtgccgccggagatgctgcacggcgtgcccggcggcgaggcggccatcctcagcatccgcattgatagagctgctgctgccacgcccaagttcacgactacacgagccaggtcccagaagggaatgcactgaagcttagggtctccagcgtttcggttttgatttttagcactagataagctattaacgaaattactttggatttacttatttctttaaggagcttatatataaaattattttagacaaaacataccgttcaatattttggaatgcgtgctaatttgatctttgaagctgtgggaaagaatgcaacctagtactgtagaatggtttatcttttgcatgtctagccaataagtaatacacaactcatgaatattgtagaaattttgcaagaatttcacggaaaaacagtaaaacagttgaattcccgcagtaatttgtgggtggatcccatcattcccatgtctgtaaaaggaagtctactgcaccaggaattggacacaaaattcatcacctgcatttcaatgccaagcagtgccgcttcacttcaatactaccatctgtgttccagtcaggacttcagaacgtatgacaaaagatggtatgtagtagtatgaagtatgaacttgaatgactccatgctaattttctattatgttgtttccgctgttgaaaatagttctgggtgtgtttagttctttgggtgtaaagtttttaaagtatacggacacacatttgaagtattaaacgtagactaataataaaacaaattacagattccgtatgtaaactgcgagacgaatttattaagcctaattaatttgtcattagcaaatatttattgtagcgtcatattgtcaaatcatggcgtaattaggcttaaaagattcatctcgcaatttacatgcaaggtgtacaattggtttttttccacatttaatgtatccatgcatgtatcaaacatttgatgtgatgtttttagccaaaattttttagatctaaacaaggccagatatactattgatctgaatccatcatccacaaaatgtacaagctcaacagaatgacagatgatgatgagggccttttatgggttgtggccaacagagaccactcaatccataggttcaggccacagcacgggattgctaacttcttgagggtgtttgcctgtttggtttagagacacgtgaaatgggatcagtctttaaaattaatattcttcccttaggttcatgccagccttatacagtgaaaatcgacggagtaatctaactgacttctctctcgctaacatacggaccacattatcctatctctcaaaaacaagataatcccatttctcatgttgtatggatagttaggatcttcccctctaaatgcgaggatgagtcaagttcattctacttcgttcctaatccaaacgcacgctaactcttccaagttttagtctttacaaaataaccaccgttcaatgctaccattgagttgcaatcatgaccacaacgcagtagaaattcagtatatcaatcattcaggtcttgaggaggcaacacaaggatgttgtatgagaaatgagacctttcacggtgtttgcatttcaaaaagagtaaagagtcaacgcttcataatgaaaagtaccctgtaaaaggtatttgagtattggcataggcactttacacattgttctttgctccatgttcccaacccctctccctcgtattccgcgcgcacgcttttcaaactgctaaacggtgtgttttttgcaaaaattttctataggaaagttgcttaaaaaaatcaaattaatctattttttaaaaaattattaatacttagttaatcacgtgctaatgaaccgctcccttttccgtgtggaggagatgggttccaaaccagggcatgcgaacacagccttaggtaccaagggcaaaaagataaatttgctagtagagatgagaggaaagagttgtctgcaaatttagatcggtaccgcgtcggcaccagttaagttgtttgcatgatactccctccgtcccaaaataagtgcagttttgcactatccacgtttaacgtttggccgttcgtcttatttgaaatttttttatgattattatttgtattactattagatgataaaacatgaatagtactttatgtgtgactaaatatttttaaatttttcacaatttttttgaataagacgaacgatcaaatgttggacacggatatccacgactgcacttttttttggacggaggtagtactagcattaaagttctaatttacgtggttttctctagatttatattttgttcccaagaatatcgtagaactcttcccattaattatccattacgttatttgcatagttattttgatatttatattttgttcccaagaacatcaaatatcactcaaggtttacgtcaatttaagttttgcattttattcatggaaaacataaactgtagataaaatatttctaatgattgcatccatctgaacatgctatggtaggttaacaaacaagataccagagcttctctctcgaccctatatccttcaggttcaactattcaaaccctagaagaagaacagaaagggatatctcattttagtcgcttatacgaaggaatttgttaactatgtaaataacgaatcaattgtgtaaataagtataggagcagaggagatattacccgatgcgcttgcgcctagccgtctatcggcccatcttgaaccctcaaccgtgccgatatttcctcctttgtctccttctagtggaacaattcaaaccctagagcaagaacaaagccagggtcgaagaaaggaggcgtcgatctcttctcttttttttttttctggtgcagaagcacggatcgattgttgcattgaattgtccgaaagatttactttgttttctacctaacaatactggtgattggacctaggtatttgattcactcaaaatgctcttcttcttttagtagttaattactctattggccattgctattagttatgataattttattccgtacttgttgtagcgcccgttccgtcgtggcgcctagcgggaaaatttaaatactaaaaaccctaattgcgaaatctgtttctttgcttgttgtcagtctccgtgccaatccctgatctcgaatcctcgatctatcgtcaaattcaaatcccggatccaaaaatcctccccaaatcaaattcctccgcaaaagtctatttttcctctcttaggttcggtgggccgatttcctctcggcccatctctctctctctctctctccctccctcagccctcctctccctcgtcccgcccgtgcgtcgcacgcgcgtgcgcgtgagccgacgccgagccgagctctccctctttctcgttctcctgctctccctccccgtctctctcttcccggcgagccccgcccccgagttttgaatcccccgcgccattgcttcccgcgcgcgcgcgcgccgtggtggccgaccggccagtcgccgccgccgtcagcgcctgccgccctgtagccgcgcccttccaaaccgcccccgccgtcatcgccgtcgttacgacccggccccgccaccaccgcgcatgctcccaaggattggaggcagagctcctcctcccactgcctcgtcgccctctctctccttccttcttttcccaaagtggcaagaggcaagtctcctttcccccttcctttcttcctttttctccccgccggcgtcatcctccctatcgccgttttggccgtgaccgccgagcgccagcttgctctttgaccgccctaggtcggtttccaaaccggcattgccctcctattaaaccaaggcgccctcccttcctttccctccccattccccctcgctccaccacgccattgccatcccctctgtctctctatcgccgaccgctgccgtcgcgtgtgccggaggagccggtgtgcgctaggacgcggaaggggactctgggcgctcgtcttcttcctcttccccggcctgaggccggagagatcactcccgtgccgtcggcctctcgtcacagcgccctcctctacagcggtagtgcatcctccccgttctccctcctcgttcctcctcttccccttagctttcggtagaagcttgtatagcctccccgtagctagctggcgccgccccgaccgttgccgccgctcgctgtgtgctcgccgccgtcgccgcccgtgctcggtagcgcccacacgtcgccggcctctctcgtagtgtctccgtccaatctgacgctagaaacggattcccggagtcgcgtagatgctctagctcgcccgaatcgacctcccgtcgcgccgtcgccgtttcccccttccctcgccgacggttgccgccgccgcaatccgccgccgtcgagctccctccggcgaatccgagccgttggatcgtctcccctcgtctcgtgcaaccacccggtgtgcccgcttccgccggtatcgccgtggttcgccccgccgttcgtagccgccgtccgccgtccgttttggccggcgccgtcttcaacctcccgccggcctgtgtggcagccacgtaggcgccacgtcggtgccagctcggctaagaccgggtcaagccgacctcggtccgccgctcccctctgccccgctcgcgcgcgcggtccaccatgagccatgaggctgcgcgtgggcccgccgcaaccgcacccccgcgagccgcgcgcgtgcaccgcgtccctcccccaaatcctagcgcgcgccgcgtgctccctccgcacggtgaaccgtgccaccgacaagcgggtcccgctcgggaccacgcgaggtgagcccggcccactggctccccctctcctcccctcccgcgcgtgccttgggccgccttctcgggccggccggcccattaagctcagccgagccgcccttttctctcgggtcgcaccctagccgcccgagggaagtctgtttcccctccctctttcttttctctttttcaaaagggtttaattaaatcctttttcctttagaccaaaaatccaataatcttagaaattcaatatcttcttaatcgtatgtcggtttgactctgttcaacttctaaaattcttcaaatctcgagatctatttaatggcacgtttagaggtcaataatagagctttattttcgttgtttgttgagttgtcccgttttgcgtgtagtttcggagcccgaagacccgcagtgcgaggatttcgaggatcaagctcaagatctcgagcaaggcaagtcacctttgatcatcttgcaccgataatttaaatctaagtatttcttttccgcaaatattgcatgaataggatttacacaagtaattcggccgcggcttgcgagatagcctgccggcccccaatcctaattgctgcaattaccctccttgaattgttgaacacttaaaccttctttgtcacctgttgtgcttcgatgcacgggccctcgggcacgcgcatcggaacacctcccctcaaatttaaaatatctaacgatgggtaaaacttgggttttacaaaagacttggaaaacccgacacctgggtcggtgcttgcgaactaaatgaatttccaaaatcgcggatcgggaaatgtaccgggagtacggtttcccgctcttgcacttaaggaccgttttcctttggaattacatccgagcatacaatagtgcgaccacatgggtggaatggggcacccctggctgagtaattagctaatcaggggagccttgatgccgagagacaagtggattcgccggggtggtgtcggggaggacccttgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttattaaactgttcgaacagccatgcccacggtcatgggcggatgtgaggtgattcctagcgtagttttgtttgactactgctttgtgaaattgctgttgtggaatgggatcgatgtttggaaaatctgcggctgatgggatcagctaggcccgggtggccgtttgaaagttgtggccgggtgccaaccttgaatcaattcaaagactgatacatcgcacatactccggccggacgagacgcactgcctcatccgtgtcgtttgagaatcactcacttagttgtttcaaaaaggagtttaaataaagtcatttgcaaaaacaacagccttacctttgaagcctgcattaaacacttaattcccatggcttgctgagtactcctgtactcacccttgctctatataaataattcccccccagttgctgaagaggatgaagtggatcccgctgacgaggagtttttctaggagcaagtcggctacgatgagttttagggtttcggtctagttcccaagtcgtgcctgtgatgatgggtccaagtcttggcttccgctttcccttttgtaatgcagttgtgagctcgggatctgtccgcagcccaacatgactgtacacctactctgtaataaagagacctctgttgctgtgatattctgtcttcctgggactggtatcgattaacaggttaatttggagcgtcacgggctagttctgttcggggctagttcggggcgtgacacttgtctctcttttaattaatggtttatattgttccacctctcaatacatttaagtactctcaaacaccgtaaaaggtctcatgagaaattgcattgcgcctttacggttgcttgatccaatgatctgaccaccttgtagagaaaggggagatagagaagattaggaagatacgcaaaacgaggtgagttattattgcatgactaatgagtattaattattttaaatttcaaaatgaactaatatgatttttaaagcaacttttctatagaaaatttttacaaaagacacaccgtttagtagtttggaaagcgtgcgtgtggaaaatgatgtgctttctatctctaatctcctaggctgtgtttagatctaaacttccaactttttccatcacatcaacctatcatacacacaacttttcagtcacatcgtaccaatttcaacccaaacttctacctttgaaagtaactaaatacagccctaaacaaacgcatagtggcaaaggaaggccaaagtggttgcaaactggcaatgatgaacggctactgatatactccctcatatttttttttaaatgtgacacaccctaatacttatatgtcgcctccttaaacagtgtattaggctacgtttagttcacattaaaattgaaaatttggttgaaattagaatgatgtgactgaaaagttgaaagtttatgtgtgtagaaaaattttgatgtgatgaaaaaattgaaagtttgaagaaaaaaaatttgtaactaaacactaccttactgaactagtccgtagtaactcaacagtaatgcgtgatgaatcaacttgtgtcatcaatcaagtaaaaacaacaaatcttgggtccagaggctagttaatccccatatccgtttctgggaaccgactgatcctgtgatgttgcacactgtctcacttcatttggctcatgagctcatgctcatctcttcccagtcccaccacatgactcaacaacacattctctgtctctctctcgctttctagttcttggcttcttgcaatgaactgattactacgttttgttctactactaccaccaccaccacatcatctccggagactgcagaaatggctgagcagaacaagaggagctcgtcggcggcggagaacggccacgccggcggcaagaaggcgagggccaacgtcgaggtgaagcaggaggaagaggaggcggaggaaggagagatgagccaagaagaagagagcgcaaagacggggcctctggtggtggccaccgccatggacgacccgcagatcgacgtcaggatcgccgtcggcttgctccactgccatgcctgcctcctccccctcaagcctcccgtcttcaaggtctcactctcactctcacttcatttcaagattcctctcttgatttcatttgtttctttttgtttttcttctcatgtcgtcgaatgtttgatagcttttgttgtaatcttggatttttgtgtttggatcaaatcttcttttgttgtgtggttttgcagtgcgaggcggcgcacgtggtgtgctccggctgccgcggcaaccacggccagctctgccgccgcgccgccgcgtacgcccactgcgccgagctggacgccatcgtcggcgccgccaaggtggcgtgcgcccacgcgccgtacggctgcgacagctacgtcgtgtacggcgcggccgccgagcaccagcgcgcgtgcccgtgcgcgccctgctcctgcccggaccccggctgcggcttccgcggctcgccggcggcgctcctcggccacttcgccaccgaccacccctggtccgtcacgcagatcagctacgcgaagccgtgcaggctcgccgtgccgctgccccggcggtgccacgtcctcgtcggggaggacgaccgcgccatgttcctggtggtgtccccgtccccgtgcggcgtcggcgtcggcgcggcggtgtgcgtggcgtgcgtccgggcgaacggcgacgacgcggcggcggcgcagtacaagtgcaagctgtgggtggaggtgccgaccaacagcgacaacatggtgatgatgacgtccaaggtgaggagcagcgacctctccggcgggttcccggcggcggagcaggggatgttcttggtggtgccgccggagctgcttcacgaggtgtccggcgagacgccgatcctcagcatccgcatcgatcgagctgctcccgccattgccaagcccaccactccacgagccaggtccctgaggagattgcagtgaagcttatgtgaatccaatagagtatatgcttaagatgacagtctggtattagtacttgatcttttgtgtattgactagcactagccaatatatgagtaatggagtatggtttaactcatgacttgtgtaggaattttgtacggtttgactctaatgttgttagtaatttaacttgagatttgtgaaccgatgatgaactgttcatgtatgatgctaccgtttcagaaattggacgccattgctcacatgcatgatttcgactattgcatcacgcagtgctgcaccagaggaggaagagaggtggtccaatgtttatgctccctagttaaaaaaaaaggcaaattttgccacaggacatcgtgactttacggttttagctgtagaacaccgcgcgaagtgacttttgggggaatacactctcaaaatgtggttatttgctggtggacaccgcacccattaaattaataatttccagttgaataggagagagaaattgtgtgaaaaggagagagaaattgtgtgaaagttctaaaatgtccttgggtccatatgtcaggtctttccttctctcttctctctatcccctccttccacactgctattgctagtgcttctccgtcctccatgtcgacgcgaaggagatggctcgtgctgggctaacccacaagcaggaacccggcgagggaggccagctgattggagccgtatgccggcgagggaggaagcgccacacgtcgggcggcgctgtggggtcagggagcggagcagagaagagctgggcgtgggggcggcggcgggggcagtcgtctacggtggcagcggccgtcttctgctgcagctagtgccgcacagccacgccagccgttgctccgccatcgcgccggccgccgctcctgcacaagtgcaccaccgtgtcgcgcgccgcccgcatcacgccgcacggttgccgcgagccgcgtcgtccgctactccaccttcgcggtggcccgtcactcctgcacgagggcgccattgcatcgctcgccaccctgtgcggcgtcgccggctgctagtatcgcccaatgccctgtgcggcgtcgccggctgctcgtatcacccaatgcactgtgccacgtcgccggcagctcgcatcgcccgccaccctacgccgcgtagccacgccggtcgttgctccgccatcgcaccgaccgccgctcctgcacgagtgcgcccccgcgtcgcgcgccggccgcccacaacgcgccgcacggtcgccgcaagccgtgccggccgctactccaccttcgcgctggtcgccactcctagacgagtgtgccatcgtgtcacccaccgccctctgtccctgcatcgcgcgccgcacggtcatcgcgaggcgcgccatcgagggagagagaggaagaagataggaagagaaagaggaataaggggcaatttagtcaagtcatataaaaaagtggagccatctcatctagtcagcacagaaatcattaatttaatgggtgcggtgtccaccagcaaataactacattttgagaggttccctaaaaatcacttcgcgcggtgtcctacagttaaaatcgcaaagtcacgatgtcctatggcaaaatttgccaaaaaataaccaacctcctactaatctggatatatatatataatgtctcatatcctcgatattaggttggctagtgctagaaatttggatagttttctaatatctaaatatgttttttataaaaaggtttatttattttaaaatcagataaacttattttgggaaggggggactaccagtccaaagcttgcttcaactttcaagtcgatatctgcaaaagaggcgtatagtcgtatagaggcttcaagcgtggcagaaatgtacgtactacaggcttcaagttgcatcctagtagaaatatcgtgtacaggcttcaatagccaacgctggtgtgcagtaaaattttgttgcagtattactactgtactacctccgtcccaaaatagtacagccataagtttctatgtctaacttgatcgtccgtcttatttaaaaatttttaatacttagatttttgttgttacgagatgatgaaatatgaataatactttactcgtgacttatgtttttaaattttgtttaaataagacgaacggttaaagttgaccgcggaaaaatatagccgcacttattttggaatggagggagtacttgttactctgaacattttacctcactgaaacatacacatgccactactatgcattattgcaaccgccacctcttttcatgtttggatgtaacaattctgctttaatacagtgccaacctactcctacacatatctcttcttgtgaaagatctttttttctcttttgttacaaatggttcggtttatttttttactggaattcagaggtatactgctacagtactactctaaagtaaatgcagtgctgccctgttgacgtggcgtgaacccagaacgtttgaaatactgaagaaagagagtaactttccactctataattattacaacaattttgtactccctctatccccattttaaatacaaccattatttaacatgtccaattttaatcgtccgtcttatttaaaaaaattaaaaatataaatcacgagtaaaatattatttatattttatcatctcataacaataaaaatactaattttaaaattttttaaataagatggacgattaaaattaaacgtaaaaactcatggttacattaaaataggatggacaaatacagttttactacctcacctcccactctactgctactcaacaatgcaccagcaacaaagttcatgccttttcaaagttcataatgtaggagcttgttgaatgaccccccccccccttcccggttcatgccttttggtttattctctctctggtcgtctattgctgcaaactgcaaccaaccaccgattgtttgttcatgctgttgcagttttcagtcaacaaggacgcacacaagagccgatcgccgtagacgacgatgcagcacggcgagcagagcggcgccaagaaggcggcggcgtgggtggtgtcgcccaacggccaagtcaagcgagaaatggcggtggaagcggcgcgcggcgagggagctgctgcagccgccggagccggagaagaagaagaagaagtccaagccggcgggatgatcgccgcggcggtgggcgacggcttcgagggtgtggagatcagcgtgcggatcgacttggccgtgctccactgccccctctgcctcctccccctcaagcccccgacctaccaggtaccagctgttcgtccaattcatcacctattcttcttcttgctgtcgattcgtgaggtgctcggctagtgacgatttcttggcgtgcagtgcgcggcggggcacttggcgtgcagcagctgccatggcgacgtcccgggcaagaagtgccacacgtgcggcggcggcggcggcggcggcgtctacgcgcgatgccccgggctggacacgttcctccgcgccgccaagatcctgtgccccaacgacctgttcggctgccggagctatgtcgcctaccacgacgtcgccgcccaccagcgcgcgtgcccgcacgcgccctgctcctgctcggagccgcgctgcgacttcctcggctcgccgccgatgctcctcgcccacctcgtcgccgaccactcgtggcccgtcagcaaggtcccctacggcgaggtcctcaccatccacgtgccggagtcggagcggcgccacctggtcgtcgcgggggccgccgggggggacgacgagcgcgtgttcgtcctgtccgtgggcgcgctcggcgtggcgagggccgtctcggtggcgtgcgtcagggcgaacgccgcggcggggccgcgctaccgctgcaagctctgggcgcacgccccgggcggcggcgccgcggacttcgtccacatggactcggcggtggcgagcagcgccgccgcgcccggtggcgaggtcgccgtcgacgaggaggccaggttcctgacggtgccgccgtgcttcctccacctgctcgacgccggaacgtccaaggagatgctcatcaggctcagcatcagcattgacattgacattgacatgtcctgatcgatcgacatgaaacatgatggtctactagtaatgtcctaaattcgtgattagtgctctgatgccgttcaagtttaggtgctagtttcaagttctaaccagccataagctttgctatttggaagtttgaactctgatgttctaaattataattttcgtaaggaaaactcgagttaaaaattcgaacttgtactttccttcaacctcgtttttaatcttcaatggatagaagtagatgccaaaaagatcctaattgaagcaaactatctttaccccaaaccaaaaccaaacactgccggcctccgtcccaagaaaaacccaacctttactaggatggaactaggggtgaaaacggtacggaaatttccgagaattccggctaccgtttccggtttgcaccgaccgtttcaatcggtatcggtaattgtcggtatcggaaatggaaacggtaatctctttcggaaatggtagcggaaatgatatggggttttttccgaccgttttgtcggtaaccgttttttatcggtaatttccgtcaaatttccgacaaaattccgaagaaggaagtcggctgggcctggctagcaggaggagcaaaattccgaagaaggaagtcggctgggcttggctagcaggaggaggagcccattaggcattaaggagcagcccattccgaataaagaagccaactaggcctgaccgcatcgtcgtcttcatcggcgctggggcaccgccgcgccatgttgggcgccgccaccaggtcgccgacgccggccgcaacctccttcgccccgacggcctccgtcgcagccggccaccttccctcccccatgctccaccgccggcttccgtgccaccgagccaagcgccgagcgccgccgcaccgccccagcctcctcctccccaccgatgccgcccctttctcctctctccttcccccaccgccgccctgcgccaggccgccatctccggcgcctctctcctctcgggcgcgcgtgaaggagccaaaggcagagaagagaacgagagagaaaacagagaagaaatcgagagagcaggaaaaggaaccgagagaagggaaggataagagagagagagaaaaaataaaagaaagagaggaaaagaaagactgtgggatccactggcgggccccaccatcttgactcctctctgtgatcgacctggaaataccaaaaagtctagtttagcatgaaacttaattacaacagtagttatacaatgtcaacataaaagttcttatgcaatgtgccactgtaggacgacgatatagctatgtcaattgatgatgaaataatgaatgatgtttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatttatcaatcttattgtcaacttattaatcatcatataacggtattgtgtggcagcgtaatgatgcaagggtgaaattataaggtcatcttcatacatagttaaatgcgggatgataccacagttcgctgtttccgacatgaattttcgacttccgtccgatatcggtatattcccgttccgacggttccgtttccgagataccgatataaccgatatcgttaccgtttccgagtataccgttccgattccattttcgagaaaataaaatgaaaatggaaatggtagagggtttttccgaccgtttccgaccgttttcatccctagatggaacgcaacctaatataacaacgaatctagacgtagagtatatctagattcgttgtactaggatgtgtcatgttataaaaccacctccgaaatcgacataggtagctaaacgcgaaaaaacgccatagaacatccaaacatgaagacgataccgaggcacgatatttgataacagagtttagccgaggcctacatcttcggagcactgattacgggcgctactccccgatccagcatattacagcgtatcagagttacaacgactcacggtcggacgccgtcggcaaccgcttcctctcgctatgctaagtcgttatgcggtcacaacagtcacgccccactatttatgagagagactaggatagagtccgactcttactctagttctatacctagtacaactccaagtcctaaattataaccgactttgtacacatatacaaactctaacatgttccaacctagtgtaaggttgggtcttcttgtttttttttttttgaacggaaggagtgcgacgattttcattttttgtgggggctaatggaagcataatatcatgtacccatattacatgaggtaattggaggttttgaattcacctcaagcagattattcaaacagatgtggctgattgttttgtttactgaaaatcagacatgcttgaataatgccaaaaaaaaaaaactccaatcacaaaaaatactcctctcttcacacaagcatatgtgcgcattcaatgggatagatggactttgtgagatgctgctacgtttgattttgattagcagggacttgtccttgggtagatgattgaacaacaatagagaataagggaaagggtttagggatgtgaccggttgacgcgttggatgaagaggaagtcccagccatcgtcgttgtcgtcgctctgcttgacgtgggcggcggcggcgatggcggtcgtgacggcgacggtgctgcgcggcagtggtggtcgtaggggatcccggcgaggtcgtggcgcggcggtggagtcttcccgtcactggctgcgccccctcgatcggttagggtttatggggtggagtggcggc

SEQ ID NO: 74333 - DNA, 7720 bp, Oryza sativa
tgtgtcccagggtagacttctcgctactccgctaacactgtcaattgccccacctgtttcatctcttcttcctcaatatcaacctctactgcatcctcatcatcctctagaacctctccctctgggaactcctccggacccaggtagccgcttctcgaattgcatgttgggggaggactcatctccccaacctcctttgctttcaacttcagagtttcttcatctgtcgacgacgccctcaatgtggaatccttcgaactcggccccaacaatgctaattccttcccctgctgaccactcatgtcaccgtcctgcggcttcgggcgggtaatcatcgccttgatgatcccttgatcgcccctaccagcagacggctccatagattgatcgtgggaaaactgatgccaagacgagatccaatctgcactgcctgtcttcaacgaaagggtgaaacacagagatccccctacctgagtatcccttataaagggccagatatacaaaactgactcccatccgggcctaaaccagggtatccaaaaatgcctagaacaaattccagatccatcataaccaatttggatagtgtttgatctcgtccataagaccctaggcttacccagtcgtaccggttctgatttgatcttaaaatctgccgatcctgaaaggagtatgcccgagtccgatgatgatcaagatcatggtactgtttccttcctggatcccatagcacctgaagaaaactaaaggtgggcgatagccccacagacacaccaagcagatcgggaataatccccatccaaaacccactccacacgtggattacggccgccggtgacccctggttgcccgagcgccaccatagccctaacagcgccgccatttgtccggtaagcacgtctcttccattttgtattctctatagtatctagtaggaataaagcttaggagcttcggtgctatagtcctcttggagttttgggtatgtttctagtacttacagttttcgtaagactatagttgaattaatagaattatcttctttatttatttatgctcgtcgttcatatatttctttattgagtatatgttctatgagtagtatatactttgtatatccgtttcatcctagggtagtcaatccctacaacgataacggtccaaccagctttataggttgctctagctccaatttgttcatccgtatggtgagagtcccggtggagttactgatattatttacgagcataagcatggtaattaggctagataaatattgttggatgcaggtgtgccccacagaaagtgaggtaggcggcatgtggtaacaaccctctccgtcctttgtattcctccacgtttgagtatgatataagaatacgtaaatgtcataatcacgctagcaggcgagtaaagagtggtccctcggtagtaccaaggtgcctggaacgaagtcttatgttgtaaacatgtatatgttgagtgtatactagacatgattaatatagaagtatagatgaatcgtagtttcctaatgctaattttgtactagagattcttattaaagtgaatctcctgtgtgtcgcaacgtggatttaacattccaatttgggcaagagggccctggttgtgtcgcaaaagatgacattctaagttttcttcctcctctccggtctacatgtacctctggtcctaagcacccccgaatagcaaccatctataactaatgtcgacaaccgatacggattctctatcgattgaaggagctcgtgaactggaagtcatttttcacctttgaagtttaaaagatagatcagtcttacatcttctccggtgtcagaagtactatgtagcggaagtccgaatgcagcagagaggtaagacaagcctaaacttttcccatgggacataaacctttttagtagccggagtcatttcagtcctcgcctttctcatctttcgtaggggcctttagtcttttgattatagtagaggtcgcgagagagcagagcgtaccgcccttattcttgaaccctccaccgagctctaccctacccacatttatttggaagggggccaaagaaatgtctccacctgctgccacagtagttcttcagaattctacagaacgggtcgatcctccactaccttatcaattattatcctaacccctatttagaccacggtgaattaattataggttgattaaggatatataaaaaacatatttttatgctgccgccttttcctgccgaaatataaatacgataaccttgggaatactcatggctgaaatgctacagcggtatccgtgcgcttacggatttatatgtgaacgtaaaaattaccaacatattttcgtcaacaaaatagtccgacactagaagtactctcgtttgtatgcatcctatatccgtgcaccatccatccatagtatcacaagatcctctactagcggctcaaagtacacatcaatatcgttgctaggttatttgtgcacctgaaatagaagtgacatcatgatgtacttatgcttcaaatattcctattaatagagccgagaaggtggttgtagataataacagcgactggccatgtgctatgatgactgctcatgtcaccgaaatgattcatgccgtcggtgctgttcagttgggtgtcttatcgttccaactcatttacgttctttgtggtgccattggtgacggtcgttatcgatcagtttcgacctttaatattactaaaatagaggaaaactagtggtgcttgcaatgcatatatctgttagaacaataatattccactagtattaggtctactaacctttttgcagagaatgataataaagtggaggagaatcgacatcaacatagatgataaatcaatcggacaatgtcgagagttggacttatgcatgaattgacaagaactcagaattgacacgacacactgggccaaaattcacatgtctacagaggagaataacaaaggaggctacctgccgaatatgggccaggttgggctgacccctggttcggcagaaccaggaggttcggctgaacctcccctggcgccgttggatccaggttttggctggacggtatggatcactccccaatgacagttggagggcaattccgaccattctaactaccacaaccgtcattggcagcctatttaaggagctcctctcctcacttcactcacacacctcaagcaatagctctctcatttctctcaagtttagtttagtagtatctagctggtggaataggactagaatagaaatcaggagtccggaaagagttcgggtatggctctagtagctttcctttcctcttttataagctttgtactttcattagaatacttttctatattcatttatggtattgaaatactttccgagtatatgagtacctactttacattatgttcatgttatactgaatatacggctagcttatctgggagatgcattggtgtgggtataatgtttgcttatgcaattactctatgtcatgacgatgatattagagtactatctggtagtttagacatggtgtctagattacgggatatcattatttggggttatatgctgcggatgagaggtgggccgctgatggtaacaactcagtatgggtattcctccgcgcctgtttataatcctaagtttattcccttggaagggtattcctccatatttagcctcggttatatggtcatgacgggctgtcgtaaggaattcagccgttgggggtggcttctcgtagtaccaggagggcatcggatagagggtattagctagtatatcggttaactagaataaatgtatactatgtatattagaagtataggaatagattatctttctcttttctgtcaacttaccttagataatatattatgagaatgagtagctaatgcttgtgtgtcactctacccttggattatcttaacccctgcttagaatatgattatcacaagtaacatataaactattagtcaatttctctctacatgatcttcccacgggataaaataaatacgatacccttggaatactctcgggtgaaatgctacaatggtatatctgtgcgcttgtggatgaactctgtaaccataatataccagaagtatttctgcgccattgctgggaattatatttttagtaatgacgttaagaaataccaatagtatacttggaaagtatttcaataccataaatgtataaagaagattattctaatagtagtacaaagcttacaaaagagaagagaagagctaccagagccatacccgaacacttccgaaggcttccggactccgttttcaactctattcctattccactagcttaagaacactaaactaaacttaagagaatatgagaaagctttgattgaggtgtttgttgaagtgaaaagggtgaggggtttatatagcctcccaatgacggttgtgatggttagaatggtcggaaataccctccaatcatcattgggagctaatccaaatttggctggtggcctcctggacttctccactccgcagacttctaaactttggcccagttagtcgtgtcatttccgcgttcgtggcccgttcattgataagtctgattctccacatcgtccgattgatttatcgtttgatttgatgtcgattctccttcactttgtggttattctctgcaaaagggttagtgaaccaaatactagtggaatattattattctaatatgaatatgcattgcaagcataactagttctcctctattttggtaatattgacggtcgaaactgatcgctaacaaccgtcaacaatgttgcaggtcaaataccagtcgtagttgtacctcgaccattagaagtcgtggtgcgaggatcgctacgctgttgatagaagaccagtcgtagtcgtacctcgaccatttgaagggaatccagagtaatagatggacgacattctcgtgacgtgcgagaactgcctcctgatgacgacgaagacaatgagggattatcgtagtcggtggttcgactcctggacctactacctcgtcctcgggccctctagaagtctagggatctcgagtttcgttgtcgtcgtgtgatgttgtgctgttgttaaccttttctgttgtcgtcctgatgtaattaatcctagacgttgtcgtcctgttgacaacgacgatctagccagtcttggttgtcgctatcacgacaatgttgattgtcgcgttaggtgtcatgagattgctgtaaccgactggtcgaggaacaggagtaggcgtatctcgatcacctgaagatgaatttttaggtggtgagagatcgctatgatctattggtcgaggaccaggtttagacgtacctcgatcacctattggcaactgacaggcatacggaaacaaaccgtattcgcgaaagcatctcttgttatccgtgactccccttatcaatattttccgtactaacttggtcaatcccggtgtaagatcatagagacatggagttttcgacaacgacagatggagttcaacggtccacaagtgaatttaagttgataggggtactagagttggttattacatgtgcatctcatgtggccagcatgactcacatacccaacttatggcatatccggatgtctattcgcaatcatgtcgggtgatcaagccgacaatgcttgcgaggaattatccgttaacaatctttcctcaaatagaccagccgtagccggcgctatacatgagataagtcatcagtctttgttggtaggttgggtgcgacaactcagcattttccgagaacgttctcgataatggggtgtactcaaccacaacttactcgagtgctcgattgttcctgaaaacattttctagaagacaagatatatagcagagaatatcgagcatgtactgaaaagactgcatgtaacttctaatattatcaggatataacaagcagattaaatatcaggcaatatgtaaaccgtaaataagcatgatttatacataaggaaatagagcgagcccctagcattaaaccgtagtcagcctaacaccggaaacactcgtacaatagatatcatataaaaaacatgctctaggtaaacttaataaagtatggatctgacaatattgtattgatatgaagaataggtacgataaatcacatatagaatattgcgtacctttgtaggtacatgccggatgtatctacgaaattagtagattaatttaaaaaattaatctcctaattacctgatcggtcttatttgcaggcacgcgtcgacaaaccaatacatgcatccctgagtacgtactgattcggcacattcgcatgcatgtgtatatctcacgagcaagcagtgcgtggtgatcttggacagtgatatattcaacctgaaaaaggtgaactatcatgtgctttcttgccacgtgccgtcaggatggatgttctcactatgcatcagggtccaaaatttggatcctagtcggagtgtgcgatgttgatttcggttcctcgaaggccggcgtcctaaacagttagcggcaatcaccgaggttaccaaaatcaattgacgatgtcacttaccgggcagtcgacgtcttgaagttcgatcaatctcgatagattgaattgttgatggggatgatttcgatcttgtcggaagatatactccgatcgggttagatctccctatagtcgaagtcatcgagtagcttgttgttggaaaatctatctcttggacccatctcgtcgaaatcttaaagcaccaaattcccctacgtggcgcgccactgtcgacatttgatatcacgactacggtatttgtatggtatgaggatcgttggtaccagggtatatgcgagattatggtaaaagagatgaaaacaaggatttttatacaggttcgggccctttatttgacaggtaatagccctactcctgtttaccgaagccggtgttgctcatttatttatcttaatcacacaagtagaatatttgggataacctatcttgccgtcatcgacatggcgactggataaccaactcgtagtcgacgtcagggtagtctacctcctcaagtacgaactcgtcgagatcagaaatggcgctagatctctgttgccggcttccgtaggtaccggatgaggtatgtctagtcttatctctgatgttgatatccggtggcactactacataaaagattttcctatacgccaccctcttttagttgtaggcagcctgtgaatggaaccgcacgggataatcgagcgactggtgccgggtggacgccagcacgggaaaatcgattattccgtgcgggcatcctaatccaaccatatgggataatcctcattatcccgtgcggtcgacttaagtggaccgcacagaaaaattgattttcacgtgcgagctttttaagtggaccgctcacaaaaatataatatcccttcctattttccctctcacccacttcaaattttttacacactatctcttcattttccctatttactcctctcctccccttccctctctctatcctctctctctccctctttcctctccacccctcctctcctcaccgagcgcacacggggcgtccaccgccgccgatggcgcgggaggcgacgcggtgcttgcttgcggaggcacgccgccacggcggctcggcgatgacatgccaggcagtgcggcgagcgatg

SEQ ID NO: 74334 - DNA, 1602 bp, Oryza sativa
ccccttagctttgggaaatgtgtcaaagttcggtgtttggccccttcagaatgtatttctggaacagatctcccttgaagctctgaaactgttctgccattttctttagagtccaccttttcactatgttctctgtacccgcgggaagggtgaatgtctcgagcattgtggtccacagcatctctttctccgaatctgggacaaagctctcatgatctctgcgtgcccttgttctgcgccaggacaccgtactgacaggcacgttatcccggacaacccaaccgctgtgtcgtacgtagttcttggctgcttctgccggggcactaggtcggccgtcttcgtccactttcgttatgatgtgccgaccctctagcttcttcacggcacctcattgtccgcgtgccctcttctgtccaacggagggttgacttccactagcctcctcctcctcgttcccctccgcatccctctccacgtttccctcttggttcccctccgcatcgctctccacgttcccttcctcgttcaagtactggtttggatcctcgttcccctcttcttcgttccagtactagttgcttccatctgtgattatatcgtacaatatctgttcctcttcgcgatcagccatttgttcatacaagaaatatttgccaagtctataggtcatatttgctttaacaatcatatatgctaacaatcatatatgctaagtctaagtgtagtatattagaaccctagataatcattaaaactgtactaatcttgtattagaactctaacaatcatatatgctaagcctaagtgtcgtatagtagaaccctagataatcatatatgctaagtctaattacaaatataataatcttatattaaaactcaaataatcttgtattaaaactctaataatcttatattaaaaatctaatagtcatatatgctaagtctaagtgtcgtatattagaacactagataatcaataaaactgtactaatcttgtattaaaactaactctaacaattttatatgctaagcctaagtgtcgtatattagaaccctagataatcatatatgctaagtctaagtgttgtacattagaaccctagataatcatatatgctatgtctaagtgttgtatattaaatctaatagtcttaattacattaaaaatctaacaatcatatctttacatcacttgcctacgcgaattccttcgagggctagctaccactccggcttgagggacgacgacgatgacgtcttttccgtaacatacaaaaaaatgtattagtctaaacgcaaagtaacatatattgtatttcacgtagtgtcatataaagcgaccgttcacgtttcattcacattcgttcacgtttcattcacgttcgttcacgttcgcggtctcgttacattcacgtttcattcacgatcattcacgttcacgttctcattaagtgcacgtttcgttcacgtacgttcattcatgttaacgtacgttaagttcacgtttcgttcacgtacgttcattcgttcatgttcgttcacattcacgttaagttcacgttcgttcaccatcggcgttatataaaccccaggtttaaat

SEQ ID NO: 74335 - DNA, 46613 bp, Oryza sativa
tggcgacagcttagcaagtccgtggatatttgcaagcatttcttgaaatatcactccgagaattcggtgactcgataaagatagtctctccacacacaaacgatgaaccctagtcccatttggattactttcgtcgggagtttgttgggtgaaccctagttctaaatgtttaaagtccctaaaactggtaaatccaaatcgacttgttctcatgtctacttgtacccatcaacgggctttcccctttcacatacttgaccaattatctcgatatatagatgcattatgcacttaaacatgttcacaggcagcatatgtagtcgaacactgaaagcgttacttactggcttctagcaaggccattaaaatatacacctaagttttatgggtaattaaggccttattggtgccatttgagtctttattatgaataacagaaatttatgcgtcttctttatttctattcgatcttttttcaataataatgaccatgccactaatttttctgagcaagatgaagagccttcaaactcaatggttataagcacaaaatggggatgcattatgatgtgagcgatattacaattcagagctatttttttctaggtgtaaagtaatgagtagatttcaagcataaaagaacaaatatttactgttctatttaacctattttgattggctttctgggatgttatgttcttgatctagaattaaaactgatccttcccctgtattgttggtaaggctgcaccattctctacaacacaaagtcaaagtggccatattttctccgtatttaagctcatggactatgagcccgtgttaaaatgcctgaagaagttgcctggagttgctgtgcaagatataccttacaaaacaaggaatgttatcaagaatctccctaagttctttgccgaaagctgcgcttctgataaagaagttgacgggcttctcatgaagttgccacaacacttacgagatgcactcctaccctttcaacttgaaggtgtgaagtttgggcttcgaaggcatgggcgctgccttattgcagatgagatggggcttggtaagactctccaggtgagcattttacatgagagcatgcaaccattgctattctgtatgactattgtgcacatgaataaagtattattgttgaaaacaaggttttggagcctacataatgctgaagtttgggcacactgttaaagcatgttactgtttacaacactaataaattagacttatatgaatattaaactgcctgaggcattgtaaggggtctttttttcttcttctttcgataatacaaagaagcacagctctcttgcgtttttgagaaacacagcttatatgaaatagcaacttccattttagtttcatttccaaacaattcttaataaaaaaatgttttttagagcatatgaataattgaatgaataggcttttgagcgtccttttttccctgtgaaagcagcacattctcattcatttaaatgcaggcaattgcaatagcttgttgctacaaggatgagggcccagtgttaatagtgtgtccagctgttttgcgttatacatgggcagaggaattggaacgatgggatccttcatttctgccaaaagatattcatcttggtaatcattcaacctctaatagtctttacagtttgttgatgtgaaatctggtattatgattattgtaaagctctggtgtataaaactcattttgcctttgatagttgtgaagtgctgattttatctttgcccgcattttcattactgtaatcatttagggtcttcaatgctttctctttactctagtttgattccagtaaatatagtttttaaatgaaaagtatagtatttttcacttttcaattaaaaagcatatacattctatttctccaaagactgtagattgtattatttttaataaatgttgcatattttatatttgatgtattgaaaattctgaatggtggacattgagaaagctacattcattgcgtcaatccagttgaaatgcttcaatatagagtaacattacagattagatgacctgcttctatttgttgattgattcactctactttttttttgtttagttgaattaacttgagattttactgaactcattgtttcctaggatcagctagaggttttgtaaatcttgtagtaaagttgcactagctaaaaatgaaatgctttcatgaacagtatgaaaggaattataatgcagtaaccaaagattgattgtattgacctgagttgaaaattgtgaacttcagccctaaacttaggtaacataagtattttactcaagtttaccagtgcgcttgaggtttaaatagtgcctttaacttttggctgagtcacatatgcaatataataatttgattcttctatactagtgaagaactgaagatactgtttaaaaaagtatggctaatatcatatttcttgtcacttgtccttcaattgtatattactactttatttagcctttcagttttgttatatacttatttttttaattaggagcacaattttaacagttcggttgtcactgtataattttcagtgtttggtcaccaagacagtcttgaacgtttaggagcttgcccaaaggcagtggtcatttcatatcagatgctaagccgtcttcgcaaaagcatgatgaataggagatgggcactgatgattatcgatgaatcacacaacatacgctgcacaaagaaaaaacacgaaaaaaatgaggtgtttaaattattagcttgtcatgcaacaatcttatgtatcaatacaattaacataaagtattcagctcttgaattctccaatccatgagaccatgatggtgatttggtgctttgtaaatttggtagatcatattttattgtgctagaaacgcctcacttttttttaaaataaaattctcccagttgattttattgatctggttatatttttcagcatttctccctgctttctaaaatattgcaatgcacaaatgttgaaattatctcaaactatttattccaactacttcagtcaccttgtgtatcaatattgcatttgatttcactaatggtaagtgaccgttggtactattttatgacctcatgacagacacaggctgtactggaactagcgccaaatgtcagtcgcattgtgctgctctctgggacaccctctttgtcaaggttgtaactttaaagatattggttgaatttctcttaaagctccttatgctattgtgctattttactccttgatatctggatctccaatcatgcagatagctgctatgatatatgacatattttgtgtacatcatctaaacggttttaaaattccagaggtgggtgtggatagcaatatccaagctacctgcgccttgtaattgagaaaagggaatgatgaaaactttatcatggcccaattttctgaaattttacagaaagtttttttttttgtctattactctttcaaccattttttgttcatctagtgtatttgtacttacccatattattttcaaatgcattctctgcactatgttcattggttactggtcattacttgttacttgcaatatcttcctttttccatatttggctcgaagtctggctgtttgtaccgtagagatttagagcactcaagtacatttttgtcattcctatatgtttccttctttacttgattaatctgatttcttggtacttatgtatggtttacttatgatagccttgattggagacttctattttgcttgtcagatctatctcacagtttgttttctcctaggagacaatagaccttttgacatctatcatcagataaatatgctatggtaaggaaaaggtgaatgccattgtattgtgttagtcttatcaaacttttctgatcacacttccctggcttttcaggccccatttgcttggcagcaataaatttgactttgcgaacaaatattgcttgctacatactgttcaaggctgcaatgggagaacttaccaggtattttgagtgtccggtttctcaaggcagagttccagcttttctattgctaagctctactaggttgttactccctctatttcacaatattgttctggtgtacatactaagggggcacaatattagataaatgtggaattgaactattgtttttggtggaattgaacaattgttgctttattagatagatgtacaagtactctatctaatggcatcaaatttggtctgattttatcaactgtattacgattttatgttttcttgattattggaccgaggaccagatatataatgcgaaacaaggagtatttgcttttgtgtaccatctatgctgcttatacactaatcaatcagtgaactgtgaaatagtttatgaaaaactcagaaaaccagtgcttccaaataatttttgttccagtagtaggagcatatgtagataaacatttgattctgttgagggctgtcaccatttttctctctgcaggatttttcaaagggtgctcggttgacagagttaaatgttttgctcagtcagactctcatggtctgttctttctctctattatttatgcctgctatgcatagcttgtttcgttcattttattcatgatatgttatctgaatgtggtattcagactatccataagtattattatgggaaatatgaagtgttccaaatgtgttatgttgatgatatttctccttgaatttgtaaatggaaaaatcagtactgtgacacgggaagttcacgagtttagatttgtaagtacacgataatactgccacaagttttcaaatttcccttttataccatttctgtttattattaatatgcttgcaaatattgtagttgttttgtcgccacaacccatgctaaccacatgatgtttttgtctggtaattgattgttcatcgaccattctatgtcggatataacagatgatgtttacttctgtgctgtagattaggcgcttgaaggagcatttgttgaatgaactacctcccaaacgtcgacagattatttggttgaagctgaatgcatcagatatcaagacagctatatcttgtatcaaaggggtgaacactagtgatgagattcctacaattgcctcgccagacaatagcaatgactctgaggaggtgaacatggaagaaggtaacactcattgagctaatggcagatatgataatgagacctccttgtatcagttataattttatgtgcctttgttatgctgaaatatataatacacaccttgttgcatttgaatgtttgatattgttagatttcagaactataacaaaatgcaacaacttatatggaactgtaattttgttgaagcttgcttggcatttgtggcatatgcaatgccaaacatgtatgggtttacagctttgcatattggcagttggttatgacataagcaatgcaatatggcgcagtatggtattgtacttgacactgtctgaatcgaaatttatttacaacttcttttcaaaaagagccattttcttatctatagtaacagagaacatttgtcaagaaaaagataaccagcatttttgttgatttctgttctgaagaacactatgtatatcaagtagaaatgttggtgcaactgtgcaatatcctgttgtactttacaggtgaagaacattacttgccatttccaatcattgtacttatttttttttaaaaaaattctgatatgttaaacatgaactaccatgatcaaaacattatgtttctttttgacaaacaaccaggcaaccacctctttttaagagtagcgtgccactttaaaggagacaaccttcctctttttatccttatgtaacatgtttctttctcataaacaattattaatgtaacaatgttaaatgtaacactggtattaacacttgggataaagcacatgttttctactatttcagggttcaagattagtaagattggtctgtctgctccttataaacattgtgctcatttccttgtatttccttttcatttgcccacagctgatggttgcaagaaatctccaaggaatctcactacacaagaaattggtattgtgaaaatacctgggttcagcgagtggttcttaaatcatttcatcatgaaagaaccagctgataatggtagtctggactctcagtctaattgccagaaaacaataattttcgcccatcatttaaaggtcctagatggagttcaggtaaattctgaggtttcttttctgtattttttttgcgagtttatcatgctatgtttctcacgattgacaatagaatcttgaacagtaagaaaagatttataatcacaactatgttactttatgtaattttgattttgcaagtatcatttcaactatttgtagttctatatatcttgtaagcttcacttcctcctaatgaaatagaagtttcatctttagagtaaatgaaacaaaataaatgatgtgtcaagaagctggactataggatctcatatgaatagaaacactggtgtatgtgtaaaattggtctggccatgtacatgtcattggcaccgttttttagaagccaccagtaccatgtccagcattctggcattctctagcatataatactctttctgtgggactgtagatgttctcgtaatggtttggaagttttttttgtcgaatacgcaagatgcatatcattgcattaataggagtccaaacacgccaaagaacagcaagaagtacaagacctcaccaccgcaaaacaacccattgcaaaggcggttacatgaccaaaaggaactaaaactaaaataaaatgccctagctggggtccataattagggagagccccttagccccgccaaattacataggccagcttcctcacttgctaacatcaagtcggttgataaacttggagatactccattgaagacaatcatcccattgccgccatgttcaagatagtccattaatcagttgaatacatggaaaaaatcagactaatgatcaatcggatattcgggtgcacactttcactttataatagttagatagcattatatcatattaaactataccatctaactttatgaaaaacatttgccaatacttttgactgaagtttttcttcgtacgtaggtgtttgtcacagagcagaggatcaagtatgtccgcattgacggaagcacatctcctagggaaaggaaagatgctgtcgattctttccgtttaaatccagaggttgtcccttcccttccattcggttcgattcatacttggtattccatgttaagctctcaagttttattctcaaactgcctatccattatttactattttactagttcttttattttctaccaaataggtaatggttgcaattattggaattactgctggcggtgttggtttagatttctcatctgctcagaatgttgttttcgtggagctcccaaagtcagcttcagagttgcttcaggtccttagccttctctcttgcacatacattttcctcatccatagggtacaagaagacttttgagttttttttcaccatcctgttgtgtagcccaccattcacaattcgcactatgatattatttatatgtactgtagcaactgcagtattattcactgggcctggtggtgtagctttaattggaattcagagataagaataattagttttattgttgggtttatttctttatatatatgtaagtttctttacagatatgttttccatagggatcaggtcaagtcatcccctatcagtcgagcaagaagaaatgtttctcctctatttgcttaaaaacacttattcctatttgctctcttttgatccctttacgcctcttacccaatctgtctattgcctgcttcaaatgcaattctgcatggtctttatcccgatgtggactaagattatctggtaaatgaaacaaatcaataatgcacagtaaattgctacatttcatggttcatgcgcatgagttttcatgctttcgcacacttaatgtgtgtgctctcttggacgcatgcatggtgcaccctactgttagtgtttgtttattgtgtttctaactgtttggtacatttgattgttgatgataggctgaggatagagctcataggcgaggtcaaacaaatgctgtcaacatatatatattctgtgcaagggttagttccttttttttttcctgtagcgtactttgtaattttgtcaaattataactataaattgttctgttttgtcttggtcacagaacacattagatgagtcacattggcttcatttgaaccagagtctgttccgtgtctcatcattgatgaatggaaagaaagatgctataagagagattgaggtaggccatagggtcatgtaatttttgattttatactgttccttagggaggttaggatgggcactacaatataagtgtagtattgtttggattgaggtgcttccatggtccgtaacaattgacaaaatgtaagtatgcacccattgtttggagttaggtttttctatagtttataatgcgacacaccacataactttagaaatttatgctgaatttgtactgaatgtttgcatattcaatcttttccatttcatgtttggtgctgtaaaagtagaaaataatttacaaaatgaaccaaaatagtttaccagtactataaaagtctgatgccattaaacttcaacatttaacagaagggattgatatactactcaatatacctttgcagctgagacatagtttcttatatcactgctggaatcaattggcttagtagaatcttgttggttaacagaccaattaagggactgcattgttctacagtatttggtgtttattcattcaatatagtttccttctttctaaggttgatcaagtttaccaccttgaggaaagcagtaaatctgagggaaaatcacagcttggatttcttcctttggagaatcataatgctggtaaaacatctgaacatcgttaacagagaattcatgcattggtaccaatcattattacatgcttgtaagtgaaatgaaaggctgaattttttgaacctcatgcagattgtgggcatggaccaggagagaatgtagaaagtgatgatatgtccattgagaattttcctggcctcaacgatatgaattttgagtcagatttcttcagtattaggacaattcctcttcactttgaggtagaaaagaggcgttccttgcaaattttggtacatgtttactacttgctagttgctacttatcagtcagtagtcctatgaaatccttcaactgattctttttctatgcctcctcaggatgatagccttcatacggtaatgcaaaattgtccatctccaacagcacatgaagagatagcttttgatagttcttctatctctcaagcttcagttatttgcccttcaatgtcaagcgctaaatcagtaaaggtaataaaaagttcttgcttgtattatacaatgttttgcactatatcctatgcaacatcacctcaaatatcgcaggctcgtcggaggctttctgaaatttttcagactttaggccttccagcaactacagactgcaatattgaagagaagtttctgcgatttgaggtttaactgtcctctctgttcatattctgttctcatgacttgtctcattaatgtgaagttaatttcattttacattccattccggtcttcattctttgaattcatttgatttatcttcgtattttacaggttagccagcacacaggccgaattcatttgtacatatgtgttccagggcatgattcaagacccagaccactttttgaaaacttcctgccagaagaagtagagtcacctttatgttctgataataccatgaaaacaagtaatcgtctcttgaagagggatcctgcattttgcaatacgttcaaagcgttcgtgaaggaatggttggcgcttagaccaattgagcagaagagactactgggaaagcccttacagcttcccttgagccttgagttgtgctacctgaaagataccaacaaccacagcacaaaagtacgttcctcttgattttgagtgatcaatttgaatattggtttaattccaaatattgcagaaaatatgcaaaagcaacgcttccatgatattaagcatatctatgttctatctatatcattctttatgcaagtttttcttatgttctagaaattgctcaagttctatcaggatttactctaatagaggatattgcaatgtttgacttttactctaatggaggatattactctaatggaggattcaattggtgatttggcatatacaaaaaaaaagcaaaataaaactgcagcttttaagctgctaggcccaccacagtgccacactaccctaggcatctcattgtagctaagggtttgcttgtgagctgctatcatatcatcccgatgtattaatttttcatttgaaatacagtttaaaggatctgattttgtaccaaactaagaacatgaaatgaaaaaaaatatgtcttggcattccttggtttaatcatgtttattttttgtcaattgtgctctacttcataggggttgcttaaaggaggaagtaagaggcgtgtaacaccatggtgtgatattagtaatcctttgccagaaaatgctgaatggagaaaggtggttttgcataatggtacaagtagagagagagagtacactcaaggctggactgttcacgatgaacctctctgcaaattatgtcaaggaccttgcaagtaatatgtctcatttgtgcactttatttccagtagccatctgtgttttttttttgaaaaaaaataacaatgttgttatttgtgatcagtggaaggcttgcaaagtcacctgaatattttgaagacctgttctgtggtctgccttgcttcgaggtgttcagatcgagaactagtggcaggtttgcacggcaggtgagatttttctttaatcttctgcaattagcattcataaacaaagtgttaagttgcattatttatgaataaagctggtatgccagctatatgtgaaaatatggaagttatatgtactaaagcaatgcttgcctgatgaataggcactatttgaaattgaacatggtatatgctccaagtgtaaacttgactgtcacgagcttgtcaagaatatcagaccattatgcaagaaaaagagagaagaatacattaggaatgttgctccaaatattgcaagtagattgaaattgtaagtgccatactttgatattatgcttttcaatgttttgtgcttatgttaacttctctttgcctatttaggcaacttacaggctattggggacactattgtggtctgaactcacaaaatattaatgaatatgagtagttctcctaatttgtagattgatggtgacactgtttttttcactatattttaccacaggctagataagcttgtacatgagccaaatgagggtaatgcttggcacgcagatcatatagtgcctgtatataaaggaggaggtaaagtgtgtgcataatttttgcgtgcttttggctcttaacattatggtctaatttatctgatctcacgcaggggaatgcacacttgagaatttgagaactctttgtgtggcttgtcattctgaggtcacctgtgcacagcaaaaggagcgaaaagatttaacaaagaaagctaaagagcttctgaaaaacaccgtcaataatcagcagaaggatgaagttagtagtcctgccctatttcaaactttttttgaaaacatttttcctctgaagtgatgccatctctgaaattattaagattacagtaacacagtgactctcctgtgcttactgttgatactttctcatatattagcttctgttactattgccagttggctgtcatgccatttcttaagcatggtgaagaatgataattttgcgatcattctacaaggcaaatcatctactgtctccgttcagaaatataaggcatattttgactgtccaattttgagctttgaccaactattaatctaataatatttacattttgccatgaaaagtgatattataggattttgagtatgcttttgtatccgtaagtgaaataatgtaaggaaactttacagtcaaagcttgtcttttggatcgtcaaaatacaccctttgtttttgaaaaaaaaagggtagtaaatagcttgatctggataatgtctatccctttatgctatgtaagattgcactcactgacttatttcctggactatggttccaattgttttttttttctttttcccattgtaggcaagtgaagcagcagaagaagatgataagtcgttgcttgtcgttgtccctggtagtgcctactcctgagttgggtagcgtggttctggctagagcatatgtatgtagattacagttggacattcttccaaagggcaccaatattttgtgcatatatttgttgcgtgtggccaagattgcaattgcactcatgcattatgattgcgatctgcaaccgtcttctgtttagtcggggcggcattttgggctgtgtaaggaatggttgtgaaagaagaaaggaaatgtcaattttgttttcagtttttacccacacgaaacattggagaactgccacatgtttgtttgggaacttttttatttttaattttattaatagacttttacaaaaaaaacatttccaaggttcagatttggaaatgcttgttgggatgatctattaataaaaaaaaataaaaaagtctaaaaaataaaaaaaaaactttgtttggaggcaaacttgtttgtacattatgggtgcgttcgttctgggggattgggtgagaaagggacatcgtattccgtgcgcacgcttcctaaactactaaacagtgcattttttgtaaaaattttctataggaaatttgctttaaaaaatcatattaatccatttttgaaatttaaaatagttaataatcaattaatcatgcgctaatggctcacctcgttatcttctcaatcttctctatcctcctctcctcaaactcaccctatatataggctgtgatgtactctcgctgtcccaaattataaagtctatatttttttacacggtttttaatgacatactttaaccattaatttatctcatattatgtttccaacaaaaatgaaattagcatcacatgaaaatactttaaaatataaatataaatctagtgatattggttaagtgtaaagttatcgagtctgattttcctttaaaggatgtcctataatttgcgacaaatggagtaatatgaaaacacaggttacaatcgtaactgaaaattattgatcaactggcacaactacctccccgatttgcgtgcaactataaactacatggacgatttgtacgtactcaagtaaaaaaaatctctattagaaatgatcaaatctcactgacttgccttcactgatcggtgcagaatgtgctttaataattttacagtgatcaaaccagaagcaaagctgataaccacgtctccatttctcagagttatcaaaaacgattaaactcatgatacaatgcaaatgttgttcatgtctgcataatctacgaactcgcgattactagcacgtgctaattaagcctaggcggctaggccgcgcatgcgggagccttgaattccgtgaacctaacgaacgcgatgccgcgcgccgccacgcgcagcggcgccgcgcacccgtcgccgacgacggccggccggagctcggggatctcgccgcccgggccgagcgccagcgcctcgccgttgagcagcaccacctggctccggatgtcgccgccgagcgggctcaggtggtactcctccctccgcccgccgcacggcgccgcgccgagcgcgccgccggccaccgacacgtcgaacgccgtcgcgttcgacaggttgatcaggagcaccgtcacccccggcttctccctcgagcagtgcgcgtacgaccggaggtacggcgaacctccgccgccggcggtggtcgccgccttgaggaccaccgggcccatgaggcggtgccagagcagcgcgccgtagtagtcggggttggggacgaaggtggtggtgttgaggaggcagtagttgccgccgacgagcgcctggcggcagtacaccctggtgccgtgcgccgccgacatgccgagctggtcgaggtaccagaagccgttcacgtacctgtccgacacgcccttcccgccgctgttgtacgcgccgccggactcgcccacccacggcgagctccacggcccggagccccgcaccgtggccgccatgtcgcggaacgtcttctccacctggtcgaggtaccccgggtcctgcatcttcctcgccaggtccctgtccttgccggagccgaggttgtagatgtggtgcgtcacgccgtcgacggcgccgcgccccgacacccgcagcatctccgagaaccacgcgccgtcgtagaacccgcccggcgcgagcaccttcggcacctcgccgccgccgccgtacacacgctccaccgccttcctcagcaccgccacgtcgcggccgtactgcgccgccgccaccctcgccgcgacgccgctgccggacagctcgttgccgagctcccacgactcgacgcggtagcccttgccggcggtgtaccgcatcaggtcgagcgcgttccgggcgtcccagtcgccggagtacagcgtgtccttgccgccggcggccttcctccggcccttgagcgcgttcagcccgaacgtcaccgtcgtgctgcacgtcaatcaaatcaaatcaaagataattagtcatttaatcctcctcgaaatggcgattaattagccgataattgcagtttaattacttggttcttttgaagaagacgttgagctcgtcccatcggttcatttcaaggcagccgtcggtgaagccgaagaggccgccgtcgtctcgctggaagctccggcaatcgccgtagttgctgccgactttgtacgtcacctggtcctgaagagaccctccgagcctaatcctaagcgagttgaacgctgcaacatcacataaaactctggttaatttcagtacaattttttttgatagatcagtgatctgcaaattatttacctttgacagcattgttcagaatagtgttgttcagatcctgtgagggaagaagagtgacgtgctcagtgtcagttagaagtagattgatccatatatgaaatgaaggtgattaagtttggctaatcaagtttcaggggtggtaattaccaggttaatgatggaggcgttgtaccaggggcacatgccgtagttgcacttgtccctgggccaccagtcgagcgtcgcgcagacgaagttgtcgtcggtgcgggagacggccgccgccgccttgacaaccacggtggccgcctcgccgccggcggcggcggtggaggcggcgggatgcaggccggagaagaggacgaggagggcggcggcgagcaagggaaggacggcggccattgttccacagagtgtttacttactgctcgtccagtgatggtgtgaaatgagatggagagctacatgtatataaaagagagattttgaaaagggataagattttggcgagatttggatttgttattaggtgcagagttaatagggatgagctgtttctcatgcatccatgcaaacggtttttggatttggatgcaaatccatcggagcttagcttacgcaacaacacacctatgagttagggagaagtggttggatcttgaatggatggatagatggatgaatcgatacatggatatgctgttcagtggaaacgcaaagagaggccgaagaaggttggcgaaatatcatgtgaaaacatgggtttagtggaagtttttgcttcacttcaactctcaaacgattgtgagatgagcgtttgttatgcatacgtgcaaaatcaagatcaaaatcatctacattttgagtgattttggctctacgatcgttataactcaagcaatataactattgctgagaatcccagcaacatacttaaagtgaccaatcgagtgataacaagttcactcaggtactcaggtacagacaatgttaccagaactactgtatgtcagataatatctcattttggttaccatcccccacccacattctcctaaaaaagaaaaaaaaacgagaagaagaaatgcagcaagaacaaagtgtcagtgcagaccaaagagcagccttgagagctcgtgaaacattatcttcttcatcatagtgcttacactgcatctttaaccttcttttcttctctcattcgagcccttgacaaagcgtcagtcatatctgagttcagtggcacagcaactttcagcagatcaacgaaaatttcaacctcctcgacatcaccttcatctccaagatacttaagtatcatctcaatcatcccaggcctagggatccaaccagtatttggagcatatacacatagggcattctttgtcagctcatatgctttcgcagcatcacctttctccgcatagccagctgccacaattgcccagctggttgaaggaggcatctttcccttcttcaagaaatcatccagaagtgcctcagccttgtccagcaagtccttctggcggtatccagtgagcaggacatttggaacttggaagtcaaatgcatttccgctcgactcccactctttcagcaacacttcagcttcttcaatctcattaagtttcacgagcactgcaagcattgtagtgtaatccttattaatatgcctattgcagttcgacatttggagcgcccacagcctattgacctctgatttgtcccccagatgtccatacaaggaaatcaggtggttataggaatctgaatcttttatatttatttttgcttctgctttctttaaggcagagaatgctttctcccttatgttgcccttaatgtagttgcttgccacgacagcatacgtgttccaatcaacaacgattttaggttcacactccatctcttcaagggtgttttccatcccgaaaaaatcagcccttgtgccataagagttaatgcatattctgtagctgaaattgtcaggaacgataccattgcttttcatctctgcaattactgaaggaaccttttcatgctgccctaggttcgtatacagacccatgatgttgttgtaggggagtgtggaaaacacaaaacccaactctttcatcttctgaaaatgagccaacgatttttcaaccaggagttcccgtgtgtagcagttaagaagtgcaccatagggtttttctgtcttatctttatctggcaggttgttgaagtaagtctcggctgcactgcttccatgaatttcaccaatcaaatccaggtgaacagcgtgatcctttggcagaaattttacatgtcccttggcattcatccattcagagacctgcgcaaagtaaaaggttacagagaaatcaaattaaacatgccaactaggaagtgcacttgattattaaaataagaagccccaatggtgataagctcttgaggtctggagtgtaaattatagatatgaatcagtgttgcaaccataattgataagcacattatattagtgcttttaactattgatcaggtttcatttcttggggaaaaaaacatacaatcccatcacagaaactaaaccaaatacattaaccgatggaacacttagcaatcagtcaaatcctctaattggatgaacactcccaactcccaattgacaacaaactgtcatgcaagcctcctcatgatgttcagttgtacacagccaatcgccagttcttcataacgcccaaactatattaacacgacgctactacatctctcttcttgttcatggtgcagcattacatcatacacctcacatgcatgaagagggccaacaatttggcgagtgcaactcaagaaaccaaacagcggttgaggccgcaacggcatcgaacgccccataatagtctactgatgatgagctgagctgaggtacgggccacgggggggggggggggggggggggaaaggtggagttacctcgagggcctggcggtggcggcgtcgcttgcggagctccttgacgatgcgctcgagctcgacgtggcggaggcggttgcctggcttggccgcccaccgctcgatctccggcaccaggagcgtgcccgggtggcccagcggccacagcgtggactgcaggctcgggggccgcgccggcttcctccccccgctgtggccgcgaggagaggcgggggaggaggcggcggcggcggctcgaatgagggcaggggtggagccatgggatcgcgcgtggccggcggggaggagcctgccgcagccgaggcggatcaggcggcggccggcggcgaggaaggaagaggaggcggccatgggggttaactggggttttcctcccttttgggcctcttgggttgaaggaggtgatatgaacttgtgaaggttgctcaatttgcggaaaaagtacaccgaaaggtccctcaacttgtcatcgaattacaaaatcgtccttgaaccgtaaaaccggatataaagcatcccatcttataaaaccagtacaaactaggtctcttggtctcttgatggttttaactccggttttgtctgatgtggcagctgactcagcgtgggacccacgcgtcagcctcttcttccccctcccctctccacctctcttcctctctcctctcttcttcacgggcaccggcgggggagcagctgcacggtcggcaggcggcggggcaaggagccgcgcgcgtccttctccggcgcggtgttcaacctgtccaccaccatcatcggcgcgggcatcatggcgctcccggccaccatgaaggtgctcagtctcgtgctgggcctcatcctggtgatgctcgccgcggtgctcacggacgcctccatcgagctcctcgtccagttcagccgcgctgtgggcgccacctcgtacggcgaggccatgggcgacgccttcggtgctttcggcagggggatcctctagctctgcgtcgtcgtcaacaactgaacaacgtcggcgtgatggtcagattcactgaacatttcattgtgactctaatggcttgtgttctttttccctgggatgagttcagatccactgaaatacacgccggccgtgtcggttgctctggccatcgtgttcgtggtgatcaatgtcggaatcgccaccatcaagctgatgagagggcagattccgatgcctaagctgttccctgatgttcatgactggagctccacctggagacttcacactgcagctccagttcttgtgagttgtgaccgcctacatttgccattacaacggtacattttaattaccagctaagtttgcatttttctgtgggaatgtgattaacttgccactgcattcagtgcacacaattcacaacgagctcaaggaccactcccagatcaggccaatagtgcgggcgtcactgctgctctgcttggtcgtgtacaccaccaccagcttcttcgacttcctcctcttcggcgaggcgacgctggacgacatgctcgtcttccccatcgtgttccacgcgctgcgattcaacatggacggcctcctcttcccctcagcgaggcccctctcctgcgaggctgcgacaaccggaggttcggcgcgatcacggcggcgctcctcacggtcatcttcctcgccgccaacttcgaccccaacatctgggacgcgttccagttcactgggagtagctgcatgggcgacgacgtcgactgcggaggcggcggcgacagctgcctcgcggccgtaatccttgtggcagcagccgtgtctccgatgaggccgcgctcgacgccgtaatccttgtggcggcagctcgacgccggtggcggggaagaaggagaagacggcgacgaggtggtgctcgccatccgctgcgccccgatgcgacaaggctgcggcgggtcacggaatgccgccgccagcgccgccaccaccaacgcccaactctgtctgggccatcgctggcgacacgacccccctagcccctccaccagtggctcttgcccctgcttcggccggccggcatgaccggcgaattagaagagaagagaagagaagagagagagagagaggaggggagagagatgacgtgtcatcctgtcatgtggggcccacgtgggtcctacgctgactcaggcgccacgtaggataaaaccggtgtcaaaaccaccgaaggacatattgtaaccggttttgattagttaagcgacgtcggatatctggttttgcagttgagggatgattttgtagctcgatgacaagtcgagggaccttcggtgtactttttcctcaatttgcggttgtgcaaattttcttaaatttgggaaatggtttacgcggtgacaaaataatttctccgctgtttgtttgttactccagcttatctccgctgcatccgaactttaaatttcgaaaaattttagagtttatttttttcacattagcaattaagttgctaagaacatcaccaagtttttttttaacgacttgcacaagacggtgcaaaattttattgatagaacaggaaaaaattacaaagattacaaccatgtaaggtcgtaactaggaaaaacgaaaaaatataccaccacccacacaccggtagcgccaaactacaagtcttggagaagactagcatcggaccgaccgccgctaagctaacaacggaaacaaccaagatcgcccaaaaccctatccttacaaacaacataaagcccaattcatccacgtcttcaggatctagggagaaagggtgggagagaagatggaacacctctccccctaggccctccgccgtggccaacttgttgaaactaggacaagttttttttttttggttgctacattgatttctccacttatttatcagccatagagcaaacgatgagaggctattaaatgctaatttgttttatttttgtaggtcatggttaatttgagtttataatccaaaggagataatttgaattaggatgtatgatttgctagtataattcctgtcacagtgaaaaatctcacagaacattgctgaaaggggaaaatccaaataccccccccctacaagtcactgctctttctactctccccccacaactcaatattgttcaaaacactacacataaattaatttctcttccaattttccactcctattcagtttttacgctttctcgtgatgcgctcaatttctcgttatcgtgggccttcagcgcagcccacgggtggagttgtctcgtgccacattggcggcaaaagcgcgcacaccttcttccactttccatctttccctgctttaatttcacgatcgctactgcaacactaaggcggcgaaagaacagcggtacaacggcgaagtacgacgatgatcgcatagtacagagagaagggatatcaaatcccctgcccggcaagagaagtcgtagaaggaagcactgaagcatcctgtacttcgatcacctcgtcaattcattctacaggttccttttttctccctggttttggtcggatcatgttttatgcatgtaattgttgtattactagattcagataatcgaatatttgctctttgatttaggttgcaaaccaataaattggtataatctctgcagatgggtcgaactagtatttccttcattgttcatactggttgtacaactagtggaagccctaggaaatctggtggggaaaggaattgttcatcgatctatcttttagacagggattctctgaaattcatcgatttggaggagtcattgcttatacatggatatcaaaaaggagatggtgtatactacttgaagccttcttatgtccctccacaaggtcttgtactgattctaaatgatgaaaaaatcaagatgatgttggatgatcataagacggaaacagagtgctcactgtacatttttgcaaggccgcaggaattagtgactgataatggaagcacatcaaggtttgtaagcccaagtagtatcccattaatcggacatcataacagtgtcccaggtgattttgataaagatgatttgacattgcatgaagagtatgtacagcaacagttgagggaaaagaaaaaaggcaaggaacctgctattggcaaggagccagtaatgttcttccaaggagactctgatactgaggacctatatggtactagtcagatagatgcagaggttaaccaagcagaaccacatccgggaaaaactacacaggaaaaagaactagtagggaaaaaaactaacaagagaaaagagaaggatataggccaatcagctgaggtggattatttgtcagatgagcccaatgatgacacaatagatttcaatgacgaagcacctatctatgtgcacagatcaagaggaattgaagacatcatttttgatgagtccaccctacggcgtccacacatgcaagttggcatgttgttcagtaatgttgatcttttcagagctgctttgaagaatatgatcatcaacgaggggagggaggtgttcaagggcaagaatgataggaatcaagtttctgtcaagtgtaaggcagataattgtccttggtacatatatgcttcaaaattgcctggtgaagacacctttaaaataaagaagtatgtttcaaaacatagctgtgggaaatcacacaatatagcacagcttgactggagatggcttactaatgaatacatggaattctttagatctgagaagaaatgggatgcacatgcctttcaagattgtgtcaggcgagataccaatatagaagtcagcataagtaaggcatatagggcaaggagggaggcctacaagaaagttatgggcgatcatgatttgcagtttaaaagaattcaagattatgctcatgctgtgctatctgctaatccgggaagcaatgtttttgttaagtgcgaagtatcacctgagccagaaataaggcctaggtttcaaaggttgttcttgtcatttgatgctcaaattactggcttcttaggtggttgcagacccttcatcggtatagatggatgtgacatcaaactcaacaatggttctcaaatactagcagcacaaggcagggatgccaacaataatcttttccctattgcctttgtagtagtggagtctgagtgcacaaaatcttggacatggttcttactatgtttggagaaggccattggaaaaggagaagagtttgggggctgggtattcatgtcagatagacaaaaggtaatggctatcatatatgtctactttgcattaatacatgtcaactgttttttttaacattttgctgccatatatagggactacgcaaggcagtggctgaagttttcccaggagctgagcaccattactgccttaggcacctacatgccaatttttcccaagcaggatttagaggggaatatctgaagggtttgatggaacgagcagcatatgcatatagacaatctgagttcaatgctgctatgcaagaactaaaggttaacaatttgagggcatgggagtggctaagcaaggttccaaccaagcattggtgtagatatatgtttagttctagagcaaagacagatcttcttcttaacaacataagtgaaacatacaattcaaagatactgggagctagagatgaacccataattaccatggttgagcacataaggacaaaaatgatgggtgatttcaataataagagggaaggtgtagaaagggacaattggcaaatcccaccaaatatattaaagaagcttgaggcagagaagagagaggcaagatattgcaaatctgtgtgtgctggtaggggcatttggcaagtgtccgcatttggtaatcaatatgtagtggatttgaacaagcacacttgtgggtgtagaaaatgggatttaactggaatcccatgtttgcatgttgtttcagctattcaaggtttcaagcaaaggccagagagctatgttgatgacatattgacaaaggatgcatatgcgaggacatattgtgggatgatttatcccgttcctgatgagacacagtgggaaaaaactccatttccagatgtagacccacctgtggctaggacacaaccagggaggccaaaaacaaagagaactagagcatctgatgaacctagggttcaaggaaggtcggttgcaaagacaacaattagatgtagcgtctgcaaagagtttggtcataacagcagaaagcatggaaaagacaaccaaagttcttcatctcaaaatgtgagtacactactaatttatcatataaagacattgtactttgctacttctcacaatttgttgtctgtttctctcagtgtaaaacacaaataactaggaggaagaagaggagcaattcccagcctattagttctagttcaagagatgatattccaacaacatccacacagccaccagtatatatggacaatgcatttggtgttggtctctaccatcatgtgccagatgggccttatatcggtcctactggaagaaagctgcaaattaggagaaactgatctcctatttttatgcagtagtattatttacatcaaaattcttagctacaattagtgggggatgctgatcccttcttaatctcagtaccatcttttttacgacaaataattttctgtacttctaactatcagatttgaattgtgatttttaaggggattctacttcaataagcatgtcttaaatattctggaatgtgtttttgacttggtgttgccattcttcatattgatgtggaatcacgaatcaggaggcagacacggttgttttgcactggtggactagaaattgttttcctgtgtttatattagcgtcatgtcgtcctacccatatggctcgcagaattaagagcggatggagatgcgcgcgcttttgccgccaaggtggcacgaggaaacttcgctcatgggctgagctaaaggcccacgataacgagaaattgagcgcatcagagaaagcgtgaaaaccaaatagggtgggaaattggaagagaaattaacttatgtgtagtgttttgaacaatattgagttgtagaggggagagtagaaagagcagtgacttgtaggggggtatttggattttccccttgctgaaaacacacacagcatcaccaaggtggtccgactgcttaagatgcatgttcttctagcattatctaaggaaaagatgcagcattcaacttgctgcacaaatggcacacccaaaatttcttgggaaaaaaacatgaagtttaacatacatttttcactactaattggagctcaacaccagagaaagctagaaaaagcaaatcaacacccagagaaagctagaaaaagcaatctggaaaacaaaacagctaactaagatttacaaatacatgtgcatttaaccccatttacatataacaatgttggtacaaagaattatctacaacaactgcacgcatgagtgcaaaagtgatcatctagcactcctatgttctagccggcttcaccatccgcatcttcatcaggacgccattctagtagagcttggttctgtggcttctcattggaagatctaacatcaactagtccttcgatagagcagttagacagctctaacaacattgcgcagaacccgcaggagcaagatctgcaaactgtcccatggttcaacgcagagttaaacctctggaatggacgcgtacatatcagtataccatgaagctgatgatggagcatcagaggaataatgtaaagactaagaaaacatgatggagcactaggccactatcgccctggcaagcacatacccctaaagaatccttcaatttctttatctccatagattgcttctgagctagttcatgtgattcctgcagtttcctcagggctccactcaattttctctgctctttggaaacctgcttagtgcatcaggaataaaaaataaaaagtaaactagataagccacagatatatcaaaacaaaggtacaagtcaaattcacttatatttatatactaaaacatacttggttttttaaatcatggggcaaccatttcacgtagtctatacttacgtttttctagctacatttacacatctaacttatttatttatcagtacctgagcctctagttcctggatttgttggatagctgcctgctcaatgcaagaccgacgcttgtattcttcctcaagcatgccagttatttggtaccttagttcagccatttcttgggtgagatcttctgcatcctcctttgccttcagtttttgttctcgaagctcttcctaacatatttaaaaacaaaatgcttacattacaccaaatgatcgaagctattcaaataaaaaacaaatggaacagatacatcctcaaattagctacttttggtacagttaacacaccggtaggacgtggcagcgggagaatagagggagggaaagcaaaagtgccgaagtacatttagtagacataaactaaccttgagctgctcaatcagtagttcagattcttcacttcgctttgccatattttcaagtattgcaccgcccctctcatagtattgaccatcaatcttctcaattgttttgtcaacttgctcatcagatgttaaagcagtggcaactcctccagggaacaaccgttttagttctttattctcaagtaaaagatggtcaatagtcttatgtgcctcttgcagctggagctcatactccctcagtttattatctgctatggctttatcagcagaaacatgctgaccaaagctgtcagcatcaaacagtctctgttcaagtgtagttaaatcaagttttaagctctcaatctcacattgtgaatccaaatttacattctcaagcttctctatttgtaaggctgcctttttcaatttctcttcttggcatcggacttcttccatcagaagccagcactgagaatcagaccgcatcagctcatcatctataactctaactctttcaggaaacttttcaagttcagttagtttcagttcaagactgtggatatgctctcccatgatgtttgcttcaacatttcggatatttagctgatcctgcaaatagtctggatttgaaaccaacaaaaactgttcaagtcattgtgttaacaatagcacggactaacagcaaatagagagagtagaaacaaaggaatataccaatttcctgatagcagttcctcagttctgtttccaatttctcgatgtaatgcctgtccttctgacaggccctaaaagctgcatttttgtctagcagcattttctgcattaattaataaaacaattagctccatcggagtgctaacaaatcaataacacaattctctcttatgatacattgttttggagaacatgcgcaatactatcctatgttacattgatttggaaacatatcaaaatgtcacatgatctggagtgtcacttcgaaatgagatggaaacattatcatgccagtacatagaaaattccatgaaggagcttgcaccttacaggcttacagtttgtcatagttatgttcaatttacatgttttataaacactatatgaggattctatcaaacaactgtttagctaaaatttccactttacagtgatagattgacacatataccaggtggaaatatccaagacttctcaccttcttaacaataacaaggaacagttttcaagcataggaaagctcatgaagctacttaggttagataccagactaccaggagtggtaacttaagttcacatgaatcatatgaactgacacctgagtgtaaataacaacctaatcctcaatgcatatcaagaaatggttaggtaatttggcattacacatgtgaccaagtgagtagacaaataggctgagaagaaagtgttctggaaacttgagaaaaatctctctttttttttgtatcaatcattaatttgcagggtaagggagaaaatcttccaagtgccaatatcagagttaccattgaacaaaaagaatgtcagattactggtttctcacaacactaaaaaataccagtgctcccaaaaaattaagttttacaacgaataaatcacgaaacacatgtcaggtacctcttgattgttctctcttttttgcagaacctttgcaccattaacaggataatgcccattgccattggagctactagacatctgcaaagaaagcaacggataagccctactgacagaaaatttggggaactcaattaagatgacattatcctgtgatatcaagcacaagaacatatttactagagtagttactacgctgccatatcgaagctagagattggcaatcactccaacatggactctcatgctactatagttgcaaaccaagaaaccaaaatgcggatccaatatttacatagcataccgaagccgtgccctgaacgaaaacagcgtgtacctctgaatagattcagcaatggatagatacagtacaccaggaatcactatgagcaagcgacgaaatcgagagctactcgggagcaagtttgggctcccaccgctgcctccgaccttagctccgggaagcagtcaagcaggagggttcggccggcggcggaccgcgagttcagttcccggccgcgggcttggcgtcggcgaccgacgacaagcccgccggttaggtcgggcggcggcggcggcggcggcggcggaggggggaagggagcggaacggcgagggcggccggtggccgagggaggcagggcagcacggggggccagccgcggcctcggggtggggttgggtggcggcggcggtggtcgccggagtgggggggtgagacgcgagggtggtggggacttggccgccgccgccgctacggagtaaagcagtagaggctttttgcccacctttctcgagaattggccacaacaacatgcacgccacctatatgagaaaatgtgtgaaccaaacttgccaaatgcttcacctcaaaacatcatccaaaagcgaaaattcatcaaattttggacaagctaagctactactgctcgatttagttctccgttctataagggaggaactttcagggacagtagctgcaagaaagacatatccaaaacttgtgcaatccacttggtccaatgctaagctttgcgaccaaggttttgtctcacagacagatcctcctcattatcaatggacaaccccaaatagcacattactactcaatacgcataaggtttggggtttgcctttcgttgtatgggtcaaacatgagactatatataccaaattctaaactttgcaccgttaaaatgagatgttgatattaaacagtcagctaaaagaataggtataaaagggatcaaaataaaaaaaaaattcaagggtatacaaaggaacgagcaaagctcaggataattttctattactattactaagggtgtatttgtcatttgctactcaatctgccaatgcaactgcattgtgcatttgtgtttcttcatgaatgcagctcattagttaatctagtagtactagtcctgttcttgaatgtctcacagatgtaggcacacttgtccccacttgttcttcactatgacagcatcacccatccgggaaaatcattacccagcactgctggtcaacagtttaagtacgcactgactaaactcactaaaaacggtataagtacaatttgacacttctttgctcaatagctcacacacaaggtttttcttttagataatagctcaacatacacaagtagcatactaataaaaaattgttagttctagatttcatacctcttatcccagtagtaagatcatgaaagaatttaataaagttgccaattgccaaccatgccaaggactactcaactagtgctagatttctgaattttctttttttttcttttcaggttgatcagtgtagcctctatgcgttgtcaatgatacttctccctttattttcttcaggaaggaacagaaagtcaccttctggagttcttgttaatgatccttctggaagaattaatcttgcatgaaaaaaattggctaacttgcaacgatggagaattaattaattgcagggatcgatgtgtgcacccaagggaaaagccggccgtatctatgcaagataagcagcaagcaaagcaaagttgatgccttgatggccgtagttaagtacagggagacatgccagtagaagatgcagcaaatggggaggctgcagcaaagatacgacgtgtttggatgttccaacaactccactgaaacagtttaccaatcactcgctggtcatctcacactaataactagttttaatttggcgccacataatgctggtccatgcagatgcaggcatgcagagcgtgatgattcactgaccaggcatgtgggtacccggcgattctactagtctgattaatcaactttgttaattgagcaacttttgttgtttcagtatttaaacacagcagcaaagttagctgtttatgtgttcaggactggatgaaggtttaacaaaggactttgggctactgacctaatggctaattgacagaaagtgatgttcatattgatacctacagtttatcaagcagttctttaattatatgcatgcagttaaattacgtagtactagctttgcgtattgtactcccttttgaagagctgcacagctattggcaaaagcttgattaggtttgtttttgatgcccaaaaaaatgtcaacatgaagcactagtttattcagcttgctgtcctgtagttccatttagtggactcagtgtttcccatgactagataagttcccatataaatttgttgcttgttccaaacagaaacaatttctttttttgggggggaagaaacatttttttaataaacagtttacaatcttgtaattaactgtgtcattctatcttccttatgcctaggttcataaggagaacctatttacacctcagttagcctagcctgaatattattttttctcacctgaatcttcaatttgagttgcacaccaaagttgtgttactcaccaatgtcctttggttgttaaagtcagtatatgcacgttctcagacagccagacaagtaaaactaaagtgccatattgatagaaaatgttgctccattcgtatgagacttttatggttgatggattatcaccgagatgtattctaataactcgagtggatgttcgatcgtttattgcatgtcaactggatggttatgaaaaaatttcaaaaaaattgacaagatagatcaatatataatatatcactttacaaacatgcaagttcaaattcaacttctataagttgtaacaaaaataacaaatttagttgtaaatatacatatagtaatttaatttttgtttattatttttgttacaatttgtagaagttgaattttaacttgcatgtttgtggattgatatattacatattaacctatcttgttcatatttttttaattttttttataaccatttagatgacatgcaataaactggtggacgtccactcgagctgttaaaatagtgtcccggattatcactgcacacatcccaatcttctaaatgttatgattgttactaaaactttttcatgagcatttcttatggcagaggccaggagtcctgtctcggtataattgtatcgtctcgatgtaattgattaagtttaatagaatcttctgttatcttaatataaaaacagagcatttcttaagaaaaattgatctttttattttactttgtaatagctaattcatttgtttttaactcagattcatccatcatccacattcaaatgtaccccttattaccttgcataggcgcatagttgcatgcattgagaagtaagcacagcactcaacggtatagagaatttttttttttgaacgaatcggcaagctgccaatttcattgaatagagaaggagtaaactttacaagtaagaaaaaccaggcccaggaccttcggtcctactgagctaaaaataaaaagcaagccagctaccaagatgcctcgcccccgcccgagaccatgttttggcctcctctttaattttggctaacagacttcctgtagatagctctttgtgctggaaaattctacgatttctctcgttccagattttccagttgaccagaagtgttaacttgcgaagtgctttctttgggacttccttcaagttggcggtggcctcccaggtatagagaatttgcatttcttcgtctttcttgtttccttttggagtcttgaacaagtgtttgatgggtgtgattgatcactgaagctactacatactacatgacggccaaatctgccgacatccttgtgaattaaaaaaaaactgacagacttggttagcaacaacaactgggaaattaaacggcaatttgggtaattataagcagctagactgattaagaaagaattaagtgtaaataagctgtcactcgcacgccataacatttgcaactatccaggagatcatccatataaaacacatatgtatgcgttatattgccgtgtcactgtgcggtaatagcgtactgtacattactaattcattattattgggtacaaggtacaagaaaacgatggatacgcatgcaattgctacatagtccagcaccatattttagaaaataatcatttggtatatctaccagacctcactggtaaactacgtggtagcttctattgtttaccttgcagtttatagatttgctccggtccaacaaaaagtatctcaaggtaccagtacctctcggtatcaaatcgttttcgatcgttggatctaataatgcccattaagatccaacgataggaaatgattggtactgtgaggtatcggagcaaatctcttcagtttataagccactatcaaattttaaactttaaaacttaagcttaaagttgatattaggtttttttcgttatagtttgttttttaaacatagattttagaagtcactaaggacacgtataaaaatattactcataagttatttattttaccgataaatcgtaaaacaacttattagttgtaggccaaacgataggtaaaactcagtggtaaactaatagtgttatgaataattaaatgtatccaaacaataatgaaaaagctctaaattctttcctaccactcagaaaaaagcctgcaatataatctgcaataatcataaaaagaggtccagtggatgaatttatcagctggcagcaaagagacaaatatccactactttattataagacgatgtatgcgatgttaccatatatcacgccattctatctccaatgaatattgtcggcttacactagcctacccatgaacaactagcgatgcgtatgtgtcattgtagatagatagacaccatctggtcatcgccattacttataggtgtccaaacgggcggcacggcccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcgaaatttgagattttttagaattttttcgaaatttttatgaattttttagcctcccaacggttattttcaaatttgaacggtcaaatagccgttagtgtgccacgtggcgccttcccattcgaccgccgcccgcccacgtggcgctttcggcctgacgggccgccggcgaaacgggtcgtgccgtgccgcgggccgtgccgggccgtgccgctacagtagccgtgccgtgccgtgccggcccgcgggctcggccagcggcccaagcacggcacggctactcgggccgtgccggcacggcccgttactgtagcaggccgtgccgggccgtgcctgctacaggttcggccgtgccccgggccgcccgtttggcccggcccgtttggccacctctaccattactgctccctacagatagctatatacagttgctcgagaaaatctatatacggtggtatatatccatatcaccatgatcagggttcacaaagccgtctccttggtgggtttccaagttttcacgaaaagtgattaaattttattgaaaaaataaaattcagtttgactttctttaaaaaaaaatcattgatttaccgagtggtttgtcaactccagccaacttaaaaactgtaaattccgtgagagaaaaagagagatgatttttatagattgtgtgaacacttaccaaggtatcatttcatattattctcgtgaagtaagcataactcaattgattagattccttatgataaaaccagtccacttaaatcgaagtcctaacttaacatgagtgttgttatttacgactaattattctgtcgacagcgaggcgtccaaatttgataaaagatatgggcaggttatgtttctaaaaaaagaaaaaaatgtcctcgtagacttgacacgtcatcaaagcagcctccacagcggaccagctttctctctccaatgtaacccccttctttctctctcctcttcggcccatgtgactctctcttctccgtctgtttttaactttgcttccatgcatggatttctcctcccccctctccctcaacctcaaccgcaccccccgctcgatcgcgtcgcccctcgccatctctgcagcttaaccacaccaccaccccaccccaccctaccctacctttcctcccctctactcctccacctccacttcgatcgaatgctcgctgccgcctcagatcttcccgcgcgatcgcgcccagctgggtcaggttcgttcgttcttgatccccggatcctgaattccggggtttcttggaattctttcttgggttcgccatggatgcggggggagtggagctctctggcgtgatgcatcggtgtagggtgtgcgggaaggggttctcgtgcggccgctcgctcggtggccacatgcggtcgcatatctcgtttggggaggcggcggcggagctcggcgccaatggcggcgtggttgggtacgggctgagggagaatcccaagaagacgaggcggctgtctgagtttgatggtgatggtgatggtgaggaggtggaggtggaggagggtggcgatggcggcgagctcagggcgtgccgggagtgcggcaagctgttctcgtcgtggcgctcgctgttcgggcacatgcggcgccatgcatccggcggcggagggaggaatcacgacgacgacgacgatgacgacgtggatgtggaggatgagttcggcggcggggaggaggaggagattgtggcgccggcgccggcggcggtgactgtgatcgcggcgccgccgaggcggaggcggcggtcgatgcgcgtggcggcgcccgcgcccgcgcccgcgccgccgcggccggtgctgctgggcgggttcgagaaggaacaggaggacgtcgcgctcggcctcctgatgctctcgcgcgacaccggcgtgtggcgctcgccggtcaaggcggagacgttcgagaagccggagcagaagaagaagaaggcgacggcgaagcagccgccgccgctacccctcccaagaaacggctacggctacggctacaactccgacgaggattcagctctgctccagtacggcggcgacgtcgcgaagagcaggaagcgaagggctagctaccactctcccaattccatctcctcgaagaagaagcagcagccgcgcgcggcggcgccggcgaagcggacacggtacgagtgcccggggtgcggcaaggtgttcgcctcctaccaggcgcttggcggccaccgcgcgagccacaagcggatcaacactagctgcagcgcccccaaggtctcccccgccaccgccgcggcggcggcgcccgcgccggagccgagctcggagacgtacgcctcgctgagcaccctctccccctcggcgtcgccgggctcggcggccgccggcattggcgaccgcaaggccaacaacaagtcgtcagcggaggaggagaagttcggcggcgcgtgctcctccgacgagctctacgccgagctggagctggagcagcgctcgccggcggcggccgcggggtttcttgatctcaacttcccgccggcctcatcggaggttggcgtgaactgaagcagaattggccgcgtcagcagctgcacggagccaaagatttcttgatccgaaaatcgaggcgatcaatggggaactgtacagattcaattcattccattcattccaatctcgagctccaagctttccaagatcattgaggaaaaaaaaatcgacaagtgatcagagttttctcaggttattccaaagttttcttcatttttgtttcttcttcttcttttttttttaacatttcctttatttagttttctctcctttgaacttctttgaaggggctaaatcacaataagcctatgatgataagagctcacagcatctgaactgattcagttattaatagcttaagattagctcaaagcaactgtttttaactctgttatctgcttgcttttagcaactatccctgtgtcagtatactaactgaatcccccgtgaatttctgggtcaatgctaacctttgctctgctcctacttttgctgcactaatccgagatctgccttgggggaggcaggcagcagcaaagccagcaacagcttggttgcctcaaagtaaccacttgcttcagttgctgcatgcttagtacatcagtactgtcatgccattggttggtgtggctgtgagtgaacattgtgcagcagagaagcaagcaacaatagcattggacccccaagaaccagtacattatctctatctgtgacagagaacacaagaatgcaaatgctgataaagaatcaagaaagcattgtgcaagcagcaaggtgagtagagagtgatggaagcagagagaagctgcagactagtgatgaaaatgattggtgagtacagtgtaacaactaacaacaagtctctatgaagaagcaggtactaagcatgcatgtgtgtgtgtgtgtgatggcatgtggtatcaatgcttctggggttgttcacttgtccaccagagcaaccaggacaagtcttctcactctaccattccggtgtcattttctctctcaacccctcctcttgttgctttagcaagcctgcagcttaaactagattatgttttctttcctcaataaagattaatagtattgttaatcatgacatctttccctcacctgtttctctctcaagagagaggaggaggtgcacaggcacagacagctcacacaaacattgtgttgttcatgtctctttcttgcctacctttgttgaactggtttgccttgggagacacacaggacactcgaggctgcctggctggcctctttgtcagggagaaacctgctaatctgctataatagtgttgcttataattctatgattctatccatcacaaaggacacagtatagctgcatcctttaactgcagcttgcaggcctttttcatcgtttacttgttagcttatcagccgcgaccaaaatttttagtactaaaactcaatattagagttgatgttagggtttttttcatcgtagtcaattttccaacattggctttttaaactcaatcttgttactctgcaatagtatatgccttgcttcagtttgagatattcagtaaactgtgctgctggaaaacaattttttgtaggtccatatgtgttgtggtgttggttatcatgtagctcttgtcgaaaattgaggtgtctgaatataatgccaaaaggcaagcaaaactgcaacgcttgatagttaagaattttgggacggcagaggctaaatagggtgtgtgatatcaatgacaatcagatgtggaccattcttgtgctgttcttctgcggccccatccttatttggtggagctctcgatgtatgttggcgatccacttgtcaggcaaagtctctttgtttcttttgtggtgctaactttggatgttggcctgaattgaccacaataatctactagcatgtctgatcagtgatcagttcgtggtttgatggtaattaagaagctcaaatgtgcacaacatagttgaactgaattatggctgatctggtactgttctactgaactcaattctcagtttagtcagtgattaggcacaatttgtcctgatgtcagatatgagtagcttccattttgcttttacgaagcacataaattgtgccatagtcttacacacactcatcactaactaaatttaaagttattgccagtgacacatccatttgcagtttttgcattgacttgaactgaaggccccaatcaaacaaaaccttttgtttttcctcaacctccatccctgaatgagttagtttacaattccaatttcgatccaaacaaaacagcacgatccttgaccagtaacagcaagtccctagaataataatgccactgtttttcttttaagtctcagaacgagcatgcagtccatcacccccttggaagatcagacacaacaggccaaaatctagaaaagaaatgagctgtcacaaagcttcttctgcatctaatctagccaaagcatcaggtcatcacattccacaacttgtgagaaagatatacacctgcagagaagaaacaaagatctcccggattaatgaccatcattgcaagaaaaacaatgaaaagatactgcatcaataaagccatgagaggtcaggtgatgtgcaggccacacctctatctgtgggctgtggctcccacaaaagtttgcagcttaaccagcagaagccattgctctcctgcatgcctgcattgcattgcaacaatgcagccacttaaccaacctttctttggtctcaaaaaaaaggaagaaaataaaagagaaaagaaatcttttattagcagtcagcacagatccagatctgcctgcctgcctgcttaggtgatcagtacaatgttgctaaaattagccaagtgaatgctccgaaagataagagctctaattggctgtatgtgaccaggtaagtaagcagccaccaacttaacctgacattaattgtagctaaccattttagcttgtttgtgttttttatttgtggcctaaattaaagtcgttaataattcggtacattatttgatgatatactggtctaccagaaacaaaggtagactctatttgtgaattcaagaatgtaataattgggaaggccgattaattagttagtataatgaccaagatcacaccagccaagcttggtggttactctttcacagaaaagctgaagctttttacatgccctgaaatatgtgacaaatcatagctctatctagcaatcagcaaatgctgccttaatcagctaccatctcatgccatgctacttgctttcagtcactgtagttgagatgattaaagaaatacatatttagtgttagggaacataagctttggattcaaagaggatgatctagactaaatcaaaacaaacagacaaaaatggaattccgtttttctgttatttttcaacttttgagatagacagaaatgttaccatatagttagcctatgatctcttcatctcttgattccaacttgatctcaccaactaatcaccaacaacacaatattgcaggaaaaaagtgcagaacttggtgtcaatttcggtgcattgcaggtgttgcactgttgacgtcaacttcttactaactagtacgtacagacgtactacaagtactcatttagctttactagaaaatctgaaacatttcaggtcacactcttcttgtaaatttgacaagatttggaatgcatgaaaaatctgttattagacaaatttcctcgtatgatcgcatccgcacagtaaaaattcagaggacaaagtacatatcaaatccatcttgtcgcctttgaggaaaacgcatcaatttccactatagagcaaaagatcggcagttaaagggaatatcatgaaatctctgatcagcaaataggattcgaacagctttgatggaaaaaaaggaggcaaagactgatgttagaagtaaagtgttccccactagcatctatcaggaaaaaaaatgtcaaatcaaattcaactctgtttttaactgcttgatttggctatgttcatccgtattggacgtagtgaccaggttttaatccattatctaagggccccttcgaaacaaaggatagaaaacacacgggaaaaggaaaaacatagaaattaaagtagcatgttttactagtcttacaggaatagaaaacacaggaaatatttttttgggaatacacgagacacacattttttattaagaggaataaatgtatttacagagcgggcctgaaaaccaaaaagaaggggacagggtacaggagaggggaaaagaaaagcataagcctaatctcccgaatgatttggcgacccaagaacaaacgaatggactgtcatggttggtatggctgatctagccatccgccagaggtccacttccccatcatagccctagctatcttcatccaaggtctgctcttctggttgaagacccgattgttcttttccttccagattgtccacgctaccagtgttgcaattgtgtcgaaccctcggcgatgatccttaatcatccttttgcgactgtcacacagccaggcatgaaaggactgctcgttgagaggtagacattcggaatgaccgatagcactaagagcaatccaccaaagctgtcgggactccgggcatgcgaccaggagatgatcaatcgtttcgtcgcgttgatcgcagaggggggcaatgatccgggaaatatgaggagagtctatatgatagcaccataggaaacaaacaaagcataggaaagtttccaagaggttggacctcttgcttatttcctatgaaattgagctataggaatgcaatcatatgaaaaatttcctatacttttatgtgaatcaatgggtttcataggaaaaattccttaggaaattgaatactccaaaattcctatggcaatcctccaatttaagggtcctaaaagttttcaaattcttagatatttttgaacaccaggatgtgtatctcttgttttgacgacacgtgtgtcgtactacctccattttcatttactcatcacttttgattgtgaatatatgtcactacgcacttaaatatgtgattcctcttttgcccttggtgagcctaattaaggtgatatatgtgcggcatatgtatttataaacctctagattctatatcccactaagttaggggtattttgatcattttatatagaaaaagtttattgttttggtctgggtgcatggtcaaaactgacaaataagtaaaggggagagaataattcgaatagtaatttgaatattctaactcatgtgctggagctcagacagagcatgcctaagagatacccaatactatccccaatcctgaagtatttgagttatatagggaaaaagtggatctaatagacctccaatctagaaaaaaaaaaaagaaaccctgatctcggttctcgctctccacaagttatgaagattgcaaactcccatttcactgatccatggaagtttgcgcgtggtagatcatgtgggaaggggaatgaccgttgtgtggtagttcggggtggacctacttctaattattgggtgttaattttgagttaatttttagatatctgttggagaaaagagtctattcacatctaaaaaccttcttttttagaagagtgttttttttactcggcctctatacccaaccggatactcaggctacatgccctttcgctcacgcctaaaaacctatttagggatcgtaaaagcataattttaggaatatattttttgggttttttttgtaacatacacatttacttctcttagccaaggctcaaatttgaacatatgaatgaatttagcagaaatttagaggaaatttactccagaataattagggactgaatttcaaatggaaattgactaattaatattaagctcttgattgtcaaaaggataaaaaaaagagtgtcctgaaatatttcagattttcacaatgtgtggcctaaactttttttttttgagggtaatgtatagcctaaactgataaggcagaaatctaattttatccacgagactatagtgagcctactcttcaagctgggcttcaatttatgtgggccaagtgttaacgaagagacattttgggccatcatattcggcttgtatgggccatcagatgtaacacctacgcttctctttacggcccaaaaacacctacgcttccgtagttctcgaggcttctgtttcctcgtctctcgtcgtcgtcggcggcggcggcggccatggaggacgacgacgagtgccctcccctcgccgtcgagctctcgccggagaagccgtacagtcctccgccgctcggtccctccgcggcgtcgccggtcggagtcaccgtcatcactggctacctcggcgccggcaagtccacggtgagcttttctccgcaggctgtgccctccccgcctccccgccccatgctctccctgcaaagtgcttggaggattgggggcgtcagattactggaactatgtaggatccgagattggtctacggaagattcctggaggactggagttgtggctggtagtttgatccgatcgagttgcatacttgcctgtcgccatagctcttgctgttttcttaggtttaggtagttctcaacatgctgggttggttggagcagtgtccttttctatttggtgagctgtcatgtgactcgaactcgcttcgagggcttcgtttctcataggagctcattttcaatttatttgtagttctagtagtatataagaaaaggttcatcgatctacatgttgaactagtaaccaatcaattttgaactgtagttgaatgttatatcaccaagtggagtaactagttctctttctttttttagactaaacttaacattaccgagttactcatggataaacacctttttcacagttgatgatatattgaggatttatacatgtgtttagtactattttatcccgtgcttttttatcaaaatgaatctgtcagtggctgtttactatttagcttatgttgacatttgtttctactatgtctcaccttaccactctcctagcagaacctgtacttattgaccaagtgtcctgtgaactttataatccagtttgttagttcaactaattggtatgttatgggataacttatctcccgcacatcaaattttcagttagtcaactacattctaagtgcgcaacatggaaagagaattgcagtgatattgaatgagtttggagaggaaattggggttgaaagagcaatgatcaatgaggggcaaggtggcgcgcttgttgaagagtgggtagagctggcaaatggatgtgtttgttgcacggtgaaacacagcctggttcaagcacttgagcagcttgtgcagagaaaggagaggtaaatacggatgttgctgtcttgcatggatatgtagcatacaccatttgatcctataagtatgtgtcctactattatgttttattccctatgattttcagtacaaagtgatgtcatgatgtataaagacttagtgatatgttctgatttgctattgatattctggttttagctcaaaactatgtttacactctggcattttttggttagtccacatggttgtttgtttgttctagttcttctggaaatagtaaaattttgattcactttcctgtgtatgctatgtactgatgcaaaaatgtaaagtggatcatgctcttactttgatctttcattaaagaagattggtgttttttttttctgataacattagtagtttcattatactacagtgccttgtaaattacgacggtatgaattgaagatactatgtgctgcagaatggatcacatattactagagacaacaggattggctgatcctgcacctcttgtctctattctttggctagacgaccagttggagtcatcaattaaactagactctatcattacggttagttcaaccttatgttcttatttgttagtctgactatatcttacaagttcgggaaatgtgcctgcttctttggtccttactttggataacagtttgaaggactgcattgtattggacaattttcttatatatatatttactggtcaggttattgatgcaaaaaacttcaggctgcaaattgatgagcacaataagtcatcatcattccctgaagcatttcatcaaattgcatttgcggtaacttggtcctcagtgttatcctatttgtaccattttgtcttcactacagaatttggaattctttgtgctgattttgtggttctgaaatttgtcttacttgatgaatcccaaaatgcaaacaaccataataacaaaagtgtcaaaactttcctggaccaggatgttgtgatattgaacaaaattgacctagtagaaggcagtcttgaggatttggaaaggcagattcatgaagtcaacgctcttgttacagtggtgcagtctgtccgctgccaggttgacttaaataaaatatttgatcagcaagcatatggtgccaaggtcaatacctagctcgaaacttgcattttgttatttctttgtattcaatgcagaggaatctgtctttgattttgtttttggacaaaaaaaagactaactttgattagttaattgattaagtatgacatcaattagtcatgtcaacatatgggcactaaatctagtcatgccaagacatggaaactaagttattctcaggtcattaaactctatggcacttcttaacaaaagctcgaatcattcagcacgaaaaatcagtgttggtgagacgttttttcagcatctgcttgctcatgctaactagcaatacagaaatttgcttacttgcttttggtacttattttgtagttattgcttttgctggcgatggcaccttgtgctcaacaaaatctgaacaccttattcagggatttgattctgacatgtttttaatttattttccatagaattcatcgcagctgcaagaacttctggagtacagtaaatcagtaccacctaatctccgtcatgataacagtatttctaccttgtgtatttgtgagcaggatccaatttccctgtctaaggtactcttccattagagttttttttaactgcagttaacatttagaaaacatttcccttggacaactttgaaagggtatttattcattaatcttaaaaacatagattttggttgacaactacatcattgggatttgggatatttagtttttttttctgtactcacccattgttctgttagtactttgaagtacatgctcttatgtttcacctacttttctaaaatatgtcttcacattccatactgcttaggttgatttgaaaagttacaatgaacaagtgattgcaagctctacactcacttttcctggttgatgctacagcaacaactggaaacattatttgattaatattgccccttgaagtcttcatgttgagatagatgtgttatatgtcatgatttcaaagatgatcatttattgggatctgtgaaggatgctccatattctgctctactatagagaagagtagaagtctgtttaatattcaagcacatacactgcatttcctaggtttctccgttcatgaccaatgaacaccgatatacaattgtgagatatatgcatttttgtttgatttaatttgttctgaaggtggaatcatggctcgaggatcttctttgggaaaggaagttggacatggatatttatcgttgtaaagggattttacatgtccataactcggatcaagttcatacattacaggttgttgcatcataaaaagtattctcaagaatcatacattatgagttttcaaacaaatattatcccacctgtttgctctcatgcaggcagtgagggaagtttatgaagttctgccagctcgagaatggtccaagacagaatctcgcacaaacaagatagttgtcataggtatatttcgtaactcactagtttagcgatggcaacttatgaattgtttattaattatcatatgcctgtggtgctgcaggtcgcaacttggatatcaatatccttcaagattcatttagtcgttgcaagcactgatatcgaagggtttgttcatcctgtaccctgtaagttacattctgttttttggggttgtttgtgtgtgtgtatatacatacatacatgcatgcatgtatgtatgtatatatacatacatacatacatacatacatacatacacacacacatatatatatatatatatatatatatatatatatatatatatatatatatatatatatatatatatatatatatatatatatatatatatatatatatatatatatatatatatatacacacatatatatatatatatatatatatatatatatatatatatata

SEQ ID NO: 74336 - DNA, 2300 bp, Oryza sativa
actcagagctaaaaacccatgagatggatgttttccatcggaaaggcctcaaacactcgatggctttggtagctgatccctctggtagtacttcttctaatgactcagcctttgtgtatggtggcttctctcttgccgctttacactcggtcactgaggagcaattagagaagatccctgaagatgatcttgctctttttgctagaaaattctcaagagcttacaaaaatgtgagagatagaaaaagaggaaaaaccaatgaaccatttgtgtgttttgagtgtggagagcctaaccacaaaagagtgaattgtcccaagttgaagaagaagagtgacaagacgatcaagaagcccgagggacaagggcgaaaggggaagaaggatttgatgaagaaggcgatccacaaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcgcttgaggataaggatgactcatcggagcatcctgaggtatgtcttgatgatatcccttccttggatggttctctttgtgatgattcttgctcagataatgactctgttgatgatgaactaagcaaagaaagaatggcacacttgatgattgaaattagtgataagtataggtcttctaagtataaaattgagaaactaaaatctgaaaatgatggaatggcgctagaaattgctaggcttcgatccatgattcctgaggaggatacctgttctacttgtgcttcatatctttctgaaattaatctcctcaaggataagttgaaatcatgtgctttaggagctgggaatccttctagtgctagtgctgcttgctctacttgctatgaaatgaaagttgatatgggtttgcttgagatggaattgaaagaactaaaagaaaaatttgttcatgataggattggtaggtgtgaaaattgtcccattctcactagtgacaatgatgaattaagacaacaagttgccatgcttaggaccaagaatgatttgttagaatcttttgctactaaggaacctattcattcttcatgtgctaattgtgctatcctggaaactgaactaaaagatgctaaaactgtcattgattctatcaaatctattgattcttgttcttcatgcatttctctgaaagttgatcttgagtctgctaagaaagagaactcatacctacaacaatctttagagaggtttgctcaaggaaagaaaaagttgaacatgatcctagaccaatccaaagtgtccataaacaatcaaggtataggctatgattttgctgagtctttgaggataggtacccatgagattttaggtgtcacagatgggatgatagaactagctcaaaaacctataaccttcaagtctgcaggtttcattggaaacactagttctagtacacccaaaacctcagaaccaaagatggtacctatgactagcaagtctaagcctgtagagttacctagacccaaaaatccaaaacaagttgagcacaagcaaaaccagagacaaaccaagcctgtagagaaaaccaagtatgagtgcacctattgtgggaaagctggtcatttggtaggtttctgctttagaaaggctagaaaagagcgacaagaacgtcttaggactagaagagctactagagtccctgagaggttcgagtgtgcgtgtcattgtcgttcaagtggtgtatctcgctttcctcgccgagatgtgcaccctcgacgtgacctagcagggttggggcaaaacagacatggtcatcttgcatataattctgctcataacactaaagatgcttgtacttctcgcatgattcagtactggattcctaagtcatttttcactaaccccagtactgaatcatcgagatctgctgtgtctttcttgtaggattttggagtagggagaagtaattcttggcttgtggactccggttgctcacgccacatgaccggtgaagccaagtggtttacttctctcactcgtgcatccagtgatgagaccatcacttttggggatgcgagcagtggacgcgtgatggctaaaggaacaatcaaggtcaatgacaaattcatgctgaaagatgtggcactagtaagtaagcttaagtacaatttgctctctgtttcacaactctgtgatgaaaatctggaagttcgtttcaaaaaggacaggtctcgagttcttgatgcttctgaatct

SEQ ID NO: 74337 - DNA, 17993 bp, Oryza sativa
ctttgtttagcctgtgagagcatcctgagtcatatctcatatgcatacttagttctttgattattgtactatacatgtcatctctgggaatgcacgtctgtcattcactgaaacggtggtgctccagtttccctgtttctcttgtagtgatacttacctgtactcctgtctatagctgatatgtggattcctctgacgacatacatgctggtgtaaaactgctcatcttaccgtgaattttgtattttctggaaaagtatcattggctccccaaacaatttttcgattgttgatggctaagttttcttaacccttggtaggtagtttatttcttctgcaatgcagtgccctatacattatggactgttagtgttcacttttcctgtactctgcaactgggacaaatatcatatcttctgtaggcaaagaggcattacattatgtataagttgtatgctgagaaaccaaccactaggtgcaaaatcaaacctgatggttctacatgagccagcacttcaatattttggcacccaagtgctagtggctgatgacaaatttaagatagaatacctgtgtcaacctaaaggagacacaaagaggcatactgatggaaataaagttgaatttgattcaccgacgcattgtttggcactgtggattgtagaatattaatttgttgaaaaaagcaatgaaatgacctttgcatttagtatttaaagaggcagtgctggaaacgtagttttctactgttttattattctattcatttgtcttgtgtttaatagataataacttgttatgttaggctgtgttcgttttcttgtgttgggaacttattccttccgcacagaaactgagtgactcattagcacttgattaattaagtattgatttatttattttttaaaaaataggttaatatgattttttaaaacaactttcatatagaaattttttacaaaacacacattgtttagtagtttgaaaagcgtgtgtgtggaaaatgaggaaggtaagttgggaaagatgggggaagaacacagcttaggagctttgggaaccaattaagaacatgggctgagaccctcaccaaaggagatatctgtatgatgacaaatcacctctgagttttgctcttttgaaaagaagttctgatgatctaggggcatttatattaattatggatttgggagctggtcagacttaaaatgacaggcagtggatattttcctacatgaagtggtggaacaacatttgtcaacttctattttattatctgctattctttggtaagcgattctttcgtcattctgcgttatacattcagtgtttttcctgtgacagtgattggttgatagctatactcatttcaaatgatgattgttttgggattactcacaaaacgaaacatcaccagctcattttagaactgaatgtggacagttttcaatcccagtagtcttctgctggccaattctctgccttgtactgtagcatgctctaaattactctacctgcaactattacaaccttgtgcccactgtattcttgttatataattgctaatttcacgcaatttgtgcatgtgtactttaatactggatctgtgctaactgctaagcatcactgaagtgatcatgtgcttctagcttggttttcacatgtctagttcagaagtgcaatcataaaccagttcgactaagtcctcaaaaaggagaaaaccagttctcgtaccagttcagaagaagaaaccagttctggactaatcatgttattaagatacatacagatagaatatttattgcatgttgggcatgctgttgtgtactcatctcactgtactcaacctcagtgcatacccaatcaaaagctatgatacctagatgtttcctttcatcatctatgtgtttagctcactaatcaacattatcgctttgtcagcatgccaatacaggcaagttgatttagtagtgtggccagcacatttcccaaacaatgttctctgttatgataaaggtcttaagacccatagatatatgcttttgttgaattgttgggtatgaatcatcaagagctggtgccatttggcatcaactcatttttttttgcagtttgttagaaagggattggtgtggttgtgtactgacaaatctatggtattcaataagaaattagcatagggtgatagggaggtcactgattggtgcatcatttgcttaattaagtactgccaggttggtgtgttagcctatctggagagagagagagagagagatcatgcaaatcaaagctttttggtagctcatgtcagtttgatacgtgtgcatgcatctgaatgtagatcggtatccttccatttgtctcttcctttgcagatttggggattatttgtgtcctcttttttttttgtcagaagagttcagggcattgccatgtggctggtatatatattcctgctttatcatttgctgaagtccccagaagccacaatacgttaaactctttatatatcagggaggaaagaagtagattaatttgtcggtgttgttaatacatttccctctagtttttcagctgtaaactcctgtgcctagaaaaaaaataaaaagggggtactatcacgtcattatgttaattcggtatacaactattttacttctgatcccacagatgtaactgtatcttgtatataattgttaattatgtttctccaaatacaattttctgttctatgcacagctatatcgatcaatcctcgctattaaaatttggactcatcatgatctactggtttacaaagttctctgtcttctattaatattgtaatttctaggcctttggaatgagtacagtggtttttttcaagtttgttttgataatataatagattgatgtcatcgacataaactttcgcataatagaacttggaatcgtgttactatttttctagagttattttttcaccgtagttttctgtagctagccatgggaatggtgcctacctcgactggcagggagctgttaggagcagacgagcagtgcaccagcctgagtttgaatccctttcagtgcatgttgttggtaacttttttggttacgccgtcaatcatgatgaaaacacctaatgttttgcggtgctacaaagtcgtcaaccatctcgatctagataaatctaaaccaaggtggtttatgtaattcaaaactgactagttgaagctggcttagatgaaatagggataaacatttgtctcgtgggtggaacggaaggtttttgggacagacctacaaagagattcgcacacccacatcgaggatggacggctttcagtgcaaaccgacaaagatggatgaaaactagaaagaaaaaaagtgattggctaattgtattgaaaagagattatgtgttcagttgaaccggccatagcctttataaagagactggtcttgtctcctacagaatcttctccacgtcttactcaaggtagataccaataaaaactcaaaaacctcaacccaagcaaggaagcctgagacccgacgaaattcgactcgaagtcggacttagacggtttgaccgtccatttgtcgccaatcagatcgatcagccacacaccggcgatcatactagccctatgtaggaaatcccgatcttattcaaatttgatcatattttcttatttcatgtctagatgtcaaatttggatgttaacacatgttttctcactactttatcagcaatggatgctaagatcctctttagtaacctaacacatttttttgtttttttttaaaaaaagttagccatgagtccatgacatcctaggacaagagtaaaaaaaaaatcaaaacagataaatcaaacttaaaagaacacccaaaattcataagatcgtcgatgtgctgcccaagttgccgtccacggcgacgtgacaagactacaagagaagggaaccaaaaggtggcaatggcaaaatccttggttctgctcgactgctcctactcatcagtcaccgaggcgaaaggcatggctgttcttgctccaaacccgtaggccatccactgcccattcgtctgcgctcacaagttgcagttaatgctaaacaccaaaggatgcatatacgcaagtatatattccctccgtactcataaataaagtcgtttaaaacaatatttaagtcgaaccttgaaaatatatattataaataactctcgagttgttgagtttgtaaatataaaaattatatgaatagatttgtcttgaaatttttttataaaattatatgaatataacttttccataaatattttttatagaaacaagaagttaaagttatattttgaaaactgtgtcgctgtagtccaaaacgactttctttacgagtatggaggaagtatgctttacaagtaggagtaggtcagatgaatctgatacagtaactatgagtaggattccatcatagagtttgcatgcactggcgtataagacaataccaacacgatcatatgagccaaaaaaaaggaagtccaataattaatccaactatccaagtagtactcgtttagattctcttaaaaaatcagtcgagtattgttaaaaaagaaaataaaatcagtcgagtaattaattcaagtactcgtttgggttctcttgaaaaatctctagctcccttcaaaggttggtgctgccgcttcgtcgtggcactttcctgctaacgaattcaaaaaagcgacaggggaaaaaacacttcatggctgtatttagttcacgctaaaattgaaagtttgtttgaaattgaaacgatgtgataaaaaagttggaagttcgtgtgtaggaaagttttgatgcgatgaaaaagttaaaagtttgaagaaatattttggaactaaacacggcgcaaattggataggaattgggaaaatcaaatcggtgcgttttttcaggtgaaaatgtcaagcagtcatgctgtgtcttgtgcatttcacggcacgatggtgaactcactcgagctattcaattgtgaaagctccaaatcttgtctcggtcatgtgagacatctccggcgacgacgatgggtaaattactctgtcggtttatttatcttttctttttttttaaaaaaaaagacatgtccagccacgtgactgaactatgggtaaattactctgtcggtttatttgtttatttcaaaaaatataaagatgaaatactaagaacatcgtgcccctactccattcccaatatagatttttggggatttcagtcggaaaaaaatacactaatagtttccctgctctctcacaaaaacgaaattcccttatctttcattctcactctccacaagttgaaaaccattctctcccaaatttcatcttttgagcgagactgcaactcaagagcaagcaggagaatgaccctgctagctaaatgggtggcatgatctgataatgcctaggtgaagggtgatcatcttttcattttagagagttaaatacagacatcaccttcctttctattttaagaagttaaatacagactatggaagcatatttttaataagaaaaacgggtcaaagttatacattaaaacaaaataaagtcaatagtgcattgaggtacaactgttaatatcctatatgacaaaagaaaacaaagactaattaatcacacttttaaaaaacaacgtccatggtgcaaattcagaagttgaaaacatacggcaacaaaaaaaattaaattcgaaggggaaaaaaaatgtcgaggaggagaacacggtcgaggaaacaagatggaaggaagcttcacctttaaaatatgcaaaatctccacaaagtcaactttccgcctccgcccgtagacttctttgaccgcatttccaccgcgcgtttgactttggcatctttgaccgccgccatgtcatcgagcctatcgcctcttgccacgtcagatcctcgcagctttcgtttcgcctcctccgctccgagacgaaggcacgaagcatgctgaaggccgccacgtggcacggctcgtccaaacagcagttagtttttaggctatcgctggtcttgcctaatcacgaagcaaattagttaagcgtgtgccagctaaattcacagtgtaaaccttcgtcattagctagcagaccttgtcattagctacataattaattatgtgttactcctaccatgcaagcttaaacagtaaaggctgtaaggctccgtttgaattcatggaggatgaagattaagtaaaaaatacataaaacaagaatattattattattattattattattattattattattattattattattattattattatttattaagttatttatctaatagtttaaaacaaaattaacttctatatagaatttttttcacgaaatatataggttagtaatttgaaaaatgtgttaacggaaacgagataaaatccatatcttaataaaaacaacgcgttacctggattaatatgctttgtcccattgtgtttacgcgataaattactggactaactaactcgccgcacaaacaaaggttgctacgcgtgggacgtgaccatgcgttgtcatcttttaattttcaattttttttcctccatgggcggcgcaccgtcgttgttcaattccatttccacggaataaaatgggagacgaaaacggtggttgatgccgtacagtggactaattaaaaattatttgaagctctttcgcttatcttttggcgtttttttagggatggagtgtaatttatggggcacttgacagttgacatcctaaaaagacaaggtgtgtatatcagtctctcgatcgatggtttgacaatattaattagcgaggtcctcgcacggccgaaaggtttagcaaatgtgaagattcatataggttgcctaattcctatttatttgcatatatatatatatatatatatatatatatatatatatatatatatatatatatatatatatagagagagagagagagagagagagagagagagagaaacttttaaggcttctgtgatttttttagagcaaaattcattgataaaaccttttcgtctccggataacattttgatatcaagaggaaagttttatttatctatagttgatagttttcatagactttttttaaggctccaacaaattttgcaggtatttccttagtgaacacatttgatgttcgaaataaagggtactaaattagtgcagtaactctgtgattttattttatttttttgacaaactaaccgtgtgatttcaagaagtcgaaatgttatggaaatttgttagggcatccacactatgctaaaaagtaggtagcaaggagtcatattacgtggttcactattgtgagggtaggtagtaaggtggatactactattgtgagggtaggtagtaaggtggatagtagtatgatccagtagtaacactactaccaaataacaagcaatcaacaaatattaaaacactctcctttctcactcccactctcttattcacccatccattcctagtaataactaaaacaacaactcccttcattgtaaaatataacaacttaaaattggataggacatatctttctgtccagattcgtacaactaagatgtgtttcattcagtcatatgttgctacattttgggatggaaagagtacatgattttgtgttccatccttattacccacttgctattcccttcattcacaaatgatcagcatatatgatttgtgcacctatgccaatgcactcccacatgccacttaaatttacatcgattaacctgcaacaccgttttttcatatcctatgcatgcaacaagggaaatttgcaccaatgatatattgcttgcatgtatacatgcatgcacctcaaattacaattagttgaatagtacattgaactatgcatgcaaaagaccatttaataatacacagagaaacgaaaagccaggtataaaaagtactatcaaatatgcttaccatttctatataacgttgaaaaaaattatatgatgatcatttatgaatggagagtcttcctcctcattatagtccttctagaatccaaggtattttgtcgaaatatatcctgtctttgaacctttgtatccctaggagagtactacattataaggaggcccttagaagtaatcctctcttcaatgtcctgactagtcgatgcgatgtgcttacaggctacagcaaagaagggtacgtgcagctggttggaagtcgaaaccgcccgcagctgtactctctttatcacacgaaaacaaatctatgactagatgtgatatattttaataaaacgaatctagacattctagtacaataaatctggacagaaatatgtcttgaattcgttgcactaggatatgtcacatccaatcctagttttttttttattttttttacggagagagtagctagcgagagaagttcaaaccgcatggcatacacagatcacacgacacgaacatgctagctagatcaatttaccagttaatttgtctaatgctctattcatcttctagcgcttagactaacaaaagaaaattaaataagttgtacgaaatgtacaatccaacattactgggtgtgctcagtttcaaagtcatgaacaaccatttagacatacaaaacaggtggaaaaatgaaggcgatgcaagaaattttggtcaaggcgtatctagaaattccaagcccgaccggcctaacactctcgactcgtttcagaacattcagcaaaacaatactccctccgttgcttctttaacgtttgacatcattaacttttcaataaaaaattaacaatttctcttcttaaaagaagttactccctccatcccaaaagttactagagtacaatataagtattttttttactataaatctggataagccaaaagttattatattttgggacggaggtagtatataattattatttttttattgttatttgctttactattaaatatactttaatcaatttttttcatatttgtataatcttttaaaaaagaatggtcaaacgtacgtcttcaaatattaaaaaataggggcagtaattaattactgtacttttcctagcccgagctacttgtaaaaacaatatacagccggcatgtcacattagtgtacttgccttgagataaattaatatagagaaaaaaatagctcagctcagctctctgaatttctactactacaacgtggtggctcttctgaactctgaacctttaatatattttttccctcagcgaaagagaaaaaaaaatcaaggccggacgacgtactggcagagcaaagatccgaatcttggggcgtcacatgccgccacatgtggtccttagctcgtctcgttgttcttgcgtcgcatgtgcatggatggatggatcatgcatgtaagctagttgcacttgcaccacactgaccgcacgcagcagtggcacgcctcactcacgtcccgcgtattccctctccgttccttaagaaaagaatctaatacgaaaatatgatatatcctaaaactataagtctaaacagaccattatttagattgatagtactaagatgtactcactccgtcccaaaaaaaatccaatcctagattagaacctggacacatgtgtgtccaggttcatgtgtccaggttcaaacttaggattgggtttttttttttttgaacaaagggagtatgtcatttttagagacgaagggagcatatttctcttgcaaccaagcacaaacagcacaaatatttattatagacaaaacataccggacaatcctctctctctctatatatagagagagagagaggggcaaatataacgtcatcctgtctgtacttattttttccgtgtctgcaggacaaagatattcataccgaatgattcaatattaacgtggtaccatcaataatttgtacggtctttctctctctctctcacacacacacacacacatatatatatatatatatatatatatatatatatatatttgtgtgtggtgcaccagagctgtccttgatcctttatgatattgcttatgctattttaatatatgtatttcttttgagaatgatgaatatatagttgaaaatataatacatgcatataatatcatatgcgtagtagtatatgatttgacctaattaggttgtgcatacgtctttcacataatccatcaaacactagatagatcatatctaggacatccattgtcagtcaaagtcaccattttcgccaccacgacgaatctaattccatttcgtgccagaacgtactctcgtcgaatgtgagagcgaaagcagtatatccacactccatgactccatatccactagccctcctcatggatcaccaaattcccctcctcccttcacaatcagccaacgtgcagtgacacccaaaaatccttggagtccacccaggttcaacgaacctggacgcctttttctgcctccctaaacctctaaaacccgtcccagttcaaaaccatgtccaggtccatccaagagaggttcaaattacactggctgagccgcttaaaatcaaggtggcaaccggccggttgctaccgctttttgacctggtttgcattgtgaggttgttttttcttctccccgagataagaaaaagcgagcgtttgccgtttcggccggatcggcggcctcgggcaacgtgctcgagcaggcttgtgtgtgcgcacacgagtcagtcaagtcgccacatggccggaaaacacaatgcgttggatcgtttcgtggcagacaagttttttttttgagtgattccaaagaggagcaaccagggttcgtaattctgacaaaaaccggctgtattctatgaaatttcgaccttttgatatggctcggaattaatttttggttaaaattttgaaggttaaacattaagtttggtcgaaatttagtcgaaatttatcgaaaaccgatcaaaatttgtcgaaaaccgtgataccgacgggctcgaaatttagtggtcaaccggtaatataaaccctgggagcaactttggtgctcccttaatctcaaaagtatctctaccgatcttgcaatttcttgtgtcctataaaatacatagatatctttatattaggtataaatttggactatcttttcctatgaatttgagtaaaccaaattagacatgttcgcggtatagccgctatgtcacatctgctgacacaaagtgctattcgagctagctgtaccgtagtcgaatgagtgcagccgaattcataagtaaagatacctatatttttggtgacgagactaataaaagtttgcctataattttcctattttttagcacataaaatgtacaaattaagggtaaacatacaataagcacatcattgtattatatcaataaaatcgcacgatcacgctgacactattttgtttcctaaaatattgtgcattgaaattgcgatttttaacacatttgttgcaagacaggataagagaatggaaattgaatgaaatctactcggagcaattgagaattagagactccattttgaggagggaatgggcaaacaacacgccgaagataccgggagaaatgaatccgctatccaaaatcgagctaatatagcactgttactcatatgaatttctagatttttttcctacatatatagtgcaattctatcatacagttattattaatttgtaataggtgtatttcggtcttattaaactccgataataatggtttaacaattactccctccgtttcacaatgtaagtcattctagcattttttacattcatattgatgttaatatatctagacatataaatatggaaaatgcaagctagacttactttctccgtttcatcatgtaagtcattctagcattttccatattcatattgatattaataaatttagatagatatatatgtctagattcattaacatcactatgaatataagaaatactaaaatgacttacattatgaaacggaggaagtagatactaataaaaagggataaaatatacccaaacaatcgagccttgtatatgtattttatctaccttgatacgattgggatcaaagtaatacagtagtatattcttgctttcatgggaggatcaaaaaaatgataacggtataaaaaaagcagtgaagcaagctcgcagacaacacgccggatacaaaggggaaaccgaaataaaaccgccggagaaaaggaaatgaatatatatattttcaatttcgtaacgaaaaaagatatatatataaaaagaagccttgaactccgcctttaaatattcccacctcgcctcgctccccttccccatcatctcatctcacaccaaaaacgaatcagctcgtctccttcctccgcctccgcctccgcgagctcccattccattcccggattgcgccgccgccggtgttgcagcagccatggggatggggccactagagaacgccgtggtggacgcggcggcggaggccgtggcggcgaaggccgcggtcggcggcgtgggcgtggggggttcgtacgcggtgctgcagtgcggggaggactcggagtacgtgaggaaggcgtacgggggctacttcgaggtgttcagggcgctgctggcggaggacggcgagcggtggcgggtgtaccgcgccgtgcgcggggagctccccggggaggaggaggccgcggggatcgacgggttcgtcatctccgggagctgcagcgacgcccacgccgacgacccgtggatcgtcgccctcgtcgacctcatccgccgccagaacgccgccggcaagcgcatcctcggcgtctgcttcggccaccaggtgccacccccctcctcctcctcgtccgccatggatgtctccctctgttcgtctcggttgcgatttggtttggtttgctcgggggaggggtgaaatggtaaatttgctctttccgagatcggcgccgcttgcgattacctggttggagtggcgttgttctagcgacttcttatggattctttttttttcgtcttccttttgcttttttaaaaccatgcgcagtaaaaattcgaactaattgcattatcgcaggttaaacaggttgaatccgagtacaaaatttgtaaatagtaattcataaattggggggtaaacctgcaatggcaactgcagaagttcacaggaggtgagcttagcctttgcagtgatccgcacggactttttttttattttgaaaaagtacttcttctcaaataaataaaaattgcttaaacttaaaatatactctatccgtccaaaaaaaatcaacctcatactgaatattgaccatatccagatttataagatataatatatcttgagtttcttttggacggaaagaagtacaagtataaaatcgtttttaaaactagtagagctataatatttatggggcgtgaatcccgtgggcccacaccgaaccgcacccgtggccagaagaaattcccgtcttgtgcgttggacaggtgggccccactccctgtcacgccaacgcattagcctggccgcttaaataaaagaaaatgaatttttagctttcgctaaatctaattccggacacggttgatgacagcctggcacagtgcgccaaggcggttcacgtgagctgacgtggcggcaccggctgagctcacttgctgttgcacacacacaagacaatctagtaatctaattttatttaatatatattttttcttctctatatttggcggtaatcaactcctccgtggaattgctgccacggaagctgctcggtttgaacggcacacggttggcgtgatgcatctaaaccggtgaaggcggtcagcggtcgcttttcaaatcaaaccaccagcgacagcgcccaaagagtgtgatttttgtgttaggttggggtgggcttacatatacatgtttgaatccggtcgtttgtccgaacgagcgggaaccatggttacgtgaggactctgtatacgttttgttgtaaaaaaaaggatgagtgcgcgtattcaacttactataattgttttgatttttttttaaattttttttaagagattgcacagtctgatctgtgtctatagaaaggagatagaagtagccttgtccctaacttgatcgaagagacgagttgttcttgtttgtgcgagtagggaagcgcaacttgtgctgctgttcttgggggacattgatccccaacttgtcagcgggattggtttctttagtgattagtataatcgtaggatggagtcccgtaccgatcatagcttaatatccaagccaagcatcgtccgtgatttctgttcaaaagtcaaagctttgcaagaaccgtacagagctctgtcgaagaggtcagcgtgtccatggcagcaacagctgcgcaagaacagttataatttactcctacattcggtgtgccgcgttagatctcgcaagctgtctgaatccgaaaatggatcatgccagctcagctcgcatgtactccctctgtccaaaaaaaaaaaagacaaaccctggtttctgtgtttaacgtttgaccatccgttttatttgaaaaaattatgaaaaaaattaaaaagacaagtcacgcataaaatattaatcatattttatcatctaacaacaatgaaaatacgaattataaaaaaatttcatataaaatagacagttaaagttggacatagaaacctagggtttgcctttttttttttttttggacggagggagtactccactgtctgtctgtcggtgtgctctcctcctccacccacatggctgggctctgcgaagctctaccagttggaattagttgaaatgtttgtgatttgtgaacgagctggatgtgatgcgtcgccggccggccccggcatcggtcgatgatgaccccagtgtggcgaggatggaatcgatcgcctgtcagaaagaaacacgtttagctcttaaaaatgccagctttggtcttaattattcacgcacaggaccgagttggctgttgatctggtcccccttttgaagatctctgcatgtgattgactgcagtctgcaacatttgtttttatttttactggaaagtttcagatatgaagtaataatatagttttgccgtacaatggttcagtttcttgccgtttgaaaaaaaaaaaacaatctttacacaagtggctaacagaggcgtgatcactctgctgcaggtcctgtgccgagcgctgggcggcaagacgggccgatcgaagaagggctgggacatcggcgtgaactgcatccaccccaccgcggccatggcgaggctcttttcgccgatcaagctccccgtccacatgcccatcatcgagttccaccaagatgaggtacactttttcgccgtttcgttttcaaggtttgctctgatcaaagcttcagaaatggtcaatgacctgacataacttacatggcaaaatgcaggtgtgggagctgcctcctcaggccgaggtgctggcgcggtcggacatgaccggcgtcgagatgttccgtctcggcgaccgcgccatgggcgtccagggccacccggagtacagcaaggacatcctcatgagcatcgccgaccgtctcctccggaacgatctcatcctggtaagctacggaattgactgaactctctgtggtttcttctgtctactactgtagctggtctgaaaaactgaagatttgtgttgattacaggatcaccaggtggataaggcgaaggcgagcttcgacttgcggcaaccagacaaggatctgtggaagaaggtgtgcaggggttttctgaaggggaggcttcagtcatcgcagcagccgcagcagcagcaacatcagaagcagcagaaggcggcgcagctggtgctatagtaaacaagattagtgagtgagatcagatgggggcattggggagcctagattaatccttattttctgcttcagatttgtacaggaaaaaaactatttattcggagcaataataagagagtaattgggggtggcctaattagcaaaatcccatttgccaatcaattcccatcttccatcctacattttcgtcacgcggcacataacaaaacgtacttacatggatgctcgttcatgtatcgatcgtcagtactgtaggatgcttccaattgaaaccgagtcccttttcaacttttccaagaaacaaagctgtgtccatccacagcgcccaaacctgcaaagtacaaaaacactaactttctctttggcgtcatttcaaaagacccaaccaaccaaacaaaacaagccagtaccaagtccctctcatggctcaacagtgttgtgtttgttagttggaacgaacgaaggacattgtcatcatttgggctacagaatccgctcggtttcttggccgtcctcatcgcgcgagagagtctgccaagatccaagattccggcggctccccggccacgcacgcgcccatctctcgcgaacgtgacgccgttgcggcgttggtgaggacgaccacaacgcaacgcagcacaacacaaacgcggtagaaatgagttgaagagatgtggccagccatggccatatgtggggtgcggggggttagtgtagtatggacaatggaccaccggcggagcgccgttaagctggtggagacgcgcgagcgagacggatccacgcgcagccttctccgtaggcagagggattccgggaccggcggccggtggctcatgcttggcggagggggaccaattgatgcaattgaaatggagatagctacgtaacggtattccgtttaaacgggatgatacttcagaggtactccctcctctccgtctcataaaaattatatttctagctccaagtctttgtcctataaaaattatatttctagtcatgtggggcccaaccaattgattcatctatataagtttaatttgggctgctaatgcttgtaattttattaagtatgctaattatatgggttaattctctcaaacttccttttaatcatttgtatatatggaatgtgtgcatgcagtgggttcattaaataagttattgtggtcatttttcaatcctactattttatcctaaattagctagaaatgtaatttttatgggacggaggtagtatcatctgatgtgtggatatcagccgatacctaccaggtatctgacaatactttagaggtttcatctcttctgaacggaatatcgtcctgtagcatttttcattgaaatttactccgaactatttagttttttttagggggtggcaattaggatatttatagagtggaaataagattctatttgctttactactttatccctattttttctaagggaaaatctgctctaggacactttaggctttattttgttgccaattccaaccttacttaacttgatgccttacaaaatttagtagtatttttgagaggaaagtttcggaagtaacaaattttagtagaatgtcattggtaaggtaatgtttagttcgttaccctactaaaatttggtagcactacaatttaatacgtcgaaagtggtaacaacgtgaacatgccatctcactttgatgtgaagttgaacgagggttccatagcaatgccttcaaaaaggtgaacggcgctcgagggcattgttgtcgctccaccagcaagccgagtaagactttcacctcagagtccccatacaaccctagcatccacaacgaaagccaccaaatttcacatacacaccgaagctacctgcactatgcacactaccacctgcacaatggtcggactggtaccattgacaacctgctctgccacctagccagacccagggagccaggtcgtcggtgctactagatgactaccaactagacagtcccctcacagagaccaccatataacctggatgtggatctacagaaagagaggagcaggaggagggggggggggggggtagggagaaggaaagatgggctgcaggaa

SEQ ID NO: 74338 - DNA, 11496 bp, Oryza sativa
ccgtcatgtcgacaacagttagataggctactccaaatattgtactggtgtgattatcatgaataagagcaataccggcttcggccaacaggatgtagggttattacctgacaattcaggggcccgaacctgtataaaaatcctcgtctccatctattttacctcagtctcgcatatatcctagcactgacaatccacataccatgtaataccagaattgcgacatcaaacgccgacagtggcgcgccaggtagggggattttggtgcttcaggatttcgacaagatgggttcaaaagatggattctccgacaacgagctactcgacgacttcagctgagggggagatccaacctaaccagatcggagccatcatcgtcatcgacaacttggtctatcgagatcatccaagcctcaagctccgcggcgtaccaaaagatgtcagatcgcatgatatcgaacgagtacgcaacaaggtaattggtagattggttttttaaattgatctactaatttcgtaaatacatccggcatgtatctacaaaggtacgcaatattttatctgcaatttatcgtacctattcagatcatacagtattgtcagatctataatttattatgtttacccagagcatgttctttatacaataatatttgttgcgcgggtatccccgatgttaaatcgactacgatctaacgctgggggctcgctctgtctttttctgtataaatcatgcttgtttacggtttacataatgccctgacatttacatctgctcgttatatcctgataatactagaagatccatgcagtttttgagtacatactcgatattatctgctatatgtcttgtcttctagaaaatatttttcaggaacaattgagcactcgagtaggttgtggtcaagtacaccgcattatcgagaacgatctcaacaaatgcagagttgtcgcgcccaacctaccaacgaagaccgacgacctatctcatagcaccggccatggctggactactcgagaaaaggttgttaacggataattcctcgcgaacaccgtcggcttggtcacccgacatgattgcgaacggacatccagatatgctacaagttgggtgtgtgagtcatgctggccacatgagatgcacataacccaactctagcgcctccattggtgttcgagagataattctacatgttcgctggttctcgaaccagcacgtagcaatctcttgcaccgccaacctctattggtgtccgagagataactctactcgctcgctggttctccaaccagtacatgacatccctcgcaccgcaacctccattggtgctcgagagataactctacatgttcgctggtcctcgaaccagtacgtagatttctctcgcaccgcaacctccattggtgtccgagagataactctactcgctcgctggttctccaaccagcacgtagcaatctctcgcaccgcaacctccattggtgtccgagagataactctactcgctcgctggttctccaaccagcacgtagcaatctctcgcaccgcaacctccattggtgtccgagagataactctacacgttcgctggttctcgaaccagtacgtagcaatctctcgcaccgccaacctccattggtgttcgagagataattctactcgctcgctggtcctcgaaccagtacgtagcaatctctcacgccgcaacctccattggtgctcgagagataactctacacgttcgctggttctcgaactaatacgtagcattctctcgcaccgccaacctcattggtgtccgagagataactctactcgctcgctggttctccaaccagtacgttgcaatctctcacaccgccaacctccattggtgttcgagagataattctactcgctcgctggtcctcgaacctctcgcaccgcaacctcagatggtcgaggtatgactacagcaataacgtagcagtcctcgcaccacgacttcaaatgatcgagagacacctactcactggttctcaaccagtcaatcgtagcaatctctcgtacatttacttctagtggtcgagtttagactacatctagttctcgaccagcggtgtagcgattctcccactatttctacttctagtggtagagttgcgactaccacctggtcctcgaccagaggtgtggcgattcttccattacctctactccaacaaagttgacatcagatacacaatatcgccaagtgttttacccagagatcccttaccacaaaagacacatagcgttgaaacctatcctactgttcctttacgccgtcttgacaaggcctccgaggaacctaagggaactttggctggggacgcccagagccgataaggccttgtcggattcttcagagacgaaagaccatgtaagatctggtcgtgtaagagttctcgccgtgcgtattaaccaagccgtgtaatcggaaatggattttccaacttcatggctgggggctaggatcagtgcttgttcaaccgaggcaggtcaaaggtccaagagccttgtcatccgagaacgattctccgacgacaatgctgggggctagggagagtgtatgactctacaaactgactgatcggagtcggtaagagataagacactcatatacaaaacactggtctgtacattcaattcactagtctgtcatattataacatgttaccctttgagcgttcgctcgggggctatttctatctaatattcttttcttagtattgattttaggaaaattctattcgacattatcgaagatcgcatgtctctatggttctacaccaagatcaactaaggcgaatacgacaaatgttgacaaggctctgtcgcagactctacgcctactcgattactcgagaacggttcgtggatctcgacgaggaatacggaatgaagagatggtgtacccgccgagataaaatttcttgacttcaatccaaattctcgattgcagcaagacgggagacttagtcatacgctctgtactttctcggtcgacatcagagattgacttagacaaaccctttcggtgcccgcacgaggctgataaaggaagtctaacattatctctaaactcaccgagaacggtcacgtgagctcgataatagttcctccaaagtctgcggttgagaatatgaactcgttcatttgcatcgaagtcgggggctactgtcagggttatggataccacatacctaatagtagttgactaaatctcggcaggatccaccacataccatgttttatacggaaactgacctcgagggagttccggataaggaaagacaaccagagttctacatggaaacgacaatgactactcatattgtatccatattggttttcctagttctacttggacaaggggacacctatgggtataaatacaagcccccctaggaggagaggggacatgagagaatcaacacccaccatggaggatcaacacccaacacaatcgacatagaagccacaacatagaagcctacatacgccaagacacgccgccggatattgacttcagggataagcacggctagtaccctacggtgtctccggatactgtcaggagagacgaaagcgccatctctgatctcgccgggcacgaattcgaggaggaaggctaccctgttgtcgactacgagttagatcgtcagaccgtcatgtcgacaacagttagataggctaccccaaatattgtactagtgtgattatcatgaataagagcaataccggcttcggccaacaggatgtagggttattacctgacaattcaaggcccgaacctgtataaaaattctcgtctccatctattttacctcagtctcgcatatatcctagcaccgatgatccccataccatgtaaatactagaattgcaacatcaaacgtcgacacttttcctgttcttggaattattcatagctcgagcaattctgttagcaaccaaagccaaatcctcctcctcgatttgttcgagttgatcatcggatgtggcattaaaaacagcaagaaaagaaggcttagatgaagaagcatcaacatccgaagaggaagacgaagaaaccaaagcactcgacttagaatcaacttttcgagaaagaacattcatctcatgtgttttcaattttgtgtaaagtgaatccaaagtcaaagtagacatgttaacagactcctgaatagatgtaactttcatcttccaaatagacatgtcaagatcattcaaaaagtgacgagaaatctcagattatggataattagcatcataagaagaatcaacagatctaagatcactcaaaattttattaaacctagaaagatagtcatctaaagcttctccaggtttcatctcaaatttaatgtactcctttttgaaaagatctcgacgaagttctttaatgttattagttccttgatgaaaattactcaaaacattccaaatctcatgagcagtttgaagatgagcaacacgatcataatctgaacgagaaatcccactcaaaagaatattgcgagctttgcatttttgttcaaacttagtttttaaagcagcagtattaatctcttcaggaatcacataaggacgagaaacttttctccaaatatcataaccttcagccataatataagattgcatcctactacaccaatgagaaaaatccgttccatcgaaaacatgaggcttagttgaaaacctagcgggagtagccatgacaaaaactctagatcgataaaaatccaaagaagaaaacaaggctctaataccacttgtaggatcgaaacacaagaactaagccaaccagagggggggtgaatggttggtatacccaaaaaccgaaaacttttagcggaaataaaagttaccctcgaaattgacggaagtcagtctgaccggtgttgatcttctggttggaccgccctggaatccctgtcgcgcctgttgtcgccgccggtctgaccgcaggtcacccgccggtctgaccgccgtaatgccgccggtctgaccaccgtgtgtcgccgattagaccgcaaaaacccagtgaaacacaaatcgaagaactctaaaagtggatgacgactttattgattctctctgtgtttacaaagtgcaccaacagcactccttatgaaaattttgactaaactcgaaatcctaactcaaaactcaactcaattgctctcaaaagcgataccgggaagcctcacgctccccctctatttatacatgaggtaggcagcctaaagccatgaaccaaactcatactaagagtcctaaacaccttaggaaaccctctagtacaagaaacaaactttacataaccaatcgtaccaaatttggactccttccaaattcgtctccgcatcccatacgcacacaatacctccatcgtatgtcatatggaatctccatcaaccacgtgcatcaactctagcctaagtatcccgcatgatctctaaccaccacggacgtcgtcttatccccaagccgactcccgatccatcaccgcaaatactctcccgaggcatcaagtcacctacacatgaaataaacaatgaaaccatattccgagaccaagctatctccaacttgactcattagtagcaaacaacagtattacatacgtatagtatccatctagaagtcataattatgaaataatcacggatatccaaacaaacaacccgaaactgaaaccgacacagcgtcggccggtcagaccgcgggctggcaggtctaaccgcgcgcataccgccggtctgaccggctatcagagcccgatctaaccaatcacataaaataatataatcctgcgatcacctgtgaatccaatcgtctccaaaaccacttcgtgaataaattccaaataacaaaaccaataatctccaatgtccaattgttcatcacagaataataatcaaaaacacctttgattttacaatatatcgtgttcttttctcctgaaaatgaagatgaagattaagattaagttttttacgcaaaatgatgtgatattaacatatcattgattgtgttttagttattacaaacttgataaatagattaatataatattttagagtaactttcatatagaaaatttttgcacgaaacacaccgtttagtagtttaaaaaagcgtgccacaagaatcttaatcttcatctaacttttgttggagaaaagaataggactactgcatgagctcgggctacttttaactattgctataagttccaaccatgatcaagaattcaagatatgtgcctatgagcatggaagaaatacgctagagaggataaggttacaatcaaagtaggagagaagctctcaggcgtggaagaaaatatctcattaatgtggggaggagaagtgcttgctgatgggaggtaacatggctctaagagcaagttgctgagatggaggagataagagaggagagagagaagaaacggactgtaaacttagaggcggtttagacacaagaaccaagaaactctgtaagagagacaagtgggtctatattaattgtaaataaccttatagccaacaaatcggctgtattactagccttgctttaatagttcagcgattctagaacgacttacgagaaataaggctacctagtctaataattacccccctccattttaaaatataaacataatattaaggttagaggaaagaattcagtggatgtgcacactccttaagaaataatttggctaaagaacaaaagcaagaaacttagctacaaaactaaaatcatctataccgaaaccttgcttttgatgtccctattggaaccttgatgctttgttatgctaaacttatatttaatactaattacataattacttactcttcgttccctaattgttttgggtaccgatgaccactctgaacaccctagctaggtccgccccaaaagaaaaaaaagatctcactttactcacctcaatggttaaaatttaaattttgaattacttgtactttcgtcctaagcacttgattgactaaatatttacggattttatgccctagaatcaacgcctcaaaaatatttatgttgtattatttattttcaaattaaaaaaataccatatcacgcgacttaaagtaataaaacctaccctaaaatgccattagaagaacaaagggccatcgacccatcgtagggagagaaaaaaaacagtttgctactcataatttgatactaacaaggatactttggccgagattagtttcaaaatttttcttcaaacttctaatttttttatcacatcaaaactttcttacacatataaacttttaaatttttcatcgcatcgtttcaatttcaaccgaactttcagttttagttttagtgtaaattaaacacaccctttttacttacgtgcggcctctattccctcccgctttatcgcacgtcctgtttcccggcctgcttcctcgcgcgcgcgcggtcggtgagcgaccagaagaggttttgatgccatggctgaaactgaaagcgtgacctgacctcccaccaactccccccaaggcggggctagtcgatcgagccatccgattcattcccatgacccacgcgcggcgacaagtcggccggtgatttcaccgtaccagctgcccccccttgtagtatcacgttcgaacggtgcgcccgccgatcgagcttgcgctcggtgcgccagcgcgcaagaaaatcgccgcgcgacgaggcggcacgcacgggatactgcgccgcgcgcggcttccgctcttccgcggtgggatccccaggcgtccgccgcccacaacgacaagttggcacggctgcgcgaaggaacgaccagcccagccggcaggcagcatagcagcagacacgggcggatttcgtctcggcccgcgtcagggcccggctgttcggcggatgtcgctggctggctcggtccatgcaaacaagtggaaagtggcctatatctggattgagcctggccttgtcaacaagataggccttgtcgctggctcggtccatattgggctttcgggtgtgacatggaagttcgattcttttcttcaagtagaactggtggcactgttaaaaagacaacatgtttttttattgatcatttgcttctacccctggggacagtgtatagcataggttgttcataccatacggttatatgggaaaatatataagtgtaaaccatatatataatgtaaacccgaaaactatcgtacaataaaaaaaatggacgtctgaaattgtccacgttaccctgagtgaaaaaattattttcagatttaaccatagtaaaagttttaccatgacatggataagcattagatgcccatatttttatcctactatagtttttttttgtaacatatatgtgatttacaatacatattttccctcaattatataatgctatgaagaaatggtcatatgtctaaggatagcatcttcacggtggaaactgaactagagaaaatgaccgtttacgttctttatgaagaatataacatggcatgttcaagacaatatgtacattgtgtgaaccagcagtttactgtttatttttttagtgcaacgaaaaagggctataatcttttcagggtagggcaaatagagaataaataacatttttttccttgtgaattactcctatcaattactttacttcgttaaattcagaggaaacataaagttgataacattgagtatttaatacaaacacttcataaaccagagaaaagatcaaaattatggcatgaaggaatgaactttcagaagtcagaaactgtgagctatagatagactgatagagacattaaacaacaattaatttcatgccatctaaatttgagagactgttgccattacattacaactaagtgatagatatactcaagacaggacttggcatttgaaagtcaagagactggcatgcaaattagcaatgctcaagacagcatgtacatttgaaagtccaagaaactgaacatcactacatgctacttctagagacttttgcagattagcaatgagtaaatggagacaataactcagaccaaactgcaatattgagacctacaatgaaacaaacataacatgtattttacacgattgttacaaattcgttcgccccatgcttggcccagaaagtcttcaagtcaattggaatagcaaggttatacccctcaccacttcaccagtcaccggctagcttcctccttccagcaatacatgcaccccatgtttagttccaaagtttttttttccaaacttttaactttccatcacatcaaacttttcatacacacacaacttttctatcatcgtaccgattttaaccagacttccaaacttcagtgtgaactaaacacacttcagtgtgagtcattggtagtggatatgtcgaaatagaagttgtgcaacatgcaaactgccagccacctgcaccccaacgataccattgctggggggatcagtgcaagagctgctagcacacaggtgttgctatccttgaaagatccaaatcaataaccattaattaccatccccacagtcttctcgtggatgcatgcatgttatgtttgaagctttaccaaattttggtgtggtttttaaagagtgaaagtttctacaagattccaaaatttaggatgtattgatggttgaaatattttttgttcgctgataacgttgatttgggcaacaaattaaataggcacagtaaatactggagtatttgaacaactttgtggtaatccttgcacacaagtcataattcgtaatactccccttttctcaaaaaatagcaacttagaccgaagaagacatcacttagtagtataaatctgaacaaactatcagttatctactcacgtaaaggtgattatccagatttatagtattagataatgaaattgctatatatttatcgacaaattttctcttataaatttattaaatgtaaatacaatataattgtaattatattgtaacttttatgcaactatattctatcttttatgtaactgcaatgtaaattgaatgtaacttttatataattttaaacttgtatgtaagatatgtgtaagttagaaagaaaaaaattcgtagcgcgcgtgggagaggagattcggtctcgcaacctcctcttcatgaaaacagcgtgttaccataggagttttgaaagctgaatagaaattgtattatagtacaatataattgacaatattattatattataattatactgtatttatatctgataattttttatcgataaatgtcctagtctccattccaaaacaaattaacttctaaagattaatttgaataagcatttattcatttaagtttgtctcaaaagataaacaaagggcgtatattcagtaggtggagtacgccgatgttacggcagttcgggaatgtacccgcagcttctagaaccctccattctccccacgtataaggccgcgccccgcgatccaagcagcagcagccatagcccccgccagctcgccgccgccgccatgttcggcgtcgtcttcccggaccacagcttcccgctcgacgtcaccgccttcgcgcaggtggcgcccaactcctgggcgctcgacctctccacgctctccctcgccgccgccccgcgctccgccgtcgtcttcctgctcccggccgccgccgccgcgctcccgccggggaaggccgtcgccgtctacttccagcccgccgccaaccgccccttcgcgttcctcggcgcgctcggcccgggccgcccctccgcgagcctcccgctcccggaggccggcgacgaaccggagccccccctcggccccgccaagctcggcgtcgccgtggaggacgcggcggcgctccctccgccccccgacgggcagcgcgccgagcgtgtcgcgctccgcgtcggcgagaacctgttcaacttcatgcagtcgttctgcggcgccgacggcggcaagctggtggtgcccacggacatcctcgaccggtggttccgcaagttccaggagcgggccaagaaggatccctcgtatctcaagacattcgacttttgagagcgaaggtacagaacagccttcccggtttgcatcgattcttcctgtaatcctgttttttttttctctttttgttcccctttggtaccaaatcgtcaattgctaatgtaattagtagttagtgttacgatgctacagtacaatgcttgtaactaatgctagtcttagtgcagtaggactaaaattagttttagatcatgatctcacattctcacagacggggacaatgttggagattttataagacaatgtagtggactagtggtgaacatggtatactttgggtatgcatgtaccggtgtatcctagaggcccaaattgaatccttgtgtaggccttgtcggttatacaaggattcaattcggccgggaatgacaagtatagtaagaaatt

SEQ ID NO: 74339 - DNA, 5676 bp, Oryza sativa
cgggacgcagtgacacattgctccccttagctttgttcggaccggaaatgaaatttggttagaacgacagtaaaaaccaacatttgtgttggaaggcaataggatgaacttcttgtaatgcgcgcccttcagaaatggcaccatattgtcttctgtggcatcgggatactggtcgagccatgtgatgtttcctttcccagggtcgatgaatccagtatagtaaaccccccgctgtttctcatcaaccaggactaaagatattttcctgctattttgaaattctttttaaacccggttagggttaagaaccgggactacagataatagtactgaatattgaatttcattacatatgtgtttctaaaatagtaaataatgcattaaaattatttaaagtcaaaaaattaatgacaattacttcgaaaaattattgttgtctgtagtaaattaagtggataaaacgtaataagcaattatatgatttaaactagttaaaaattctaataatcatatataattagcatatgcatgatattaaattgttaaaaattctaattaacatatgtacataccacatgcatgatttaaaattaataaaaattctaataatcatatataattagcatatgcatgatttaaaattgttaaaaattctaattaacatatgtaaatgccacatgcatgatttaaaacttttaaaaattctaattatcgcatataactagcatatgcatgatttaaaattattaaaaattctaataatcatacataattaatatatgccatacaacaattgatttatatggatattcaatacatccaaaatagttcacatcgtgtacacaacaattacggcaatacatcggcgatgacggttgaccgcacgtactttctcctcactattgttccttccttgtgatcgctacgtgagtaaggggtatcttcatttgataggaggatgctagggtcaatcgtcaccgtgaaagggggttgcccatccaactgatcgtaatcctcgtcagtcttgtcctctactccgacgatttttcgtttgcctgggagaaccacgtggcgcttcggctcgtcaggccctttgcccttccttcctttgctagacatatccttcacgtaaatgacttgcattacatcattggcaacgacaaaaggttcatccaagtatccaaccttgttaaggtcaaccgttgtcatcccactttcatcaatcgttacgtctccactagtcaacctaacccattggcaccggaacagagggaccttgagaggaccatagtcaagttcccatatgtcctcgatggcaccgtaatacgtgccagttgttccatcgtgtcccatggcatcgatacgaacaacgctgttttggttcgtgctcttcatgtcttgggctctcgtgtagaatgtgtacccattgatatcatatccctggaatgtcgcgagccagatggtcccctcgctaggaaggccagttattggttgatcgtctcgttacccatgagatgttgtcgtagccacgcggggaaagtatcaatgtgatgccgtgtaatccttgcatcggacttaccgatgtttccggcgcgaactagagccaagtgctcctcgatgtaaggagccaccaatgaagattattgcagaacagtgaaatgggctttacggaataaattgttgtctaccgtcattattgctttccttccgagagtcccctttccccgtagtctcccttcatggcgtgattcaggtaccccgattaggcgaaggtcttaaataaattttacgcaaaatttgatgacctcctttgttccataccccttggcgatgcttgcctctggacgagcacgattacgaacatacttcttcagaacgcatatgtacctctcgaaaggaaacatgttgtgtaggtacacaggcccgagaataccgatctctttgacaaggtgacaaagcagatgcgtcattatattgaaaaataaaggtggaaatatcaactcaaaactgacaagacattgcaccacatcattctgaagggcttctaatctatccggatcgatgaccttctgcgaaattgcgttcatgaaagcacatagttttgttattgttgcccggacattatctggaaggataccccttattacaactggtagcagttgtgtcatcaacacgtgacagtcatgagactttaggtttgtgaacttcttatccttcgtgcttattattcgctttatattcgtggagtatccagacggtaccttgatgctctccaagcattcaaacatactttccttctctgccttgctaagagtgtagctggctggactgaagtaatggcttcctttctcctttggttccgggtgaaggtcgccgcgttgttccatacacttcagatcattacgtgcttccagtgtatctttcgactttccatatacacctaggaagccaagaaggtttacagaaaggttcttagtgaggtgcatcacgtcgattgcgtggcggacatccaagaatccccaacaaggtaactcccaaaatatagagttctttttccacatcgccgcgtgaccatctttgctctctataggctggtttccaggcccctttccaaatactactttaagatctttaaccatagcaaacactgttttcccgctgcaatgtttaggcttcgtacggtggtccgccttatgttcaaagtgcttgcctttcttttgtacctggtggtttgtggcaaggaatcgatgacgacccatgtacacaaccttcctacagtgcttaagattcgtactttctatttcatccatacagtgagtgcaagccttgtaccccttgttggactgcccggaaaggttgctaagtgcaggccaatcgttgatggttacgaacagcagcgctcgtaggtaaaactcctcctgtttgtcctcgtcccacacggggacatcttcctttttccacaacagtttaatatcttcgaccagtggtcttaggtacacatcgatgtcgttaccaggttgcttggggccttgaataataatcggcatcattatgtacttcctcttcatgcatagccaaggggggaggttgtagatacacatcgtaatgggccaactgctatagccgctgctcatctctccaaaaggattcatgccatccgtacttaaaccaaaccgtatgtttcgtgcgtccttttcaaagtctttaaattttctgtcgatgtttcaccactgcgaaccatcggcgaggtgtctcagcatcccgtcctgttgacgttcttcagcgtgtcatcgcaacattctagcattccccttgttcctgaacaaacgccttagccgtggtattatagggaaataccacatccccttagcaggaattctcttctttgttagctgcccgtcaacttctcctggatcgtcccgtctaatcttgtatggtagtgctttgcaaacagggcatgcttctaggttctcatactcctccccgcgatataggatacaatcatttggacatgggggaatcttatgaacttccagtcctaacgggcagactatttttttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcaccttcgcagtcttccctggcgtcctgcaacatctgaccaagatcatccacaacgtcgttaccatcagcagctatttcctcctcgcccgtttgatttccttcaaatccaacatactgagcaaagttcggaatattgtcgtcttccacttcatcttcttccatttcaacaccttgctctccgtgggatgtccaacaattatagcttgccatgaaccccgactcaaacaagtggaaatgaatagtcctggatgcagaatactccttctgattcttacacttattgcatggacaacaaataaaacccctttgcctgttagcttcagccactctcaaaaaatagtgcacgccgtcaataaactctttggaccgccggtcagcgtacatccattgccgatccatctacatgagtcaaaaaaaccgcacacaaataattattcttacaataatgacagtcatacaataattataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagtaattttgaagcttgctcgggcagctggaggaggaagaagacatatatataggggtgggactttagtcccggttggtagcaccaaccggggctaaagatcaccgggatctttagtcccggttttaagatcccgggggggcctgataggtcctgacagcattcgaaccgggactaaagatgatctttagtcccggttggtaacacaaactgggactaaagatcaaatatgcccgtttcccttttgaaccgggactaaaaatcatctttagccccggtttttattgcatccgggactattgtggaaatcggccgaccgacgaaagatggtttctccaccagtgaatgaaaaataatttataaataaaatttttatatacgtaaacttaacgatctaaaaacaaaggctgaaaaataaacatatatgaagaaaaacctaaatttaactctaaattcaagtttgaaaaatccgtttttggttgataagtataaagaaaaagatgaggccgtgagacttatctccgacggaatatcacataaccatgcacatatatataaccttcaaaaaacattccattgccatatggaaatattaattagacccaattgaactttttacagctgtgactgcttctacattttactagtttactaccgtgtacaaagtaaactactccagtatataatactacggaagtttctacgatgaaatctgcaggaatctaattaaaaatgtatccattcatgattcatcagtggttcagtgtttgcctcgaatattactgttcaaaaagtatattttgttgttatcgtgccgtacgtacatggaacgtgttaggtactgctgccaatgccatcgcagtataaaaaattaaattaattgctctagctacagatctacacacagacgaggtaaatccatttgacggtaagtgtttatgcccctggtgactgtcacggattatcaaataacgtgacatttaccaaatttatatgccgaac

SEQ ID NO: 74340 - DNA, 10292 bp, Oryza sativa
  unsure (1)..(10292): unsure at all n locations
aaaaacattggaggatgaagttactaaccttttagacacctccaatttgtatataatcactaaaaaaatttcacaaaaaattttggcatgacctcccctctttctttgagaaattttgaagcttgctctcgggctggaggaggaagaaggcacatataaagggggatctttagtcccggttggtgttaccgatctttagccccggttggtaacaccaaccgggactaaagttaggatctttagtcccggttggtaaccgggactaaagatcccgggggccatgacaacgtctgacatctctacaaccgggactaaagatgatctttagtcccggttggtgttaccaatcgggactaaagatcacatatgcccgttgtagccaccaaccgggactaacgatcatctttagtcccggttttaaaaggatccgtgactattgtggatttcggccgaccgaccaaagatggtttgtccaccagtggctgtatcgctgttgttggcggctctggaaacagatatgattattggagtatatacataaaaataaatttatttgatttattttgaaaaggttttttatagaattattttacataaacgtactgaacagtgtagtaaacatgataatcaagccttgtttacttggggaaattttttgagtttggttttcacatcgaatatacggacacatatttaaagtattaaatatagtctaataataaaacaaattacagattctgccaggaaactgcgagacgaatttattaagcctaattaattcgtcattagcaaatgtttaccttgtcaaattatggcgcaattaggtttaaaagatttgtctcataatttacacgtaatctatgtaattattttttttttatatttaatactctatatatgtgtctaaatatttgatatgacagcgtgaaaattttagttctgttaactaaatatagagttacccaaaccgatcgaacagcccaaacgaacgggcccagtctttcacatggaagttaacgttggaagtggtgccgagtcccctgaacgggcactgcagaccatttgactatcaaattctgtggcggctttcgtaatttcattatttcttaaatcgtaattctgacacattaaattacatatatttggatgcagattgtttcggacaatgacaatttcatattgttggacaaccaccaatcacggctggtcaccggacgacaaaaatgtacgtatacgtccggcgaaagcactaaagtactccatgtttctctttacaagcctaaatatgactaaatcttgccactagcgcatgtagtagttaacctaacacgttgcttcagatgcttcgatctatgcagaaatcccaggcaaattaagatagtttattccccagtaacgtcttgttcggttaatccctctcacaatggtattgaggggatatgaaggggatttattccatctctattgggaatggaattatttatcctcaatctcctccaatctctattttttgggattaaacgaaaaaaggtcaaactgtaacctcttctatatccataattattcttgtatatttttagtggtcttggtacaagtacgaaatttttttttgcacgcgattgttaacctatttatgcatgtgtttttcgagccactgcaactaagagccaatagctatcgaggttttgccatagaaggattccattactatccattaaaatcaattttttataggcggctctaacgaaccgaccataaaatgaaacttctagttttacttttttagaaaaaagggaaaattgatgccgtatttcacgaggcatctattcatgcaagttctaagtcacacgtgagggaattttatactcaaaatatgcgaatctagaacatctctctctatgcgtatccttcttaccatcccatatgatagcatgacattggcacatgttgcacttttattttctcattgacatgaatggatataaatcaattgccaaactttaaaataatgttgattataattaatagatttgtcatcaatcatcaaaaaatgagagattataagttcaagtgtttaagattgttggtttaggtatcttaatttgatgattaatgataaatctaactatatgaggctaatgtttttgtgaacttttcttttactagtcccatttgaatatgaaaatggcatgtaataaactttccatattctaaattggtctcactcgtggatccaaaacgtagggtggacacattcatttacttatttgattatgtgcatacatgttcctttatattcttatgtttgcacatcttgaggggagctcattctatatattgatctctaccatgatttgaaattatgtcacctcatttatatattgtttacatcgggttatcatccatcaccaagaagagaaaagattaaaagatcgtacattaaataatttgcgtaattatggctttggtgatttatagtaaactaacttctatcggaagaatgtattgacgatagaagcattctatatggaatgttattagttaagtctggtgttattagtgtttataatgagcagcactttagcaggccggtgtccaaaacttgtagcttgaagatgtcaaaaagataagagaaacccactatgatatagccgtgtagccctaggaagggctctctgccgtgctgccttattatgggcgttcatattcattatcatggagtttgattcctccatgtagtatgtcacgtcctgataaattcattccgaaataaaattcattttctaaaaggaataatagaattaattaaaatttgaaaagaaattggcaaacactaaaatacgtacaagaaaaattcgaatgtggtccggagaatttttgttaaattctccttggtctaaaaggagccctcaaattttacttgaattttcagagcaccggaaataattattaagcaacaaaaacaattatcaaagtttaataaaaagaaaatctaaaaataatcctccttttcctttgggccaagtctagcccaaagcctccctcactctccctcggcccgcggccgaagtccttccctcctccctctctttttccttccctctctctctcttgggccgccctccctccttccccggcccactccctcctctccttcccggcccaccttctcccgcctcctcccgcctgggccgccgcccggcccaagccgccccacccagcctaccgagccgctcccctcccgcgtgcgcacgcgcgctgacgcgcgctgcgcgcgcccgaccgcgtggggcccacgcgccaggccggtcgcctcctttctcccggccggcctccttcctctctctctctctcccgtgcaaacctagagccgttcctcctccaaatccgcgcaaatcaaaccatggattccaaaattaattggggggttttaaatcccattgattcctcttcaattccccccaatttcccccttggatcgtgcccccaatcgccgggaacgcccgcgtcttctccggccgctttccatggccgccggccgccattcccgtcgccgttccaccctctcccgtgctcggctcgcttccctccgctataaaatggaatcccctcgctccgttctatcgttttagccccctcccgcgatctctcgtggtccctagccacctccccgccgtcgtcccctctctcccgtgccgccggccgtcttcagccgcccctgccgccgcgttagcacgccggccggccgtgccgtcgcctcctccagcgtcgccgccacctcctcttcgccggcctgccctccgtttcgcgcggtgaccgccggaggcgcgttcccaccgtcgcccttctctttcctccgcgccggccgcctacagccggctttccctcctcgcccgagcgctgcccggccgtgccgtcgccttccccggcgtcgcagccgcctcctcttcgccggcctgccctctgttttccgcggggacctccggaagtgcctccccgccggcgacagtggtgttgccgccactgttccgccttcggccacctctgccgcgtcgccggtacgccgatcgacgtcgccatctcctccgtcgacgtcgcagcgttgtcctcacctccagctgctcctctgtttcgccggaacgccgtcgcccgtgccggcctccatcctcgtcgtcgccgacgtcccttcggccgccccgttcatcctcgccggctcgtcgtctcgcggcgccgcctccgtcgtcggcatcgcagcggcgtgttccacgccagcctcgcctccgtgcagccgctgccggctgccctcgtcgccttctcgccggccccggtcgtcgtcgtcgtcgtcgtcctctcgtcgtcctcatcgtcgtggcgttcgtccctccgtcaagccgttctcgttcgtcgtcctcgcttcgtcaagtgctgcagccccgtcgtcgtcttcgtcctcggctccgcgtcgtcaagcctcgtgccggccgcgtctcgccttcgtccaaggatcgccgccgaagccgtcccctcgccgttcgtctccgttgtgcccgtctgtctccaccgcgcccgttcgtcgttgtcgttcccacgcctcgtcgcgtggtggtaaggatccgtcctctcgctgccccgtcctcgtcctttcggtgtcgccccgtacccgttgtgcggttgtcgaccccggtacccgtgtaccggtgtcggtagtcgttcgcttgtgcgtgtggtgaccgtgttagtgtgcccgctcggtagccgcgtggtttccacgtgtgcagcccgtgtggtgtctagtggagtccgtttgttggccactcgcctcggttgacacacggggtccgcttccgtcgacccgtggaccgtctctgtgtacccgatctaccgcggtcctttaggttgacatgtggggtccgcatgtcaacggcgcagccttcctgtcttttccaggctagcgcttacacctgttttatagttgcaaaacctaattacaataatccgcaaatctccatataacagcattaaacttcggatgatcatatcttggtcatacgagctctgaatcgacccgttcaagtctcctaatgtttgtataacctaaagaaccctgtgctttcttcttatgtattgttattgcttctttttaggcttgtagctttgcttgtgtgcttcgcgtagctttcgtcgtttcggaggttcccgaagcgtggttcgtggtcgtcgccgaaggttcggaaggccgttctctctgagcaaggcaagtcacatcatccttgagcatattgaatcccagtttataaaattattttaatttaaattaatgcattaccgctttatttaaattcccgcgttatcactgttttatttagccatgcctatttacctttgttatgacattattattgctattgttattattaccttgttcaccctaggataaacaaaaccccaactagtgggtactctatttatggttccactagtatgaatttaggtagatgcttcgctgattaattaggcaacattaggtggttttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggctggtgtcctgctgctagggggctcaatcctgcctgcctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtaaaacctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacgaccttgattaataatactgtgtagctttaggatcgtctttttaaaatggctttgggcaactaagtgacttttaaatgctgttttctgcaaaacttaacccctatatcattaccccttgtacccccttgcattaatcgtgcatccgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgatggtcaggccttaagtgcctttgtaataatgtaaatattatcgatataataaagatgtgccttttgtatcatgtttgttcggtgtaccccggcttttcctgggacggggattaatacactagcattcgggaaaaggtaattttctcggtcgcgacaagctggtatcagagccatctcgactgtaggataagcccagtggataaaaacctaaggacatattttataaataaaactatttgcgaaagttcctctttttctccttcccctaatgctatttgcaaaaggtttacccttttcttccgtcttcaattttcaactagtactagatggtcagctttgcgaagaagaagatgtcgtcagtcgtttgccgaagctccggaagactgcaggatccgctagcgaagcaaaggaagtagtgaagccagctgtgaagcaggagtgaagatcttggagaacccgtcgcagaacctaagccaccctatagggtagtgttgttagtcgtgtgttccttgcttgtgtgtgtagcgcgtggtttgcatcggtgggtggtgatgtaaccatgcttggttgtttgcttaatcaacttgcagaataagtgaaacaaacaacacatcaacaagaagagttagttcctttaaggtcctgtccctagttctggtctattctttcctggcttgtttcctctctcaccacaatccctgtaacagatgtttaacagagaaaaaggaaagaatgtcagcgggtatgcctccagtaactcaagttttcaactcaatccaccactagcctcaagagagttaacaagggcacacccttggtccattccaagcatgctgcttagttcacagcgaccattggttggaagtcgagaccaaaatcagtatgtgtttgatcgagcatttgccacccaggtcaatgagcttccaatgccagaagagcatgtccccttttgtcatgattgtagagaacaaggacactatgcccttaattgtccatgggtatatgccaaagaagccccttcctttggtttagcagggcagacatcgctaaaccagcctcctcgcaccaagtcaagcttgcagcctagtgtacaaagaagagagcccattagagagaatccattgaatcccggaaaatgctttcctcctagcctttcgtaccacgtggggtcacgtactaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcacgacagttgacccagcacctcctaagccatggcggcagagtatctgatagtgaagggtcagatcaagtctcctcggattatgaagatgagtctctccgacatctcggcgaggaagagatggaatcaaaagcatgcccccgttgtggagaaattggacacgttgctagcatgtgtctcacactttgccctcattgtgaggaagaccatccaccaggtggatgtcccacccgcaaggtcacatgttttctatgcgaaggtacaaaccatgtgcccaaggattgccaactcagtgtgttgttgaccaagactgcagaaatccaacgaacaaccctacgattgtctcatcagctagtcagctccaacatcaacatcgacgatatcatccccagcaccaatgctcctcctgctgcacctgactctgcagtaaatcatagcaataataccttcaacaccaaccattctctgcaccgacggcctcagcaaagaattgtcgtcgatggaagaagttgtgtctctccccgacctactccaggccgagcgaagggcaatcaatctcaggagtgcgataccaagcagaagaccgttatctgcttcaaatagcaatcagaaggaagcttctcctgtgaatgatagcaatatgcagtcctaacacatcatcacagaaccaatcaaggatgcagtcactaggacaatgccagctatatctctccagaatcaaaatgagtagccacgtttgtggtttttagttcgctacttatcattgtgtaatcgggagtttgcagcaatcatgtaataaataaatacattcatgattataaacaatgagtttgttatgtttatggaagattcatgttgaggatgcaatgtactgatgttaagcaccttccctttttgtttaaggcaaggccttgcattcatgtaataagggagacatgtgtaataaaaacaagttctatgaggattatttcggaagatgctgatatgggattatgtgtataattgtttactgtcaaaggagacctagggtctcatttcagaggaaccatgttctaacctcgagttaataaccaacctgatgatggaaaagaaaatcaagcgattaaccaaagagacatttgtttggactaagagtttcagacgtgtctttttcggatcaaaggcaatgacagtcagtatagcttttggcgaaaacacttcaaggtttcactgaaaggcagcagaccaaaggaccacatcgtcaccagaagcatccacaactctcggagtgaagagtacttggttgacaaagttccaaaggtgactaatagaagataccagcaaaggtgtttattgtcgggcaaagaagtaggtcgaaaggtgattgatacgagaaatctgaaaagaatacatcagggttgaatgtgtgaaggaatactttgaatgctaaataatgacaacatgaagagaatagcaggaagtaaactgaatgtaaagaaagtgaatccgagttgtctgttcatgggaactattcccagttatgaaccaagtgatatgttcgaagatagtctatagaggtcagattaaaatcgcatctaacagtgaagcttcagatttggcagggtaacgatcaaacaataacaagtccagcagtaaagtcatctggaaaggcgtcaaagcatgtcaagtgggataagttgactctgttgagaaacataattgaaaggcgaaaattatcgaccctcgcatcgcatagcagaagtagctagcacccggagaccaggaaaactaatatgaggcagtttgtggcaacttagaagtagatgacaagcatggtatcctagtaatgacgagctgatctcgacgcatgacatgaagtgggtaacttgtatgaggttgactccaaagatatgaactatgcgaagttctggaactgaagccccatcttcaagtgccgcaacccagtcgaagtcagctaaaggttcaaccagggacaagtcaggtgaagagaagattccatctgcaacaggagatcgagccaagcagtccagagtggagaagttgtgctaggcaagtttgttatagaagacggagcggaagaagtcaggcgagaagagaagaccgcccaacctatcttcttgctagcctcctcgaatctcggggacgagattcctgtaagggggggtggatttgtcacgtcctgataaattcattccgaaataaaattcattttctaaaaggaataatagaattaattaaaatttgaaaagaaattggcaaacaggggatcctctagagtcgacggcgtgcacaccaatgagatctcatnngcacgg

SEQ ID NO: 74341 - DNA, 774 bp, Oryza sativa
  unsure (1)..(774): unsure at all n locations
gtacaagacgacccgtgtagtgcgactgaagctcgcaataccataagccgtttttgctcacggatatcagaccagtcacnaagtacaatgggcatcgtattgcccgaacagataaagctagcatgccaccggtatacagcgagtcgctctttgtgaaggtgacgattacctaacaatcggtcgattcgtttgatgttatgttttgttctcgctttggttggcaggttacggccaagttcggtaagagtgagagttttacagtcaagtaaggcgtggcaagccaccgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcagtgttaagcaccttccctttttgtttaaggcaaggccttgcattcatgtaataagggagacatgtgtaataaaaacaagttctatgaggattatttcggaagatgctgatatgggattatgtgtataattgtttactgtcaaaggagacctagggtctcatttcagaggaaccatgttctaacctcgagttaataaccaacctgatgatggaaaagaaaatcaagcgattaacggggatcctctagagtcgacatgcnggcatgcgaccatgtgctaatacgaatgtcaaaggtgggcgcagg

SEQ ID NO: 74342 - DNA, 688 bp, Oryza sativa
ttgagagatgaagtgaataattcaagtcatcaaagaaacataatgaaacattcgacgcctcgagagaagaatattggagacattgctgggcttttagcctgccagtcaacttcagcctgagatgtgcccgtcaaaccactcgaaggcggcgaccagatgtgttacacattcaggagacttgacaaaaatggctaaagatctacaacatctcaaatattcttaacacatactcatgtgaatctacttcccaagatgtgcactagattcacactttcatcttaagcatggaaatacatagcaaaatacacttaagacgaaaataatctaaatcacaactacttcatagttacataggccgaccggcgaaataaagatatagaatagcgggaagcttgactacccaatcctcaagcacaccgactaggggtttaccccattaagttcaagtcctagaagaagcaatcgatcacccgcatcactcaaagactaaatttaaaacatgcaagcaaaagttaattcaacagcaagagtcagtacattattaaaaataatgtactggcaagtgccaagacaagcctaacaccctactggcaggcatataaacaaaggaaggatagtatgttctttttagcataaagcaagttttatttgataaaacatttttaaataaaattggtttccaataatg

SEQ ID NO: 74343 - DNA, 719 bp, Oryza sativa
tttccgggatattaaatcacggtatattatttccaacccaaagcctaatattctttaatgaaataagatcttggcataaagggcggatttaacatgtcactgaagcatatagagcgaatatggttaaatcagataagaccgactgaagctccgatactaccctaatcggcaatcagaaggcaggctagagattgatattctaagcacgacttgatagatcaaactcaactaatgcagcattaagtataaaaaaatgaataatatctagacaatcaagccgctggaagtttcatagagtggtagatatcttatataatctaaatcaacatcaaaatctaacctaatcggctgccctctactaacagatgttagccgattataggttagatagcgatcttgccagagattatgtacgatatatgataccttgatgaattacgtaaacacgattagagtatcataaagatggaagctctaatcccgagaacacaagccgtcataccaagttttacctcttattgaagatcgaaaccgatgcagctcaacccgaaagcaagaacccgtcgaaataaaactaaagcaaaaaggtggcgatgcgccgaaattgtattgaacgtgtgtgttttttattacatagggctcggggtctatttatacccgagaattacaagatatgtccataccggacatgactattatctctaacaaactctaagata

SEQ ID NO: 74344 - DNA, 13860 bp, Oryza sativa
ttgcgttttcgtatcacagatttggcgggtgatggacggaattggcgggaatggttaagtgtgtgcaccgttagctggaacccactaattaaatggatgcggttttgatcagcttaattgggacaggtgacaacggccggccgtttctgatgcagagatagaggtaagaggtatattcagctgatgaatctgttctccaaaaaaaaaaaaagatgatgagtcacctcactggctgatgctgatgctggcgtgtatccaacggatctctctcttgcttaaccgtctttttagctgaggtaggacagtgcctttgattccttggtcgagctaactgatggatcaatgacagctattagcaaaggctgtttggattgtaatttaagcaatgagaggcaagagaccaaaaaacagtactaccattattactactgctcgttcttgaagaacgatttaaattttagttttgctgttaggggttgttaatttgtatctcaggttttgttaaagctggtttaccttaatcatgttttagatcaaatcttgtttgtttggcataagagaattgtggatatatataaaaaaacataagttctctcaaagtaaaaaaaaatgttttattcccttcgctcttctgccttttctcttgtgggccaaacagaggatttggattttacataaatctacggtaacagaataataaccttaaacctaataattcgtataaaacttgtttttacttttcccatccaaacaaccactaaagacgtctgattagctcagtacttaaaatacagaaccttatgggattttatcttttttctttttgaaaaaaaaactactccctctatccttctctaaaagatcttatttttatctatacgtttggagtatcttttactccctccgtttcacaatgtaagactttctagcagcatctatatgaatatgggcaatgctagaaagtcttacattatgaaacggagaaagtaatacgtatctaaacaagtatttgcctagatgtataaccagaaataatgtcttttaggatagagttaatgtgcagttaattactccctccattccaataaatacatgaatatatccaaaatttatttaaacattgatttttttaggcgaagtgagtattaattaggggtaatctctaatacatgagtcattaatctctactgtttttaataaagaatcattaaagatgtccccttaaatctctataagggttcttctgcgcaataatagcatgtcctttaccatttgaaattacccctcaattgctgaccagatatttttaatggctcgtttaattgttaaggatcacagtggtgaaccattagatattaggctctgagtagaagtacgtgacttgaagatttgtgcgaacctttcaacatgttgaaattaatccactaggtaagggatttattggggtgccggacattaacagagggggagacgaccaataaccgatggtgcattaattggtgtggacggtagaaagagcattcacgtacgctgccactcggtaatgcttgaaggagggcaatgcatgggtctattccctcggtcgaaaaaaatgaacaaacatttgtattagaatatgacatatcctaatacaataaatctagacatactttatatttaaatttggtgtatcatatcctaatacttgattgatttattttacaccactagagaaaggggctttagtcccggttgggaacccctatactcctggttatacaactgggagcacaaatccaaaattaaagatgcccatctttagtctcaggtgaaataaccggagtaaaatggagccaggctaggtgcggttgctttttcttttcttttattttttttcattgcttttaacattgaatattgatttcactccatttccaaatcatcccaaattcgtgaaatcccaaatcgatcatcacatcacaaattaaaaggatcctctccaaatcctcaaatcgatcatttccaaatacatcacaaattcttaaaaaaaattacatcacaagttctaaaaaattcatcacaaatacataatatattcatcacatcacacacaaatcaaatacatctcagatatgaataaaaaattctcaaaaaaaaaccttagaggcgctgcccaccgctgccacgctggcctgccgccgtgccacccgcttcgctactacaagatgagaggagaggataagagcaagaaaagaggagaggataagatagagagagaagagggagagatgaggaagatggggagagagactttgcaatagtggatttgaggataagttttagggattatatacgacgggttgagttttagtctcgggactaaagatctaaataatctttactcccggttggttgggactaaagttgtgatctttagtaccgactaaagattctcggccccctgacaggcctctgataggagatgaaccatgactaaagatcatctttaatcccggttgatcaaaaaaattttaaccgggactaaaaataaattttagccccgattcttattagaatcgggactattgtggaaatcagccgacccagcaaagaccacttctctagtagtgttaggaccaagagagtatatttcaaagggggcaatgaaagagtgagatacacagattttatttgtcaatgaaagtttattgtctcaagttgatttattttgatatggaagtagcagttttggagttcggatataaatttgtagaatacatagatacatgccggtttgatgatatatatatatatatatatatatatatatatatatatatatatatatatatatatatatatatatatatatatatatatatatatatagagagagagagagagagagagagagagagagagagaaacttttaaggcttctgtgatttttttagagcaaaattcattgataaaaccttttcgtctccggataacattttgatatcaagaggaaagttttatttatctatagttgatagttttcatagactttttttaaggctccaacaaattttgcaggtatttccttagtgaacacatttgatgttcgaaataaagggtactaaattagtgcagtaactctgtgattttattttatttttttgacaaactaaccgtgtgatttcaagaagtcgaaatgttatggaaatttgttagggcatccacactatgctaaaaagtaggtagcaaggagtcatattacctggttcactattgtgagggtaggtagtaaggtggatactactattgtgagggtaggtagtaaggtggatagtagtatgatccagtagtaacactactaccaaataacaagcaatcaacaaatattaaaacactctcctttctcactcccactctcttattcacccatccattcctagtaataactaaaacaacaactcccttcattgtaaaatataacaacttaaaattggataggacatatctttctgtccagattcgtacaactaagatgtgtttcattcagtcatatgttgctacattttgggatggaaagagtacatgattttgtgttccatccttattacccacttgctattcccttcattcacaaatgatcagcatatatgatttgtgcacctatgccaatgcactcccacatgccacttaaatttacatcgattaacctgcaacaccgttttttcatatcctatgcatgcaacaagggaaatttgcaccaatgatatattgcttgcatgtatacatgcatgcacctcaaattacaattagttgaatagtacattgaactatgcatgcaaaagaccatttaataatacacagagaaacgaaaagccaggtataaaaagtactatcaaatatgcttaccatttctatataacgttgaaaaaaattatatgatgatcatttatgaatggagagtcttcctcctcattatagtccttctagaatccaaggtattttgtcgaaatatatcctgtctttgaacctttgtatccctaggagagtactacattataaggaggcccttagaagtaatcctctcttcaatgtcctgactagtcgatgcgatgtgcttacaggctacagcaaagaagggtacgtgcagctggttggaagtcgaaaccgcccgcagctgtactctctttatcacacgaaaacaaatctatgactagatgtgatatattttaataaaacgaatctagacattctagtacaataaatctggacagaaatatgtcttgaattcgttgcactaggatatgtcacatccaatcctagttttttttttattttttttacggagagagtagctagcgagagaagttcaaaccgcatggcatacacagatcacacgacacgaacatgctagctagatcaatttaccagttaatttgtctaatgctctattcatcttctagcgcttagactaacaaaagaaaattaaataagttgtacgaaatgtacaatccaacattactgggtgtgctcagtttcaaagtcatgaacaaccatttagacatacaaaacaggtggaaaaatgaaggcgatgcaagaaattttggtcaaggcgtatctagaaattccaagcccgaccggcctaacactctcgactcgtttcagaacattcagcaaaacaatactccctccgttgcttctttaacgtttgacatcattaacttttcaataaaaaattaacaatttctcttcttaaaagaagttactccctccatcccaaaagttactagagtacaatataagtattttttttactataaatctggataagccaaaagttattatattttgggacggaggtagtatataattattatttttttattgttatttgctttactattaaatatactttaatcaatttttttcatatttgtataatcttttaaaaaagaatggtcaaacgtacgtcttcaaatattaaaaaataggggcagtaattaattactgtacttttcctagcccgagctacttgtaaaaacaatatacagccggcatgtcacattagtgtacttgccttgagataaattaatatagagaaaaaaatagctcagctcagctctctgaatttctactactacaacgtggtggctcttctgaactctgaacctttaatatattttttccctcagcgaaagagaaaaaaaaatcaaggccggacgacgtactggcagagcaaagatccgaatcttggggcgtcacatgccgccacatgtggtccttagctcgtctcgttgttcttgcgtcgcatgtgcatggatggatggatcatgcatgtaagctagttgcacttgcaccacactgaccgcacgcagcagtggcacgcctcactcacgtcccgcgtattccctctccgttccttaagaaaagaatctaatacgaaaatatgatatatcctaaaactataaatctaaacagaccattatttagattgatagtactaagatgtactcactccgtcccaaaaaaaatccaatcctagattagaacctggacacatgtgtgtccaggttcatgtgtccaggttcaaacttaggattgggtttttttttttttgaacaaagggagtatgtcatttttagagacgaagggagcatatttctcttgcaaccaagcacaaacagcacaaatatttattatagacaaaacataccggacaatcctctctctctctatatatagagagagagagaggggcaaatataacgtcatcctgtctgtacttattttttccgtgtctgcaggacaaagatattcataccgaatgattcaatattaacgtggtaccatcaataatttgtacggtctttctctctctctctcacacacacacacacacatatatatatatatatatatatatatatatatatatatttgtgtgtggtgcaccagagctgtccttgatcctttatgatattgcttatgctattttaatatatgtatttcttttgagaatgatgaatatatagttgaaaatataatacatgcatataatatcatatgcgtagtagtatatgatttgacctaattaggttgtgcatacgtctttcacataatccatcaaacactagatagatcatatctaggacatccattgtcagtcaaagtcaccattttcgccaccacgacgaatctaattccatttcgtgccagaacgtactctcgtcgaatgtgagagcgaaagcagtatatccacactccatgactccatatccactagccctcctcatggatcaccaaattcccctcctcccttcacaatcagccaacgtgcagtgacacccaaaaatccttggagtccacccaggttcaacgaacctggacgcctttttctgcctccctaaacctctaaaacccgtcccagttcaaaaccatgtccaggtccatccaagagaggttcaaattacactggctgagccgcttaaaatcaaggtggcaaccggccggttgctaccgctttttgacctggtttgcattgtgaggttgttttttcttctccccgagataagaaaaagcgagcgtttgccgtttcggccggatcggcggcctcgggcaacgtgctcgagcaggcttgtgtgtgcgcacacgagtcagtcaagtcgccacatggccggaaaacacaatgcgttggatcgtttcgtggcagacaagttttttttttgagtgattccaaagaggagcaaccagggttcgtaattctgacaaaaaccggctgtattctatgaaatttcgaccttttgatatggctcggaattaatttttggttaaaattttgaaggttaaacattaagtttggtcgaaatttagtcgaaatttatcgaaaaccgatcaaaatttgtcgaaaaccgtgataccgacgggctcgaaatttagtggtcaaccggtaatataaaccctgggagcaactttggtgctcccttaatctcaaaagtatctctaccgatcttgcaatttcttgtgtcctataaaatacatagatatctttatattaggtataaatttggactatcttttcctatgaatttgagtaaaccaaattagacatgttcgcggtatagccgctatgtcacatctgctgacacaaagtgctattcgagctagctgtaccgtagtcgaatgagtgcagccgaattcataagtaaagatacctatatttttggtgacgagactaataaaagtttgcctataattttcctattttttagcacataaaatgtacaaattaagggtaaacatacaataagcacatcattgtattatatcaataaaatcgcacgatcacgctgacactattttgtttcctaaaatattgtgcattgaaattgcgatttttaacacatttgttgcaagacaggataagagaatggaaattgaatgaaatctactcggagcaattgagaattagagactccattttgaggagggaatgggcaaacaacacgccgaagataccgggagaaatgaatccgctatccaaaatcgagctaatatagcactgttactcatatgaatttctagatttttttcctacatatatagtgcaattctatcatacagttattattaatttgtaataggtgtatttcggtcttattaaactccgataataatggtttaacaattactccctccgtttcacaatgtaagtcattctagcattttttacattcatattgatgttaatatatctagacatataaatatggaaaatgcaagctagacttactttctccgtttcatcatgtaagtcattctagcattttccatattcatattgatattaataaatttagatagatatatatgtctagattcattaacatcactatgaatataagaaatactaaaatgacttacattatgaaacggaggaagtagatactaataaaaagggataaaatatacccaaacaatcgagccttgtatatgtattttatctaccttgatacgattgggatcaaagtaatacagtagtatattcttgctttcatgggaggatcaaaaaaatgataacggtataaaaaaagcagtgaagcaagctcgcagacaacacgccggatacaaaggggaaaccgaaataaaaccgccggagaaaaggaaatgaatatatatattttcaatttcgtaacgaaaaaagatatatatataaaaagaagccttgaactccgcctttaaatattcccacctcgcctcgctccccttccccatcatctcatctcacaccaaaaacgaatcagctcgtctccttcctccgcctccgcctccgcgagctcccattccattcccggattgcgccgccgccggtgttgcagcagccatggggatggggccactagagaacgccgtggtggacgcggcggcggaggccgtggcggcgaaggccgcggtcggcggcgtgggcgtggggggttcgtacgcggtgctgcagtgcggggaggactcggagtacgtgaggaaggcgtacgggggctacttcgaggtgttcagggcgctgctggcggaggacggcgagcggtggcgggtgtaccgcgccgtgcgcggggagctccccggggaggaggaggccgcggggatcgacgggttcgtcatctccgggagctgcagcgacgcccacgccgacgacccgtggatcgtcgccctcgtcgacctcatccgccgccagaacgccgccggcaagcgcatcctcggcgtctgcttcggccaccaggtgccacccccctcctcctcctcgtccgccatggatgtctccctctgttcgtctcggttgcgatttggtttggtttgctcgggggaggggtgaaatggtaaatttgctctttccgagatcggcgccgcttgcgattacctggttggagtggcgttgttctagcgacttcttatggattctttttttttcgtcttccttttgcttttttaaaaccatgcgcagtaaaaattcgaactaattgcattatcgcaggttaaacaggttgaatccgagtacaaaatttgtaaatagtaattcataaattggggggtaaacctgcaatggcaactgcagaagttcacaggaggtgagcttagcctttgcagtgatccgcacggactttttttttattttgaaaaagtacttcttctcaaataaataaaaattgcttaaacttaaaatatactctatccgtccaaaaaaaatcaacctcatactgaatattgaccatatccagatttataagatataatatatcttgagtttcttttggacggaaagaagtacaagtataaaatcgtttttaaaactagtagagctataatatttatggggcgtgaatcccgtgggcccacaccgaaccgcacccgtggccagaagaaattcccgtcttgtgcgttggacaggtgggccccactccctgtcacgccaacgcattagcctggccgcttaaataaaagaaaatgaatttttagctttcgctaaatctaattccggacacggttgatgacagcctggcacagtgcgccaaggcggttcacgtgagctgacgtggcggcaccggctgagctcacttgctgttgcacacacacaagacaatctagtaatctaattttatttaatatatattttttcttctctatatttggcggtaatcaactcctccgtggaattgctgccacggaagctgctcggtttgaacggcacacggttggcgtgatgcatctaaaccggtgaaggcggtcagcggtcgcttttcaaatcaaaccaccagcgacagcgcccaaagagtgtgatttttgtgttaggttggggtgggcttacatatacatgtttgaatccggtcgtttgtccgaacgagcgggaaccatggttacgtgaggactctgtatacgttttgttgtaaaaaaaaggatgagtgcgcgtattcaacttactataattgttttgatttttttttaaattttttttaagagattgcacagtctgatctgtgtctatagaaaggagatagaagtagccttgtccctaacttgatcgaagagacgagttgttcttgtttgtgcgagtagggaagcgcaacttgtgctgctgttcttgggggacattgatccccaacttgtcagcgggattggtttctttagtgattagtataatcgtaggatggagtcccgtaccgatcatagcttaatatccaagccaagcatcgtccgtgatttctgttcaaaagtcaaagctttgcaagaaccgtacagagctctgtcgaagaggtcagcgtgtccatggcagcaacagctgcgcaagaacagttataatttactcctacattcggtgtgccgcgttagatctcgcaagctgtctgaatccgaaaatggatcatgccagctcagctcgcatgtactccctctgtccaaaaaaaaaaaagacaaaccctggtttctgtgtttaacgtttgaccatccgttttatttgaaaaaattatgaaaaaaattaaaaagacaagtcacgcataaaatattaatcatattttatcatctaacaacaatgaaaatacgaattataaaaaaatttcatataaaatagacagttaaagttggacatagaaacctagggtttgcctttttttttttttttggacggagggagtactccactgtctgtctgtcggtgtgctctcctcctccacccacatggctgggctctgcgaagctctaccagttggaattagttgaaatgtttgtgatttgtgaacgagctggatgtgatgcgtcgccggccggccccggcatcggtcgatgatgaccccagtgtggcgaggatggaatcgatcgcctgtcagaaagaaacacgtttagctcttaaaaatgccagctttggtcttaattattcacgcacaggaccgagttggctgttgatctggtcccccttttgaagatctctgcatgtgattgactgcagtctgcaacatttgtttttatttttactggaaagtttcagatatgaagtaataatatagttttgccgtacaatggttcagtttcttgccgtttgaaaaaaaaaaaacaatctttacacaagtggctaacagaggcgtgatcactctgctgcaggtcctgtgccgagcgctgggcggcaagacgggccgatcgaagaagggctgggacatcggcgtgaactgcatccaccccaccgcggccatggcgaggctcttttcgccgatcaagctccccgtccacatgcccatcatcgagttccaccaagatgaggtacactttttcgccgtttcgttttcaaggtttgctctgatcaaagcttcagaaatggtcaatgacctgacataacttacatggcaaaatgcaggtgtgggagctgcctcctcaggccgaggtgctggcgcggtcggacatgaccggcgtcgagatgttccgtctcggcgaccgcgccatgggcgtccagggccacccggagtacagcaaggacatcctcatgagcatcgccgaccgtctcctccggaacgatctcatcctggtaagctacggaattgactgaactctctgtggtttcttctgtctactactgtagctggtctgaaaaactgaagatttgtgttgattacaggatcaccaggtggataaggcgaaggcgagcttcgacttgcggcaaccagacaaggatctgtggaagaaggtgtgcaggggttttctgaaggggaggcttcagtcatcgcagcagccgcagcagcagcaacatcagaagcagcagaaggcggcgcagctggtgctatagtaaacaagattagtgagtgagatcagatgggggcattggggagcctagattaatccttattttctgcttcagatttgtacaggaaaaaaactatttattcggagcaataataagagagtaattgggggtggcctaattagcaaaatcccatttgccaatcaattcccatcttccatcctacattttcgtcacgcggcacataacaaaacgtacttacatggatgctcgttcatgtatcgatcgtcagtactgtaggatgcttccaattgaaaccgagtcccttttcaacttttccaagaaacaaagctgtgtccatccacagcgcccaaacctgcaaagtacaaaaacactaactttctctttggcgtcatttcaaaagacccaaccaaccaaacaaaacaagccagtaccaagtccctctcatggctcaacagtgttgtgtttgttagttggaacgaacgaaggacattgtcatcatttgggctacagaatccgctcggtttcttggccgtcctcatcgcgcgagagagtctgccaagatccaagattccggcggctccccggccacgcacgcgcccatctctcgcgaacgtgacgccgttgcggcgttggtgaggacgaccacaacgcaacgcagcacaacacaaacgcggtagaaatgagttgaagagatgtggccagccatggccatatgtggggtgcggggggttagtgtagtatggacaatggaccaccggcggagcgccgttaagctggtggagacgcgcgagcgagacggatccacgcgcagccttctccgtaggcagagggattccgggaccggcggccggtggctcatgcttggcggagggggaccaattgatgcaattgaaatggagatagctacgtaacggtattccgtttaaacgggatgatacttcagaggtactccctcctctccgtctcataaaaattatatttctagctccaagtctttgtcctataaaaattatatttctagtcatgtggggcccaaccaattgattcatctatataagtttaatttgggctgctaatgcttgtaattttattaagtatgctaattatatgggttaattctctcaaacttccttttaatcatttgtatatatggaatgtgtgcatgcagtgggttcattaaataagttattgtggtcatttttcaatcctactattttatcctaaattagctagaaatgtaatttttatgggacggaggtagtatcatctgatgtgtggatatcagccgatacctaccaggtatctgacaatactttagaggtttcatctcttctgaacggaatatcgtcctgtagcatttttcattgaaatttactccgaactatttagttttttttagggggtggcaattaggatatttatagagtggaaataagattctatttgctttactactttatccctattttttctaagggaaaatctgctctaggacactttaggctttattttgttgccaattccaaccttacttaacttgatgccttacaaaatttagtagtatttttgagaggaaagtttcggaagtaacaaattttagtagaatgtcattggtaaggtaatgtttagttcgttaccctactaaaatttggtagcactacaatttaatacgtcgaaagtggtaacaacgtgaacatgccatctcactttgatgtgaagttgaacgagggttccatagcaatgccttcaaaaaggtgaacggcgctcgagggcattgttgtcgctccaccagcaagccgagtaagactttcacctcagagtccccatacaaccctagcatccacaacgaaagccaccaaatttcacatacacaccgaagctacctgcactatgcacactaccacctgcacaatggtcggactggtaccattgacaacctgctctgccacctagccagacccagggagccaggtcgtcggtgctactagatgactaccaactagacagtcccctcacagagaccaccatataacctggatgtggatctacagaaagagaggaggaggaggagggggggggggggggtaggg

SEQ ID NO: 74345 - DNA, 5689 bp, Oryza sativa
gtgcccagccgcgccactcaaaccggcgcgcctcccgttgcatcccgcgcgcgcgtgccgtggtggccgaccgcctggtcgccgccgccgtcaccctctgccgcgcctgcccgcgcctgtcgcccgtgtcgccgctccgctccaaaccgccccgccgtcatcgccgtcgtcatcacctcggccccgccactccgcgcgcaagccgccaagggacggaggcagagcccctcctccctctgccgcgacgcccccgctcccctcctccttttcccaaagaagcaaggggcgagccccctttctctccctccttttccccttttcctcccgccggcgtcatcctccctccgccctgtcgccgatttggccgcaagcgccgagcgccagctcgcgccttgaccgcccaaagtaggtttccaaaccgacattgccgccctttaaacccaggcgccctcccttcctctttcccccccaatcctccccgtttctcgtccgcgccattgccgccgccttccgagctctgtctcgcctccgccgttcatcgccaagcgccgggagagccggtgcgttcgtggacgcggaaggggactctgggcgctcgtcttcctcctcttccccggcccgaggccggagagattactcccgcgccgtcggcctctcgtcactgcgccccacctcgtctcggtaatgcctccctctgttcttcctcctcgctccatctccccccttagttttcggtagtagcacgagtagcctccccgtagctagccggcgccgccccgaccgttgccgccgctcgcagtgtgctcgccgccgtcgccgcccgtgctccgtagtacccgctcgtcgccgacctcgctcggcgtagctccgcccaatccgacgctagcaacggattcccgtagctgcgtagatgctctcaccgccgggaattggcccctcgtgacctcgtcgccgtttccccctttcctctccgccgggcgccgccgccgcaatccgccgccgacggactccctccggcgaatctaagccgttggctcgctccctctctttctccctcgtcatcccggtgtacgccccgtcgccccccatcgtcgcaaggcgtcccggagaaaccgccgccgcccgccgtccattcgcggccggcgccttcgtcttcctcccgccagcccgtgtggcagccacgtaggcgacacgtcggcgccagctcggccgagatcggatcgggccgaccccggtcagcccctctcgtgcgcgcgttccaccgtgagccgtgaggctgcgcgagggcccgccgcatccgttccaccgcgaaccacgcgcgtgcaccgcatcccttccccgcccgcgcgcgtgcgccgcgtgctcgctccgcacggtgaaccgtgtcatcgacaagcgggtcccacccgggaccacgtgtggtgagcccggtccaccggccctctgtctcctcccctcccgcgcgcgcgctttagtctattttccctccctcttttcttttcttttcttttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttatttttgatgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgttgtcccgtctgcaaggcagattggcggacctacctaatttgttgcatttgatccttcctttgttaattgatatatcatgtccccttgtaaccatctagttgcgtctcgatattcgtgcaccctgtgcgagtatcgacggacgccttcaaacttaaaatctgagtaacaacttgggtaaaactagggttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccaaacataagacaagtacgaccacatgggtgaaatgggacacccctggctgagtaactagcttatcaggggagccttgatgccgagagacatgtggattcgctggggtggtgtcggggaggaccactgggcttcctggcacagtagggtctgggacctaacctgttgttggtctgggacccctctcgtcggcatatggtaaacctgtgtcggctttggaaatgccttgtcatgaaagcttggaggtctcccgacgtggctgattcccacgggctgggtgatccgggttagtaatgtcgtgtgggtaaagtgtaccccccctctgcagaggttaacaaactgttcgaacagccgtgcccacggtcatgggcggatgtgaggtgattcctagcgtagttttgtttgactactgcttgtgaaattgctgttgtgaaaaggggttcgatgtttgaaaaatctgcagctgacgggatcagctaggcccgggtggccgtttgaaagttgttggcccgggtggccgtttgaaagttgttggccgggtgccaatcttgatcaattctaaagactgatacattgtacaaactccgaccggacgagacgcactgtctcatccgtgtcgtttgagaagcactcacttagttgttttcagaaaggagttcaaataaaatcaattgtaaaaacaacagcctttccttgaagcctgcattaaacacttatttcccatggcttgctgagtactcccgtactcacccttgctctatataaataatcccccccagttgctgaagaagatgaagtggatcctgctgatgaggagttcttccaggagcaagccggctacgatgagttttagggtttcggcctagttcccaagtcgcgcctgtgttgtttggtccaagtcctggcttccgcttcccttttgtaatgcagttgtgagctcgggatctgtccgcagcccaacatgactgtacctctactctataataaagagacatctgttgctgtgataatctgtcttcttgtgataccagcactgtgtcctgggactggtatcgattaacaggttaatttggagcgtcacgggctagttccggtcggtactagttcggggcgtgacaaagggctgcgccgcagtacgccgactcctgctccggtgccacgggggagctcgccctcatggaggacgcaatccaggagatggagtcggggggcttgacgccgaaggaggggacgacgtggacgcctgctccgcgcaacaaggcggcctccacttcttcgctcaccagcgaaagctttgctgcctctatctgagcacagggaggcgcctcgcgctccccgccgtggagctggggcgcatcctccagcgcggggccggggttgagtggcgagtggtggccggcgcaggtgaggggccccgtgtgcgggggaggcaagtcgccccgggcctggcgcttgggcaacggggatggcgagggaggcttggtcgccttgcgcatgggattgggcttgctgcgacggcggtaggtggtggtggtggcggctggtggcaagggattaggctccattttggtgtcatcggccggcaaaattatttatgtcagtccgccggcttctggccagccctcaccaccttcaaggtccgcaccgtggccttctccatcaagtatcagtcatcaaccctcgggggtatctcggggaatcacgactgatactcacaagtatcaggcctggtacccaggtatcaaggtctaatacctaggtaccagccggtacccaaggttttagaggagcgcacgtggaagctcacctatacagaggaaaggaaggggaggagtcacttaatatttagatcccacccgaaaattttataccttgtcacatcgtacgtttgaacacctgcataaagtaattgcacatattgtgactactttgtaagacgaatctttaagcctaattgctccatgatttgacaatgtggtgctatagtaaacatgtgctaatggtggattaattaggcttaataaatccgtctcgcggtttactaacggatactgtaattagtttttttattagtgtccgaacaccccatgcgataccctatataatacccgatatgacacgctaaaactttacaccactgaatctaaacaccccatattcattttttgcaatggcccaatggactgcatgtcagcacggttgaacccctggcgcccttgtcttatccttctactctactctccaccagaacacgcacttcccctgacaggaaagcatccagaagctttgcaaggattttcaaggcgatgtaacacttacacagtggcattggttggggccccccccccccccccccccgcttttttttttttttgacaactctacggtttccacttgtatttgtatatgacattaccttgtacttcaaagttcatatctttcaatcatgcaagttcataaggtttgctccttgcacggttaaactgccatattttttgtagaccaatgttgtcattgctctgaactcaagctcaataagttgcatactcagcttcgagtgcttttgtagcgtctggttggcacattgcgagacatcatgcgacattggactacctgtatggctgtagcaggatattttctagggaaggcaaagaagaattcagacttctctagaccgcttctttcctctgccaagttgcagtctcgcagaactgtcttccttgtttgctcagcatggttgtgacttgtgagaggcagagagggagttgacctaagagccagcctgaagattaggcagggcctaccaacttgccattcttcagacaaatccacttgcacaatctgataggagtcttgtctcctgtaaaaatatgctcgtaatctcgcctgatgtcaccgatgaaagatggtatttgtcatgtacatgctatgccattcaatatggctgaaacatgtatagtaaaatgaagctctcgttgggaacacataaaaaagaatgcaacttgttcgtgagcttcatctcacggctgatttgctgatgtgattgttgagggattaggactgcaatattcactaacaagaaagttcttttgtactgaatggactttttaagcttgatgattaacacaatatagaaacattatctagttacttattcatatgtccatcaacggcgctctgttctcatcgatctaatgatttcgccatttcccttgaataaaattggacccatatggtttagcaggtgttaggtgatgatgtaagatgattgctaatttcttttatcagaaacgataagagcttaatgtggttatcaagtggaagcatggccagtggtccagtgctactgtaatttagttatttcttttttgaaaaaacttgatttaattactttctgtgctgagaagaatcttctgggataccccctggttaggaccaaatatccattattcatcaatcaaactgcagagtgaaaggtgaaacta

SEQ ID NO: 74346 - DNA, 2445 bp, Oryza sativa
cccccctacacccacaagacccatggatacccccggagcaacctctttatttttttaccatgaatgataaactaaaggtccctaaatggctagaggttaaagaaactgtgtaattgagcccccccccccccccccccaaatttttgttcctggatccgcccctggaaggggatctcgggtgatggtgaggggatctcaggtgacggtgggggatcgtcgacgacctgttgaggcgcgacctgaaaccgtctggcggcatacctatgacagcttgagggcgaggtggcgccgtggagaacggacggacggcgtggcggcagcaagggaggagggatcgcgggtgacgacgacggcggaggggcgggatgcggcgccgagagcaagggggtcgtcgctgttctggcgagggcaatgggaggcacgatggaggcgcgggcagtcggcggcagaaggcggaggaggagcgtgcggcggcggaaggtggaggaggaggcgcgggcggtctggggctttgggcgacggtttttttttctttttgcgaagaaaaggattcagaagcgctaatcggtagttaatccggcgctaattgcaaggttaatcctacttctaatttgcatcattggatgaggggatctgatggttaggaataggtgggtgtactaattgcactaaacaactcgtgctttttatattagtctagattatcatatttttatgttgttcagaaatgatcggtgtattttggtaaattgatattccctctcagcgtcttttccttttccatttacctttacgaagtaaatggatcagcgcatgcatgcgcatgcaattgtttgcgtgtagtgcctcattgtatcccttcaccttcgtgtgcactatatgacacatccactaaagtgaagtaatatttttctttcatcgatacgctaattaaatagagtatgggtcgattttctcctcctttggtctcaatgcgaacacgatgaattctggagggagggagtaatgaaactgagtcagatccaagcagtccatccgttttggagccgtctgctgcactgagaaactgtgattttcggatgcatcgctcgctagtgaccggtgcacctcgtacctgccaatctgccatatatcgttggtgggcgagtcaacaactaccttcccactagtgagttgtgatccctggaatccggcacaagacaaatatagcatagcggcgacatacatcatcatctccctccaactcccaagtctcccaacctctcttgcgcggtggcagaggtaacgacatgcacaccaaggaattcattgacgggaaacattgccttgccggcgacaaggacctggtacgccaacattacatttgggatcatttgttcatttcggcatttcttttctttggggttgatgtttcctgtgggtgatttatatatttgagaaatctcttgatgggattctcggatggaacgagacatctagtttttttgggtctaagttgcatccctgatcaaagagatctagaaatggatgaaaattggggcagacagaatcacacaatacaccaaaagcttcagttttccaatgtgatttttttttcaactatgatcttctttgcaatttacaatacggtgaagattgaaatgaacgacaccggagacccgacacagatgcggaaaaccttttccagacgctaagaggaacacgagcttttccaataacaaagctcggggacctgaccagggaggggcatccggcccctcccattacaatataaatttgatcccccagaaaaaaaggggagaaaattggacaaagaccaatcaaatcaaaccgaagtcctaaataataaataacaaataggcctaacgattactgaccagactagaccatgtgattttggtaaaagggcaaaagggcacgagtagtatgtacatgagttatgcacaagttggagatgagttggacaaaaggagaataggaagatgttttgcattgaaaggatcaccactcttgatagtcctttctttagtgtaggaaggtaaagccagagttctccctgatcaaaggcggcatgtcaacatctgttacctcaatttctttcattgactttgagatatcatccaccgaaaacggaatgctgcaatcagaagtaccatggccaacgttagagaacaactttttcaggtgtgattgacttttgttgaagtttggtgtaagggaataaaccttgaatcatcgtccagcaagaaagaactgctcactgcgttattcgagtcttctgtcatcattatcctcatacttgagatgacctataagcatttgtgcatgaacaaaaacaatatttagtgataaagaaataaagaaatatagtaaatccaccgcttgacccagtagcagatgtatattggaaaatttgacaagtaaaattaggccaaacaagattac

SEQ ID NO: 74347 - DNA, 13610 bp, Oryza sativa
cagaatcaccacaagaatcaaaaactttatttccagttttcttaaagtgaacctcaaaattttgattaacaatttgtgaaaccgaaagcaaattgtactttaagtcctcaaccaaagctacattcttcaattcaaatttttcatttaccttaaccaaacctgtagcgagacggcatttgtagcagcatcaccaaagataatcgattcagtcttgcatgcctttttgagtgaggagaaccaatttttatcaccggtcatgtgccgcgaacaaccggaatccacgatccacacgttctccttccttaccaccaaagcctacacacaagcacaagtcgaagcctcagtactggggttagatgataataaaaattaatttaggaatccagtactgagacacatgaccagaagatccaataggcatatatccacgtgcaaaatcaatttttgaattttcagaaaaattcctccgaggccggtctgaccgaggtacagtggccggtctgaccgggggccggtctgaccgcctctgtaccgccgtctgaccggtgcccggtctgaccgacgctcagtagccggtttgaccggtcgccggtctgaccgcgggacccactgcggtctgaccggtttcttcgagggaaaaccatatttttgccattttgattttgcaaaagcaatctctctctcctttttctgtttatgagctaatctgaaacaaaaaccaacaatatgtccatctttgccacaaaaagaaaagtatatttctcacgatgattagacacattggtagaattagaagatttagcaacacaaataacaacatgagatttagcatgcacaacattggattttgaagaagatgcactcataatagacatgataccagtagatttaaacacagttttattagtatcaggtttaaccaaaatctcaccacttctagcaccaacacctaacacaataggaggatgtctagaattatgagcataaggattaaaacctaaaccacggttatgtgtgctaacctttgattgatccaaaatcatattgaggttctttttaccatcagaaaatcttagcaaagaatttttcaaataagaaaccactttttccaaattagcacaattttcacaatctaccatgacacctttgcttttacgacacttggagcaagaaagcacttcattgtttttcacaacatcttccatgtactcaacacgacctaaagcatatttcaatttcaacttattcaaattacatgttgagcaatccagaacatcatgaggttgttttaactttttagcagaaatcatgttaaacatcaaactagcatgaaaagcaatttgatatttttgcaacaactttttagttaaaaacaactcatccaaagtgcgtgtgtgcaaagcaaaactacaagcaagagaagatttatttttcaaatcatgtgcatcattaacatctctaatttttgaaatctcattcattaaaacctcacaattttcgcaatcatcatcattaggaataagagattttaatctagcaatttcagatttaagagattcaatgataaattcctattttctatacatcttctcacacttcttattcttttcactcaaaatattaatagcttcctcaaaatcacttacctcattttcttcatactctgtgtcagattcaccacgcgccatgaagcaaacattggagatgttctttcccttatcatcatctccacttagtggctcgaaggcggtgcaaacttgttgaaaagccttcctgagattctccagcttcctcctttgggatgaaccctttggcttgttgttgttggtcttctcaccatctttgtcttctcttttgcctgtcccattcttaggacaatgcgaacaaagatgatcaattgaaccacattcaaagcaacgatttggaccacctctttttgtcagggttatagataccacatacctaatagtagttggctaaatctcggcaggatccatcacataccatgtcttatacggaaactgacctcgagggagttccggataaggaaagacaaccagagttctacatggaaacgacaatgactactcggattgtatccatattggtttccctagttctacttggacaaggggacacctatgggtataaatacaagcccccctaggaggagaggggacacgagagaatcaacacccaccatggaggatcaacacccaacacaatcgacatagaagccacaacatagaagactacatacgccaagacacgccgccggatatcgacttcagggataagcacggctagtaccctacggtgtctccggatactgtcaggagagacgaaagcgccatctctgatctcgccgggcacggattcgaggaggaaggctaccctgttgtcgactacgagtcagatcgtcagaccgtcatgtcgacaacagttagataggctactccaaatattgtactggtgtgattatcatgaataagagcaataccggcttcggccaacaggatgtagggttattacctgacaattcaggggcccgaacctgtataaaatcctcgtctccatctattttacctcagtctcgcatatatcctagcactgacaatccacataccatgtaataccagaattgcgacatcaaacgccgacagtggcgcgccaggtagggggattttggtgcttcaggatttcgacaagatgggttcaaaagatggattctccgacaacgagctactcgacgacttcagctgagggggagatccaacctaaccagatcggagccatcatcgtcatcgacaacttggtctatcgagatcatccaagcctcaagctccgcggcgtaccaaaagatgtcagatcgcatgatatcgaacgagtacgcaacaaggtaattggtagattggttttttaaattgatctactaatttcgtaaatacatccggcatgtatctacaaaggtacgcaatattttatctgcaatttatcgtacctattcagatcatacagtattgtcagatctataatttattatgtttacccagagcatgttctttatacaataatatttgttgcgcgggtatccccgatgttaaatcgactacgatctaacgctgggggctcgctctgtctttttctgtataaatcatgcttgtttacggtttacataatgccctgacatttacatctgctcgttatatcctgataatactagaagatccatgcagtttttgagtacatactcgatattatctgctatatgtcttgtcttctagaaaatatttttcaggaacaattgagcactcgagtaggttgtggtcaagtacaccgcattatcgagaacgatctcaacaaatgcagagttgtcgcgcccaacctaccaacgaagaccgacgacctatctcatagcaccggccatggctggactactcgagaaaaggttgttaacggataattcctcgcgaacaccgtcgcttggtcacccgacatgattgcgaacggacatccagatatgctacaagttgggtgtgtgagtcatgctggccacatgagatgcacataacccaactctagcgcctccattggtgttcgagagataattctacatgttcgctggttctccaaccagcacgtagcaatctctcgcaccgcaacctccattgatgttcgagaaataactctactcgctcgctggtcctccaaccagcacagagcaatctctcgcaccgcaacctccattggtgctcgagagataactctacacgttcgctggttctcgaaccaatacgtagcattctctcgcaccgccaacctccattggtgtccgagagataactctactcgctcgctggttctccaaccagtacgttgcaatctctcacaccgcaacctccattggtgttcgagagataattctactcgctcgctggtcctcgaacctctcgcaccgcaacctcagatggtcgaggtatgactacagcaataacgtagcagtcctcgcaccacgacttcaaatgatcgagagacacctactcactggttctcaaccagtcaatcgtagcaatctctcgtacatttacttctagtggtcgagtttagactacatctagttctcgaccagcggtgtagcgattctcccactatttctacttctagtggtagagttgcgactaccacctggtcctcgaccagaggtgtggcgattcttccattacctctactccaacaaagttgacatcagatacacaatatcgccaagtgttttacccagagatcccttaccacaaaagacacatagcgttgaaacctatcctactgttcctttacgccgtcttgacaaggcctccgaggaacctaagggaactttggctggggacgcccagagccgataaggccttgtcggattcttcagagacgaaagaccatgtaagatctggtcgtgtaagagttctcgccgtgcgtattaaccaagccgtgtaatcggaaatggattttccaacttcatggctgggggctaggatcagtgcttgttcaaccgaggcaggtcaaaggtccaagagccttgtcatccgagaacgattctccgacgacaatgctgggggctagggagagtgtatgactctacaaactgactgatcggagtcggtaagagataagacactcatatacaaaacactggtctgtacattcaattcactagtctgtcatattataacatgttaccctttgagcgttcgctcgggggctatttctatctaatattcttttcttagtattgattttaggaaaattctattcgacattatcgaagatcgcatgtctctatggttctacaccaagatcaactaaggcgaatacgacaaatgttgacaaggctctgtcgcagactctacgcctactcgattactcgagaacggttcgtggatctcgacgaggaatacggaatgaagagatggtgtacccgccgagataaaatttcttgacttcaatccaaattctcgattgcagcaagacgggagacttagtcatacgctctgtactttctcggtcgacatcagagattgacttagacaaaccctttcggtgcccgcacgaggctgataaaggaagtctaacattatctctaaactcaccgagaacggtcacgtgagctcgataatagttcctccaaagtctgcggttgagaatatgaactcgttcatttgcatcgaagtcgggggctactgtcagggttatggataccacatacctaatagtagttgactaaatctcggcaggatccaccacataccatgttttatacggaaactgacctcgagggagttccggataaggaaagacaaccagagttctacatggaaacgacaatgactactcatattgtatccatattggttttcctagttctacttggacaaggggacacctatgggtataaatacaagccgccctaggaggagaggggacatgagagaatcaacacccaccatggaggatcaacacccaacacaatcgacatagaagccacaacatagaagcctacatacgccaagacacgccgccggatattgacttcagggataagcacggctagtaccctacggtgtctccggatactgtcaggagagacgaaagcgccatctctgatctcgccgggcacgaattcgaggaggaaggctaccctgttgtcgactacgagttagatcgtcagaccgccatgtcgacaacagttagataggctaccccaaatattgtactagtgtgattatcatgaataagagcaataccggcttcggccaacaggatgtagggttattacctgacaattcaaggcccgaacctgtataaaaattctcgtctccatctattttacctcagtctcgcatatatcctagcaccgatgatccccataccatgtaaatactagaattgcaacatcaaacgtcgacacttttcctgttcttggaattattcatagctcgagcaattctgttagcaaccaaagccaaatcctcctcctcgatttgttcgagttgatcatcggatgtggcattaaaaacagcaagaaaagaaggcttagatgaagaagcatcaacatccgaagaggaagacgaagaaaccaaagcactcgacttagaatcaacttttcgagaaagaacattcatctcatgtgttttcaattttgtgtaaagtgaatccaaagtcaaagtagacatgttaacagactcctgaatagatgtaactttcatcttccaaatagacatgtcaagatcattcaaaaagtgacgagaaatctcagattatggataattagcatcataagaagaatcaacagatctaagatcactcaaaattttattaaacctagaaagatagtcatctaaagcttctccaggtttcatctcaaatttaatgtactcctttttgaaaagatctcgacgaagttctttaatgttattagttccttgatgaaaattactcaaaacattccaaatctcatgagcagtttgaagatgagcaacacgatcataatctgaacgagaaatcccactcaaaagaatattgcgagctttgcatttttgttcaaacttagtttttaaagcagcagtattaatctcttcaggaatcacataaggacgagaaacttttctccaaatatcataaccttcagccataatataagattgcatcctactacaccaatgagaaaaatccgttccatcgaaaacatgaggcttagttgaaaacctagcgggagtagccatgacaaaaactctagatcgataaaaatccaaagaagaaaacaaggctctaataccacttgtaggatcgaaacacaagaactaagccaaccagagggggggtgaatggttggtatacccaaaaaccgaaaacttttagcggaaataaaagttaccctcgaaattgacggaagtcagtctgaccgagattgatcttccggtctgaccgaagcgtagccgccggtctgaccggtgttgatcttctggttggaccgccctggaatccctgtcgcgcctgttgtcgccgccggtctgaccgcaggtcacccgccggtctgaccgccgtaatgccgccggtctgaccaccggtgtgtcgccgattagaccgcaaaaacccagtgaaacacaaatcgaagaactctaaaagtggatgacgactttattgattctctctgtgtttacaaagtgcaccaacagcactccttatgaaaattttgactaaactcgaaatcctaactcaaaactcaactcaattgctctcaaaagcgataccgggaagcctcacgctccccctctatttatacatgaggtaggcagcctaaagccatgaaccaaactcatactaagagtcctaaacaccttaggaaaccctctagtacaagaaacaaactttacataaccaatcgtaccaaatttggactccttccaaattcgtctccgcatcccatacgcacacaatacctccatcgtatgtcatatggaatctccatcaaccacgtgcatcaactctagcctaagtatcccgcatgatctctaaccaccacggacgtcgtcttatccccaagccgactcccgatccatcaccgcaaatactctcccgaggcatcaagtcacctacacatgaaataaacaatgaaaccatattccgagaccaagctatctccaacttgactcattagtagcaaacaacagtattacatacgtatagtatccatctagaagtcataattatgaaataatcacggatatccaaacaaacaacccgaaactgaaaccgacacagcgtcggccggtcagaccgcgggctggcaggtctaaccgcgcgcataccgccggtctgaccggctatcagagcccgatctaaccaatcacataaaataatataatcctgcgatcacctgtgaatccaatcgtctccaaaaccacttcgtgaataaattccaaataacaaaaccaataatctccaatgtccaattgttcatcacagaataataatcaaaaacacctttgattttacaatatatcgtgttcttttctcctgaaaatgaagatgaagattaagattaagttttttacgcaaaatgatgtgatattaacatatcattgattgtgttttagttattacaaacttgataaatagattaatataatattttagagtaactttcatatagaaaatttttgcacgaaacacaccgtttagtagtttaaaaaagcgtgccacaagaatcttaatcttcatctaacttttgttggagaaaagaataggactactgcatgagctcgggctacttttaactattgctataagttccaaccatgatcaagaattcaagatatgtgcctatgagcatggaagaaatacgctagagaggataaggttacaatcaaagtaggagagaagctctcaggcgtggaagaaaatatctcattaatgtggggaggagaagtgcttgctgatgggaggtaacatggctctaagagcaagttgctgagatggaggagataagagaggagagagagaagaaacggactgtaaacttagaggcggtttagacacaagaaccaagaaactctgtaagagagacaagtgggtctatattaattgtaaataaccttatagccaacaaatcggctgtattactagccttgctttaatagttcagcgattctagaacgacttacgagaaataaggctacctagtctaataattacccccctccattttaaaatataaacataatattaaggttagaggaaagaattcagtggatgtgcacactccttaagaaataatttggctaaagaacaaaagcaagaaacttagctacaaaactaaaatcatctataccgaaaccttgcttttgatgtccctattggaaccttgatgctttgttatgctaaacttatatttaatactaattacataattacttactcttcgttccctaattgttttgggtaccgatgaccactctgaacaccctagctaggtccgccccaaaagaaaaaaaagatctcactttactcacctcaatggttaaaatttaaattttgaattacttgtactttcgtcctaagcacttgattgactaaatatttacggattttatgccctagaatcaacgcctcaaaaatatttatgttgtattatttattttcaaattaaaaaaataccatatcacgcgacttaaagtaataaaacctaccctaaaatgccattagaagaacaaagggccatcgacccatcgtagggagagaaaaaaaacagtttgctactcataatttgatactaacaaggatactttggccgagattagtttcaaaatttttcttcaaacttctaatttttttatcacatcaaaactttcttacacatataaacttttaaatttttcatcgcatcgtttcaatttcaaccgaactttcagttttagttttagtgtaaattaaacacaccctttttacttacgtgcggcctctattccctcccgctttatcgcacgtcctgtttcccggcctgcttcctcgcgcgcgcgcggtcggtgagcgaccagaagaggttttgatgccatggctgaaactgaaagcgtgacctgacctcccaccaactccccccaaggcggggctagtcgatcgagccatccgattcattcccatgacccacgcgcggcgacaagtcggccggtgatttcaccgtaccagctgcccccccttgtagtatcacgttcgaacggtgcgcccgccgatcgagcttgcgctcggtgcgccagcgcgcaagaaaatcgccgcgcgacgaggcggcacgcacgggatactgcgccgcgcgcggcttccgctcttccgcggtgggatccccaggcgtccgccgcccacaacgacaagttggcacggctgcgcgaaggaacgaccagcccagccggcaggcagcatagcagcagacacgggcggatttcgtctcggcccgcgtcagggcccggctgttcggcggatgtcgctggctggctcggtccatgcaaacaagtggaaagtggcctatatctggattgagcctggccttgtcaacaagataggccttgtcgctggctcggtccatattgggctttcgggtgtgacatggaagttcgattcttttcttcaagtagaactggtggcactgttaaaaagacaacatgtttttttattgatcatttgcttctacccctggggacagtgtatagcataggttgttcataccatacggttatatgggaaaatatataagtgtaaaccatatatataatgtaaacccgaaaactatcgtacaataaaaaaaatggacgtctgaaattgtccacgttaccctgagtgaaaaaattattttcagatttaaccatagtaaaagttttaccatgacatggataagcattagatgcccatatttttatcctactatagtttttttttgtaacatatatgtgatttacaatacatattttccctcaattatataatgctatgaagaaatggtcatatgtctaaggatagcatcttcacggtggaaactgaactagagaaaatgaccgtttacgttctttatgaagaatataacatggcatgttcaagacaatatgtacattgtgtgaaccagcagtttactgtttatttttttagtgcaacgaaaaagggctataatcttttcagggtagggcaaatagagaataaataacatttttttccttgtgaattactcctatcaattactttacttcgttaaattcagaggaaacataaagttgataacattgagtatttaatacaaacacttcataaaccagagaaaagatcaaaattatggcatgaaggaatgaactttcagaagtcagaaactgtgagctatagatagactgatagagacattaaacaacaattaatttcatgccatctaaatttgagagactgttgccattacattacaactaagtgatagatatactcaagacaggacttggcatttgaaagtcaagagactggcatgcaaattagcaatgctcaagacagcatgtacatttgaaagtccaagaaactgaacatcactacatgctacttctagagacttttgcagattagcaatgagtaaatggagacaataactcagaccaaactgcaatattgagacctacaatgaaacaaacataacatgtattttacacgattgttacaaattcgttcgccccatgcttggcccagaaagtcttcaagtcaattggaatagcaaggttatacccctcaccacttcaccagtcaccggctagcttcctccttccagcaatacatgcaccccatgtttagttccaaagtttttttttccaaacttttaactttccatcacatcaaacttttcatacacacacaacttttctatcatcgtaccgattttaaccagacttccaaacttcagtgtgaactaaacacacttcagtgtgagtcattggtagtggatatgtcgaaatagaagttgtgcaacatgcaaactgccagccacctgcaccccaacgataccattgctggggggatcagtgcaagagctgctagcacacaggtgttgctatccttgaaagatccaaatcaataaccattaattaccatccccacagtcttctcgtggatgcatgcatgttatgtttgaagctttaccaaattttggtgtggtttttaaagagtgaaagtttctacaagattccaaaatttaggatgtattgatggttgaaatattttttgttcgctgataacgttgatttgggcaacaaattaaataggcacagtaaatactggagtatttgaacaactttgtggtaatccttgcacacaagtcataattcgtaatactccccttttctcaaaaaatagcaacttagaccgaagaagacatcacttagtagtataaatctgaacaaactatcagttatctactcacgtaaaggtgattatccagatttatagtattagataatgaaattgctatatatttatcgacaaattttctcttataaatttattaaatgtaaatacaatataattgtaattatattgtaacttttatgcaactatattctatcttttatgtaactgcaatgtaaattgaatgtaacttttatataattttaaacttgtatgtaagatatgtgtaagttagaaagaaaaaaattcgtagcgcgcgtgggagaggagattcggtctcgcaacctcctcttcatgaaaacagcgtgttaccataggagttttgaaagctgaatagaaattgtattatagtacaatataattgacaatattattatattataattatactgtatttatatctgataattttttatcgataaatgtcctagtctccattccaaaacaaattaacttctaaagattaatttgaataagcatttattcatttaagtttgtctcaaaagataaacaaagggcgtatattcagtaggtggagtacgccgatgttacggcagttcgggaatgtacccgcagcttctacaaccctccattctccccacgtataaggccgcgccccgcgatccaagcagcagcagccatagcccccgccagctcgccgccgccgccatgttcggcgtcgtcttcccggaccacagcttcccgctcgacgtcaccgccttcgcgcaggtggcgcccaactcctgggcgctcgacctttccacgctctccctcgccgccgccccgcgctccgccgtcgttttcctgctcccggccgccgccgccgcgctcccgccggggaaggccgtcgccgtctacttccagcccgccgccaaccgccctttcgcgttcctcggcgcgctcggcccgggccgcccctccgcgagcctcccgctcccggaggccggcgacgaaccggagccccccctcggccccgccaagctcggcgtcgccgtggaggacgcggcggcgctccctccgccccccgacgggcagcgcgccgagcgtgtcgcgctccgcgtcggcgagaacctgttcaacttcatgcagtcgttctgcggcgccgacggcggcaagctggtggtgcccacggacatcctcgaccggtggttccgcaagttccaggagcgggccaagaaggatccctcgtatctcaagacattcgacttttgagagcgaaggtacagaacagccttcccggtttgcatcgattcttcctgtaatcctgttttttttttctctttttgttcccctttggtaccaaatcgtcaattgctaatgtaattagtagttagtgttacgatgctacagtacaatgcttgtaactaatgctagtcttagtgcagtaggactaaaattagttttagatcatgatctcacattctcacagacggggacaatgttggagattttataagacaatgtagtggactagtggtgaacatggtatactttgggtatgcatgtaccggtgtatcctagaggcccaaattgaatccttgtgtaggccttgttcggttatacaaggattcaattcgggccgggaatgacaagtatagtaagaaatttatgatagatacaacgagagaccgggatttatt

SEQ ID NO: 74348 - DNA, 1680 bp, Oryza sativa
tatatatatatatatatatatatatatatatatatatatatatatatatatatatatatatatatatatatatatatatatatatatatatatatatatagcccggagtttgattcagttatttaattgcaaatatcagttttgcaattatggtcttgtggatccatgacttccttttcttttccaaaataaccatataattcctgttgtaaccaaaactcgtgaaaccaacagaataataccaaaatcatcaacgtaataatgagtaatacatacgtagatgaaataactaggcaattatgtaggcaaatagccaatcaagcgtctttgtttgcttgcgacaaaaaaatccctccgttccatataagttgttttgagtttgtcccaagtcaaagtttttaagtttgaccaagtttacagaaaatatttagcaacattttcaacaaaaaaaatattcgatgatggagttaatgaaactaattttgtattgcaggtgtaggtttttttttttacaaacttggtcaaaattaaaagaagtttgacttcaagacaacccaaaacttcttataatatgaaatggaagaaatacatacgatagttacagtatagtggtatacaaacatgccactcaattagggtttcatcaggtattgtcggtgcctctcaaaagttctattgagcgttcttggcatctcttcaatatcattgtgtcatatgaatatttcaccatgcatgtctctcatgcatgtttcaactacttccatgttagtcttgttcaaatttcagcaaccaaatgaacaaaagttaaagcaagccgccctatgacaagtcgatttcccatgagttatatattgagtccacctcaacacttggcagaaaacatatacaattcatccgcaaaaaaaaaatctataaactggttgacaagtacacttgatctctcaaatgaacctactccaaccccacaccacctgcgcctgcagcctgctactctactagtacttatcgatgcatggtatatctggttctatcatcctatagagagagatcacattgccattgcctttcttgctttgtgcagtgcctgctttgtctcttgtcaattgtatcatatccatccgttatgcgttttactctacttcatatccctgaaaaagtgtatcggtgtatgtaaaattatgaagtcgttctagtttgttcataaaaatgttatggtacctactgaatttctgtaagtaataaacattataggtattgggatgtcttacatggtatatgggtgtttctcattttctttctcctgacgcttcccatccttacgcttctatagatctctgagaaatggacaactcatgagacaaaagatggactctacagtgctagaattactctagcatatatatacattacccgaatgaaaaaattattttcatgaaaccacaaatgtacactcccttccactatttgccttttatctcttgttcattcttgaccttttccgtttcattcgtatgtctatgtatcaaagatggacacagtgatgaaataataggttggcgtggcattgatccccttaattatttgggaaagtcattttaccctttaaaggggatgccccttttttttgcatgtcactttaatcatgaaaaattcttgaaaatttgacaaggggtgcaggaa

SEQ ID NO: 74349 - DNA, 30503 bp, Oryza sativa
cgccgccgccatcaccggatatggacgagaaggggaggggggacggccgcagtccaccgctgccaacacgcatgcggcccccagcgccacccaagccgtcgccccatctggatctgacttagctcacgatggtccactgtcagctacttatctatttccctccatcctcagctaagttcacagtgctgaccacggtcaaggtgccacgtcatcgaataccgcccacaatactaccataggagtcgatttgtaccggttctagtaattgggggaatcgtcctacccggttttctagttaagggtcacgaattagattcggtgaacaattaagggagtcaaagtggactttttcctagcggcgccgtcgacaggctgacatgttccatgggatgggccgccgactcacccaaccgcgcgcatccccgcggcccaaaccaaccaactgcctactcgcgcgctggagctcacacaccgcccccgcggccgcgcgcgtccgtccctcttcccttccccttatccgctccgctccacagcctcgccccgattcccccctcgtgatttcccccttccgctcgctcgcgccgctccctaccggccaccaccgcgcgcgggacaagcaacctagctgctccggctgccaagccatcgccatggctccgtgccccgccgcgaccacgtacgtccgctgcacccagcactcctcctcctctctgacatttatcaccttatcaccttttgcttctctccctctctcgatcgtcagaactcgcattggggcgccgccgttcgccgcgacgacggctcgccgacccgcccggggcgcgacgacgacgacgaaggcgcgggcgtccgggctgcggcaggtggagggccccgtgtcggagagggcgtactcgtcctcctcgcccgctcccacccacaaggtcaccgtccacgaccgccagagaggtgtcgtccacgagttcgtcgtcccacaggttaatcaatacacacacaccttcgatgccgtctcaagcagcagtagcgcaattctccttcttgtgctttgtctgattcgtgccgtggttggggggcgcaggaccagtacattctgcacaccgcggaggcgcaggacatcacgctgcccttcgcgtgccgccatggtaggctcccatcctcgtgcctttcccaggacacattttttcttctgattggctacactttgccctcactactcactcgctcactcaagcttattagggcagtcccaaccctccacctagtatggtgtctatgacattaactacattgccatgtaggacttttagcttatgcggcactatattaattaagagagagattgaagagaggaagaaactgggtctcatgcaagacacagcttcaacacgagaacctatgcactagacactatcaagttttacattgggagagaatagtgtcttcataatagatgaagattaaatatgattggtagagaagagagatgatgtatttattaatggcccactttaaaaaaccatgggttgtagagtgtagttttgattgtgatgtcttattaacatggcaccatagacactgcttatggatattatgagttgggactgccctaagagtcaagttaatctgtgctggactttaaggcttagtcgttgcttagacaaatccatcatactctgctagattttagttgcacaaaaaggaagcatttttttacttgtttgtcaaatgttattcgtattgtattatgtatgcttaatcacggcaaaggaacacattaagcaagaaaaacgtgtgccgtaccatgttgatcaattgacacaagcggttgcttacttttggactcagccagtgtagtctctggctagcgtatcatttctcccttttcttctgatctacaatatagataagcaaatgaattactttagggaatgtgcaaatggattgctcactttgtattaagatggagaaagaaaagttacatcatcagcaattcggcatgcaaaaccagcagattgaccaaaacaaaaaaccaaatacaaccaggcgactatacttctgaattactgaagacacatttttctaatcaggttgctgtactagctgtgcggttcggataaagtcaggacaaataagacaacctgaagcacttggaatatctgctgaactaaaagataaggtgcatccatctttttatgctttgttgtcactattaattaagtatatcatgtttttactgtttctgctacagtttgcttgccacttgatccgcctcattcctcaatttactcagtggtttcaacagtgtctatgttctatccattagtaacacacgatcctacccagttagtattctttacaagtcaattgatgttcctgcaaggtttcatggccttcagcttcacaatttcttttattcgttacaaaagtatcacatttatttgtaatcaatagtttggatggtactatctaaaacaactgatttggagatgaattgttgacctgttaggatccttaaaggttcccttcgattttggtaagatagagttgtattgttttctttaattagtgtgtgaattaggtgttctagttgtgtgcctataaaacattcattattctgattcttctatttggcataacaaaaactgaaatggtgatatgttgcatgtcttattacttcctttttcagggctatgcattgttgtgtgttggttttccaacttctgatgttgaagttgaaacacaagatgaagatgaggcaagcattaagccaccttgttaatagtagtaactgtcttatctaaccatacagaaggaactagactgtattcttctgaattcttatgataagtcctacatgttccactaagcacataacacctcaatgtataggtctactggctccagtttggaagatatttcgcacgaggacctgttgtaagtattattaaatttgtatttcacaactcatagtttttatgcctaggaactcccgtgtagacaatttatagcataagcgcataactgttgatgttggctgtggttgtcaacaccactgttattccaattccactttaaacatgaaattatatcttctagcttttctcagacatagtggactgctcttttttttcaggaaagggatgattatgcactggagcttgcaatgggtgatgagtgagccgtgtctaaagaggtgacaccaccagaaatttcaatctctacattgtttaatctgttcatttttccccttatattctcatctaactctcagttctcgtccttcacagtggtgtttgcagtcgggagctcatgttgtcttaaggactttctttgaaagtggagaaaggggctttttcctcagctcacaattttccatcttcagtgctgttactctgttagcgattgtttggcatgtaaaaaagtgtgctttcttgtaaaaataccattttctagttcgcacctgacagacgaagaacaccatggattacatgtaaagttgtaaactgaacacctaatcttgagtgcgaataatgaataatgatcaccggagttatgagtttgggaatgatatgctgccatgaaaaccttgaattgagtgaatttgaatcttaaatttatattcaaagcaaatgtagtttcaaatacttccgttctatacaaccagtttgaaaatgagcttctagagttcgttgtagctgagaatttgtagtaaactagagtactgatgcagggcaagttggttttatgttcatgttgcctcaggttacaccgttgtccaattctgcgtggaaccaacctgagaatgctcaattctctgaaactggagtagccgagatgaattcagacaaatcctctgcccaattaggccggaaatcagccaacttgttattcttcaccgaattagtcccacgaatgaattcggcacacctcttcccatcaactaaatcagactgcttaattcatgtcagcaaatacggtccacaaatgaatttcccaaaccaaaatagcaaatacccacagaagtctacgattggatccactagtgaatttggcccaacacatccatcaacgagttcaacccaccctcaacgaattcagcacaccaacaaatttggtcccagttaactccatcagtgaaattggcccacgaaattcccgcaaacaaattcggcccgctaaaagatttggtccatctgctacccattagcgaattcagcccaagcataaattcggccgtcttattctcgacatcgtattcagcccatgagtagatttggcctcatagattctcgtctacaaattgagcccaagagtaaattaggccgactaaattctgtcaactaatttggcccaaaaataaatttggtccatctattttccgtaaactaattcggcccatgagtagatttggtctcatgggttcccgtcaacaaattgagcccgagagaaaatttgaccctctaaattccgtcaaccaactgggaaatttgggctactaatttcatttcaacgaattcgggccatgagtaaatttggcccactaattcccaataacgaaatttggcctactaattcccaataacgaattcagcccaccacggaatttgcaccactttattcttctaaaaaattttggcccgctactaaatttggcctgctaatttgtcatcaatgaattcggcccgtcaataaatttggccgactcaattcttgtcaacgaattaggccctcaatcgtattggaacgacgtaactcccacgaacaatttcggcccatcactaaatttggcccacttaattatcgttagcaaatgatttcggccacctaaatccagtcaacgaaatcgggccacaggtacatttggcccattaattttcccaaacagtttaggcccaataacgaattctttccgctaattaatttggcccaccgccgagtagataaggcgcgtattgcgatttgcgagggaagagacacgcgcctcgccgccgcccgccgcgatgctactggcgcgcgctccgccgccgccggcgatgccctcggcggtcagctcgccgccgcaacgggagagcatactccgcccatactgcgttccctggacccgcggctccgttgcgacggccgccgtggcgaaggctgctcctttccggggcgagcaaaaccacaagcaggtagcgagcgtggcgaaccccctggtgaagcactgcgttaggctcaggctctcctccgcgtaccgccgctcctgccgccgcattctcctcgtcggactcatccccatcctgtaaacttttctctattctaagctgcgaaattcccttattttgttttattctgagatgaatttttttcctaattctgcactcgtacgccttggtgcagggagatgtgtagcttcgaattctccaccatcgaaaccttgcttctcttggacggcatagagctaccggaggaattgtacgggttctctggcaatgtcgtgtatgtcagcgccgctgtgatgaagaaagtttctgggatgcaatcagttgattcaactgaggcaatcgctatcattcacatgcctaagtatttccgcgaccttgacagcgaccagggtggagctgttcttgatgagtggctcggctctgcaaagaggattttggttctggatgggattcaggtaaaaagaagtgtgcaatattccgttattatccatagtaaatggatgtcattttgtgcataagacggcacataatatgttgtttattgtttattttaagtttgaactagtccatttgattcctcttaagcaagggttctaaatttttactgtgtccataatggttctatcctgcaggaccctggtaaccttggaacattgataagatccgcttgtgctttcagatgggtatgtcatttactactaattgttgaagcgtctctgattgcatttctcaaaacttgatgtttcatggtctcatggatcacaccatcctattgtttcatataaagtagttatcacagcttgttttacttctcaataataaggtagaacttaagtgataaaaaagctaatactactggtagtatgtagaattattaggtttgcacttgtttttacatctaaggatgatagtgtaatgctattaatgacattttgaaagcaaaaggttagtacattctgggttagaaggctagaaaccccatacgtgttctacatttccacaaaaaattatgctcctattatacagcatcagatgaagtttagttagcagttagcacatgccaatatgccatcacacaaaaatatctgcatggtgtgtagcctaccagaaatttatactaactcttcaagtgctttcagtagtgttgttcggttagtctttaccaatttctatgcttctaacagcatttaaaaccaactaccaacaggatggggtatttcttcttccagcttgctgtgatcctttcaatgaaaaagctcttcgtgcagctcgtggagcctcattgcagcttccagttgtttctggtaactggtctgatctgcatgctttgatggctaaatctgatatgaagatgctggcaggtcatccagaaagcagcagtaatggatctgaaagaacacatgttctatctaaagaactagcggattcactgatgagtgaatcagtgtgcttagtgttaggaagtgagggcaatggcctttcggcagatacccttcaagcctgtgagcttgtaaacattcctatgcaaggtacatttgaatctcttaatgtttcagttgcaggtggtatcttcttatttatgctacaaaattaacagcaaaaaatggcagaacgttaactgtttaagtcatccttgattttttaataattttattgttcttgtccaatctgttacatttggttcttctttctgacatcattgctgatagcttgatatcaatccaaagtgaaggaacaaactgttaagaggaatgcaagatcttggttgacaaacaaaacaaaatgagaacattttattatataccctccctttaaattgaaatgaattgtttaccctcctgcgccgctgacatgtgggatcatctaagatcgctgacatgtggaccaggagggtaaatcctcaacttcaatctaaatggagggtatatgatcaaactttacctgttttgtcacaaggatcattggatggcactatatgaaacctagtaaatgatgatggaatgaactgccgaaagaattttaaaatgaactcattgttcagataaccaacacaactttgtgtaattcttgtagtatgtatttgtacaactgaagatcgctatgcaatttatgaaagggatccaccataatcactgcagccttgcctttggcccttgaatatagtagcttcaatcaaacacggtggtcctttatcaatacgagccttttggaacaggccagatcagtagtcctggtccacaagcttatgtaagttatctgtgaaattttgttgattgttacaggaatccttctatcagcccaagcatttactatgtagaattgaaatgttagagtacatttaacagtagtcagttgaatcattatgcaaattttgcggtaaaatgtccatttagacactggattagatcttccgtatctattgatataatcttccaaacttaaataatctaataggaagctttaagacttagtccagttgagatatgattcattgattgagtccaactttatgttctttcttgagctggaccgtccaaatgctataaatgactagcagctttcagtattgcttctcgctgctgtgggctgtggaatactcaaactgtaatctaattaatgatacataagatcagcagaaactcctggctttgtcagcaccgtaatgacaccttccacatatttattatgggatcttacatgtgatccaccattgctgactgaaaaaggtatcgtccttaatcgagacatcttgcacactggattttgcagcactacaacttatttcagccccaattagttggtttccagaggaaggtatgtcttttcaggtgaaagcttctttgtttagcctgtgagagcatcctgagtcatatctcatatgcatacttagttctttgattattgtactatacatgtcatctctgggaatgcacgtctgtcattcactgaaacggtggtgctccagtttccctgtttctcttgtagtgatacttacctgtactcctgtctatagctgatatgtggattcctctgacgacatacatgctggtgtaaaactgctcatcttaccgtgaattttgtattttctggaaaagtatcattggctccccaaacaatttttcgattgttgatggctaagttttcttaacccttggtaggtagtttatttcttctgcaatgcagtgccctatacattatggactgttagtgttcacttttcctgtactctgcaactgggacaaatatcatatcttctgtaggcaaagaggcattacattatgtataagttgtatgctgagaaaccaaccactaggtgcaaaatcaaacctgatggttctacatgagccagcacttcaatattttggcacccaagtgctagtggctgatgacaaatttaagatagaatacctgtgtcaacctaaaggagacacaaagaggcatactgatggaaataaagttgaatttgattcaccgacgcattgtttggcactgtggattgtagaatattaatttgttgaaaaaagcaatgaaatgacctttgcatttagtatttaaagaggcagtgctggaaacgtagttttctactgttttattattctattcatttgtcttgtgtttaatagataataacttgttatgttaggctgtgttcgttttcttgtgttgggaacttattccttccgcacagaaactgagtgactcattagcacttgattaattaagtattgatttatttattttttaaaaaataggttaatatgattttttaaaacaactttcatatagaaattttttacaaaacacacattgtttagtagtttgaaaagcgtgtgtgtggaaaatgaggaaggtaagttgggaaagatgggggaagaacacagcttaggagctttgggaaccaattaagaacatgggctgagaccctcaccaaaggagatatctgtatgatgacaaatcacctctgagttttgctcttttgaaaagaagttctgatgatctaggggcatttatattaattatggatttgggagctggtcagacttaaaatgacaggcagtggatattttcctacatgaagtggtggaacaacatttgtcaacttctattttattatctgctattctttggtaagcgattctttcgtcattctgcgttatacattcagtgtttttcctgtgacagtgattggttgatagctatactcatttcaaatgatgattgttttgggattactcacaaaacgaaacatcaccagctcattttagaactgaatgtggacagttttcaatcccagtagtcttctgctggccaattctctgccttgtactgtagcatgctctaaattactctacctgcaactattacaaccttgtgcccactgtattcttgttatataattgctaatttcacgcaatttgtgcatgtgtactttaatactggatctgtgctaactgctaagcatcactgaagtgatcatgtgcttctagcttggttttcacatgtctagttcagaagtgcaatcataaaccagttcgactaagtcctcaaaaaggagaaaaccagttctcgtaccagttcagaagaagaaaccagttctggactaatcatgttattaagatacatacagatagaatatttattgcatgttgggcatgctgttgtgtactcatctcactgtactcaacctcagtgcatacccaatcaaaagctatgatacctagatgtttcctttcatcatctatgtgtttagctcactaatcaacattatcgctttgtcagcatgccaatacaggcaagttgatttagtagtgtggccagcacatttcccaaacaatgttctctgttatgataaaggtcttaagacccatagatatatgcttttgttgaattgttgggtatgaatcatcaagagctggtgccatttggcatcaactcatttttttttgcagtttgttagaaagggattggtgtggttgtgtactgacaaatctatggtattcaataagaaattagcatagggtgatagggaggtcactgattggtgcatcatttgcttaattaagtactgccaggttggtgtgttagcctatctggagagagagagagagagagatcatgcaaatcaaagctttttggtagctcatgtcagtttgatacgtgtgcatgcatctgaatgtagatcggtatccttccatttgtctcttcctttgcagatttggggattatttgtgtcctcttttttttttgtcagaagagttcagggcattgccatgtggctggtatatatattcctgctttatcatttgctgaagtccccagaagccacaatacgttaaactctttatatatcagggaggaaagaagtagattaatttgtcggtgttgttaatacatttccctctagtttttcagctgtaaactcctgtgcctagaaaaaaaataaaaagggggtactatcacgtcattatgttaattcggtatacaactattttacttctgatcccacagatgtaactgtatcttgtatataattgttaattatgtttctccaaatacaattttctgttctatgcacagctatatcgatcaatcctcgctattaaaatttggactcatcatgatctactggtttacaaagttctctgtcttctattaatattgtaatttctaggcctttggaatgagtacagtggtttttttcaagtttgttttgataatataatagattgatgtcatcgacataaactttcgcataatagaacttggaatcgtgttactatttttctagagttattttttcaccgtagttttctgtagctagccatgggaatggtgcctacctcgactggcagggagctgttaggagcagacgagcagtgcaccagcctgagtttgaatccctttcagtgcatgttgttggtaacttttttggttacgccgtcaatcatgatgaaaacacctaatgttttgcggtgctacaaagtcgtcaaccatctcgatctagataaatctaaaccaaggtggtttatgtaattcaaaactgactagttgaagctggcttagatgaaatagggataaacatttgtctcgtgggtggaacggaaggtttttgggacagacctacaaagagattcgcacacccacatcgaggatggacggctttcagtgcaaaccgacaaagatggatgaaaactagaaagaaaaaaagtgattggctaattgtattgaaaagagattatgtgttcagttgaaccggccatagcctttataaagagactggtcttgtctcctacagaatcttctccacgtcttactcaaggtagataccaataaaaactcaaaaacctcaacccaagcaaggaagcctgagacccgacgaaattcgactcgaagtcggacttagacggtttgaccgtccatttgtcgccaatcagatcgatcagccacacaccggcgatcatactagccctatgtaggaaatcccgatcttattcaaatttgatcatattttcttatttcatgtctagatgtcaaatttggatgttaacacatgttttctcactactttatcagcaatggatgctaagatcctctttagtaacctaacacatttttttgtttttttttaaaaaaagttagccatgagtccatgacatcctaggacaagagtaaaaaaaaaatcaaaacagataaatcaaacttaaaagaacacccaaaattcataagatcgtcgatgtgctgcccaagttgccgtccacggcgacgtgacaagactacaagagaagggaaccaaaaggtggcaatggcaaaatccttggttctgctcgactgctcctactcatcagtcaccgaggcgaaaggcatggctgttcttgctccaaacccgtaggccatccactgcccattcgtctgcgctcacaagttgcagttaatgctaaacaccaaaggatgcatatacgcaagtatatattccctccgtactcataaataaagtcgtttaaaacaatatttaagtcgaaccttgaaaatatatattataaataactctcgagttgttgagtttgtaaatataaaaattatatgaatagatttgtcttgaaatttttttataaaattatatgaatataacttttccataaatattttttatagaaacaagaagttaaagttatattttgaaaactgtgtcgctgtagtccaaaacgactttctttacgagtatggaggaagtatgctttacaagtaggagtaggtcagatgaatctgatacagtaactatgagtaggattccatcatagagtttgcatgcactggcgtataagacaataccaacacgatcatatgagccaaaaaaaaggaagtccaataattaatccaactatccaagtagtactcgtttagattctcttaaaaaatcagtcgagtattgttaaaaaagaaaataaaatcagtcgagtaattaattcaagtactcgtttgggttctcttgaaaaatctctagctcccttcaaaggttggtgctgccgcttcgtcgtggcactttcctgctaacgaattcaaaaaagcgacaggggaaaaaacacttcatggctgtatttagttcacgctaaaattgaaagtttgtttgaaattgaaacgatgtgataaaaaagttggaagttcgtgtgtaggaaagttttgatgcgatgaaaaagttaaaagtttgaagaaatattttggaactaaacacggcgcaaattggataggaattgggaaaatcaaatcggtgcgttttttcaggtgaaaatgtcaagcagtcatgctgtgtcttgtgcatttcacggcacgatggtgaactcactcgagctattcaattgtgaaagctccaaatcttgtctcggtcatgtgagacatctccggcgacgacgatgggtaaattactctgtcggtttatttatcttttctttttttttaaaaaaaaagacatgtccagccacgtgactgaactatgggtaaattactctgtcggtttatttgtttatttcaaaaaatataaagatgaaatactaagaacatcgtgcccctactccattcccaatatagatttttggggatttcagtcggaaaaaaatacactaatagtttccctgctctctcacaaaaacgaaattcccttatctttcattctcactctccacaagttgaaaaccattctctcccaaatttcatcttttgagcgagactgcaactcaagagcaagcaggagaatgaccctgctagctaaatgggtggcatgatctgataatgcctaggtgaagggtgatcatcttttcattttagagagttaaatacagacatcaccttcctttctattttaagaagttaaatacagactatggaagcatatttttaataagaaaaacgggtcaaagttatacattaaaacaaaataaagtcaatagtgcattgaggtacaactgttaatatcctatatgacaaaagaaaacaaagactaattaatcacacttttaaaaaacaacgtccatggtgcaaattcagaagttgaaaacatacggcaacaaaaaaaattaaattcgaaggggaaaaaaaatgtcgaggaggagaacacggtcgaggaaacaagatggaaggaagcttcacctttaaaatatgcaaaatctccacaaagtcaactttccgcctccgcccgtagacttctttgaccgcatttccaccgcgcgtttgactttggcatctttgaccgccgccatgtcatcgagcctatcgcctcttgccacgtcagatcctcgcagctttcgtttcgcctcctccgctccgagacgaaggcacgaagcatgctgaaggccgccacgtggcacggctcgtccaaacagcagttagtttttaggctatcgctggtcttgcctaatcacgaagcaaattagttaagcgtgtgccagctaaattcacagtgtaaaccttcgtcattagctagcagaccttgtcattagctacataattaattatgtgttactcctaccatgcaagcttaaacagtaaaggctgtaaggctccgtttgaattcatggaggatgaagattaagtaaaaaatacataaaacaagaatattattattattattattattattattattattattattattattattattattattatttattaagttatttatctaatagtttaaaacaaaattaacttctatatagaatttttttcacgaaatatataggttagtaatttgaaaaatgtgttaacggaaacgagataaaatccatatcttaataaaaacaacgcgttacctggattaatatgctttgtcccattgtgtttacgcgataaattactggactaactaactcgccgcacaaacaaaggttgctacgcgtgggacgtgaccatgcgttgtcatcttttaattttcaattttttttcctccatgggcggcgcaccgtcgttgttcaattccatttccacggaataaaatgggagacgaaaacggtggttgatgccgtacagtggactaattaaaaattatttgaagctctttcgcttatcttttggcgtttttttagggatggagtgtaatttatggggcacttgacagttgacatcctaaaaagacaaggtgtgtatatcagtctctcgatcgatggtttgacaatattaattagcgaggtcctcgcacggccgaaaggtttagcaaatgtgaagattcatataggttgcctaattcctatttatttgcaatatatatatatatatatatatatatatatatatatatatatatacacacacactactatgctaccggtatttggtgattttcggtatgatgtattctaatttaaaaattttatgtatgatatattctttttttttagaaaaattcaggagtaaatttcactttgggtcattttttattactgatgttttgtttttaaccaccataaaaacaatgttttcactttgaatcggatacttttacctttgtggcactttgaaccatccttaattcttttatccatctatattaaacttataatatgctgaagaaatgatctcatatatagctgaggagttcattgacaagtagaaaactgacataatcgacataatcgagatcgttcagatgctctagaagtaggttgggtggtctaaaataaaacaaaaacaactttatccggtccaaagtaaaaacattggctaaatggtgatccaaagcgaaatattgataacaaaaggtggaccaaaatgaaatttactcatcaacttttgaccattgatttatcataaattatatttttaatagctataaatccaatatttttacacgttaatatatacttctaattgaactaccttgatcaaaacctataaagtcgattatttcgtatgagggcgtttataatttacaaatatgccatgtaatagggcctatttagatggtgaaatgaaaattttcgggtgtcacatcggacgtttgactggatgtcggaaggggttttcggacacgaatgaaaaaactaatttcataactcgcctggaaacgcgagacgaatcttttgaacctaatttagttgtcattagcacatataggttactatagcacttatagctattcatgaattaattagataaaaaaattcgtctcacgatttacatacaaagtgtgcgattaatttttctttgtatctatattttatactccatacatatgtcccaatattcaatgttatgtttttgcgaaaagtttttgggaactaaacagggccatagtgtttggcatgagaaaattatgaactcagagcccaagcaggagcaggaccgaaaacgcgtgactagtgcaaggtttgaaaatagtactccttaagagcgatactttcaaatctttatctggagaggctcaagtcttttttttattcattttttttagtttcatatttaaatgtcacgtggaacttatgaatcctaaacacaatgcctaactggcgtcacatcaccgatcacactccacccccattcaaagtttcaaacaaactccaccattttcgtatgaaattgggtgtgctcgcgcgcaacttgatccacacacgtacgcgttgcccatcgatctccaacagaattccgaattcaacaaactctaatcatcaccaaagcatggcccttgcccaatcccagctttcttccaaaaaaataaagaagaggtttccatggcttccaggcttagatcaccgaaattcaataaagtttatctgtcctttactttgtttcgccattgccatttatgcacggcggttttcaattaaaaagcagtgaatagtgtagccagatttaccaaagtgtggttgctaccgttttcatgtcaccagtagttgtctcgtcccaagatcacggccaggttcgatgaaccggccgcggcaacccaggttttgaggatgatgaattgatccgcatttgaatcaatgctaagctttgcgttttcgtatcacagatttggcgggtgatggacggaattggcgggaatggttaagtgtgtgcaccgttagctggaacccactaattaaatggatgcggttttgatcagcttaattgggacaggtgacaacggccggccgtttctgatgcagagatagaggtaagaggtatattcagctgatgaatctgttctccaaaaaaaaaaaaagatgatgagtcacctcactggctgatgctgatgctggcgtgtatccaacggatctctctcttgcttaaccgtctttttagctgaggtaggacagtgcctttgattccttggtcgagctaactgatggatcaatgacagctattagcaaaggctgtttggattgtaatttaagcaatgagaggcaagagaccaaaaaacagtactaccattattactactgctcgttcttgaagaacgatttaaattttagttttgctgttaggggttgttaatttgtatctcaggttttgttaaagctggtttaccttaatcatgttttagatcaaatcttgtttgtttggcataagagaattgtggatatatataaaaaaacataagttctctcaaagtaaaaaaaaatgttttattcccttcgctcttctgccttttctcttgtgggccaaacagaggatttggattttacataaatctacggtaacagaataataaccttaaacctaataattcgtataaaacttgtttttacttttcccatccaaacaaccactaaagacgtctgattagctcagtacttaaaatacagaaccttatgggattttatcttttttctttttgaaaaaaaaactactccctctatccttctctaaaagatcttatttttatctatacgtttggagtatcttttactccctccgtttcacaatgtaagactttctagcagcatctatatgaatatgggcaatgctagaaagtcttacattatgaaacggagaaagtaatacgtatctaaacaagtatttgcctagatgtataaccagaaataatgtcttttaggatagagttaatgtgcagttaattactccctccattccaataaatacatgaatatatccaaaatttatttaaacattgatttttttaggcgaagtgagtattaattaggggtaatctctaatacatgagtcattaatctctactgtttttaataaagaatcattaaagatgtccccttaaatctctataagggttcttctgcgcaataatagcatgtcctttaccatttgaaattacccctcaattgctgaccagatatttttaatggctcgtttaattgttaaggatcacagtggtgaaccattagatattaggctctgagtagaagtacgtgacttgaagatttgtgcgaacctttcaacatgttgaaattaatccactaggtaagggatttattggggtgccggacattaacagagggggagacgaccaataaccgatggtgcattaattggtgtggacggtagaaagagcattcacgtacgctgccactcggtaatgcttgaaggagggcaatgcatgggtctattccctcggtcgaaaaaaatgaacaaacatttgtattagaatatgacatatcctaatacaataaatctagacatactttatatttaaatttggtgtatcatatcctaatacttgattgatttattttacaccactagagaaaggggctttagtcccggttgggaacccctatactcctggttatacaactgggagcacaaatccaaaattaaagatgcccatctttagtctcaggtgaaataaccggagtaaaatggagccaggctaggtgcggttgctttttcttttcttttattttttttcattgcttttaacattgaatattgatttcactccatttccaaatcatcccaaattcgtgaaatcccaaatcgatcatcacatcacaaattaaaaggatcctctccaaatcctcaaatcgatcatttccaaatacatcacaaattcttaaaaaaaattacatcacaagttctaaaaaattcatcacaaatacataatatattcatcacatcacacacaaatcaaatacatctcagatatgaataaaaaattctcaaaaaaaaaccttagaggcgctgcccaccgctgccacgctggcctgccgccgtgccacccgcttcgctactacaagatgagaggagaggataagagcaagaaaagaggagaggataagatagagagagaagagggagagatgaggaagatggggagagagactttgcaatagtggatttgaggataagttttagggattatatacgacgggttgagttttagtctcgggactaaagatctaaataatctttactcccggttggttgggactaaagttgtgatctttagtaccgactaaagattctcggccccctgacaggcctctgataggagatgaaccatgactaaagatcatctttaatcccggttgatcaaaaaaattttaaccgggactaaaaataaattttagccccgattcttattagaatcgggactattgtggaaatcagccgacccagcaaagaccacttctctagtagtgttaggaccaagagagtatatttcaaagggggcaatgaaagagtgagatacacagattttatttgtcaatgaaagtttattgtctcaagttgatttattttgatatggaagtagcagttttggagttcggatataaatttgtagaatacatagatacatgccggtttgatgatatatatatatatatatagagagagagagagagagagagagagagagagagaaacttttaaggcttctgtgatttttttagagcaaaattcattgataaaaccttttcgtctccggataacattttgatatcaagaggaaagttttatttatctatagttgatagttttcatagactttttttaaggctccaacaaattttgcaggtatttccttagtgaacacatttgatgttcgaaataaagggtactaaattagtgcagtaactctgtgattttattttatttttttgacaaactaaccgtgtgatttcaagaagtcgaaatgttatggaaatttgttagggcatccacactatgctaaaaagtaggtagcaaggagtcatattacctggttcactattgtgagggtaggtagtaaggtggatactactattgtgagggtaggtagtaaggtggatagtagtatgatccagtagtaacactactaccaaataacaagcaatcaacaaatattaaaacactctcctttctcactcccactctcttattcacccatccattcctagtaataactaaaacaacaactcccttcattgtaaaatataacaacttaaaattggataggacatatctttctgtccagattcgtacaactaagatgtgtttcattcagtcatatgttgctacattttgggatggaaagagtacatgattttgtgttccatccttattacccacttgctattcccttcattcacaaatgatcagcatatatgatttgtgcacctatgccaatgcactcccacatgccacttaaatttacatcgattaacctgcaacaccgttttttcatatcctatgcatgcaacaagggaaatttgcaccaatgatatattgcttgcatgtatacatgcatgcacctcaaattacaattagttgaatagtacattgaactatgcatgcaaaagaccatttaataatacacagagaaacgaaaagccaggtataaaaagtactatcaaatatgcttaccatttctatataacgttgaaaaaaattatatgatgatcatttatgaatggagagtcttcctcctcattatagtccttctagaatccaaggtattttgtcgaaatatatcctgtctttgaacctttgtatccctaggagagtactacattataaggaggcccttagaagtaatcctctcttcaatgtcctgactagtcgatgcgatgtgcttacaggctacagcaaagaagggtacgtgcagctggttggaagtcgaaaccgcccgcagctgtactctctttatcacacgaaaacaaatctatgactagatgtgatatattttaataaaacgaatctagacattctagtacaataaatctggacagaaatatgtcttgaattcgttgcactaggatatgtcacatccaatcctagttttttttttattttttttacggagagagtagctagcgagagaagttcaaaccgcatggcatacacagatcacacgacacgaacatgctagctagatcaatttaccagttaatttgtctaatgctctattcatcttctagcgcttagactaacaaaagaaaattaaataagttgtacgaaatgtacaatccaacattactgggtgtgctcagtttcaaagtcatgaacaaccatttagacatacaaaacaggtggaaaaatgaaggcgatgcaagaaattttggtcaaggcgtatctagaaattccaagcccgaccggcctaacactctcgactcgtttcagaacattcagcaaaacaatactccctccgttgcttctttaacgtttgacatcattaacttttcaataaaaaattaacaatttctcttcttaaaagaagttactccctccatcccaaaagttactagagtacaatataagtattttttttactataaatctggataagccaaaagttattatattttgggacggaggtagtatataattattatttttttattgttatttgctttactattaaatatactttaatcaatttttttcatatttgtataatcttttaaaaaagaatggtcaaacgtacgtcttcaaatattaaaaaataggggcagtaattaattactgtacttttcctagcccgagctacttgtaaaaacaatatacagccggcatgtcacattagtgtacttgccttgagataaattaatatagagaaaaaaatagctcagctcagctctctgaatttctactactacaacgtggtggctcttctgaactctgaacctttaatatattttttccctcagcgaaagagaaaaaaaaatcaaggccggacgacgtactggcagagcaaagatccgaatcttggggcgtcacatgccgccacatgtggtccttagctcgtctcgttgttcttgcgtcgcatgtgcatggatggatggatcatgcatgtaagctagttgcacttgcaccacactgaccgcacgcagcagtggcacgcctcactcacgtcccgcgtattccctctccgttccttaagaaaagaatctaatacgaaaatatgatatatcctaaaactataaatctaaacagaccattatttagattgatagtactaagatgtactcactccgtcccaaaaaaaatccaatcctagattagaacctggacacatgtgtgtccaggttcatgtgtccaggttcaaacttaggattgggtttttttttttttgaacaaagggagtatgtcatttttagagacgaagggagcatatttctcttgcaaccaagcacaaacagcacaaatatttattatagacaaaacataccggacaatcctctctctctctatatatagagagagagagaggggcaaatataacgtcatcctgtctgtacttattttttccgtgtctgcaggacaaagatattcataccgaatgattcaatattaacgtggtaccatcaataatttgtacggtctttctctctctctctcacacacacacacacacatatatatatatatatatatatatatatatatatatatttgtgtgtggtgcaccagagctgtccttgatcctttatgatattgcttatgctattttaatatatgtatttcttttgagaatgatgaatatatagttgaaaatataatacatgcatataatatcatatgcgtagtagtatatgatttgacctaattaggttgtgcatacgtctttcacataatccatcaaacactagatagatcatatctaggacatccattgtcagtcaaagtcaccattttcgccaccacgacgaatctaattccatttcgtgccagaacgtactctcgtcgaatgtgagagcgaaagcagtatatccacactccatgactccatatccactagccctcctcatggatcaccaaattcccctcctcccttcacaatcagccaacgtgcagtgacacccaaaaatccttggagtccacccaggttcaacgaacctggacgcctttttctgcctccctaaacctctaaaacccgtcccagttcaaaaccatgtccaggtccatccaagagaggttcaaattacactggctgagccgcttaaaatcaaggtggcaaccggccggttgctaccgctttttgacctggtttgcattgtgaggttgttttttcttctccccgagataagaaaaagcgagcgtttgccgtttcggccggatcggcggcctcgggcaacgtgctcgagcaggcttgtgtgtgcgcacacgagtcagtcaagtcgccacatggccggaaaacacaatgcgttggatcgtttcgtggcagacaagttttttttttgagtgattccaaagaggagcaaccagggttcgtaattctgacaaaaaccggctgtattctatgaaatttcgaccttttgatatggctcggaattaatttttggttaaaattttgaaggttaaacattaagtttggtcgaaatttagtcgaaatttatcgaaaaccgatcaaaatttgtcgaaaaccgtgataccgacgggctcgaaatttagtggtcaaccggtaatataaaccctgggagcaactttggtgctcccttaatctcaaaagtatctctaccgatcttgcaatttcttgtgtcctataaaatacatagatatctttatattaggtataaatttggactatcttttcctatgaatttgagtaaaccaaattagacatgttcgcggtatagccgctatgtcacatctgctgacacaaagtgctattcgagctagctgtaccgtagtcgaatgagtgcagccgaattcataagtaaagatacctatatttttggtgacgagactaataaaagtttgcctataattttcctattttttagcacataaaatgtacaaattaagggtaaacatacaataagcacatcattgtattatatcaataaaatcgcacgatcacgctgacactattttgtttcctaaaatattgtgcattgaaattgcgatttttaacacatttgttgcaagacaggataagagaatggaaattgaatgaaatctactcggagcaattgagaattagagactccattttgaggagggaatgggcaaacaacacgccgaagataccgggagaaatgaatccgctatccaaaatcgagctaatatagcactgttactcatatgaatttctagatttttttcctacatatatagtgcaattctatcatacagttattattaatttgtaataggtgtatttcggtcttattaaactccgataataatggtttaacaattactccctccgtttcacaatgtaagtcattctagcattttttacattcatattgatgttaatatatctagacatataaatatggaaaatgcaagctagacttactttctccgtttcatcatgtaagtcattctagcattttccatattcatattgatattaataaatttagatagatatatatgtctagattcattaacatcactatgaatataagaaatactaaaatgacttacattatgaaacggaggaagtagatactaataaaaagggataaaatatacccaaacaatcgagccttgtatatgtattttatctaccttgatacgattgggatcaaagtaatacagtagtatattcttgctttcatgggaggatcaaaaaaatgataacggtataaaaaaagcagtgaagcaagctcgcagacaacacgccggatacaaaggggaaaccgaaataaaaccgccggagaaaaggaaatgaatatatatattttcaatttcgtaacgaaaaaagatatatatataaaaagaagccttgaactccgcctttaaatattcccacctcgcctcgctccccttccccatcatctcatctcacaccaaaaacgaatcagctcgtctccttcctccgcctccgcctccgcgagctcccattccattcccggattgcgccgccgccggtgttgcagcagccatggggatggggccactagagaacgccgtggtggacgcggcggcggaggccgtggcggcgaaggccgcggtcggcggcgtgggcgtggggggttcgtacgcggtgctgcagtgcggggaggactcggagtacgtgaggaaggcgtacgggggctacttcgaggtgttcagggcgctgctggcggaggacggcgagcggtggcgggtgtaccgcgccgtgcgcggggagctccccggggaggaggaggccgcggggatcgacgggttcgtcatctccgggagctgcagcgacgcccacgccgacgacccgtggatcgtcgccctcgtcgacctcatccgccgccagaacgccgccggcaagcgcatcctcggcgtctgcttcggccaccaggtgccacccccctcctcctcctcgtccgccatggatgtctccctctgttcgtctcggttgcgatttggtttggtttgctcgggggaggggtgaaatggtaaatttgctctttccgagatcggcgccgcttgcgattacctggttggagtggcgttgttctagcgacttcttatggattctttttttttcgtcttccttttgcttttttaaaaccatgcgcagtaaaaattcgaactaattgcattatcgcaggttaaacaggttgaatccgagtacaaaatttgtaaatagtaattcataaattggggggtaaacctgcaatggcaactgcagaagttcacaggaggtgagcttagcctttgcagtgatccgcacggactttttttttattttgaaaaagtacttcttctcaaataaataaaaattgcttaaacttaaaatatactctatccgtccaaaaaaaatcaacctcatactgaatattgaccatatccagatttataagatataatatatcttgagtttcttttggacggaaagaagtacaagtataaaatcgtttttaaaactagtagagctataatatttatggggcgtgaatcccgtgggcccacaccgaaccgcacccgtggccagaagaaattcccgtcttgtgcgttggacaggtgggccccactccctgtcacgccaacgcattagcctggccgcttaaataaaagaaaatgaatttttagctttcgctaaatctaattccggacacggttgatgacagcctggcacagtgcgccaaggcggttcacgtgagctgacgtggcggcaccggctgagctcacttgctgttgcacacacacaagacaatctagtaatctaattttatttaatatatattttttcttctctatatttggcggtaatcaactcctccgtggaattgctgccacggaagctgctcggtttgaacggcacacggttggcgtgatgcatctaaaccggtgaaggcggtcagcggtcgcttttcaaatcaaaccaccagcgacagcgcccaaagagtgtgatttttgtgttaggttggggtgggcttacatatacatgtttgaatccggtcgtttgtccgaacgagcgggaaccatggttacgtgaggactctgtatacgttttgttgtaaaaaaaaggatgagtgcgcgtattcaacttactataattgttttgatttttttttaaattttttttaagagattgcacagtctgatctgtgtctatagaaaggagatagaagtagccttgtccctaacttgatcgaagagacgagttgttcttgtttgtgcgagtagggaagcgcaacttgtgctgctgttcttgggggacattgatccccaacttgtcagcgggattggtttctttagtgattagtataatcgtaggatggagtcccgtaccgatcatagcttaatatccaagccaagcatcgtccgtgatttctgttcaaaagtcaaagctttgcaagaaccgtacagagctctgtcgaagaggtcagcgtgtccatggcagcaacagctgcgcaagaacagttataatttactcctacattcggtgtgccgcgttagatctcgcaagctgtctgaatccgaaaatggatcatgccagctcagctcgcatgtactccctctgtccaaaaaaaaaaaagacaaaccctggtttctgtgtttaacgtttgaccatccgttttatttgaaaaaattatgaaaaaaattaaaaagacaagtcacgcataaaatattaatcatattttatcatctaacaacaatgaaaatacgaattataaaaaaatttcatataaaatagacagttaaagttggacatagaaacctagggtttgcctttttttttttttttggacggagggagtactccactgtctgtctgtcggtgtgctctcctcctccacccacatggctgggctctgcgaagctctaccagttggaattagttgaaatgtttgtgatttgtgaacgagctggatgtgatgcgtcgccggccggccccggcatcggtcgatgatgaccccagtgtggcgaggatggaatcgatcgcctgtcagaaagaaacacgtttagctcttaaaaatgccagctttggtcttaattattcacgcacaggaccgagttggctgttgatctggtcccccttttgaagatctctgcatgtgattgactgcagtctgcaacatttgtttttatttttactggaaagtttcagatatgaagtaataatatagttttgccgtacaatggttcagtttcttgccgtttgaaaaaaaaaaaacaatctttacacaagtggctaacagaggcgtgatcactctgctgcaggtcctgtgccgagcgctgggcggcaagacgggccgatcgaagaagggctgggacatcggcgtgaactgcatccaccccaccgcggccatggcgaggctcttttcgccgatcaagctccccgtccacatgcccatcatcgagttccaccaagatgaggtacactttttcgccgtttcgttttcaaggtttgctctgatcaaagcttcagaaatggtcaatgacctgacataacttacatggcaaaatgcaggtgtgggagctgcctcctcaggccgaggtgctggcgcggtcggacatgaccggcgtcgagatgttccgtctcggcgaccgcgccatgggcgtccagggccacccggagtacagcaaggacatcctcatgagcatcgccgaccgtctcctccggaacgatctcatcctggtaagctacggaattgactgaactctctgtggtttcttctgtctactactgtagctggtctgaaaaactgaagatttgtgttgattacaggatcaccaggtggataaggcgaaggcgagcttcgacttgcggcaaccagacaaggatctgtggaagaaggtgtgcaggggttttctgaaggggaggcttcagtcatcgcagcagccgcagcagcagcaacatcagaagcagcagaaggcggcgcagctggtgctatagtaaacaagattagtgagtgagatcagatgggggcattggggagcctagattaatccttattttctgcttcagatttgtacaggaaaaaaactatttattcggagcaataataagagagtaattgggggtggcctaattagcaaaatcccatttgccaatcaattcccatcttccatcctacattttcgtcacgcggcacataacaaaacgtacttacatggatgctcgttcatgtatcgatcgtcagtactgtaggatgcttccaattgaaaccgagtcccttttcaacttttccaagaaacaaagctgtgtccatccacagcgcccaaacctgcaaagtacaaaaacactaactttctctttggcgtcatttcaaaagacccaaccaaccaaacaaaacaagccagtaccaagtccctctcatggctcaacagtgttgtgtttgttagttggaacgaacgaaggacattgtcatcatttgggctacagaatccgctcggtttcttggccgtcctcatcgcgcgagagagtctgccaagatccaagattccggcggctccccggccacgcacgcgcccatctctcgcgaacgtgacgccgttgcggcgttggtgaggacgaccacaacgcaacgcagcacaacacaaacgcggtagaaatgagttgaagagatgtggccagccatggccatatgtggggtgcggggggttagtgtagtatggacaatggaccaccggcggagcgccgttaagctggtggagacgcgcgagcgagacggatccacgcgcagccttctccgtaggcagagggattccgggaccggcggccggtggctcatgcttggcggagggggaccaattgatgcaattgaaatggagatagctacgtaacggtattccgtttaaacgggatgatacttcagaggtactccctcctctccgtctcataaaaattatatttctagctccaagtctttgtcctataaaaattatatttctagtcatgtggggcccaaccaattgattcatctatataagtttaatttgggctgctaatgcttgtaattttattaagtatgctaattatatgggttaattctctcaaacttccttttaatcatttgtatatatggaatgtgtgcatgcagtgggttcattaaataagttattgtggtcatttttcaatcctactattttatcctaaattagctagaaatgtaatttttatgggacggaggtagtatcatctgatgtgtggatatcagccgatacctaccaggtatctgacaatactttagaggtttcatctcttctgaacggaatatcgtcctgtagcatttttcattgaaatttactccgaactatttagttttttttagggggtggcaattaggatatttatagagtggaaataagattctatttgctttactactttatccctattttttctaagggaaaatctgctctaggacactttaggctttattttgttgccaattccaaccttacttaacttgatgccttacaaaatttagtagtatttttgagaggaaagtttcggaagtaacaaattttagtagaatgtcattggtaaggtaatgtttagttcgttaccctactaaaatttggtagcactacaatttaatacgtcgaaagtggtaacaacgtgaacatgccatctcactttgatgtgaagttgaacgagggttccatagcaatgccttcaaaaaggtgaacggcgctcgagggcattgttgtcgctccaccagcaagccgagtaagactttcacctcagagtccccatacaaccctagcatccacaacgaaagccaccaaatttcacatacacaccgaagctacctgcactatgcacactaccacctgcacaatggtcggactggtaccattgacaacctgctctgccacctagccagacccagggagccaggtcgtcggtgctactagatgactaccaactagacagtcccctcacagagaccaccatataacctggatgtggatctacagaaagagaggaggaggaggagggggggggggggggtagggagaaggaaagatggggaaaggaagagg

SEQ ID NO: 74350 - DNA, 26685 bp, Oryza sativa
  unsure (1)..(26685): unsure at all n locations
caatgtgatgcgatggttcccttacttgagtttccgcaatgcatgcccaagattcaccaatgttggttcccacatttcattcaaggaggatgaagtatgctccagtgttagctcaaaccactgaactgctttttgatacctaaacattttttttaaaaaaaacagaatatcaaattctcaactactttaatagcagcacaaacagttctttttactgaaaccactagaactggatgtgtcaaacatttttttcagcagagaaccaaatctaatgggatgaaattttataagttgaagagaatttgaaaagcaaataaaaaccaaacttgtatatggatcatggacatcaatcacacgtttcaaactctaatgatcatactataaatgcataaaacacacttgttatcgtgattgcgttaatgcagggcccagctggtgcagcattagttggaaactaaggggaaaaaaattagttgctctcttacttgggtttacttcactgaatactatgtgaagatcttgtcgatacaaagggaacagcaaagcatccgttacaaatcaatcaagaaagatgaaacattttttctccccaaagttcatcataatagcctatcctttcttatttatcctggagccattccccttcttttattcttcttttatcccaaagttcctccggtgtagccagtttctacatgctaaccttaacatgaactagggttcacatcatcccacttcaaaaagctttccatacaatactatgcatactacatccatattctattcaaaatttcagaaccaccaaatcaaccttgtatatcatggacatctttcaaaacatccatgttagcataacatttttcctataggaatatcagatatagaacttataggaatgctttccctttcatgagagcaaagcatcttacaagggaaagtggagcatcactggttccaataataataggataagcagacaaaagaaacctttagaacagagaaactcttactctttcatattataagctacaacccccatctcgttatatataagcggatcagatgggcagatagattttgcttgcgtgaagaactgcatcacagcagaaagaaaagggggtttaaaaaaatgatgacaaaactattatgccttgccaaataaaactttgcaaataacatactctccatgataggctctcattgtgagctacaacaaacagtattcactaagtaaaaggaagttgtgcatgataatatctcattttctataacccatccaatattacaaatacaggatgtattttcagcatctgaccaactactattaccacattaaacctccttttttgccaaaaacaaaatatggaatgagaaaatatagggaaaaaagtcagctctaagtatagtttctttatcagagtggaagcctcataagaaaattagtctcggtaggatttctcaagttattacctgctctgcaagtttgaaattgtgcattcgcaaatattgcatgcccatgtataaagttggcagatgacatctgaaatagaaaacaatttcaacaaatagtgagccgaaggacagacaacaacagaggtgaagtaattgaagtgcaacaagaatctacactccaaaacaaagagaggaactcaatccacaatgctcataatcagtaatgtgtagtagatacaaaagcttgccagtgtcccaaaaaacacgaatagcagtttccagaacagaaggccaaaaaatgaaagaaagtagaaaggatccacaatgctcataatcggtaatgcatagcagatacaaaagcttgtcacacccaaaaaaaatacgaatatcaatttccagaataaaaggccaaaacaattgaaagatagtacaaaggaaaattaatgcaactaattgtgttaagataattgctccttagacaaacaagtacaagtatgctctggtgttaatattgagttgacttaagtgtaaaaagaatcaaattaatttaattaatattttgctaaactgtacacagcataataacataacaaataaagaagtttttttacacaaacaattacttcgaaaggaattactgacccaggaaatagccgagctgctgtccgaaatgcagccattgcttgatcaccctcctcctgtgcagcataagcaataccagtaccaatccaagcaggaggaaatgtcccatctaaccctgtagctttgctgataggaaatatattagtgcaaaacatattacagctacttaaaattgaacaagaatacaaggtataagaagttgtaagagggttaaacccatccatgattaaattcaatgaacaatgagcattgaacaaataagaaacaaaataacctgcaacctttggactggtataactgagacacatgtcttaagaaaatatatattgtttatttgaacttggactctggagaattattggacagatatgtttcaccttacaaaccatctgacagactgatactacatgagtagaacctactcatttctgtctttttatcacattgttctatcattccagacaactaaaaatatttaacaaagaaatatattgtttgttataagaaatcaatcagtcagttggatatgcgtagatttcaggaggcaatggcacctatggacactgttctctccatcagatggtaacactattgtagcacacatgttataccatgtctgccatgttttcatgacaaaagtgttgccttacgcaggaacatggttgtgatttgcagtgcagaggatattcactaatcacaccctattttattttacatcccaacatcgaaggcacagcaggattatcttctaagctatcctaaggcaaaaatgcatagtgaaggttcaaataaaaataatacagtagaaattaagagaagaatatgcttacccaaagtatctgcgtgcttgatcatacttcttaatacagtagtaataacacccaacagcaaaccaggaaagagctctacagatggaaccacagctgacattaaaataatatactttgtttgctcatgtctgactacaaacaatcaagtgtactttagtattatgtccctccaactattggagtctatataaccaacatgaagggggggggggggggtcaatctcttcttgttcatcacataaataaaggtcagttaacatattttaccccaatcccgatgctattaaaggctagattttacaagttgcattaaagtttgcagaaagatgaataatgtgcacaacactgtcattatatctaagattgttacatgcaaatgaaagggggaaaagcccatctagcaggataacaaatattatgtgggtctgaatgtgggcaggccagtgggaatactcacttctgaggatagtccttcactagattgcaggccaaaatataaaggtcatttgaatggccaagctccattgcagctgccaaatgaactaacgtgcatttcaaatgaaaagggtccctttcaagtaacctgaggcacatatagcatcacaagaatgataaaccaatattgatcaaggaaacatatgtaccgacaatgaatcatttaccaacttacgcagatgtgagttcgaaacatttttggtactctccactctgatgatagtattcagctttgcaagccaacacgtcaatattatttttcagtgtcagtcctgaactcaaagatgaaatactacaagattctcgttcaaattccttgaactttgcttccactatatattctttttcatgctaaagccataaaacaaaacaaaccatgatcaaaagaaatataagtgaatgcagatacacatattgtttattaaattgcaaagcaatgcagttaataagtcgtgtaccttccttatcaaacaagagtagaatgctgagagccacccatcttcttttccaaattttagagaggacaatagctcagattctgatatcattgcataacaataagtaccaagaacaaagagaggattgaaggtccaacattaagcatatcttcttaaaactagtccagtaataacaataaacattgtattatttaaaagaaatatcctaagaggatggacatgacagatgggaagattgattttgtaaaacttaccttcctcgcatgtcaacatgtagttatcaacaaggcattcaagggcctgccatgtacagacataagaagttaggaatgaactaactggggttaccacagaggcccaattccatgttagcatctggatgccaaattccatatttagtagaaccaaaaatacaaaataatggtggttcatgtaattgaaaaggtattgtactaaagagtcacatgattcttctcacctcatagcacaaaggatcagccttcactgcagctttgtacctgagataacagcagaacaaagccataaaaccatcttaaccaagctatttggccagatatgcccaaaaaaaaacactgattagacaatcctgcttaaatcttaatttcaaacaaagaaaattagcagtacttccaggtagcaacagttatttcaactattagcagtgtgtcctcgttttacaagaaaaactcattttctttatatcttctaaagagtatcgaataacccaacattctcagtgaagatattgagtaaaaggtgtaagagaagaaagacttcaaaataactgcatcgtcattcaccagaaccactgaatacactcaattagacaaaaaatgaaatgatgctttaccattgtcgagcaaggtcacagttgtccagtgcttcgtatgccttgccacgtaaaaaacatattgccgctttgatctggcaagcaaatattactatcaatcaccatactaagagagagagagagaggcatggggaagagaaagaagagtcaacacacattgatctcatggtcttcagcatccttatcaaagtaaatgtcactgccatcatcctgatcaacaacgtttccatgctcatctatttttgcatctccaagtatgatcaaacactgatgccattctttcaactcctcctaacaaaccaaaacaaaacgatgaaacagtagctaagataaaaggaaagacggtagataaaataaaggactacacaggactgtacaccagagcacaaatcagaaaaatctatactgaatcataatattttctggtatggttcaattttctaaagtaaaatcttagaagtacattaaaaaaatcactaatcctatacagttcttttgatctttcctataagaaaccagatttttgtttcgagtgtcatggatattgattgaataagcagtcaaaatcatatgtgcagtttatatatctgacatatatagaacttaaacaaaattctcatttatctaaaagtccgaagcaggaagcacatattataatcaaccaaactcccagatcagaccagctattaagaaccaagctaagcacccgttcattgatggaatgcccaagtaaaaatattctggtcgagaaaatgcaggtgtatcatgttaattattttgaagcatcagcagagcattggacttgaagccaaaaaaatgaaatcccccagtgcaagccattgggcgcaccttgtgtgaagtaaacgaccctatctcaactcatacagctaaagctaaaagctgatcaagcaaaattttatcgagtgcttgcaaacacacagaatcaaatcgtcaaaaaaactgccaaacaatgcccagagtgaaagaacattgaggccaccatacaaccacaagctgttcataaggaagctcaagcgcagccacgcactggaacattaacaggggcagtgaaactaaaccttctatctacacacagcatgcacccaacatgttcgacaaaatggcagactaaacaagggcgtgggtggggaagctcacgaggcacttggctgcgaggaagcggaagcggaggtcgcggaggagcttggaggagttgaggatgtggagcgcgcggcggaagtggcggcccaggaagagcgcctgcgcgagcatgtagacgtcggcggggtcccccgtggccgcggccaccttgtcggcgaggaagatggcggacgcgtacaggtgcttcccgacgctgtcccgcaccaccccgcgcagcctccaccgcctcctccctcatctccgccgccacctccccctccgcctccgcctctctcctccgcttgggatttttctgcgctgcggcggcggtggtgggcggcgctgctggagggaaaccgaattttgtatcccacattcgccactagggttcgcggcggagagtggtggtttttggaaatttctcacggggaaaaaaaaatggagtcccgacgcgccgcggatcgcagcaagtgatcgatggatggaacgtgcaagcagtatggcttatgggccacgggcccacggcccacaacatatgcaaacgaaccagaaagcctgtataggagaggacacacgggccaggcccatcatctggccggattcggaatctacctctgtgaaattgcgatcaaaacctacggaaatgtatagatttcgtggtatacaaatgttgattttgccagcttacattgacgttcttcaccttagtcgtccctgtttgaatttacttttctattattattaacacgggagaaacgataatttgaaatgattcctttggaattcctgcaaattcttatgtctatcttacaattgctgcactgttctttttttttttatcatgtgaagacgaattaatgtgcacgaacgtcgtccatcggagccgaaagcggtcgctacacgccgccggtgatggccctcgttgccggagtagcggtcatcgcctgtgagccgcaccgctggaaatcggcgacgcggggcggcggcatgccgcggggagccgtcgctctcaccggcggcgagacgccgacggcgccggccgggtgcgccgccgccagggcttcttcgccgtcggctgcgaggtcgccgccgccgcaggagaggaggcacgaggcggtctgggagcagcccagcgtggtcacgatgacgtagctgccgttctcgtacagcttcatgacgtagcactcctcgtcctcgagggtctcgcgcgggacgccgcccacccgtcgcgcaggcgccgccggcgaggccacgggaacggcggcgacgtcgtcggcggcggcggcggtggagggcgcgtcgtcaaagcagttgaggtggcagtagtcccagtagatggggcacctcctgatcaggatcgggttgcgcccggtgcagaggtagcagatgtacatctccgtgtcgtcgccgccagtcgtcgccgtggcggtggcattgccgggcgccgtgttgccgtcgccgcccgtggtggacacggcggcggcggcgaggaggaggagaacttggtaggatgcacggttgatggaagctgctgagagaggcatatcacaaattgatgagagatgatgcgtgcagcctgtctcatttataagggttttttttatggcggggatatttataggtcattttggctgcagctgcattttgacgtcaggagcgtagtagtatgaaattatgattatgttgggagaccaacaaaatctcagtcaatgaatggatactacaatttgactatacgagaataagtgcttacctgtttctgcgtaagagtgctatctgaattctgaagggtggtatcaaatttcaatcgagcaatctgctaattatctcttcccatgtagaggttacatgtttttcttcatcaagataaaccagaaaaatcggttgcatacatatgttattttgtaattaagattcggattgtatctctgtttcgttagcacgcttttaaactattaaacggtatatttcatgcaaaaactttctatatataggttgctttaaaatattaaagatacccatttataaaggctgtaataattatattttaattaatcatgcactaatagttttctcgtttcacgcgcatcaacttaatatttcatcctcatctgaaaaatagctttctagctgtactcattttccagatcaaacgtctagggtatacatttcctattttcctctgtacaaattttctaacaaggttcatactcatgaatacccggtacatatccctttcaaaaaaaaaacatagtacatgcacgtagactacgcatatcgctatgaacagcaaacaaatgtagtgcaaatcagtagtggaatagtgatttactaattcagctgttcagcaactacgcgctccggcggtggatggtactatttgtcagcggtggacacggttaattagcaagcccaggaagcaatggattctgtttgaaagtggtgagcaacaagcaaagtgtgttgtgctgccgcagccatttaccaaaaaacaaaccaccgaaacggcaggttgggacgtttttagccatagaacgaggagacttctcgtgttgctgccgcaagccgcaagatcgatccgatcagtaagaaattaaacggctgtgaatttatcccaagaacacacactcgtaatttggttaacagagacagatcgtagtttgcaaatatgagctggttgattcttccacattaactactacttcctgaaaaaaaattgtgaaacctaaagtgttactcgtattattatttttatttgttttgcttgcttgaatttcttttggttttctctctaccatactgcctatatatttatgcacagattgacacgaggtttagtgctatgtccaacgttacattcgtcggatcggatcatcaaacggcacgtacgcgttgtcgacatgggctcgcggacggcggcacccgggcacggctagcgctggtcgccgcaccgctcgaactcggtcaggccgcgcggcagcgggctaccgatggcggccggggtgatctcgccggaagcggcgcccgacgacgacgacgacggcagcgcgtcgccgtagctgcacacgaggtagcatcccgcggacgcctggcagctgaccacgtcgacgacgacccagctgccgtcagggtacaccttcatgacgtagcagtcgtcgtggcccccgccccggccgttgtcgccgccatcgtcgtcggcggcggaaaaaggcagcgcgcgcggcggagacgaggaggaggagcgcgacgccgacgacggcgacgagaggcaggcgatgtggcactcgtccttgtcgagggggcaccagctgatcatcagcgtgttgcgcccgcggcagaggtagcagatgtactgctgctcctcctccgtcgtcgccgtcgatagcggcgaggagcggccgcggcgcgccatcacggttgcgttggcggcggccgccgtggcattggtgccacgagccacgacggcggacgtggctggcctggcggccgccgtgcctaccaagaggacggcggcgacggcgaaggagtaaaaggagaagatggaagccgagaaagccattggcaaataataattgaaggcgtgtgcgcggtgacactgacacacgcagcgcgtggcttatataggatggtatttaggtggagagattagtactatggtcatgtttggaaaataggtttgggatatgatttcccacacctcaaaggataagtcttaatcttagctatccatcattctcaccatatttcatcctatcgcttcattcatttccgtttcctaattccacctctcctaacctattttccaaacaccctatagtactaaattagcgagaagattggatgtccttgagctttactgcagaggagtatatgcaaagaagttatcatgggttttaaaatttaatcatttcctcccaataaaactttgtcagtgatatgggcccggggttatcatgtttagagggaggaggctgccccccccccaaaatgccacatggccctcccccaaggggagtcaggcccgaggtggggtggcggccactccttcccaaatactagtcggaggaggccgccccccaatgccacgtggccctcccccaaggagagtcaggcccgaggtgggatggcggccactccctggccgagactagagggaaaaggctgccccaggcgccacgtggccctcccccgaggggggatcgagcccgaggtcgggcggcggcggccacctcccgtgactaggggtcgggctcccccgaccacctctctaggtcaccacgtacaggtgcccacctacccgcatttatggcgacccgagcggtcgcgccacgccggcgtgcagtgtactcaaccggtctgtgaccggtcgaataaccgatggaactggctagtgcacctgtgcgctgctcgtgtgttaggcggcgtgcagcctgacatgtcccatcaaataatgatggtgagaggttctcatcctcttatcccagccggagtcggtcctcccgctctggtcaaagctaggctcccgttccccgatgtaataggagcccagaagtcttcacccattaaatggtgaatgacatgggcgtccctcgtgtcaggcggcatggtgtggtaggccccacgaccgaggcgacgtggatgcggcttccaagttaaggaacaagacatgcatttaatgcaaagatggtaatacttctcgaggaagttagttgttgggcctatgtggtatccccttgaactataaaaggaggaccttgcccactgagaaaagggacgatgacgacgacgacgacactcagtaggcctgaactctaggagaagaagagcgagaatgctctccggagtttaggaacccttgtaacactcaaccataattccaaacacaggagtagggtattacgcttcttagcggagcgaacctgtataaatctcttttgtctcatcgtctttggggattgaacgccctcaagatcacacagcttcgctcaccaagccctgaatctcacccgctgcccccggccgaactcacaaaggggggcctcacggttccctgatggaggagttcattctccgacatctggcgcgccaggtagggggcgcgttcgtgatttttgaggttctttcgagcgccggcgcgataagtgttgcgccgccaatgcgggggaaggcgcagcttcctcaggagtgccgcaccaccccaggcagggggccaggcccccctcatcttcaccggataaggctggcggccaggtctttatggcgagtcttcggaatgaccgatgacccccaaagtttcggcccagcctcaccgaaaggtaccacggtagcatcaacccctccgagtccctccagatccacacgacgatcatagaggcggcgtggggtgacgaccgggtcaaggcgagtttcttccccatggcccttcatggccaagcgcggggatcgctcatgaacctgccacctgccttcgtctactcctgagaggactcttgcagttgagctccgggtgccgtcgaagcccgggaccccctgtgctggctcttccatagcggctagcttgggtcccaccggttggctacggtgcccggcctggctcaactgtggacggggatcgctggctctagagtttttcggctctcacacacgggcgaaagtagtcgtccgtgtagaaggaagagatattgaaaggaggccaccgaaaggaaagatcaaacagaatgtgtagcgtggggacacaggcttgtgggaacctaacctcgtttgctaagtggtcgcaggcttcccaaagtggttagggacccatggagggaggccctcttcaagctaaaggtttgaaaggtcgcgacatgcaagcaaggtttgtgtttgcttcattcatacaaacgattctttgctaaaagtatgggggctacgattcctagctctatcctagccctgcgtcgagctttgggcgccgtcgacgtctgggtccccctgtgctggctcttccgtagcggctggttttggccccgtcggctggctacagcgcccagcttggcttgatcgtgggtgaagattgttggctatggaaaatttagtcctcgcactcgcgcaaagatgatcatttgcatagaattattattgcttatgtttatctctcgcccatctcttcctcgcggtcccgcggtacccacgtgtcgcgcgctggcttgcctcccttggtaacaaaaagtttgtattcacctcatccattcaaacgattctttgctagaagtgtgggagctatgattccttaagcttcttatttncccnctagccctgcgtcgagctctggtcgccgtcgacgcctggggtcccctgtgctggctcttccatagcagctagttttggccccaccagctggctacggcgcccagcctggcttgatcgcgggtaaagattgttgactatggaaagttcagtccccacgctcacgcaaaaataatcgttttgaatagatgaagtataacacgaacagaggttaacaagaggcaggggcaagcaaggtacgcggcgtaaggtcacgggcccgagagagtctaacaacatttgctgagtatatacaggaaataagttcacgacctaaggtatgggctaaactcccgagcccgcagtgcctcggagaccgggaggaaagtgggaagttaaggcgacgtatgaacgtgactaaactcccaccgcccaactcccagaatgataggacagaagatcgggcccgcatgtcaactgactagcagattggtgtcaaccctgatcacctgggaaaggttttggccagggctaacgccgggggctactgtcggtgatatgagcccgggggtatcatgtttagagggaggaggctggggtggcggccactccttcccaaagactagtcggaggaggccgccccccaatgccacatggccctcccccaaggggagtcaggcctgaggtggggtggcggccactccctggccaagactagagggagaaggctgccccaggcgccatgtggccctcccccgaggggggatcgagcccgaggtcgggcggcggcggccccttcccgtgactagggatcgggctcccccgaccccctctctaggtcaccacgtacaggtgcccacctactcgcatttatggtgacccgagcggtcgtgcggcgtgcagtgtactcaaccggtctgtgaccggtcgaataaccgatgggactggctagtgcgcctgtgcgctgcttttgtgtcaggcggcgtgcagcctgacatgtcccatcaaataatgatggtgagaagttctcaccctcttatcccagtgtcatgaccggcaatggtgacactgaaaaagttgtaatcaataaagctgtgagagctgccagaatccaccaaaagtaacaagactttactgtgaaccaatgctctcaaacgaatagcagtaggaaggtgagctcctgtcaactgcagaccttatcgctattctccgttacaaaaagacgagattgagaaacaggtgaaagaaatgattgatgctggtttaattacacctagtatgagtccctatgcatcacctgttttacttgtcaagaaaaaggatggtagttggcgtttttgtgtggattacagaagattaaatgctctcaccattaaaagtaagtttcctatgccggttgttgatgaattattggatgagctctcaggcactaaattcttctctaaactggacttgaaagctgggtatcatcaaattcgaatggtggaaactgatgaagccaagacagcctttaagacacatcatgggcaatttcagtttagggttatgccatttggtctcacgaatgcaccctccacctttcagtgccttatgaactcagtccttgcaccatttatcaggaagtttgtgttggtgtttatggatgatatcttagtttatagccctgaccttgatagtcatttgcatcatcttcagcaagtttttgttattttgaggcagcaccagttgtttgctaggaggtctaaatgctcttttgcttgcactcaactggaatacttaggacatatcatttctgacaaaggagttagtactgatcctgagaagacagcagcaatgctggcttggcctgtgcctacttctgttactgaattgaggggatttttgggactgacaggctattacagaaaatttgttcagggttatagtatcatagcacgaccattgacactcttgttgaagaagaaggcctttctttggactgatgctgctcagcttgcttttgatcagttgaagacagctatgagtaacactccaatgttagctttgcccaattttcagcttccttttactttggagactgatgcatgtgcttatggtcttggtgctgttttaagtcagcagggtcaccctattgcttattatagcaaaactttgggccctgttaatcagaaattgtccatttacgaaaaagagtttctagctattatgatggctgtggataagtggagatgttatctgcagagaggtccatttatcattaaaacatatcacaaaatcttgtgtcatttggatgatcaaatattggggactgaattacagcaaaaggcaatgactaaattgatgggtttgcaatattcttttcaatacaagagaggggttaataatattgttgctgatgctttatctagaatgccttcctcctctcaattttgtgctttttctgtggtccaaccgatctggattcaggagatgatcaattcttatacagtggatcctcaagctcagcagctactagctgagttggctgtgcattctcctaattctcaagggtattcattgacacaagggattattagattccagaataagatttggattggatccaatgcaggactgcatactaagttgattcaagcttttcatgcttctgcacttggtggccattctgggattgctgctacttatcatcggattaagaaattatttgcttggcctggtctcaagttggatgttgaaaattttgtgaagcaatgtcaggtttgccaacaggccaaacatgaacactgtcggcttcctggactgttagctcctctcccaattccaaaagaggcctggcaggacatctccatggattttattgaaggtttaccgcgctctgatggctataatgcaattttggtggtggtggatcgttttactaagtatgcgaatttcattcctttgcgtcatccattcactgcatcacaagtggctcatctggtggacaaaactgtatttaaaactcatggcatccctcgttctattgtgtctgatcgtgatcgtctctttactagcaagttctggacaactctttttgctacttgggacactcaattacagatgagcacagcatatcacccgcaaacagatggccaaatagagcgtgtcaatcagtgtttggaaatgtatttacgatgcatgactcaggctaaccctaagaagtggagccattggattcatttggcagaattttggtacaatacaaattatcatacatatcttggctgttctcctcataaggctctttttggggtggatcctcattattctcaagttcctgatctgacattggctactctgcctgatgtggtggatgttcagactgaaaggcagcacttgtctgaatttttacagcagcagttaactcgagcccagctgcgcatgaagaacaaggttgataaaggtcgttctgaccgtgtttttgctgtgggtgatgctgttttcttgaagttacagccttatgctcagtcctcagtagttaatagaccatatcctaagttggcttataagttctttggcccttttactgttttggagcgcattggagtggcggcttatcgtttggatctacctgccagcagcactgtgcatccggtgtttcatgtttctcaactcaaagctcaggtgccagatcatactcctgtttatacttctttgccatcccaagtggttcttgatgctgctgacgttgttcctgaggcgattttggagcgtcgactagtgaagcgcagcaatgcagctcatgtccaggtgttgctgaaatggtcttcattaccagcagatcatgctacttgggaggactatcatgttgtgaagactcgctttccagatgctccagcttggggacaagctgaaactcctgcgggcggcactgtcatgaccggcaatggtgacactgagaaagaggtttaactgtgaatgatagtgtgtgtgttttgggctagactttatcaaatagaatgcggcctgtgtgccttaaatcgtttgggccaacagcccatgtaatcaggagataaatactcgagagagagaatggctgtggccaacctggcaaaagaaatcgaatctatctctctccaaactctgtctctcctctgcctcagctctgtttctcttcgtccccaactccgatctcgtctaaatatatatatctctctctctcgtcggcggcgagtttcgcggtggcgtagtgttacacccagccggagtcggtcctcccactctggtcaaatctaggctcccgttccccgatgtaataggagcccagaagtcttcacccattaaatggtgaatgacatgggcgccccccgtgtcaggtggcatggtgtggtaggccccatgaccgaggcgacgtgtatgcggcttccaagttaaggaacaagacatgcatttaatgtaaagatggtaatacttctcgaggaagttagttgttgggcatatgtggtatccccttgaactataaaaggaggaccttgcccaccaagaaaagggacgacgacgacgacgtcgacactcggtaggcctgaactctaggagaagaagagcgagaatgctctccggagtttaggaacccttgtaacactcaaccataatcccaaacacaggagtagggtattacgcttcttagcggcccgaacctgtataaaccccttttgtctcatcgtctttgggggattgaacgccctcaagatcacacagcttcgctcaccaaaccctcgaatctcacccgctgcccccggccgaactcacaaagggggtctcacggttccctgatggaggagtttattctccgacaaacttcatggacatatatctatatttaaactacaataaactatatccaaatacactgagaaaaataaaagcatataaagttcctatgaagaaaaaaaaatcaaaaccttaaattggcggatccaaatttcaaacatttatttttcaccgttggatacttggatggtactagttaactcacgcaaagacctacttttccgataaccaattcctgttacgggtaggtggtgcatacccttggttaaatattcatgcatatgaccttttttttttcaattatacggtagagtacgtgcacacaacactatacacatatttttatgggagtatccacaggtttgtccatgatgcacactaaaaagagcgagaccagcgacacatctttggtgtcactaaatttttgttgaaattatacttgtattattgagcacatcaaattttaatcctagtgggtgaaatcatacatttacaactacaccaccatactgttagtgcttacttacatgcatatgaaattcccaaatggatttatcaggtaatttgggaaatatccgtatagttaaaatatcttatattataggacggggtagtacctaaccttcaaatgtacacaagttaccgatccaatttctaatatatttttattgttgtatcccttattaaataaaaatatgtgtattgcattttcttaaatctgttaaagttccccgcaaaaaaaaatctgttaaagttaattaaaaaggaatctccatgaatttctaagagaaaaataaaaaaaatacaatccttgcatagttggctcatactacgtattaattattaaccctcgcagggttttatcgaagggagaaattttctttcaggtattatcaccttacgtgcagctattatagcgtgttaaagttcatggtgtcatcattgttggaaaagacatcaaaactagttacagaagtactcagagttatgagaaaaatcgtatggttttagtgcaaaattgtttcattttgtgtcaagtttagacttgcagtagatggttcattcgaagagtcgtatgagccttactgaagtggaagccgagctttcccccaacggcaagagtccaactgtccaagagcaatcaggaaactgcaccggcagattagtaccatccgattccgattctgatccgagcttacttctccttattggaatcggatacggatccattcctggcccaggagccattgcccggtctataaatatacagtactactccggaagaccccgcaagagcagcaaactcaaggaagccgacgcgacgcgacccgaccgatcaaggagattgcggagatgggcaaacgacggtcgcgatcggaatcggatgctgaccaccgcagcggtgcgtgcgccggcggagaggccaagcggccgcggccggagcagaagcatctctacctggcgctggacgactgggagaaagggtacaatctctacaaggttgacgtccacgcgatcggctccgcggacacggaggccgagtcgcaactgcccgagcctcccgtgctccagctcgaggccgccaagggcgcacgcgacgtgctgttcgccgccgtcggcaccgacatcctcgccctgtggcagccgaggtacgagacgacgcgcaccgccgtgtacgacacggccacggggcggctggacgccgccggccctcgccacccgagggcgctgcagcccatgcgcttcgtcgtcgcgtcgtccgccggcgcccgcgggctgtacgcgctgcacgggggcggcatgcacttcctggagcgccgcggcggcggcgaggcgacgaccgagccgcggtggacgtggagcacggcctgctcgtcgctgcgcctgccgttcgacggcatgcagcccggctcgccgcgccgcaccatgcaaataacctcgtacgccatgcatcccgacgggcgcaccgtcttcgtgtccgccacgagtggcaagcaccacggcacgttctcctcctccctcgacgacgacgacgacaacgagtggacgcgccgcggcgactggctgctgccgttccatggccagggccactacgacgccaagctgcgcgcatgggtcggcctccactcgccagggcacgtgtgcacctgcgacgtcccgtccaccaccttcagtagtgtggcggcggcgacgtcgcagccgccggcgtggcagctggtgaacgcggagcacctcttccaggaggatcatccggagcgcggcggcacgtcgctggtgtccacgggcgacgccgagttctgcatcgtggagtccgtgacgccgaaatggatggatccggtgtgggatcgcgacgagatcgacgagtacgtgctccgtgtcaccaggtttcgtctcaagcacgaccggcacggacagctccgtgcttcgtccaggtgtcgccgcgcttcctacagggtgcgcaagcatgactctgtctttgcgccgcaagcgttctggatgtaatcgtgttacactagttactaaacttactactacttgtaaattgtaagaagtccaaactttctcaatcacgaaaaaaaaaagaagaaaagaaaatgtctcgttcgtgaaaaaaccttgaacgacaccacatccgggatcagggagatgaacagcaggtggaaaattgcttgcctgcctcgcttacgagccgtgagttgtgacttgtgacttgtgaccgtgcgtgacgacgacagaggctgacaggcaatttgtggacgagcactgctacacgtgctttttttttaaaaaaaaagaactcttataaacaatgatgtttgatttaagtatataaaaattatagcaaatgcagatatactcatagtgttagtaatagataataagagtttagtaagacgaaattgtatagacttttccttcatggacctaaaccgccaggcccatgggcctcagcttctggagtctggaccagcgtaacacattgaacaaaacggaaagacagaaaataaacaaacaaacttgaaaagaacgaaaaaaataaaaataattgaacaaggaagatgaaaattatacgagaaaaaagagtagaagttttggagcattcccttgtcataaaatttagagacttttaggagaaaaaaaaattccatccaatctaccaaaccccatctcataccatccaaaatggtcgtatccaactaacaaaaacaaatttacatatcctatatacttatgcaattcatccccactaagttattttcctgcttcctggtgcagccacgtcacttcagaaggagaaccgccagatcagttttctacgccacgcacgcttgatccttgaacagacgcatatgctctccttcctgccggtgaacccaatcagccgactccttccatctccatgttgtcccctgagcttcctactgccgctgtcgttcgacctcccagcagttgcttgacgttctttctcctttgtaatggccgacttatatatcttctaccggctttccatcttattgagtctgtttattgctcaccttaattctatatatatatatatgatcctttgaagtctgaacaagccaattgccaatgcagcatatcgggcattctcgtggtctcatggcaactatacattgaccagttctttcaccttgcaagtgaactcctagcccattattccagcaagtctgacttggaagtcattggaaacaaaacaaggttcctccgatttatcttgctcgatattagtacataaattggccttttttttaaccactcgcacgagacggtgtgaacttctattgatagagcaggtaaaaattacaagattacaaccttggaaggtctaaccaggaaaaaggaaaaaaatataccaccacccacacaccgacagcgccaacacacaagcccgggagaaggcaagcaccggaccgatcgccgctagaccaacaaaggaacatagacgagatcaccccctaggggatgccaaaacgacgtctccaagaagagaagtgacgggagaaccaccgccgccgccgtccgtcaaggttcaaaggagccaagactaggctttcgcctggcaaccacctttgaggggtgagacagcacgacaacaccctcaggagggggaacatcgttgccggtccggccaaggccgggctaggttttcacccgctgctcaccacatgcaaatctacagctggtgtcccgatgctccaccactgctcaagctctgccgacatgtggcacacctgcaccgccgccccccgccgaccagccttcgtgcgcggaagaccgcgccacacccaccggcagctcctcctcataccgaggtcgcctcctccaccgccggccacgcctctcgcgccaagccggcctccatctccgccgctcgcgccgagccggcctccactgccatcggctacgcctctctgcgccaagccggtctccgacccctcctccaaacgatgtcgcgccggctagaagtagccgtctgccacgccctcggctagccgaccgaagccgtcatgcctccggtgaccgcagacacgatcaccaccaccgctgctgccaaacacccgttgccatccacacctcgcacccgactccttccccgcctcaacctgctgtcgccggcgatcgtctgcacgacgtcgccagccgctgccgcatccagcgacatcagcaccgcctcacagacccgaccgccgcaaaccagccgccgttgccgctgtcgctgtcaccagccaccgacgacagccgccgtctccgcaaaccgccgccaccgccaaagaagccactgcaccgtcgccctccaccaccaaagcagccagcaaccggcccgatgccgccgccatgtcctcagctgccgcagcaaccaccaccggccaccctccagatccggccgagcggcacggatctgaggtacaccgccgacgtcgtcaccgagcaccatgccaccgtcccctccttcgctcccgccaccagcgccaccatgccggcctccgcctgccgtgcaccaccgccaccacgcacgcaccgctgccaccatgccatgccgggttttgccgtcgctggccgagccgccccgccagtgctgcgtcagtcgaagctgccgccgtcgcacgggctccgcgcgcctccgtcggccgcggacttagcctcgcccgccgccgcaccaccgggcgccgcccacgccgttgccaccgaagccggccgctcctccttccccgtcgtcggacgcctccgccgcgcggggagcgcaggggagctagatccggcgtcgccgcacgccggcgagcccgctgccgcggcctctaccccgccgccaacctcgcctcctacgcccacgccgccactacaacctctgccgcaccgccgcctccttcaccccgccaccgactcctccaccccgctgccttcttcacctcgccagccggtcgggcaggccggtgtcgccgtcttcgcgccccagaccgtgtcggtgcccccaccgccgacgggagggagagacgaagccccgccgccgccgtccttgtggccgtgcggctttgccggcggccgctcgggcggcggcgaggcggcagaggcaggagtgggggagcgggcgacggcggcggtggtttctgcctcccgtgtcgcccgtgagggagacgatgcgggggctctctttcgatacgaatgctcaggttacagattaaattggccttaaggccccctttgaatcacaggaatgaaaaaacgggggaataggaaaaacataggattctgataggaatacaagtgtaaaacagaggattgcaaaacacaggaaaaacataggaatgaccgtttgattgagccgcaggaaaaacacaggaatttgaggagagagaaagactcaaaggattcttaacatgaggtagaacctcatgttaaatttccttcaaaatttgcatgggaagaggcattccataggaattttataggattccataggattcattcctttgattcaaagggctatataggaaaaattcctataggaattaaatcctttaaaattcctatgaatttcctttgaatcaaagggggcctaagttttgtcgtttcagctcatgccttttctccgtgcttttctgactccatgggcaagatttactatgtccctcactacgtgggaactctgtcatgtggtgtatctgtatttttgttctgtctatcctctacagggttttgatctattacgtgtactctgtttttcactaaaaaatatttcacttacccatgtttaatccccccccctattgtttttctacggatgggcctaataaatgatggtagcagatcttaatttctgggcgtaatatcattttaattaattccaatcaaaggttgttgcacttagaaacccagacttcatctgaagattcgctgctaagctgtttatagaatggagcaactgaaaacgaagaattaaaagggttgttccaagtagttcatcttttaaccttgcaggcacttcatacctcatatacattatttttgtttggtttctaagcccccagtgcatttgttgcttgaatcacagaaaactgatttcttagttcataaaagcactgggtcttcctaggaatatataatctagaatttcaagaggttcagcttccttttttttttgcataacacaattaattcattccttcgagttttacctcgcattaacatttatgttgtactgagaatgcgaattttgttctgtttgcatgctcattgttgctgacttgctgtggacagagtagactgttacatggaaaatggaacacacatactcacttgggcagtagctacaagcaagttaatcgatgtacaattttttctatcctcaatcaggatacattgattggtgataataactacttagctgtagcttcagtagtctccgtagaaaggattggcacttttacatttttagataatggatattttatacccggcttcatctatcaaaagatagactcatgccaattataacaaacgttcttacagagtaacacttggaaacaaaaccgagataaaagttcagacgactaaagaccgatgtgtctagctgataaccatccattggaactaaaaaattgcaaagctgatgactcaagatgttgcgatgccgcgatcaactgtgaacgcagatcctcatgccgttgcagcttcgcccattggcgtaaccaatgcgtacccctgaatagtacctgcaaaaaagatttcggtccgtaattgtcaaacactaactcgtttcttgttaaccaaactgtccagaaaagcgctgctgctgcagttaacagtaaagtattttgttttttattaccccccttagaccactgttggaataactcaactaagtttgatggggtacttataccaaacaaaatatgaaccgctcgccacaagaacttggcaatatagcaatcaaaaaacaggtgttgaattgactcaggctgatgacagaaagcgcattttaaatcaccatgccaattcctcctagctaaattatctttagtaagaatgacacctttctttaagtaccacaaaaaaatttttatttttgaagggaccttaatttgccaaatatcctgtgaaactctaataccattactgattagtgcagcatacatcgatttgacagtaaaatttcctgaggcctgcaaagaccacacaaacgagtcacccccatcctgtaataatacttcctgtatggaagcaagcactctattccatctactaagattcgctcccaccaaattccgcctaaacgaaatattcagaggggacgaactaagtactttggccacagagtcatttttccttctaacaatattaaacaatgatggaaatctgtcctttaaaggtttattacccagccacgtatcgcaccaaaatctcgtttgcgatccatctttgattttgaacgatcccaagcccaggaaagtgtcttttatgctcattaaacctttccagaagtgtgaatccgtagcccttttctggcaacaacctaggggcttttccttcaagtatttgttcctaatcagttcctgccaaagtccgtcctcatttaacagtttgaaaagccatttgctcagtaagcatttattttgaatctctaaattggggatacctagccccccttgtatctttggttggcacatgactgtccatttagctagtctgtattttttcttgtgctgatcattctgccaatagaaccttgatctatagcagtcaattttttctagcacaccttttggaatttcgaagaaagacagcataaacatcggtaagctggaaagcacagagttaattagtacgagtctccctccggccgttagtaattttcctttccaaccccccaacttcttttcgatcctatttttgatttcttgccaatctttattgttaagttttctggtatgcatgggaagaccaaggtatctaaacggaaatgacccaatcttacaccaatagtggaataaaaggcttcgttctcttttgctctaccaaaacaaaagatttcgctcttatggaaatttatcttgaggcctgatagttgttcaaaggttgtaagaattaacttcatattaatcgctttggcgacatcatggctcatgaaaattccgtatcatccgcatattggagtatcgacaggccatcctgaatcaggttgggataacaccctctacgcggtcagcgtttttggctctagcaatgagaatcgctaacatgtcgacaactatattaaatagtactggcgacatcggatccccctgcctcaagccctttttggattggaaataattaccaacttgatcattcacctttatactgacattacccccttgagtaaacttctccacccaactgcaccatttatgtgaaaaccctttcattctgagagtttgttggagaaaagaccatctaactttgtcatatgcttttcaaaatctatcttaaaaatgaccccatcttgcttctttgtgtggagttcatgtaaagtttcatgaagaataatggccccttccattatatttctacccggtaaaaaagccgtttgagtaggtttaatcactttctgagctactgatgtaagcctgttagtagccactttggtaaagattttaaaggagacgttcaggagacagattggtctgtattgctgaatagtcctaacatccttctgcttgggcagtagaataatcgtaccaaagtttaggctattaagaggcaacgatccctgctgaaatccgaaaacagagctaacaggtcgtcctttataattgtccagaaggcctgataaaactctggtgggaaaccatccggaccaggtgcagtattatgtttcatttggaatatagcacattttatctcttcttctgtaaaatctgccgttaaagactcattttcttctgcagagacttgtcgtatgtcgtcgacctgagactcatctaaaaaaatagatgaagtctgtgatgggccgaacagggtcttaaagtacttggtgatgtgctccttaagttgagcatcaccagtaatgacctcgttcccgtcctgcaattggaaaatacgagttttcctgtgacggccatttgccagaagatgatagtattttgtgttagcatctccttccaataggtgcttgaccttagcacgttggtaccatttaatttcttcctccctcaataactca

SEQ ID NO: 74351 - DNA, 1601 bp, Oryza sativa
ttcacttgttcttggggtgttcttgggtttagcaccgggggtttcttgggttttggaggatgatttttggcgtggttgtggtttcttgggatggatggatggttttttcagggtggcgagattggtttcggttcttgctgttctttggtttcaaggatttcagtttcagggtggcctcggtttgtggtagagatgattggtctctttcacgcgcttctgttgttcggagggatcttggtttctgcatgttcttggatttgatggatacccgtttgtttgttcttgcatgtgtgttagtagttcgtggagtcgagtcagagttcagaaaaatgcagattttttttgtgtgtgcgcgtgtgttcgaagttcttgtttggttggtgggctgtgcagcaaaatcggcatgaactagttgtttcttgtgaattccagaatgtcaggtgatattcttggaataaaggttcatttttttatattcggttactgttcttgtcactctctgatctctgattattatattcgacggtaggatatcgtctttcccccacatgcagatgttgactgcttgctttagttttctcgtgtgtgtgttttttttactcggttcatatcgttttatggttatttgcatttgaagattgattcttgtttattggaatctgttacagttcttggttccgtggaaattggaatcataggtctcatacttgaatgttgaaaacatattttattattggtagtcaaatctttattttgtttttcttgggttaccatcatgacaattgcgtgcaggttctggtaactttctttgtgccgatttttttaagaataaaaaaaaactaaaatttcaattatttacaggagaacatcccgatcgaagaagtattccagaatttgaaatgctgccgacaggggctcacttccgaagaggcgcagctgcgcctgcaactttttggtccgaacaagctcgaggagaaggaggttgagttccttcatctcatcttgccattgctatcaaagatttacctttttcttgttggaaagtaatactataattcagttcatttgcgttacgtttccgcttatgctgggtcattgatggttgcaggagagcaaattcctcaagttcttggggttcatgtggaatccgctgtcatgggtcatggaggctgcagctatcatggccattgcattagccaatggtggggtaagtacttaggagtcttagacataatgacaaaatctgttactcctatttagtacttggcttctgtccttttctctgttgatgaatgcagggcaactgtgtaagtggtcccgttccttttaacaatatatgtggtgttatcatcaggggaagccaccagattggcagggctttgttggtatcatcacactgctacttatcaggtcaaatatcagtttcattgaggaaaacaatgctggcaatgctgctgctgcgctcatggcgcgtcttgcgccaaaagccaaggtctttcttcaatctccacttttattatgagatatccactctattgtccatattgaggtggagcacttttgaatattgaaactcatgttgtgttggttgttaggtgctc

SEQ ID NO: 74352 - DNA, 8142 bp, Oryza sativa
agtgacatgccttagcctcagtttgcgaataatcatcactgtctccaaaccagtgctggctcctccatattatatccctgaaaaaaaaaagatacattggagagaacatgttacaagatcagatgtacacaactggagagtagtttcctagtgtgtttcataacaaaatcatgccatgtgcaccaaatttctcaccatcactcttggcttctctggccttgtttatgctgatgcttcccatccccatgcacattagcacatatactttcagaacccaacactttgtgggaaactagatatactctaaaatatgctaccaatattcagatggatttattgcccaaagtcacaatcgttctttcattttttttctatcctttgccttctgtctagctagtgtccacagttctttctcatgtttcattttggaagtttatataaggaagatggtgatcagacactgcaagggagatgtgctagagtctctcgctttgtgaatagccagctcagttaatttggtagtgctggctgttctatttcatatccctgaaaatgtagatgtatgggaagaaacatgtagttctctactttgtttggtcaaagaaatagatgtggaaaaaactgaatttctgaccacttgaacctaagtaatgcgtgtcactgcattaagatgaataaagtttggtacaaccaaaaacaaaaaggaggcagaacccaggaggacataagcctaatctagcgacattaggcagctaacctagcgacattaagctggcgtaagctggagcagcgcggcaccagctgcactccagagtgccgcctcttccgccattgatctaggcctgtagcatcctggtgccaagggagaaggttgtgatgtagacattgttaattagtacttctttccttccagattgagaagacccagtactgtgatggtacgtgtagagaactcttctaagctgtttaggcagttttaatctactttcacagtgccacaggggagagctgagggagggggaaaagatgcttcacctctttggttggtccacacgtctgtccttttacgtcctcccacaatttttgcaggtcgtgcctaaaaagttgatttttacaagcggggtcttaattaagagccctgcttgcaaaaatagaggtattttcgtaagtggatctaccagcgaaaataaaacccagtgttatgaaaaatcatttattaaatatgaagctgcagtgacatccttacaagtcttttttagattttcctcatgaactcattggctgccacatgcaatccaacaaagtaactccactcttgttagttcatggaaataaattgtacccacaacttctgtaaagctagcgcccacatattgactctgatcttttcggcttccccgaattgctaaagtcatctatggttttgctgtgtctaactattgttgaagaaccactaggattatctccactatgttgacacattatctattggtacattgtagtttggttcccatacctgaaaaatgatatatgtgaagtccacaaaataggacactgaacagatatattaaaactcagttggtttaaggaaaacacacacacgaaattttgaaagagaagaactaattttataatcatgtgtgttaatcgatttagcagctagcacgaagtgaaattctagaagaaaaaatgtcgtagagatgatcacctacgaacacaacttctacgtctgcattccttgctctcgatgtctctgattctcatggacacactagttcagatagcaaaactaaagaaaacatagaatacattttccagagctactactcgctatctactcctacatctcatttttgctcttctttaaacacaactgattcgatttgtctttattttttctcttcctggtttctatatatatatatatatatatatatatatatatatatatatatatatatatatatatatatatatatatatatatatataatactgactggactgccacgcgtacgccatgtagaccaaaactactacggattgggtcgaggggggtaattcgtccggtttgtatagttgggggtgaagaatgtcggttttatggttcagggggtaattcggacgaccgtgatagtttaggggggtaattcgtactttttcctttattatatatctaagttacttttatcatatatataaattactttttcgagttgattaaattacttattatacattcataatatttttgagttgtttattttattatcatttttagtcaattccattatttgtgttgattaaatttaatttctagatatactcacgcttttacctccataacggatctacttttaatgtcatgacaaagttacttcctttttgttttaagttacttctataatatatgtaaattaattttaagctttactgaaattacttttatatgtttaagaagtagtttagtgaaatctaaaagtaatttagatatactataaaagtaatttgtaatttttcatcaaaatataatcatatgagatcttgttagaaagatttaattcttacgaacataaccgtgtaatcggatgagtagtttaagagaaaattttatttgaaacataggtgataggaatatattttctatttacttgatgagaactagtactacagttaaagtatctagatagagactcgttagcactaaaacgagaggcctacacgtgaacagttacagacgaatgtcgtgcatgaatacacgtcatgctagagtattagaaacgcaaacgtttcccatgcatgcacgtaaattggttggagttcacgtcacaactaaaagttatactataacggagacatgcaacggtctaattctaccgccattagttattatagcacgatagggctaacataaatgcgattgttgtcatgtatgtacgtggaagatgagaagggctaatcacctgtcgacgaatttttatttcgctatttgtagcccgctagctctaaatttgttaagacaaacttactatatagttctcatgggacaatgtatttgtttaattatatatatttttatagtggtttactgttatcattaaaacaatactattttaaaagggtgtgccaactatgtattttcatatgtttttttcaatggtaataaagctgtggtacaagaatattgtttggttctgtccaaatagcaaggttatccacgtttgtctatcatgacgcgtgctaccagtaccaactaatgacttgctgctatataccgatcgggtttatttgatcgttctcgagtgattttaaattcaaaaataataatcaattattggagctaatttaacataaggtagacataatcatagccgatcatatactttttatattgaactagctggacactcctagtagttgctttttatggaactagctagacgctcctaattgatgaattgctttggacaggggatggaacaagaaatactggagttgttacattgaaagttgcttaattgcttcaaggcaggttttgagatgctttgatcagattagcgtaatcaacgctcctgatttcatccttagccaaccagcaatgcatcataatctccgaaatttaaaatgagaaaacgaaattacatgagtcattttgtagctactactacaaagcagagggcttggataataaccattgattccatttcataagtaaatactacttttgtgtcgtaataattctatttctgtgatttaaatttgtactaaaataattgtcacaatagaatactaatggtcctattaatcacatatcattcaaatgtctccatattttaccctcaactacctttttactcttacctatacatcatttaataaggggtatcatattttttttctttttaaatcttaatgtgtactaaataacttagaatcacaattattttatgacagaggtagtattaggtaatctacatacacatcactaattttctcttacaaatttagagagagaaaaaaaaagacaactcaacatgtatcccaccgccaacaccacctcacatacttgtttttttaaactgctataatgtggatagaagtattgaaacggctagttcgttaacatttttttactattttggtttactcggatttaacatactcgaatatagggatagcaatttcccccacagggccggggccgggtgaggtttttaccccgcagggagtcggggccggggccccgcaattaggcgagtgaggggccgggggaggcattccacccgcggggctccggaggaggtatatcggacttttaaatatagcgtcaatcctaaatatagcccattagacccaacccgacttgagaaaaaccctacccataacacaaccccaccacccatcactcatggcgtactctccccctcctcacctagccgccaccgccacgccactgcgccggcgcgcccctctatctcgccctctcccctccggccatcctctttccctccgcctccagtcgcacgcgggccgcagccacacgcccttctccctcctgtttccaggcaacggcgcgcgggttggcggcacaagggcggcgcatgggcggcaaacgaggagcgaacaagcgacgcgcgggctggcggtgggcggagcgagggcgacacgcgggcaacgcacagccacggcaagcccgacgactgacaagcaggcgacgcacgcgagcctcttcctccgccagtcctcccctggtgactgcgggtccccagtcgggttgcggggccccgtaggggccggggccgagggttgatttggccccgcaactccactcggggctagggccgggtggaggccggggtcgttccagcccaacccggccctgacccaccctattgccaaccctactcaaatgaattggttacttttcttagttactcctagttattgctaaaaaaacaggtggctaattatcgtaatcatctatcaacgaagaagaaagcaagtaaaacgctacaaaattacacatatttatatatatttttaagaaaagtctaattagacattgacaataaataacatttattcagcgtttgccttttcaattgagaagttttttaggtcttgtgtaactcacggagctgatcgaccatcagttctcggggactcgtagcagtttaacatatatttactggtatgatatatggttggatggcaacaggtggagcccaggtgaatgtgagatccgggatcgtagctttagttacattatctccatgtgggcccagaaggtctcttccatactccatccgtcctataatatattaatctattatcagatatgatatattctaatattatgaatctggataaagctttaggttgattttttatagcacaaaaggaatagcatattgttgacttattttagtctttgaattgtaaactagagaggtaatattcagtagtaatcactatggtctattcgctatgattcgggggttaagcactattttttttcacgaactcgtaaaaagattgtatgtcaatatattagaaaaaagagtgtttgtttacacaatgcaatcaaccataccggcttatgccaagggaaatgagaaaagacaaaaaaaaaacaaggaaaaatgaagagactgctacgacggctggacacagctccaatcagcggggagggggcagagccacactaccctctaaaaaaacccgaaagaagcaacgccagctaacgatcatagatggccctcagtgaggatggactctagaaccactgagaccgaagagagagtaaagtcgaaaaccctaaagtttcgttccttctacagttgccaagaaaccaggagggccagagagtcgaagccggcacagagatgatcaggtaagcatgtcctaaaagatggccaccaattctggagccaattgccacgaggaggagagagggcagcccaatcacaaggcgacaacaacggaaccaagacctgccaagcgaacacgcagtcaaggaggatgtggttcaccgtctcaagctcctgagcgtaaaagagatagattgagtggcgctgctgaaatacaaatcaaaggaataacttgcatttagcatcttcacgtggggggtaagcactaccattgttgatttgatccctttcacaataatcccactgtacaaaggaaataattaatacaggttccatctgtgaataatagtatatgcaacccttgtttttagggggatatatgccacccttaaaaaaaaaaaaggaagatgtacttatgcagtactactagattatactggtgcagtacagttatttccacatgagatcgttatagttgacttcttgtctataacctcagctccgtcataaaatatgtttaaatttatagttacaaattactatattttacaaaacagggagtagtatatgttcgtcccgaattcctcatggaatagaatatcttgaaacgaaagcaaaataaccttcacctaccctggctaaattgtaaaaccatcgtaatatcatactccctccgtcccataatataagggattttgagtttttttcttgcattgattgacactcgtcttattcaaaaaattttggaattatttttttgacttactttattatccaaaatactttaagcacaacttttcgttttttatatttgcacaaatttttttaataagacgagtggtcaaacaatacaaacgaaaaatcaaaatatcttatattatgggacggagggagtaatatataccaatgctgctattgtatatgtaactgatgtttcaaaaaagatgtttttagtaatgcctaaactagcacgattaaattaatgagcttgatattgatatgacttttgctcctgcaattttttggtcgcatgcgtaatctacatggaagtcaacaaaagatcaggtcaaaagtcacgcttttgtcaagtagaagtaaaactttccagtagagacttcacaagttgacatcaaagttttgtttagtactactgttaaagcgtcaatgaactaaaactaacagcgaccaaaccatttaccatctgtctgtaaagccaaactggcaaaattaatcacatcacgcagtgtgctggagtttggttccattccataaaagaagaagaggaaaattgaaaagaaaagaataattgcagggatcagtcatcactgtcctcgtttaattttggctgtgctgacatatactgatctttatcctcgatctgatggcgatcagatggttagagtactttctcaattattgggagaattaaatcgattttcctcgcagaaaattatatcggtttgtaagagaagccaaagcgaaagcgatgacacacacaaaacgatatatatgcacccgtggcgatcggtaggcatgcagttccatctcaatctctaagtgcgttatatataacggttagcattagctagttagctgtactaattaaaaaggtataagttactagcacattattacttaagtatttttgaagatgattacttaagtgttgtctattgtaaacttgaaaaataaatttattaaatattttagataaacttatatttagtatgaagcatacttatttaacagtttgtgctcgtgataaacgaggaattagtttagctcaaatccactttaactagaacacaacttaagacatgtttcgaaactttttctcatttaaattttctctaaaattttttacttccgatataatccagactctcatttaaactattttaagattacatatatagctataagtatagagaataagtagaactcacaagctaaaaaaaagatcatttttaaaaaataaatcttatgagctggttgctttctcgtaatctcacgagctcccagacatgacacaagctcgaacagctcgagcattctcggcgaccgtagctactactagtcggcagagagaaacaggcggttgtaaataaaacaagcaaacgacgtcggaaaagaacaaggctttgacgacagccaaactgttggtttctctgggcaatgtacagcagaaaacgccaagaaagctacgactactgctagcgtggagtcaggtagagcaagcagccagagaaactgacgtgccgccgccgcgtgt

SEQ ID NO: 74353 - DNA, 19452 bp, Oryza sativa
atgatagggaaaataagaacccgggaatcaatccactagtcaagaggtgtggaactaatccggatgttttgttgtgcctaatatgagtaaattggttcccgacccggaataaatcccggtctcttgttgtacctattataaatttcttgttatacctatcattcccggcccagaacgaatccttgtgtaaccgaacaaggccttagggggtgtttatacaaatgaagctgcattgaaccttatcttgttggtttttgaattgcctgtacatcttacatttctttactcatcatcgtgtgctatctgaattttaatcctgaaaatagcgacatcgctgttttgagaatggccaggacacgttagaattgcagttgttaatataggacttcagctgtaatgctttatatgatgggagaatccattcagtccataattgaacatgaatgtttttttgggttaagttctagatactctgtgtttatcatattatactgtttgtttatgtgctggtgattctgatttaatgtttacatatcagtttggcaatatcattttcacctttgaaactaccagcttctgctcgtattttgattcatctgttcatgatcttttcctacgtttttggatacagatatcagatgcaaactaagttcttaggtgtgatttttgtttcagttcttgtttgtgtcagaccaaagaatcaatgagtcaaaactaaattttgttttaactgtctttttttttttttggtggagccaatagatcagtagacattgaaaggtttagccttcgctggtgtgctgttgctccccttttcttgggtatgttttgcctgcctttagtttttgtaatagcttattatgggtttatgtagtcttttttgttgcaagaaatttgtcttctttgttgcccaaaacatacccaagcatgaagtactgtcaaggaaacaattttatgcggcgtttcgatttttacgttgtgatcaccgatcaagcattctcttattagttattacatcttcctgcgttgataagaggcaagccagtaattgagtactaaaaaaatcagtagcatggctgaaattcccagctggagttctagtttataaactgtttgttattgttgtctgaaagtagatggctttgaaagaactgtgtttgtgtttcggacagccatttcctagtataaatatgaagatgtgcaccactaaacacaaattacgaaccttaacagagatcgaaatattagtaccactgttctgcagaactattgcgacgagcaactagcctatgtcttctattttcttttgttaatggtctacttttgtgcataatgcacacgctaattaatttcgcatgggcatatctttttcaggttattttgcagttcattgcaaactgcatgtcggcagaaagggttggttagtagagttttgtatttgtagaccatctatcagttctgtatttctagacagaaattaacttgtcattcagggactggattcaatcatggttgccagttttttttttctttttttttctgtacttctagtactcctagagaagtggtaccaaaagccagaaccacaagaaggtacttgcgtcaaaagatgaaatcgtgttgccaaactgtacagtaatacaattgaactttgctactgcgtgtcaactttatcttggagttgccgtttcatgctaagaaaggggtaattctcaagttgtttactgttctgctgttcactggcgttttagctactacacaggcttgttctttacacatgtcaggcctccctatatctttggaagaccaaaatgcagcaagggtgttgtaaaatgtactccctccgtcagcaaaaggtaatttgcttctttctggtccaaaataggggtgctggccaaatatttcctcagttgaagactatcagagcttctatcgcaatgaaagattatcagagcttctatctcctctgctttttggaggatttggaatcacaaaaacaacgttatcttcaataatcaaccaccatcaggtgcgtgaattttacatcaaagaagcagatggaccggccctagatgggtggaaggctgtcttctcaattgctatttcttcgggctcctcccatgtttaattctgtttctttctctttattatgtactagtatgctccctccttgttttcttctttcctgtattttaattacccgttgtaagcgacttggttactccattaggaggagcttatatcaatataattcaatattcgcccaaatcttcagtccttgaccaacagttttgatcccacaattgcagcagcaattggtaacaagtccacttgcttctactgcattgcttagcccacttgttaggtttgtaacatatagttttatttcttaccgataatcaagtactccatccgtttcacaatgtaagactttctaacattatccacatacatatagataataaatctaaacacacatatgtctagattcattaacatctaaatgtatgtgggcaatattagaaagtcttacattgtgaaacgaagggagtagataagtatgaagtatgaactaaatggtagtaaaacatatgcgacctttgagttaccttcctgaatgaagtatgaactacgatttccatagcagtacagcacacaaatcaaaggcctcaggttgagtctgcaggatgaaattacacagcacctttggattgcaaatcaacaccaactccttttcacatgcaaaacaatgactaaatacaaaactcaaagaataccaagaaaacgaatataatgcacaacttaggcatgcttcctaaccaacccactgatcaatcgacgtaatttaggtacaacagcaccgcagatgttaggtcatatatctacaggcaaatcttatctaaatcctgtcacaacctgtcgtcactcattagcaatgtcaaccagttaacacacaatggcccaatgtcgtggatagtcttcactaccatccttcttgctgagaagtctctcatccctaaccagaaatgcagcatttggaaatcaggattatcagaacctcaaaagatcaactgtgacattctcgaaaatgtccaatcgaacgatgggatctcagtgcaaaaccaaaggagaatcaggttctgagccgctgatggaggcaaaggatgacatactatcctccttcgaaaccgttgagaagttcagtggtgcagcagccagcctcctgttctctttgaagtaattattgtaccgtccagaatatgagcgtggagttagaagctcaggagtggcactgcctgcagaaactctacggggcaccggggtcatgaacccagctccatttccattcgggtgatggctgctcgtcctcctattaaagctgcttgtcttttttggactaggtttggagccgaaaatcaactctttctccttaagcaataagctttgcagtttcttctggtcctgtagtaagaattatcaacacatccaaatagtgaggagtcaactcttgtggtcgtaatgccaaaaggaacacatgatgcggtacaattcatacccggtgtcgtctcttgtcttcttccttttgtacccttctgagtttttgctcctccaaaatggcaacaagacgggccttcacatgcaaattcaatttatgtaattcaatggaacatagtgtactgtaatgatgataaatatggtagaccagctctacgacttactccatcatataaaaatggcacacttctttcatcctcccacgcaaatgttttagctatcaagttgtcaatcattgctgcacagaaagtatagcttctaatcattttatgtatcaaatatgcgagtgactatagatggatctatatcagaagcagcaagtagaccgagcttgtgaatcaggaaatgcttagtgattactgttaggagtacatcattgtctaataaggttatacctatatcagaaccattagcccagttcaaccaatattttagcagaatgcaacacagtgttcaactgacataccagcagacatggaaacaaaactcacatggtattttttgaacaagtatccttgccttctctgcacgcttgagatttatatgggcacccctaccagcactatacctgctactatcctgcacaaggacacacaaaaaaaaaacccttaaagatcttaactaaatcatagaagagatgtgaaatatatgttgtcaaccaaggcctatatgaatattcagaataattaaaacaaaaatgaatcgtacttggttatattcctcaagccaagtttcttcatcacaagctgatagccatctgtctactttctccatgatatctttcctggttagggactcctccctcgcttttgctatttgtgtttcaatgctggaaagaagttcacaaggatccactagacctgaatatgaaattattttagaacatttaagatattcctcagcagcaattttcaattgtaagcaagagagaatatcagtagtataccagaatcaatcaatgcggttatcttctcaggtgctgtgctcatatcaggctccatatgcgcattactgcagatatcttctagctctaaccttttcttaagaacaagctccttcattctacttgccttttgtttagttagtctctcaacttcctcttctgtctgtattcaaataattatgttaataagtccaaattacagcttgtaaagaaacaagtatctcacagatagtagccgaacctcctgaattgtctccagcgacaggacactagatgaagtgatctcttcctcagtagatccaagaacagcagctactctggtgaaatgtctcctctcttgttcagttgactccatcaaattccataacttgtggagctttccgacgatttcttgcaactgaacaaaatttccaaatagttagaaaagctataaaatgaaattgagacacctctgtactctgtagtttcctaagaggaatcaccttcgaaactctagtcctcttttctgctttgagcttaaggatggtctcagtaagaccttcaagagtgctatcactgatattcgttgaattttctgagttggccccatgtaaacttggatgcacatctttaactgtctttgcaaaatccatcccaagcacagagcataggcagtgcacttcatcgacgtatatgaagaccttctgaaggcgatcagactgaacaaggagggaatgaaaaagattattgctttcactaatacaacaatatggcatggcaaagttaggattttagataacaaaaatgaaataacctatcctttgaaatatataactaatcttgttctcagcatgttgaaagtgacagtttatggttgaaacaataggtaaacaaaaaaatggttgtagcacgtaaatgcttaaggcatacacatattttgatatccaccattcactttatcatcaatatctagtcatatgcgactttgtgtgaaaatatgtacattttgacaagatacatttgatttattttttattattattattttggtgcaactcatatccacatgatggctgaatgggttgaagcaagttgagcaaagaaccattttaagtcaagatcatagttaccttctctttctgtaaattgcgaagctccgcttgaagatcagaaagccttctggttgacaaatcatgattgtccttggaatgattgaccggaccattgtcatgctgattattgtgatccgaaatttgtgcttttatcttctcgatttgagattggacaagtgagaattgttttattctttcttctttctttgacctgagatcttccagtagaggcgtcactttggcaagttgctctttcaatgattgcttttcatccacctgtagacgaatatctcaaattactcagaaatggaatatacttatacagtgatgtcaaatatgtgacagagaacctttacgatataacaaagcataataattcacctttttttacttaactaatgtgaccctaaacatgccaaaagcaattaactgtggccaatgcatgtagaagttgggagtcaaaagaccaacacctttgctttttttttctttctaaatgccattaccaaatggaatttcaaacaaagttcaccgtacagcaaaccatgttgcatagtcaacctcatgtgtaaaagaaaagctaggcatcatccaggtatgcttaacttacaggaatcatatccagcgattcttcaaccaagtagatggtccacaattataattctggccaggaaagaaaatggtcctttgaaccaagttctacactaaactagtttctcaaatgtgcccatcagacatgactatgtaccaaccgagtgacccagctgtgcatgttgcagtgatatgatccccatcattatttgaacaaagatggccaacctgctgaatatggtatattctacgaggtgtagcatgacactaacaattatttcatacttgttgtacaagctacaagataacctaccaatatctgtagctacagacaaatcaaaccttatacgcataagacacacgataacataatcaaggtccctaggcacaaggcttggaacaagaggcaaaaatagaagtatgggctgagtataccttaaattttggggtaatttcacctattgaagccactaaaactttaagctctgcttctttggccatcaatgactgacggagctgggatctctcagcattggcactatcaacctttcgacggtacacacgcatgcactctgtttcaagttctaagaacatgcgatctttatcttcttcgcgctccccaatctcagtccatatttgctaaaatagaagttatgttagaatggaaacaattgcaagaattacatataagttcgtaatattcagagaaaataaaaatgtgcagccacctgagcagcattaatggtagctacatgtgacatttttatttatttatttatttatttttgcatatttgatgtttttattcatctaattgacacattggcaaaccggcaaatgataaattgttatagaccatgtaatttcatgccacaaggaacaaaaatctaatacgcaggcttttgatgaagcaagctgactgctcaaccacagacaacagagagagtaaatgaaactcaaaataggggtatagagcatacaaaatgtaatgttcataagagagctactaacttcccaaaatgtatataaatgtgtctttgcataccctaaccaggccccacttctctggacagcattagttagtggaaatttaatttgtttttattttctttctgcagagtttttttttggtaaaaataaggggcatagcatttcttttgaaacagcagaggattgcactctcacttacaattcccaatttcgagtacgcctgatgctattaaacttatatcattatgctcactgacacattagctgagataaatactactcctaccaaacgtaatatttctgacccgtggtacatcaacagtggtataataagagcgctcctaactgaatttacacaagcagtactactccaagttcttcagctccaaattcagactttagtaaaaagaaaaagtaaagtaaatcgtcgcatctgctttgcttcccgagaaacatagtagagacccggaatttccataaaagaaaaacatagaaaccaagaagaagctcgtagtaaatcaaaagtgaaacctttaagaatgaaatctgcaaagctgtaggcagaagcaacaaactcctgctgttatctaaatcctagcatctgttcaaaagagcgaacttttttggtagagaaaacagtatgcttgcaattcaagaaaaccaaaggagttggaacttttgagcataatttggacatataatgtgtgctcatctcgaaaacaatacacagaatttacaaaaacaccagtccagcttggctcaaactgtgcaatttcatccaaaacaagcaacgaaatcctagtatttctacgatttaaacgagcaaacgaatcaagcaagaagtatcctctcctattccttccaaagaacaccttccatttctccttaaatccgtcgtattcttgcagagaaccaaatcaaatcaaatcaaggacgccatgaacaaagaaccgaattacgcacctcgagctcgcgcagcagcctgccgcacggcgtctcgaagctgacgctgctcctcaccgccttgtccatgccatacccggccaagaccatctcgcccatctactctcctttcctctcccactcctctctctctctcccccctccaggaaggagaaagagaaagcggctagaggcaaaggatgcacctatccagtgcctcttcctctctctcttccgtcttcttcccccctcctcctcctcttgtcttcttggtttcttggttcttggcccaacgacgacaacaatggcgcttctcgccggggctgcagccagcaaccctctctcctacgctttcctcgcagcaaccctcggctctagaggactagagagagaaagggagggtggagaccagagagatgggcagcggtagttgctggaccatatatggatctcactgagcacagttggtagcacaatggaaagaaaacgaggtgataagggtgaagaaaccgagaggtaggagacgaccagagggatctgtttgtaaaattcaagaaacttttggggtgatttggatgaaaaaggtagtaacaaacaaatctcccatttttgcggtttggggacaaatctgaagatcttggactcacacaagcttagtagaattttacagcatttgtttaccttttttatttcctgttttattacatagtagatcacaattatatactacataagaaaagtgtccccatcaacttgtttcttttacaatgtttcggtattctaagcgaagatttggcaaataaatactaaacacattatacaggaatttgagaattttttatgttccaaattagtcctttaggtcatttagaattaaaaatggctgggcttcataaatgaattgcccccaaagaaggacattccctgaagaaaactgataaatgacaggtacataattaaatgacagcattgttgcctgttctgaagcgcgccagattgtgtgaagcaagaaccacccggatttttgtgtgattaatgtacacataagtaggaaaggtaggtacagttaaccacaaggtttttcatgccatttactgcacaagtaaaaaattatagaagagatgaggcaaagatattctgctgatctactccagagtgaaaaaacaaaattatctaggaataacaaggtgatcttctctaagaattcacatctacaggaagttttggcacctcggatgttagcccttcaccaaatacaagaggttaggctaaaaaccatgtaaaatgcaccacagttagattccaccattttaattagatggggacttttgttgcgatgtagattgcaacaggtcactcttggacccaatcaatagtgtagatcatgtgtgttgcacaattataagatctaaaccgtacaattaaatcagtgcatcaccgcagtgtcgccatgatttaaatgcaggaattttctcagttcctgataagagcattagagttcaaaaaaaatattaggctgttttatttttattttatgcagaaactgacctgaatgtttatccccattgacagtttgtgccgaccattaggcaatatacagacagagttgactagaattatatggatgcttgtaaacgaaatgatcaaatgaatctgaagttctgaacctacatgcatcatccacatgtacagtgtgacgagacatgccccatgtgatgctgaggtcaacctcaatagattagcaaaagctatgggatttagaagtaagtagtgtgatctaaacaatgtactggatctaggctcacctgccctttctgtcctgatttaattggaggaagcttctctcaaactgtcggatttgagtgttacctgcaatgctttcttatgaagatcctgcacttcgcacatattgattgctctaatagctctggtctcagtactagtactgtactatgctacttcagattctagattttccttgtaatttttgtctctttttcgtccacttagctatgatgggtctatgagaagcatttgacagttgcatcttctctcagaatcaaaagttctctaacggcctaacttttaattaagattataagagttggaatctagatgatgaattagaagccataaattgattttttttcagcttcttcagattctcatcagttagattctcatcagctgcttcttataatctaaaactccctaaacaaatcctttattttcttcttaagaaaggattgccaatttggcatgtgttgtctacggcagagaggtgagcagtctctctgccaagaaggaattcagacatttcttctcatggtccattgcttcgacattaatctctgcaatggtacaccatcgctgtctcctctagtttggtcaaacaaacctacttcctctattctaaaatataacaatctaaaataagataagacacatcataaactataaatctggacataatagtggatctcatcccatactagattactatattttggaacggatgtagtaatgcagaactgatataggagtatccaagtgccactagtagtactatcctgtcacaactcacaattcacacatgcttatttcatgcagtttcccccttttttttaactttgctgtttctctggagctagtgttcgtctgtatcgcagactcccagtttgtgtttgactgcaaaaatccatgaacccccccaacttctcaacctctaggaaagagagagcagaatataaggtgtgttatgattgtttatgttgtgatcttgtgatctttcagttgtacagatggacaaggagcgaaaggacaaatgtatcatctgccgtgcttgatgctcccttgcgtcttcggttgagggagcaattagcaaataatacaataccttcagatagtgattaacacgcgtaggacaaaactgtactcctctgagcctgaagagttattccatggcaaacatgaacggtcattttgtacctttgagttaatctgtgtgtgtgtgtttgacgtcttcctgtccacctgtacattggtcggcacggcctgcaggaaaggttacgctgcactttcttgtgcacatacaattatacaaacttcataaatttcttttctttcagaaggaatttttcatgtctgaacatgaatgtgattttgtgtacatctaatcagggttctatatttcggaataaaatatatttcgggggttaacgatagaagaaaaatttcagaaatcatggaaatttcagacaaaaaaaattaaaatttgaataattttgtcttatttttgaaaatttcaaccaaaataatttcctatctggaacctaaattcctgaaaaatttccggaaattttggaaatcgcaaaatgaaatattgaagcctacatctgatcagttgatcaatctggaacattatatatattgccagagcatcaaacctttttgcacatatgtttgtgactattaataaatacacatcaatacattcatgccctcttcacttttggtacatgttgaagaaatggagcaagattgccatcgcctcaatcggttggtggtgcaacagaaaggatgaaacagatgacacgtatggttttccagtgaagtatctatgtggatgaagtgcaggggaaggcaaaattcagctccagcctacacatcattcggaagttggccaaaaatttgagtaacaaacaacccgctttggtttgtccccaattccaaccattttgagatcaggaaatgctatcattactggtgtaatctggggcccctcaggccaatcagtccaaattaaagtaaatcaaatacccccaatcatttgatttggttgcttaacaaatgatcatatcattatcttcccggggggcctatcatgtccacaattccaacctaattacctcaaaagtttttctttagttgtgggcttgtgggcatggaatatatatagctagcttttcttgcaaattttggagccaattatcttaagactgtagatgtcattttttttaggtcgcactcttagtagtgagtagaccttgtgtcactgtctgcatgctacttgccaaaatgcatgccacacattggtaatgcactaatactagtatatgcatgcagtttacgctaggagaaatacagatgagcagagaaaaagaaagaaatgtgaccctctaccagcttcagatacacctttcacatcgccagctgtagttagttcatggaattatcatcaagccaatgagaaagcactgaacaaaataccttctttttttaaaaaaaaaggaactggacaaaaatcaaatgtctacgtatgtaagtatctgtctgcacattgacaatgattagtacataatttggacagttcagatcaatttggatattgcagttacaatccttcctctctctttttttttgggtttgcatagtcaatcattagacaatcatttgtctgtgggtatgtgtatatatatagatggtgatcaattatttatttcaggtgtttaaagtaagaacctgaggctatctaacacatgcagaagcaattcatgttcatcagtaaataatatctgtttcttttcccaaatacatgcatgaaatgggtagttagttacaggctacgtatgtgggctaagttgcttgcattgcaatacatgcagcaagggagcatctcaacaccctagctatctacagaaccaaatatatgtagttgcaagcactttgcttaaaacaattaaagttccctttcctttaaaattttctcctctgtaactcaccattttccctaccttctacagaaaagaactgaatattgcaacaccacagagtagtacaccacccatactagaactgaagaggtgacagtgaaaaaattatgcctttttttgagaggaagaaaaaactctgcataactggtgagattaaaaatgctttttatccaaaaaagttcttaaccttcatattagttaaaaagaaaagttggggagggaataatacatgactaggaaaaggccatactgtgtaatatccctcgtcaaacgtaaaaatttgtttttttaaagaaaattgattaaaaccagtcctctacaccataaaatttcgataagtaagaaactaaagactccacaacggaagctaacaatatacaaggctctatcagaaacaatcaaatcatgggactcatgggattctgcttagtttaaaatgtacactagtcaatgcttcaaaagttaaacaatgtaacaagccaacaacttacaaaggcgacaaataatcccgccggtggtttagtttactttactgataccttccaagctaacatgaactgatttttggtcatcattaagcctatataaacatatcaaatcctacgcactaggtcgttaatcatgatggcttgctcttcctgtaaacataaaagggcactctaatattagaaaattgagtccacgaaatggaccagcctccaggcagacactaaacaaaaaactaaatcgtttcgtttgactaaaaatgagataaaaattggcatgaaaatcccatgtctgaaactgctctaattaaaaagatataagcacaaagtagagagggacgcaggagctacaaaagcatacacgtgtggcccatcttgccgagctgccggacttctgaattttcaggtgatacatcttaatctgacgacaagaatcgtcgctttggaagctctttttctcctcttttctagttcagagagattttctgacgaagtgccctggtttttccttctgtttttttagttcagagagatttctgacggagtgccctggttggtggtgatcctggtttaaggatgttgaagcatacgccatcacggaagctcccgtgcaatgatctgacaacgcaaaaatgacgtgattcagttggttgcagcataaatcaattcggtttgatgtaatagctgtaaaggcaaaaaagatgaagtttcaaatggggcatagagctatgaactaattttgttcatcccatttcaatatactttcttggtttctgtttgtctctgacaacatgaagcaagctccaaacatagtgttagttgaacaattgtaattagaaagcaagttgcatgcttggacactgacttcacaccagatgttcaatgatatatcccttaagccgtgtttcttcatcggccgtacagtacctggagccggaaaatgattggaaattgcttgagaatttcaatgtttatcgtctagctatggaccaatatatgcctgatttgatgatcaataaactcgaatacacgtttgcttgcttcttttctcctcaagagaatgttcgattatccaatggcttgttgtaggatgtagcaatactctctgatccttactgatcaacgactcttgggaccccttgtatgtgttttcattcgccaattatccatcggattttctttgaattaggaaatcaacaattatctttgatattatatctgatctcaaagagagttgacgggtcatctgtcccttgatgcgctgaacaaaatccatttgcgtaccgtcattgtcatcatcattataccatataccagtctagaattttttaaccatgcattatatatatcatacagtttcatatttttgacaagatattgcacatttcaaggctgaaaaccaaactcaagttttcgttgttaccacaaacaacaagtgaaaggaaattgatggtctcacatagacatgaggtgacgtccattcgtaatctcgaggtaccatcggcacagctgcatcattcacataagctgaaacatcagaagacaatacttctgtacatgtttacagaattatcagtgagcattattcatcaacatatggcattaaacgtatttacagaatcgattggtaaaataaggcactcataaatattagttacttcttaatatccaatcatgaatttcagttgaatcatcattacttcaattcccttgcatttctttaatctttgaaaagcaattcccttgcattttcaacattttagtctcaacaatgtgtcaatgtcggtcgtcgggcatagacgggctgcacaaccttgtacaaacatgtgtagcagtacttacagttacatgagaatagtgcttacaacggcaaaactgggactcatgctctacgcataaagaattcacaataaacctcagatattgaaatctctctcgcccttccctttcatttcatctggtttaagcacgtgcattagaatagtcagaacaaccttcatgatttcttcttcatcatatgatgtcgtaaacgtaactgccaagtgcagatattgaacaagttagaaacaaataacgctctttgctcaactagagaaggaaataacctaactaagcaacgtgcatcttctggaccatacaggcatacatacatagatagagtaaaatatgcggccaaagcttaccccaaggaaggattgggaactcccatctctgcttaggaactgatatggcatatgcagtaacctgaaaagaaatgagacatcatataaatcataattcagcagtctatacaaaatctcagtaacaaaatgctgcattaaataacatacaagagctgaagcagcaagttgacagggagagttaaaaagccatgaactatcttcagtctcataaagaatatccaaaatttccatgcaaacatccatatttaaaagatcacctattttggatatttccctggcaatagacaagaaattaagtgatatatcagtagaaactatatggttaagcttctcatagatcaggaagtcaagaaaaaaaagcaaaaactggtagtttaataatgctgtccggcgatggtaatactaatacaggtaaacaggattgctaaaacaaatgataccctggcaggacagtctttcaagggaaaggaagaccaatgggaagagtggatgaagaagcaaaagattctttttcttttgttttattattcgcttcctcagaacacaagtgaatcacaaaactagttttaaatatgatctgagatcatctatactaacatgacacatttaaacatttctagtgcaaaattttggcactaaaaagtaagaactgctataaggaactaggcatacactgattgtgcttggtgagtaaaataaatgcaacagattatagtgaccaatcagtacagctgtctgttgtgatatacatataatataattcacaaatacatagatgtggacagtggaagccataaatgtagacttagaagagaagatatgttcgtcaagtatttattagttccaaatattcaccctcaagttttataacttggccctgaggcctaaaaacgtggtgctactgctaactgtccattacaaacaataaaaaaaatattaaacaatccaaagaacctgaattgcacgagaagctcctctaggtatgtaaaagcaatgttcaaggacccaatgttgtattccactacctacagaacccacaacacgaacaagaaggagataatctttttagacaatggaagtacaagaaaataatagaagggggaaaaggaatataacaatgaaatggagcacgccatgtagttgtatatatttcgcattacctccatgaacaccagttcctgtggcattacagcaaacaccttttagccactacaagaaaactttcaaacaaggaacaacaatgcgtcgataactcacagcattggcgaaatcgcggcaagtgaaatgctggtcggcgatgatgcgatcaccaagcgccttgaggctcttcaccgacagcggcttcagctcgtgaatctaaacaggtaaccaaatgaaaaataaaaaggaatgtaattccacctctcatggcaataaatccacacgacgtttgctcaacaaatgctcacagaatcaccttgctggcgatccacacggcaacgagggcgaagagctccaggttgctgtccctcagaggctcgagcagccaggaggtcacagctcggccaccccgtgcgccacagaaccccatcttcctgcagcgacagcgagcaagttagtaaaacaataagaaaccaatttaacccccacaaaaaccaaggtctcaacttcgcggggtcacctccggagggagggcagtaggcggtcggcgaagaaggagagcgcggtgtacttgacgacgggacggaggtcgagccgctagaaaggaatcgcagcagaaggcggcatgcgaggtgaggtagctgtcgaggggaccatgccggaagctgagggggtggaggggagcccgtaccgtggaggcgtggaggaggaactcgatgaggcggcggcggcgggaggggccaggccacgcgcttgccgccgcctccaccgcgcggtcctcgtccatggtggtgcgcgccgcggtgcggcagcgaggagttgggacgccggctagattgccgaagaggtggggagaatggaggagcggctgctcaaccaggcctccagaattcttcaacggcccactaacctcatgctttcggcctgttcggctcttggtgttggaccctgtgaatagtgtgctgttctatatgaggaaaacggaaggggatcctctcacgtgaagtcagatgcctacatgtcagtgacatatcacgaagaagttcaagtcatgtatccctttccaaggaaaacgggtttggctatatgtttctttcgaagttgcattttcccgattttgcatttcaattagaaacatatgacctatttgagaattttttggtgactgcagttttttccaaaatctcagctcccaaaacaattcatattaccactcggattctgaattgaaaaacaaattagaagccggaaattaagaaatcagtttatttcatattttcaccggctggctattaataatctctctaaacagaattacctacattcaagcacaagaattatgcgttgtaaatttatatactttttaaaaagaaaaaacaatgtacatttaattgttacacaaaaaccaacatgacaactctagggatgataggatttgcttagttgatcaattgtcaaattctgaagagaaagaccgctcaaactctgcatccatgaggacgccggccatgacatggacaatgatatcccgctccttgacgatatccacgcactctgacggcacgccgttgacgaccagtgcaccgtccacgtccctcctccaggcggagatcctcagcccagacacggactccaggacaggcgccaccgccaccatctgctgccggtggcgcggcggtgccacgtccgcggcgcgcaggcggcgagggacggcggagaagccgagcacacgggagacgacggcgtaggtggcgtcatcatcggcgccattcccgttggtagcgctgtcgttggggcgttgcagcttgaggacgcggcgaaacgactccggcgagggcacgaagacggtgaaggcgaggttcttggggagcatggacaccatcatgtcgccgaactcccccaggctcgccgtcatgtcgtcgcagttgacagatggtggtggcgaggaagacgaggatcttcgtcctgatgacacgacgctgctgtcccgcaacgacggtggcgacgaggagggagctgaggtggagaggagaacgaggacgaggaagaggagcgtcgctgcgaaggcgccaccggcgacgccggcatggaggtgtcgttgccatagcagccgtggcctgaccaagaaaagtctcttccttctcttcggcagcatattcatcagtgtgtgtcctcgctacctgttgatttgctggtcaggttattggcacgaggagatcacgggaggggtcgaggcagccgcccggcgatgtgggcgcaggagcacagccgcacatgacggatccggctaccttgcctccaggggcggcccaggtttttcaacttggctattcgaaattgtaaaagatagaaaaatttttccaacccaagatctaatagttgtataatatgtaacggtataaacatgatttcataaagtcataaatggatagaattgaccataaattgaatgcgttaagcatattagagtacagtactaaactattaattgacaaaacatatcaaatttatagagcatacaaaactctttaaattaaccatgggacctttttttctcttcatgtttcaaacctacaaacaacaatatcaaagagcaattgagcaaagcagcactggttcctaaatcctaatctagatagtcattcacatttcacaagctatgaagctaaaataaccaatacacttcacacaatcacacaatcagtcaatcacactcatcaagcattcaagcaatatcctcattagtcagtttcagttcga

SEQ ID NO: 74354 - DNA, 2376 bp, Oryza sativa
tgtttggatccttgagggctaattcagagctaaaaggtgggggctaataattagctcatggaaccaaacaggaccctagaatgaacatggcgagaatgaagtgtagattccttgaatgcagaagaatacaaattacagcaatggagaataataaactggtaaaaggcaaatgatgggagcgggagcatttgtgaattgggaaagccatccaaaataacatactatatgctagcattggagagtccatcttgtgtctcacgcgatctccatttcttagatccttgaagagtgtgaggataggaagcatcaggaaaaagaaatctccattgctattgcttggtgggtgtagcagcaacaagcctacattgggcagtaaccatggttctagaaattaattgatcatttccattttccaccatggttctttagtcagcttgctgtgcatctacattgggcagtaaccatttacattagcaagcaattacagcgcctacttctactctgctactataatcctgagtaagacaacataattgtctaggactgacatcgataatggcctcttcattgttctcacgttatcactactagtatgaaaaaaaaggagctagcatgaagaaaatcgctattgcacatctgtgaggatctttataacaccgacctttcactactcatcttcctaacattagtgtatgaaaattggcgtaaaccgttgagactagccactagcgtctgtcacttccgttcttcctctttagtccaaatgggaataggaggtatcaggataagcgtagccaaaccgttcttccaataaagtaagcagtgcttatgatattagtccttatctctgaaaatcttgtgtttcttgctgtaacaaataactaaggctgaactttagcaagctggttcaataccctctttcatagagttacattacttatatataatgtcttttcaggtgtgcgagataaactagaagaacaaacatggggagaatggagtgttgcggctcttctacctatgaggattgaagttatgtgactcctcgcatcttgaagaagaacggcacggatacacttccctgcagctaaagatcattttccgcttacataggtttgcaaggtccttcagccctacgtaggttttgtgtgtcagatgatcaatgacagattgacacacaccaacctgatcttcattgctgcatcgatcttcaaatattcggtgcataattatctagatgtatagaatagatgaagaaccagcaaaagatagaaagacaaaagatgaaaggaaataaaatgtttttgcttctgtgaaagccatccgattaatatatacgctagcattggagagcccatcttgtttggtcatgagatgtccatttctcagctatctcttagagcgcgaggatgttaagcatcaggagaaagagattgagagatcgaaatgataagtaagagaaataccgtgttttttttactctcagaaatccattatatctgaaaacaaacttttttatgaacaaagtagagaccaacttcagaattgtacatccttagaataagttatctctgtgcatccacattttcagggatatgaaagaaacagagtaaaacgtacccacgaagtgagattgaagtaatgctctgtaggacagagatggttaatgttacccattctctccattttttttcccatcaacgaatgcttattatgagaataagcatgtaactggactgccaatggacttccgctggatgtagcaaggctgtgattctgtttagacttagttcttatcccctaatacaatgacgatatattgttctttctcaatttgctgtgcaagtgtgcatgcagggttttcaatttcgatttgtcgaaaatttcggtaagaccaaaatttatgaaatttcgtgattttcggtactttttggactgatttttttttgaaattctaacaaatttttactggagttgaataaactttgaccaaattcaacaaaaaattgataaaatacgaaaatttcagttaatatattgattaccaaaatttcagaaattttgaactaaaattgcaattccctgtgtgcgtgtagattcgatatttacatcaacaaaaatcatagcacctacttctaccctgctcctactatcatcctgagtaatataacctagtactacttgtctatgagactgacatctataagggcctcctcttggagtaatgcaaatgaaaaaaaatggagcaatcatgaggaaagtaactggatgacatctatcagggtttatttttatagcacctaccacttgtaactactccatcttcctacgcatgtttgtcacataaacctccaaatgcataatgcagggaatggt

SEQ ID NO: 74355 - DNA, 4305 bp, Oryza sativa
catctccccccgcgctctcgccgtcgccgtcgccgtcgccgtcgccgtcgcgtcggctgggcggtgggtgggagtgggagagcgggacacgcacgggtgcgagttgtgtttagctgccacggcgacgacgtgggccccacgctggcctcccgggtttctagggtgaggtcactgacatgtggggacaggtaatgctggagcccacgtgtcagtgactgttaggcaggcgggggtagtccgcgtgagaagcgtagatgccgcaagcgtggggagaagaagacgacgaggacgaggtgaggtggattagtttggagcgacctgattgggttggaattggattagtgtgtgtgctaatcttatcttaaaacaacctgcagctggctttactttcgaatatgctaaacaaaaccgatttaaaaaatttattggatacataccactacgatgtgaatattagagaatgagctaatatcaaatgattatacgagtgaggcttcgaattcaagtcggctagctcatcatcatgtggagctagctgaaacacctctagacgttttctcgatacataccattactatttaaaaaaatataattacaattcatatattcgtatccatgctatacgaatacgtacaaaataacaaccatgctatcgacgttacgttttctatcatatagaccaaaatacgctagacgtgagacccgcatgtcagttccatcttctttctctatccatcactcttctttcttcatatctctctccacctcgctgaaccaaaagtgtcaggaggcgagtaggacacgatgagggaggcgaatggagaagtggtgtccaacgcaccggtgaagcgttggtactattcaccttggttcgagaaggaaggaggaaactcgatgtgcccccactcgagctcgccgctaagctgccacccgtcccaagctcctcccaatggccccgcttgctcccggtgccgaagaagacggttctcgccagatctaggttgacaccctcctcgtcttcacaagttccactcgtcctcatcgtgtcgtcgtcttcacgactgccggtgggaggatgagagacccaagcccggcgccggagatttggcgactcaagaccgtttccttggggctaccatcaaaattggcggacagagctatgtgcatgaggcacctagtatcgcctgagttggcaagcactatcgtcatctgctccacaggagagagagagaggttggagatgtgggggtggcgatggaggttggcaccgttgccgtggcagaccaacatgaggggaagggagagaggggagaagaagaaaaaagaattgggaagaagatggaaaatgtgaccataattggctttatgtatttagatggtatggatcatggtaacaaagtttttgggtcgatgagaggttggagatgtggggtggcgatgaaggttggcatcgctgtcgtggctgagcaacatgaggggaagggagagaggggagaagaaggaaaaaaaaggggaagaagatggaaaatgtgaccataattggttttatgtatttggatggtatggattatagtaacaaagtttctaggtcgatgggatcgaggaactggactgaggaacgtggtacgctatttgtgagagggttttataaggtgggacgaaaataaccccgtgtttccgtgacggcctgacgggtataacgttcttgggtcgaggaacgctaccactgattccgttttacgtgactatggtgtggactcgaatagaatattttctaaaattacattattaaattcaaaaaattgaaaccaaatcaaccaaaatatgcactggcgagatgtgaaaacgtctcagtgtgatgcagcgaccaggaaatctagcgcggcaggttacgtccatctcacccgttcatcttccgatcggacggcccacgctccacggacgcgacggttggagccacttcaactgctctttcatctctccccgattttgtttcttcctcgacctgctctgcttctcctccgcacccaaaaatatcaaagaactcaaaagcggagagaggcgaagaacaggggggacgccatgaacgtggaggaggaggtggggaagctcaaggaggagatccagaggctcggccagaagcagcccgatggatcctacaaggtaaatcacttttttctcatctcctctcctctcctccgaaacgagcaccagatctggcgcctgcagcaagggccccgcattttcggtgatccctcgagttagaattgctttcctcttcgcgattcatacgccattgtgcagcttgggtgtcatcgtgtgcgcttttccaatctcaccgacatgagattcctccagaaatcatggcctggtctatttgtgtccattgcccaaaaaaaatggatttctaggtgaccattattggtaatgctggtatgtgtctctatggaaaattggcgatgcattgttcagaggaagagagcttttatctgctggtgtgtacattgaagatccctagttagtgcgtagctggtcatgaaacaaaatagagggatcagtgatgctattgatgatcttgaattcgtgattgaaaattttgagcttgatttggtattttgtaatgttcatatgcccccaagcctgtgaaattgcattttatatgttagatatcgtttgttgtatatgtccaacgtcctagtgacgagaaagatgcccactgtgactgtcaggcagttgaaagaaatgggaaacaataaaggaccaacaagtaagaactagaattgtgtatatattttttttcccagaattcttgatgtatatgcttcttgaaaaaaagaacactacatgtgcattctattttattttctgccatcattgttccattacgacatatactcatgtaaatgtataatcatatcatacaacaagtatgtggtgatgccattatccgtcttttcttctgatgcagcctacaatttccaatcatcatctcatattgtaattttgaatcacaaattttgtttcttagttgtgtgttctataaacagtgtgatgaccaactggtccttatcattttgatcagactttcattttcctctttggtggttacagcttttaccttgttaattgtctcattccttctctttttcctctttatttttatgttaggtacaaccaacgaaagctttgcaagtgatagttttgaccatttttaggcactttactcccttgagtacttcctaattattctcccattttctccaagctctttttccattgaatcgacaactccagctatccctggcattcgtctacctatatacgcaagatgtgttgctttgtcaatttatcctatgagttaaatatatcctactcctccctgttaattgttctgttcttcatcaaaacaattcctgtcaatttcacttgaaaaaaacattttttttctatatcttcatggacaggacttattccttgatccagactcatgtatgatggtttttgtattaatttttaatcattatacgctacattacaattaatttttgatacactgtataacactcacttttggattcagtcgtaaatgttaattgttcaaggcattatgaatgtgtgaagcagggttcaatttgaacagatgggtatcatagttcagggattgtttctattttttctgaatcatccaagttaaacaatttatgaaatactagcctggttttgcatgattcacatactgaaatagcatagggtaatgcaacaaataacaatcaaaactagtaaaagaaatggctgattttttagtaagttcctatccgagttgctgaccatcacatctgtaggagtaggagcagcagagcgcataaacttaaccttggaaacgtttttggcatagctatcctacgccttatgaatttctgaattactgagcttatgcaaatcatactggttcaccttacttaaatattgtgatctgcaggtaactttcggtgttatcttcaacgatgaccgttgtgcaaacatatttgaagcactagtcggcaccttgcgggctgccaagaagagaaaaattgttaagtatgatggtgagctgcttctacagggggctcatgacaatgttgagataaccctgttgcctcctccagcggtcgctgctgcctgaagagggaagcatctgcgagcctctggtgttaaggcgttgatatgcatataatctattgtgtctagattctcatgaaccatttgatattcgaagcggatgcctatcgcgtgatgtatgaactatgggtatgcagtttcttggac

SEQ ID NO: 74356 - DNA, 2759 bp, Oryza sativa
gccttttcacaagggcgcgactaatgggaaataagtgaaaaagctacaaaatggtagaattgatccatgtgaatatttctcaacttttagcatctggtggcaacaccatttgcccaattttggtaactttgtcgaatgtttcagagactggatcctttataaatgctcttgcccaatgtcttcaaatcctgttggtgaagcacaaaaatatacatgcaattgtgtagctaactctgaatatgcaatctcctcaagttttttcaggaactgtcttgtccagggatcaaatatactttctgctcctgatcaagctctgaacaatgttggcattttggcaacatggacaatgttcatcagacaatgtctgttggagaacacctatgctaacacctaggcatgcactaattttccttgcatttgatttccaccttgcagctggttagctcatgcacatctattttggcacacttcaactctgctgaaaaaaaaagctgcacggtcaaccagctagacacgatcattgtctgatgaatgatattagaatttgattgcgttgtaaattactataacttacgtgtgcttatgccatttaaactccatctggtgagcctggtctctcaagaaacatgagcatgggtagcatccgtagtttttagtgtattttaagagatctggtcaaaacctacaacagtaaggcaaaattaaaataaaatattttgtttgcatcaacgatatactcctaaaggcaagattttccaattgtgatgaaagccggaaacctagcgaggtaggtgaagaaagacaagggatgtgtgaaacatgatatctttcatcttgtctttctttttggccattttaaaaatgattttaactctaatttatatttgggagcatgattggattacacgttgcactgacaagtgccgctctacatttggatgcttccattgactgaaaagattacaatagcatatcatttcatttttcttaaaagaaattaatagataaagacacagctgatgataaaaggcaagaaaagattgtgtcaacttcactttagtggccgaagagtgagttgccttctgcagcaattcagcaaagtgcagcttggaagcgtctggcgtattatgccaagtatttggacagcaggaatttgtcgcgatgggtctttgacaggcattaccataccaatagttgagagcttgaggctcaatctgaatatgtttccgcctttattcttagtaacgtaatttcaattatatatggataaatattattatccgtaaaaatttattctctagtaactatattcacaagaaaacaatgtaaaataaaattagaaaaagtaaatcaaacatcaaatcctgttcctgtttggcagcctgtaactaaggtagagtttagttccaaacttttttttcaaacttcccaactttttcatcacatcgaaactttcctacacacacaaacttctaatttttcaatcacatcgttccaatttcaaccaaacttccaattttaacgcgaactaaacacaccctaagttgtaacgtggctgctagactcccaagacaacggctggctgcaattccatagtgtttactaggtgaaaccctgcatactcctgtgagagtttaatacgataataataagtaaaattaatgtataagatggcttaaacaatatgagcttacataaacataagttgatgtgatttaaatttaattactatatagaatgatgattcaaatgtaaaagtaagatgatgtggcttatgagaaaacaaaagaaggaagataatttagatcatacatctaacggctaaaaaaattgagattatatggcttaatgagagaagaaaagaagaggtataatttgaaccaaagattaataatcatataaggattaaaaattaaaaacaattgatgagatatgacttaatgagagaaaaatataagtaacatgaactaagtggggatgaacttgataggtataggagataatatagaaaaaacgatgaagagatatattaaaatattatatgaattatgtggaatgatttgacatgcttacattttaagtctctaaaatttaataaattattaaattataaatattacagcaatacatgtacgatacttaaatgtaatagtaattgttagtggatgataatatggtacctttgcatataagagaggattatcttggttagaatttgtacataataaaaaatggctgtacataccatccaacggtgcgtacaaccttcgttctatataactattttgggataaaggtgcaattcaagtatataacagtactagttcagtttttaaatatgcgatgatttttgacacgatgttttaatattcatcatgttcaacaatttaatgtaatattaaaaactataattcatacttaaaatatatttaatggtaataagatcataactgaatggatgatatttatataaaaaattaatagtaaaacgaatgattgaatatcatgtataacagttgacaatattgccatatactgtatttaaaaactggaggtggtggcacaagatttatactactccagtattagtacggtaatgaagggcactttaatgatagggtcagcatagcagttgataccaattaagatatcaatcacacgtactcctaagtaaagagagtttatcacgcttaatagatcaaaacaaacgtgccagatgtgaaaacagcaaacgatgtgatgaatctgaacaccaataa

SEQ ID NO: 74357 - DNA, 32079 bp, Oryza sativa
  unsure (1)..(32079): unsure at all n locations
taatgggaactctagctggaaaacttgattgagggtcagacggcagtgtttggcacaaccatcacttgctgactgataagatcatgtggacgccgcgattgtgctattgtctttaaagaaattaaaaaaaaatcataaaaataaaagtcatgagaaaagattaaaagctcatgttctatgctttgttatcatgttgatactctttatgaactgggcattagcacattagcatgggttcattgctttgtttatgtaaatcttgcatgattatgagctggtttgcttccttttaagcttcttctagaaatagctttgcacactaaatcactaattcacttgaaagctttttgcttgctggcgatactaacttgatattcatgacttgtttcatacttcttatgcacatgcttagctaggcttgagcacatgcttgtatctatgtgatccatgtctaccttttgatgcctttagataactctcaaagctctcaaaacctaaaatttgcaagtttcatctcatttttatcttgcatttttgtctcttttgatcttgatggcatcattgacaaagggggagagaaatttgcacttattgaaaattaaaacttgctttaaatcttggtgaaagggggagtttggcacatagggggagcattcttgcatttgcatttgcatcccttttttcttcttgtcacttggtcttgatttttcgcgatttcaaaatgaccaaagttcgcttttgcaaaatggtttgctttgtgaatcaaaaatcaaattttcaaaattttgcttgagattgtcaatgttcccatcaagggggagattgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacacaaggttgcacacggtggacgaacaccgtgtgaaaaggtctttgcaacaggcttcacaaggccaagtgtgcaagcatcggattcgcgaagaaatcagaagggactgtgcaagtgcattgctgctacagtacttgctgtaggtagcatacatgcatgtacacgtactgtacttgtgcaaggaggagcttgcactgtactggttgctactagcatggctcggtggaaaagtcaagctagctagctgtgcatgtgcgctgtgattggttggcagggaggccaagccaatccagccgttccacgtggcccaagatggtgaatggctcggctcggcaggcctgcatcgtccaagcagcgacggcccaagacggcggcccatggcgcatgggctcaggaggtgcaggcagcttgcatgcgcaaggacgcgcgcggaaaaaccgtacgcggcaacccccgtttcgcgtgactcgatcggaggcgggtgcaggagcgcgggacccacacgcgattttgcaagcgcgcgcgggagcggctcagcgggacgcgtggcggcttcgggctggttgggcgctggcgagcgcgcgctgaggaaaaggagacggaacgcgcacgacgcggctgggcaacgtggcaagtttggattcgtcaagacggagagcacgcggattcatcagcaagaagaccatgtgagggttcggatcgatgaggtggcaatcatctggagcttttcctttgagtagaaggaacaatggatggaccagatctgttctgagttagggtttcgccctaggggtatttgagacaatgtcttaggggtcttaggctataaatagagagatggatgcaagggtggaggtcgctccttttggtaatcattttgagatgctcggtgagagagtttccgtgtgagtttggagtgtgtttgcccgagaggcttttgtattaggattagtttggagtgtgtttgtccgagagattttaagtttgtgttaatgttcctctgaaggtgtatgtttgctcctagttgagcggttattttgcatcacctataaatgaaatgatttgaaggatttcatttttgccttgtccatttaaattccgcaatttaaattccgcttgcaatttgaactttgcgatgatgagttttgctctctctttctcacctcacttctagtttcgggaattccttttctcttcctcctctagtttcgggaattccttttctcttctttttctctcttcttttctagatccggcttctctaatagccgcgattctagtaaggattttgagaaatccggcttgatgagtattttcgggggcaagatttgaattgctatattcacccccccccccccctctatagctgttcttggtctttcactcttaaaaaaaaacaaaaaaaaattatctcatctttattggctatattaattcatacccttgtaagattatgtgagtataaaagtatccatgcgatggccaaaggtggagaagaagagggaaggggctgacgggtggggttcatgttgctttccacgtgggcatgccacgtatgtataaatagttaagaaatcacttctctccagtgacaaattattaaacgcgagcataagagagacgacaggcaaagccaaaccacaacatcaatgtggcggggatttgacgcgtttgtcatcctagttgccttgacaatttgaaaagagcgaaacaaatgattgggtcttgaatgaccaatgcaaaacattgcgggaagttgcagaggtggcagtactctggcgtgatatgggagtacctgtctggatggtgtgctcagtcattcaaaaatgtgttgcgagagatcgtcatgtcgaaagggctttcatatcgatatgtattaaggctgcgttcgttttgggtgatagggagtgagaatgcacatcgtttttcgcgcgcacgcttcccaaactactaaacggtgtgttttttgcaaaaattttctatatgaaaattgctttaaaaaattatattaatccattttttaaatttaaaatagttaatacttaattaatcatgagctaatgtttcacctcgttttgcgtattttctcaatctcctcaatcccctcctcctcaaacacaccctaagagaggagtgagtgtgttcgcggggaatcgagcgtaggccatagggcgcaccacctcagaccctgtccactgcgctaggcgcagttctcgtacctccttttcttatcttttgtacatagtttgtatctgagcgaaaccaatttcctaatttcaatacaatgatatgcgctttgtgtataaaaaaaaaaggagttaatgatctcaaatgatagaggagatgataatgaatcatacaccaaatacacccaactgttcaaatacaaatttcaggtattttgctgagagtgaattaaacagcacattcaaatctacttcctccatttcatactccatttcatattataagtcgtcggacttttttcttaattaaaatattttaagtttaaccaaatttatagaaaaatatagtaatattttcaatacaaaacaaacatattattaaaatatatttaatgttaaatttaattaaactaatttagtaggtgttgctatttttttttataaacttggtcaaacaaaaaactttgattaagaaaaaagctagacgactatgagtagacaacagttcatattctgccagctactcatagccagatcaagcaaaagttcaccatgaaaatcggggcatgctttgcagcaagattttcttacttttatatatgaaaacgggtgcatgcttttgcaacacaattgtccttttccaccaccattatattgctaatgttaacaaggttcaggaagccttcttacatttgtacctcatggcacagaacacaaaggccagcatattcaagaaacacaagccagccatcatccagaagaaccgatccaaatgcccttcgttcaagttatcaggtatccatccaggactgccttctctggctgtgaacactggcacaagagaaacgataaacgagctgaggtaacttcctgccgaaacgttagcaagtgagaatgcgagacataagcttctcatggcgtccggtgattcctggtagaaaaattcagttaacccaatgtttgagaacacctctcccacgcctatcaggaagtactggggtccctgccacaggatgctcattggaacagccaccttcctgtgcaccaaaccttcatcctgcgcaatccgcaaccgattactctccaccaatgctgctgataccatggagagcatggaaaagaacaggccgatccccattcgctgcagtggagtaatgccatttgctctgccagtgaattttctgaacactggaacaaggactctttcatagactggaactagtataaggacagcaatgacatcaatggattggaaggacgccgcaggtatttcgaaagagccgatgtgtttctccatcaccatcccctgttctatgaatgtcgaaaacatgttgtccagaactgcagcaaataatatcatcgttgcccaaacggggaacatcctgatcaaaatcttcagttcctccacttgagtgactgtgcaaatcttccatgtgtttagtaggccatcagattcaaaatcagatggtgtcaccattgcagctctatcaaagaacctgagagaaataaaataaatagatggctaacttgatagagctgagatggaatggacagctccttgccgactttgcattgacaaacaaaggttcatgaacaatgaaggtttgcttctagtatgtataaatgaacagcagaaataagtgtattacgggagactttgtttcaaaagcgatatcacaagagacatttctttagagaatattataaacaatgtgctgaaactcttgtaatgttaactggttttccatatttgtattgtgtgatgtgtcccacagaagaattttcaaagagtgaaagaatgaaatgctttactggaattaagtatctctactccctaaaaagaggagtttcccaaaatattaaaattattattcaaagtgttactgtaggatttttttaaaaaaatatttgcatattgtacacaagtatatggctggttgatataatttaatttagttttatatttcaagccatcattttgaaattttaaaattaagctatatgatattcatgtactaccagtgttttgtaatatacgacgctgttaatttttggatctaatgtttgaccattcatcttatttgaaaaaactatgtgagtaccatttttttttgttgtgagttgttttatcattgaagatagtttaagcatgacctatatttttgaatgtttgcactaaattttctaataagacgaatggtcagacatcatgtccaaaagtcaatagcatcatatacttaaaatagaggtagtatataaaaaccagtgcatcgcatgggcactacactagaatgagttaaagacaagcttacaaaatcatattactagaaatgaaataaattatagttcaacagaaatgcaagcataaataaaagcatagaatataggcatcaaagttgtaatgtcaacatagtgtattacttaagtccagttgtatgctccaattttcggctgccttcgattgctgaactctgccccagaaactcataaagaactgaggaatcacatggcaaatctttatcgcgtttgtgaatagcagcaacaacaacctggcatattctcgcaagagggcttcctccaggtttctgaaatctatacatagaggagccaaagataaaagtaccaaaacctaaatacacaaatagtgcagaaatggtaaaaccccagatccaacctttgtgatcttgcacccacacaataacagtccccgagatcaatgagcccgcattggctacgaaataggtccaattgaaaaaagaactcttttttgttctctcattttcatcagtgtcatcaaattgatcagcaccaaatgatgatatgcaggggcactgtgcaccataccctaaagcaaccatgtacaaaccgacaaagaatatgatgttctgagaagagactggatctgtccatatgatccatgagtgaggaccagtagagattaatggaactgctgctgacagaagcaacatcatcaatccctaaataaaaggataaaggaaaaaaatgtgaacgaccatttctagaaaaatggtataaaggaaaatgtaaacggtcatgtctagaaaaatgatataaaggaaaatgtaaacaatcatgtctataaaagtttgtcaagtgttgaatgcatcactcctcttacatctgaagattaactgtataaactagagtttaatactgccattcgtccatctgaatttcatactattgttcactgaggatacaaatttttgctcactgagtggacgtaggaattgggatcatctcttacagtgtttacttccaaaaaaaaaggattataatcgttattttagatgatatacaaacgtgcattagttcatactgtcacttacgataatgaagatcgtgcagaagatcagaattgtacagtacttccccagatatgaatcagctaagaaggctccaaccagaggtgcaagataacttgttcctgaccaagttgcaacatctcttgcagcggccacgtttgtttcatgtagaacttttgtgagataactgactaggttttttacaattgaagtaaaggccagataagagcagaatgaaaaaactgcaataaaaaatgaaccataaaaggtccagtataaaattaaacagaacccaaacacaggaggaaagaatattcataaatcataataatactgtaatatatataaatgctgggaaatgaaatcagtttcagatgttcgagtatttagcatcaaatatcctactatatcttcaagcagaagcttgacaatgcaacatcatttttcagcactaaccgatggctaatgaggaacccttccagttccctgtatgtttccttaaagcaggatgcccacggatgcaaacagatccatcacctgtatattcaagggtctgcatttccaagtaaaaaacacaaatagcctttaatgccagtgtcatccatcactggtatagatgtttcaatagagaattgtgcattttcctaatgtagatggaattattctatatatttccaggaaaatttatcctaagaacaaaattatattatatacattggaagcaaattaactgatcatccaaaaaaactgcaaagtatcactaactaaaaacattattagtatgcaagggcctagccattcttatggtcacattagtaatatattgctaccactttatgtccttattgtaaggatgatatatttagacagaacatttgaaagtttatcttggattgcatgccccagtcggccatgccccatactagtgcaaccatataaaataattttaagtaagagaaaattttccgactgaacttcactctatatttcttttttactttcgcaacactctagaactagagcattaaacagaaacaaaacatcagctgaaagcagtattttcacaccatttgatgaaagcagaaaaggcacctcaaatttggccaaatatttttttctctttaagagaaaaaaatcagacaaatctcgctatgagagtgagagagagagagaacaaaccacttgcgaggagttctcttcatccagcagaggcttgtcatgctggtatgaggagtccatggctttactttcttacaagtaaaccaggttaatgtcctgaggaagaggaaagaaagtagcctgagattttgagcagatagtggaagtgcagattagaggttttaatggaaaataatggaaaacatattgccctacaataaaaaaatgccagagttataatttataaataataatagaccacccaacaactgggcatactgtgagtgatgtcaggtttcagtttagacaagcagcacgttgggcatatggctatcatttaatcagaaaaatctgtcgtacagagttttaatgtgataatcaatagtagcctgtagcccttttttgtccattatcttagactgacgcatcagtactagctctcacctaaaattactagtagttctagaaagcaagcggcgtcatggcatcaatcatctatttcagaaatgatgggccaactacttcgaataaaaaaacagtatttatatatttcttccatcctaaaatatatcaatattgtactaaacgagtcacatcatattactattaatttagacatgctgcctatctagattagtagtaacatgctacatccgatcctaggttactatattttaggacggaggtagcaaaactaaagccgtactcggtagtaagtgaagtatactactatctccgtctcaaaatgtatctatttttagtacagtaacttgtcccaaaatgaagctatttattcacctactctctcctcttaaccaatcacaaccatttttttcacctactttctcttccccatcaatcacaactctcctccaatcatctctacctacttttttaatatctgtgtctaactcaaaaatacttacattctgagacgaaggaagtactcatcagttgcaacggattgagatctcaccctactctcttgataaacgaagagtgatcatcttggtagccaatatgatgaaacactcacacggactgagaagacagaacctgctacgaacaataaatgggcagcgcatcaaccatcaagtaatccatctaacgctacgacctatccatcttctaattggcgagacggattagccatcctgacgaacgccgtaacagctagagctcagccgagaggcaagcacgcgaacctaacatggatattcttctgctccccccattttccccttcgctagctcgcttgttgggggaaaagagagaagatgagaccgtagcatccaccctcccaagaacttctctctacaactaactttgcaaaattcaacgaaggaacatgcatgcgactaatctgacgagatagtttgcaccgaaaagggggcaattaaatttgcctcgcttcaggtactagatggagacgaaaatcggagaaatcacgcaccgagagaatgaagcatgaaccggccggattggccggactccggcgagcccgacactgagcccgccactctctgctgctccgcgtgggccgtcctcactctcctccacgccgaggcgaaggcccttgatgattttgcgctttgtagagtggggatgacacgcgggtccacctgcttggaataatgctaccggtgctctctccgactccccttttcttttcttttttacttcttttcccgattacacggaagtggagagtcacaactcacacgcaccactgcacccgcatgtaactctcactaaaatagaaaatgagcaacggcaaattataatgtctctcttttttccagcttcagtttccttttatttttcctgcacgtaagcgcctcatgcaccaggcgatttgtcttttccatgtatgttgttcctaaatttggatggtactgcaaatcctttatatttttgagctgtcaagcaaatatactgctagacattcctcgagagggaaaaaaataagtagtattgtaagtttaaatctgattaatgcactagcagtcaaactgccattcaacctttttaagtcttcagttcagtttgacacactcgattcattttttcctggaaaaagtatactttaactccctcaactatggccagagtacgattcatgacctccaaccacaaaaccggatatatcgactcctctaactaccaaaaccggtgcaaactatatcctaggtggttttggttgacgtggcacctacgtggcggtgttgacccggtcttcgtcccacgtgtcgtcgacgtgtcgcttaggtggcattagagtaaaatcaaaaatttgtaggaccaacgtgtcattaacaaaaaaaaaatagtgggacccaccgacatatggccccacgtgtcattctcacccctctcccctctctctcatcttttcctctcctctcaccttcaatcactagagcgcggggcggcggcgacaacgcacagggaaggaggtcgctggccgtccacgcgcgggggaggagctcgtcggccgttcacccgcagagaggagctcgccagcgccccatcccttcttcttcctcatcctcctctctctctctctctcccttctctctctttctctcccctttctcttcgtctgcaggcggcggtgggtgtttgagggccgtagcggcgacagccagcgggagggcgggcgctgcctcgagacggagcggcgacgaggcgccctcgaggcggagctacggctcgtcgtcctcaaggcgtcgcgacggctcccgccgcgcccacgcacgtcgcgatgcctttgccgccgccgccgcctacctcgactacatcgtcgacaacgcggacgagtttggcggcacctgctgggccatcaccaagttcagctgggacgtcaagtatgccggcgtccagatccttgccgccaggatacgtcgtgatagcaacaaacaccttgcattgacgtgatatgatgtcagtgagagtgagctatgtaggcgatgagtgtgaatgtattttgcgtgtgcagctagccaactactgatgagaggggagcacgaggagaggcacagggagacactggagaggtacatgagagaaggcagagcaccatgtgtgcgcgtgcatgggccggcggcgccgacgccaacgtggagcagagccccggcgccggaggcggcgacggcggcacaggcgtcacgacatgcatgggcggcgggagccatcggaacgccttgaggacgacgagccatagctccgcctcgagggcgcctcgtcgccgctccgtctctaggcagcgcccgccctcccgctggctgccgccgctacggccctcgaacacccgccgccgcctgcagacgaagagaaaggggagagaaagagagagaaaggagagagagaggggaggaagaagggatggggcgtcggtgagaatgacatgtgggcccacatgtcggtgggtcccactattttttctcgtgtgaatgacatgttggtcctacaaatttttgtttttactctaatgcccgacacgtctacgacacgtggaacgaagaccgagtcaacaccaccatgtaggcgtcacgtcagccaaaaccatttctaaaaccacccagggatatagtttgcaccggttttggtagttggaggagtcgatatacccggttttgtagttggagccttggaggtcatgaatcatactcgggccggagttgagggagtaaaagtatactttttcctttttttccttgagttgggcccaaccgcataacgagcagagcacgcaccgtgggacgggccctgcaaaaatccgtcgagagaggcccgtgttatcgacgcgatgtgggcatacggcatgacggcccatgtccaaccgcgccagtccctagttccctacgccgcccttcgacgctttgccgaacgaagcccaattcggtggcctagtttcatcccttcgcgctatccagcaccgcggctcgcgctcaagtcggcctgtgtggtgtgctcggctgctcgcgtcgcggtgtgtcgtgtgcgtgacgggggtgggggtgggtcgcgcccccgcatcacagcgtccgttcaaggcttcacgcacatgccgcgccccgtgattggttggtactcctatctctagtagctggtgtactccgcgttgccgggtcgtcataggattttttttttcctttggctccctgcttggctgcttgtttttctttctagcagttaagtaaagggtatgtttattcctgcaccagaagtagttcaagagtatatatgctcgttacagatattcttccttgcattgcatgttacgctcgttacagatagcttacctgcgaattaaaaacaagggagaatatagacgggtgtgctgagtaaagtagcaagataactcccaactactaagagcatatatacccaataccaataaagatagtataatctaaacaagctagtaaaacgccatggtcggctcgcgatagcagtgcatgcataagagcaagtttaatagtatagccaactactagcttcaattcatctatagctaatataatagcttattcatgcaatagttatatactacactattaatacatggtcccacaagtcatacacactgtgtctagaggcggatccaacgtgggtgcaggggggactnnagtccnccntncaccnacaagacccatggatacccccggagcacccccttcgattttttcaccataaatgctaaattaaatgtttctaaatggctagaggttgaagaaaccatgtaattgaggccctcctcccctaattttctgtttctggatccgcccctaattgtgtcttagagtccgtgctataattggctacaaatctgtagcccgctactcttctctctctccttatttatcttcttaaaatatatttacagctagcttatagtctactattgtacctgctctaaagaagtcctcgatccttgctccttggcacgaagcaagcaccagcgcagaaattcaacacgatacatatccgatctcacctggggaaggctaaaaatgggcgtacacacgcacgccgtcacgtggatgtttcttcccggcgaccgactgaccaaaacatgcacaagccggggcagcggagacaagtacacgtggtcgactggtggtagctcgcacctcccccggttttggccttctggttctactagccttctaggcgtccagtagccgcgtcccttcctttttcctttgcctttgcggctttgcctctgatcccaagtcccgacgacagtgtagcgtacgtagacgcagcgcgatttctcagcgcggacggccggacgggtggtgtggtgtttggggggattttcacaaagaacggctgaaattttctgcatgccatgtacgatcgatgcctgcttttgctacccgctgcacaggctgcctgccctaccaacctaccagcgctttgacagtttgtaatgggaaagtacagttaattagtaacgtgcatggactgcttgaatctttctgctacgtctttgccccggtccgagcggaggtcaccaggtacgtatcgatgttagctttttatacgtctttgctccgtattgtgtggagtcatgaccgtagaaatgtcaagttttgatctcatgcaagctagtcaacacgatctaagccggaaatttacctttcgttgtctgctcaaacggtaaggcctgattgccagggaaattaatttgacgcaacgaaaatccggcaaaatccatgtgtttcatttgagtttattgatattttagaaagagtttttctttaccattcttgagacctctttgtacctactacctatgttccaaaataaatgtattcctaggatttaaaatatgttccaaaatagttaccattttagaatactaattatcccaccaatcacatttccattcaaatttcttcctattttaccctcagccatcctccaactctcatctatacaccgtttgatgagggacaccataatcattcgttttaaatcttaatatatgctaaataatctagagttacaattattttaaaataaaggtagtacttaggagtacattacctaatgattcgtctaggttggtgcctcacactatgtacatgctaaacggtgtgttctttttaaatatctctaaaaaaaggttttaaaaatcatatcaatatattattcctgtttaaaataattaagtaatcatgtgttaatggttcatcttattttacatatcttcttaatatttttatttcctttaatgcctaaccattgaaaaaggtattaagaagatatatgggtaagtaatttctggtttcaaataactcccccctcctcccaactagcccgtgagatccaagctcatttggcaatctccattgggtggccattcctccttaggttgagttcgtttcctttctttcccaacctatctctattgttttccgccattcccccttagagcaagtttaatagtatagctcactactagctccaattcatctatagttaatgtaatagccaattcatacaatagttgcttactatactattaatacctggtcccacctgtcatatacacattacatcttggagtctgtgctacagctggctacatatctgtagcccgctgctattctctctttccctttatctctttaaaatatgtttatagctggcttatagcctgctattgtacctgctctattaggctaagtttgttttttttcctttcccaacacatctctatcgttgtcggtgatatgggcccgggggtatcacgtctagagggaggaggccgcccccaaactcgcgtggctccccccgaggggggtcgaggccggggtgttgcggcggctgccccctcccagcttggggttgagcccggggtgttgcggcggctgccccctcccagcttgaggccgggccgcccctaagcccacgtggctccccccgaggggggtcgagcccggggtggcgcggcggcagccccctcccagctagagggaggaggccgccctcaaacccacgtggctccccccgaggggggtcgagcccagggtgttgcggcggctgccccctcccagcttggggtcgagctgccccgaccccctttacgtatcagcccacatgtacagggttaggtgggcgcgcctaacgcccacctaactgcatttaaagcggtctatgcaatcgcgccatgccgcatttaatgcggcgtgctgcgcatttgaccggtctgtgaccggttgaatgactgatgggacggcgactgtgtacccccgccctgtcagtgtgtcaggcggcgagcggcgtgctccgtcccgtcccatcataatgatggggggcttcatagcctcttacccggtcggagctagttcaaccactctgaactgacccgggttcccgtttctagtgtgaacgagaacccggaagtcctcatccattaaatggcgaatgacaagggggccctgcatgatttgatgggccccgcgcagcaaccgacgtgcagatagcttccgggctaaggctcaagacatgtaattaatatagagaatattttcccttctccctaggtaggactcgcagcacatgtggtatccccttagagtataaaaggaggaccatgtctagcgaggatgggggatcggactgaggatccctgagccaaagcttgtctaaccctagcttgcataccagggattcagggactttctaagctcagaagaatcatacacacaggagtagggtattacgcttcatagcggcccgaacatgtataaatctcttttgtctcgtcgtcttggaggagcttccgagatcaagatcacacacagttttgctcaccaaattctcgaatctcacccgctgcccccggccgaactcacgaaaggggggggggggtctcacgatctcccgctagagagagtcacccctcgacaatcgttttccgtgcacacgcttttcaaactgctagatgatatgttttttttaaaaaaaatctatacgaaagttgtttttaaaaacatagtaatttattttttaaaaaaaaatattagctaatacttaattaatcatgcgctaaccatcgcttcgttttgcgtgctgggattgaaggttcccaacctcactcacgtgcatgaccccctccccccgaactctgggcttgttcggaatggagggattacacatgatttttgtaagattggcaaatcctttggatttgatgcattcggttcataagaatcacgtgtaggaattttgtaggaatactatagcaaccctgtgaaaacgtaggaatttcataggattctgaacatccactcacatctctttttttttcattagctaccacagggtacatgctaatcacgttggattgactagatggaaactaatattttattgtttaattatactataatatatgagatcaatattaattggaaaattcctacggtttatatattcctgtattccgaatgcttcttaccatcaaattccttcgtttttcaatcctacatcttacataagcaatcctatattattcctgtgttttttttattcctatatttttcctattatgtgatccgaacaagccctcacaggtgacttcaacctcttgggcaacccggccttccccacaagtttgctagctagcgaccatcgtctcctgtttgatgagcacgaagcacattgaatgagcataggatgcaatttttgttcttgccttatccctgttgatggattgattagattttgttcagtacctgattgtaagggactataaaatccagcatatatggttaagaagaaagagatcacaatagaaaagcatgctcagccccatattcaatggcggagcaattatcaggttatatggtcaggcaaccgcttgatcttcgccacaataataaacattattaaaaaaacaatcggccaccaaaaacgttattcgtgaagtgagcttgacggcattgttggctccaacattgcctatagagcaccgatatggataacggttcgaacttatcaaacaccaaaacacagtcacatacacgagtacactacactgatcgtataagaatgtgagtggacatcgatatcaatcaaatttactgacttaaaagcctttctagagggcatacaagttgaaacctaatgtgctaacacccacgccaggcacaaagccagcttccactaccaccgaacgtggcgtgaaacaaaacctgcattaagtttttgcggctattctacgggctagcactctgtttcgcgtcataaagatcgataaactataaataaaaccaaggagcaaggcaagagcttttctgcacgaaatggccatccccgcgaattctccgaaacaaaaagaaatggccaacccccccccccccccccctcttcaccacacgcttcttccgatgaaatggaatgacgaacggcgcctttcgcagagacatcagtgctcgcatgtgcggtacagcgtcacgtccccgctctctagaaataaatcgtctgccgagaaacgcaaagggcgggcagggcagggcagggcagggcagccgcgagtcggtgggcagccggggtgtgggtggggtggtgtggccgtgtggggagccacgcgcggaagaaaacaaaagcaattaagcgacgctggtttttcgatcttggacggcaggtaagcccgtgggccggctgcgcacgcgggattcccccgcggcccgcagggaggcgcgaccaggggacggcggtttcgacttcgcgccggcagagggggcgctgggtgttgggagtggacgacgcggtctctctctctcgctcgcgcgtcggcgtcggtctttcccagcgcgcgcggaaccgcccgcgcgccgcgtgcggcctgactcggacgccacgaggcccgcgccgcggtggtggtgggttcggcgcagcagccggttcggcgccttggcggtaacaggccggtggtggtttggggctttgggcatctcgcctagcgatgcacatattccttggcttaaaccccacgatttgggctactgactaatcgcgtgctgtatttccttgccttttgcactttgttttttgcaattcgtttgcttccgtgggagaagactttgccccttcgtcctgcgtgtacagtctatatattaatacagagggtgtttgtagtcagacacccggactatgtcaattcccacggcgtgcgagctcgcgtcatttgataactgagttcgtgtaattaacccggaaagctatcgaattctacggctctcctctaacatgcatgaacttcaaagtttagtttatttctacggttattaatgacttaaaaagctttgtccactacttaaagaaaacaacataaatcattttcttacgtgccaaattaaacggcacctccaccctaaggtgagtcctccttaccgtattctttgggtcttcctcccttgtactagttcactagttatagtgaggtgccttcagctcacttgtatcggtttgctctttcccaacaagtgcactttcacctcccgcaacctatagctattaaattattgagcaatgctacacgtactaaatttttcttactaaacttttactaacaatcatctcaaccgtttgatttaagtagatggaagtttataaaaaaaaatctagatgcacgcgtagcatgacacatcagtgttagtaagaatctagtaagaaaaagttagtatgtatagccttttcctaaattattttacccttgtttttctcttttccttttactaaaataatgtatatttttaaagtctctaataaaagttagtcctattgtttaatatatcataaaacgatgaaaaatttcataatagagtatccgattaacttttttttaggtactacttatgtgaaaatgaaaatgtgaagtcttctcttacttttgacgagtaacacatgatagtttggggtgggggtgatagcattgatatatactatcccctagcctagaacaggggcggatctacagaattaaggtcgacaccgacgactttcggtaaaatctataataaaactgcttatctatatgttataacaatatgacctaaggataattagcatgctatgacaccgatagtcacgttatgacaccaacgaatctattttctagatctgccactgcctagaacccttcccttctcttttcctacttttttttttctgtccaaactccaaaccctcaaatgaattataattttgatgtcagggcgaatatggcatatgtcttgacgaaggttgaatggtaagtggtcaaaattttcgtccttttcaaccccgtttcaagaatttacagctaagattctcttacgttcaagacatgtaacaatgttaggttattatctgaaaaacgtaacaatgttaggtctccctgtatcaacaaattaacaaaaattagcgttagtggacgaaagtatacaggtcttatttctttgtaagaaaaatatgcaagaacgctactgggtttcatcaagagtaggagtactttttgtgcagcttgctgacgtcatgagtttctcagctgccgttctctgtcacgagtcacgaccacctcagatcaaatgtcaaaaggggcgagtgacgtatttgatacaagatgaacgaatggaacctgaaaaaagcagttaaatataagtacaatatatgtcgaacgtgtgtcgatcttacataagactaaccattttgcttttcgttgggaaaatgatttaaaactctcgagggaatgctttcttttcatgtcatttatgtagttgtattttttttaaaaaaatagattaatatgtggtatatcactacataaatatataagatcaaatatgatatctacaagttaaaaaaaactctagttagtttacatatattgacagttaaatttgtttgctttgtaaacttgtagaaatcatagacatatcatacatcaatctaccttttttttaacttttgagtaaagtgaattgttggtctctaaacttgttcacctgtgtaatttaggttctctaactctcgaaaatttatttttcaaattcctggacaagtgtttcattctgattccaaattgcctagacccctctataaaatgagggcctgtttagttggtgaaatgagaattttttgtgtcacatcggacgtttgaccggatatcggaaggggttttcgggcacgaatgaaaaaactaatttcataactcacctggaaaccgcgagacggatcttttgagcctaattaatccgtcattagtacatgtgggttactgtagcacttatggctaatcatagactaattagactcaaaagattcatctcgcgatttacatgtaaactgtgcagttagtttttctttttatctatatttaatgctccatatatatgtttaaagattcgatgtgatgtttttgggaaaagtttcgtgggaactaaacagcccctgagtcaatgcctcatgtggcatgtcaggtgaacaacacataggatcccggatgggtcatgaccgaaataacatactttaacaagtttaggatctaaaaatgtattttgagagttagaatacttatatgacacaggagaccggcagtgtactttactcttaattttgtataagtatttaaataagagtataagaggacaaaaatcatttttatttctggtgtatataatatttcgtcttatctcttactagctggtacaagtaaccagtactccctctggtaaaacaaaaatacatcatttgattttctttcaatcatactagaattttgatcatcaataaatttcaaaatacttaagtctaaatcataaaaaatgatatatgtagctttgtcttgataaaaatactacctccatcttaaaagaagtacacttttatccatgaatttaaactttattttggcaccaaagtagtacgctaataatccataaactaattaaactttttgtaactaatatgggtagaccagtacttagccacttctttatattttgtccgaaaattgctagattgacaagtaatacgaaacggatggaggggttgtgattaaagtatcatcattgtgacctaaaaatgtatgcgtatattttggttacagatcaacgatgcttttatttatttgaccatttatggtcagaatagactttcataaatttatcttaataaataatcacggtccaattcacaccagaacgacctaaaaatatcttcatattatttgatcagaggagcatgtgttttacagatcaacagttcctttgtttatttgactattcatggtcagatttttctttttggttttaagaagactgtgcaccgtctctctctctctctctctctctctctctctctctcacgagtactgagtactgacaggttagtttgtttccctattcattggacaattacgcagttacacaccagtgcccattttttgaccaactagtgaaaacggaaccaaatcaaaagtgtccatttaccgaatcaagtaacgacagcacacggcgatttgtctgcgcgacgaaggctcgcggcctcgcgcctggcagctcgctcgctcgctcgctcagtcgaccgtcgctgcttgacttttcccccttttcaaagtcgcttcctctagacccagcgagagcgggcaatgacggagcggccactgcttccgtccgtccctctctccttccgtccctttcggcgtttgttgtgctccgtctccgccgcgtcactattttttgcggtataaaacccggcgctgccccctgcctccaaccacaccaaaacaactcgcatccgtttcgttcaagtccccccccgaaaagagcttagtagaagcgcgccacagagccttctcgacctggctctcctctagccacctctgcttcttcttcttcttcttcttcttcttcgtctgatcgccaccgaggctaaagccaccaggaggagcaggttgatagctcggcaggcaagatggtgctctccaaggccgtctccgagagtgacatgtccgtgcactccaccttcgcctcccgctacgtccgcgcctccctcccaaggtacgtgctctcgatctgctctctctctgttcttgctgttcttggcccaatgcagagcttcttccaatatttcatggctgactcgatgggattgatcgattggtgttattaggtaccggatgccggagaactcgatcccgaaggaggcggcgtaccagatcatcaacgacgagctgatgctggacggcaacccgcggctgaacctggcgtcgttcgtcaccacgtggatggagcccgagtgcgacaagctcatcatggccgccatcaacaagaactacgtcgacatggacgagtaccccgtcaccaccgagctccaggtacagcaccctgcaggcatctctgcttcgttgaattttctcctatcacctcgcgttttctcgccgccgcgcgcggctcgaatgcacactggaaatccccggatttttggtcgataaaaccggcttggccagttggcctggcctggcagattggtgataagaatctcaggctagaaactttatttccgagtttatcatttgcgtcattcacgggaggcagaatgggggaagaacatggcacagtttccgagatgatcaccaattcgcattagaaaaaatatataggaagtccaataaataaagtaaggggatgggaagaatgatcaccatatctcttcatttttcgcattaaaatatggaaggtgcatgaatgaagggaaatgggaaagaataatgcttggtttggtcaaaacagggcaagagaccaaagttccatctactgaaacggcgtggacaacagtcaaaacctggaacacagaaaacaccactgcaactttcccctttttgtgaatgagacacattattagtccttttttcagccagacatgctttgggccagatgatgtcctagcatgaaatgtacaacattttttttgggccgggccgttctacagctaattaacgaacgctttggatgtgtgacgctgtgcagaaccggtgcgtgaacatgatcgcgcacctgttccacgcgccgctcggggaggacgagacggcggtgggcgtgggcacggtgggttcgtcggaggccatcatgctggccgggctggccttcaagcggcggtggcagaacaagcgcaaggccgaggggaagccgttcgacaagcccaacatcatcaccggcgccaacgtgcaggtgtgctggagaagttcgccccaggtggagctccttcgaggtggagctcaaggaggtgaagctccgcgacggctactacgtcatggaccccgagaaggccgtcgacatggtcaacgagaacaccatctgcgtcgccgccatcctcggctccaccctcaacggcgagttcgaggacgtcaagctactcaacgacctcctcgacaagaagaacaaggagactgggtaactaaaattactatttctactacactaaattatctatctatgaaagtgagattaatcgatgtcattgcggccgtggtgtgcaggtgggagacgccgatccacgtggacgcggcgagcggcgggttcatcgcgccgttcctgtacccggagctggagtgggacttccggctgccgtgggtgaagagcatcaacgtgagcggtcacaagtacgggctcgtctacgccggcatcggctggtgcatctggcgcaacaaggaggacctgcccgaggagctcatcttccacatcaactacctcggcaccgaccagccaaccttcaccctcaacttctccaagggctccagccaggtcatcgcccagtactaccagctcatccgccacggcttcgaggtataatcaatggaacacaattaactctcttgatcagatgaattttttttagctgatctgacacacccatcgatccgatgttatttgcaggggtacaggaacatcatggagaactgccacgagaacgcgatggtgctgaaggaagggctggtgaagacggggaggttcgacatcgtgtccaaggacgaaggggtgccgctggtggcgttctcgctcaaggaccggagccggcacgacgagttcgagatctccgacatgctgcgccgcttcggctggatcgtgccggcgtacaccatgccgcccgacgcccagcacgtcacggtgctccgcgtggtcatccgggaggagttcagccgcaccctcgccgagcgcctcgtcctcgacatcgagaaggtgatgtaccagctcgacgcgctcccctccaggctcatgccccccgtgccgccggcgccgctgctggtggtcgccaagaagtcggagctcgagacgcagcggtcggtgacggaggcgtggaagaagttcgtgctcgccaagaggaccaacggcgtctgctagtctcaattagcgacagcgccacggcctacaaatccacaaatcaagacgctgctgattgatatgattaattacattcatggtgtgagctaccattactgtattttttttttaccgtgctaatttgagtggagccttcgattctaggtccaaggtactagtagagttcataaccaaaagccatgctcttgcttttgtttctccttctgataatctgtgcagctgcgctgcagcctgcactcatctcccgagagttgtaagttgaaactgtacgattttgatgttccctgttctagtgtaagtgccaattattgagtggtatggaaaatatttcttcaagaaaccaatcagagcgtaatttccgtgcttgatgttgtgcttgcttcttgccgttatatgttccccgtagtaccctctctacctgcacttgccttaaacttttttctcaaccttatcagtagtactagtaattttcccctgatttgccttaacagtaggagtagtactaatagtatcaagtagtttgttctaaagaggacttctaaaaatgtaaattgggcccaattgagcccgactcggactcgacgcaacggcgatagccctataaaagcaacggttagccgcaacgctcagccatcgaacgactcattgatcaaagaggagagaaaaggaaacgactcgttgatcaagaaactgactcgatggcgttggagggagccgcgggcggcggcggcgtcggcggcggtggcggaccaccggggcaggaggcggggaagaaggtggggtggagcaaggaggaggacaagctgctgcgggagctggtgcggaagcaaggcgggaaggactggggcgtcatcgccaccgcgttccccggccgcaccgacaagtcgtgccgcctccggtggaggcagcacctggaccccagcgtcgacgtcgcgctgcccttctccgccggcgaggacaggaagatcgtggagctgcaccgcgtccacggcaaccgctgggccaccatcgcggccttcctccccggccgcagcgacaacgccatcaagaaccgctggaacacccacctccgcaagcgccacgcccaggacgtgcagcagcgcccgtcaggtggcctcgccctcggcctcggcggcggtggcggcgctgggcaggctgcgggcgggaaactgacgccggtgtgcctccaattgttccctccgacgcaggcaccgccgatcggggagaacttaccggggccggcaagaagcgctgtgccggagctcctcaagctcttccccctggctcccggtgatctcaaggacaatgcgagcgcggcggcggcgatggatgtgggtaacgaggccgtccgcgcgctccccgagttgaggctttccccggcggcggtggtgttcgacgcaatgccgctgcaggctatccggatgtagattcttgcctcgtcttcaattttttcttgtttcttctattttgttgtttctgagatgaacagctcttcaatcaacgcagggtatttcctagaggaacttagttttgatcgaagagctgtagattttgatcttcttggtttcttgcaacaatcttgctagttagtggtgatcaagaagccgtcttgtgattctagttcttgttagtagtagtcaaaaaattgaggtatcaccttcctgtaattacttgattgcaatagtaatcaaggtctgaccatcctgtaattacgtgatgtcgatgaatcttttgttgtggtattcagttcgaaacttgcaattggtttcatcaatgtctggtctagattacgctgacagaatgacagtatcaatcttcagccgtgcttgtgtgggactttaaaacatcctggtatgggtctgggccagttcttcagaatttgtttgatggatcaatctgcatccctccagtccacttgttgtttcttcctgtcctgtgttggtaatgtgatctggaacgactgcccgccgtggcagttaactgtaaagatgttatctcgttgatgttgtttgtctttcgttacagacggactctgcttctcctgaacagtcagactctgttttctcttgcctgtacatattcagttacatttacattttggagatggtttgagttcagccaacaacggccaaggagttcgacctgaaggcaaacaatcttaaagtgatttttgagtaaaaaagttcgattttttaaaagaatgattctttttttttgaatgcctaaaagaatgattctaagtagtttttatatatataaaaaaaattcttcctagcaattatgggatagagttgtaaacgaaaatgacaaagaaaaccctacaatcaaattctaaagcactgataaatcgaaactcctagtgggcgggcgatcgttcccctctcctccaccacttagttttcttttttggcaccgtattacttttctgttttagtaaatttatgcacctatagtttacacatctaaagtttagagatccaaagtttataaatcaaaggtttatatatccaattcaaatttgaatttgaattcaaatattttttatatatagtatttctatacatctaaagtttatacacctaaaatttatagacccaaagtttataagtcaaaagtttatatacccgattcaaatttgaatttgacttatatctaattcaaatttaaatttgaattcaaatattttttaatatattatttctatacatttaaagtttatacacctaaagtttatagacctaaagtttataggtcaaaagtttacataccaatttaaatttgaatttgaatttgaattcaaatattttttttatttatagtatttctatatataaatttttctaactcttgttttttcttattttttaaaaaatttatggtatagtaggaaggtaagaaggggaggaggaagggggagaggagtgtgtctaaggggaggatggggatcgatcacttcgcggcttcgcccgttagcatgccccctgataaattgtgtttaagaataactgaagtcccgcatatagcgtctccgtgaacgaagcagttgtcccatacactgggactccgattaaagcggagccaaaacaagtgtctgaagacaatatttccatattggttagctctatgatcagatattccgatcaccacaacgacggaaaaaaaaggcaattatagttgtctatttggtaatttgtatattcttgtagataaaagaattttcctatgaggtactagatgcatagtattactagatgataccccgcgcgttgcgacgggatatttgtaatgcatgtttgtttattattgtaaataactttaagtgattagtatatttgcaaggaagttgtaagttatatatagtctttcagaaacactacatactaaaaagagaacgcaagtaatgattatttaagaactgatttagctaaggaacactcttgttaccgctcatggtaaggaatgcgattgtgaaatactatgatagaagtatttgatcacacatgggtataacatgcaaagagccatagcatatacatttcgttacttatattgggatagtagcttcagttgtgctatgtaaaagtgccaatggactgagggttccgtagctggtacggctgaggtaggcagggcgatccgacaaaagcggatcacgcctggccaccgccggtggccggcggctgccggagccacgctcgtatgagcgctaggcgggggaggctcctcactatcgctcctctggccggtggtctcgctagaagccgaggtcagagcggcgcagatgccggccgtggtgtcggtggtcagcgcgcggctgtgggtggcgtttcagaggagagcggtggagcgctgtgtgagcaaagggcacggcgtcaattgtccaaggaggtggcgtgggcagcggccatgaccggccgccccaagccggtgcatgctgtgaccccttcgccagcatcgccgatccgctcaaagttttgggcaacgccggacgacgatgactcggaggatgatgatgaggcaccgacaccgcccccgttcacaggctcatcggcgacatcttctccgtcgacggaggaattcgtcaacgaggcaagcgcagcgggattctcacgtgcacagctcgtcatggcggagcagcaactccaagcaggtaagaacagcgaccaacggttgccggaggtaatcttgtccacgctgctacggcggaagctggtgggtccgccatggcgtggccctttaccagcggaacgcgtttctccgccgagaacgctgggcgactgcctggcgtcggcatctcggtgtccgcggcgtaggcggcgcgatggtcgacggtgcggcgttcctcgttcatcgtcatcgccggaggccgggacggttggttcaaaattcgtaattccgaaatcgttgggcgtttcaaacgactccgatcaattactacggcagggttcacggcctgatttccctcctctctgcggtgcgcactcgtcggtctctaccgcgattgccagcgcaggaggggaggtacgaaggccggcgccatctgcatctcagtcggatcggattcgtttggggcccgggaagtggtttcggcccaccaaaggattgatctccctctttgctcgctctggactcaaacctagatcgcgaaaactgcagccgccatcacgccccactgcgacgatctcgtacgctgcggtcgtacggagaggaaaagccatggcggcacacggaggcagagggtttggcggtcaagggggagggagaggctggggcttcgcgcaaggtttccaccctggcttcgacggcggccgcggccgtggccgtgatcagcgcggtcgcccacatggccacaacggtggcggattcggaggagggtacggaggcggatatggcggcggaggctatggtggtaacagtcacggtggatacggaggcaaccggaaccgccgcggttggcagggtgggcgccgcttcgcgccggctgctggccacgcggccggtcagttccacgccggaggtggcgttcctggacaccaggccggtggccaggcggtggtcggccaactgcagcagcaggccgctgctggtcagttccagccggctggcttccagacagcggggctggctgaccaacagcccgcccaggcgcccttccaggcacctctggctggccagcagcctacccagccggctgcggctggcaaccagaccagggaggctggggctgtgctcttccagcaggtcagccaaagccagaaggcccaggtggctgcaccggccaacggtggcggcctcggtacgtctcaggtcgggacgtcggcgctgctggcctccagccaagcagcaccggcggctgctccagctggctccacaagaggggccatcattggaggatcggcacaggatcccgcggcgacacatctggaaggcttcatggcaaccaagcccgaacctgcacaagccggaaagcagaagagcaagggtaaaccctactgtttccgctgctatacaaaggggcacactttagatgattgcactgtcttgctttgctgtgatttgtgctttgaaaatcatgttctaaagaattgcccaaatgtgaagaaaacaaatgcgattgcggctccatgtggttatgcagtagagggcatgggcttttactatatccctatgaatgacaacccaaagagtaatgtggaggagcacacggtcttggtacgtgtcttagacggttcctttactgttgatcaactgacagtggaacttgatagactactgccagctaaaatcacttgggagattggtttgaaggggtctgatgccttcatcattactaattttccatccgagctccgagaatatgcggtgaattggggtccaatggacaccaagacaattaagggaaagatccgcttcgagaaaggtgtcgagaatgatgtgaacagatatgagattgacaaagtttgggttcagtttcggggtctacctagcgagctcagagaatttcctattatatgggctatagggtccatattaggggtctctaaagcggtggatatgcgctttaccaagacgtttggcaggtccagactgaaggtggctgttctagacccgaacaggatcccagattacgttgatgtggtcattggtgacttcgtttatgagctgcagttccgcatggagatagatatgcctgttggagagccttcagtcattgacatggactctaccacagacaatgatggtgacaatgatgggaaaggcgaggacccaatggaggaggatgccaacaaaaataatggcacccctgatgacttaccaaaggatgctgcccctgaaaatgcccctgcagaccagctacccaagcatggcgcgggtgctgagacaggcaagctgaaggagaaaacagtggctaagtctgatccgggaaaaaataaaaggcccgtggctgtactatctcaggggatctctctggagggttccattcagtggcaggcaaacatgttgggtaaccatggctcttctagcaaaccggtggtgcacaagggagagactgtatctcctctgaggtccagcaagcgcaatgtgtcctccctggagcaggactccatggaaaaggccaccaaactgaaagctcgcaaaaacttggattccactgctgcaaaaggtaacaaacccctcccctcctcttttcataatttagatgattctgttatactggctacaactgactctttaggaattaatttgggggacgatgttagttcggttctagattctgtacattctttaaaacaaattgagttacaaagatttaacgacttttgctcatctagtaaagaggagaaacgtagctgcgaggaaaactcatcagtttgttcggaggataatgttgatattgatgctttaaatactatctgttcggaaattgcggaaagccttggtgatgggggctatgacccgctgtgtctacatacccccttatcacaaataaagaggaggcagcctaagggtaagcagaataaaaataaaagcgaacgtagtaaaacatgaagggtattttttggaattgtaatgggtttgcagacccgaaaaaatataaatttttgtctgatctaactaaggagcaaaatctagactttattgctttatcagagacgggcagagcctcttttcctcagtcaacattaaataatatttgtgctggcagagatttcatctggcactgcatggcccctagggggcgctctggtggtatgattctaggtgttaatttgctgtttcttgacattggagaaattgaggaaggagattttttcattcgctttaaattaagacagagagcagatgattttaaatttaatttgatttctgtatatggtccagcacagtctgatttaaaaggtcattttctctctgaattagtacgagtttgctctaaagaaaccatacctacagttgtaggtggtgactttaatatacttcgtaacccacaggagaaaaataatgatacctttaacgatagatggccatttctgttcaatgcagtaattgacactttgaatcttagagaattggagtcatcagggagatcttttacttgggcaaatcacttacaaaatcaaacttttgagaagcttgacagaattctagtttctacggagtttgagacaaaattcccactctctactgttagcatcctcactagggaaatttcagatcatacacctttgctatacaattcaggcggtgcgtccgcagcttaccaacctcaatttaaatttgaattgggctggttgcggagggacggtttcagtgatattgtaaaggaggtgtggcaaggggtgtccattgagggtacacctttagagagatggcagaggaaaattagacgattacgccaatttcttcgaggttgggcgaaaaatattactggtgcttacaaaaaag

SEQ ID NO: 74358 - DNA, 5436 bp, Oryza sativa
actttgcgcatgaaaaaaaagaaaaaacaggctgcaattccacccaataagttggaacaaatatataattccgtacataattgcaatgcagaagaagatgtgtgcaaggaagaagaaagaaaaatctatacctgcaactcccattgcaaaaggagatgagctgccgccgggaatcatccgcgacgacggccccgggaacccgccgctgccgctgctgctgccaacctcgaaaagtggcatggtaggcgagaactccccgaagtcggtcaccggcggcgacggcgacggcgcgggtaggcggaagaacggcgagagcataggtggtccagttccgccgccgccgccgccgccgctgcggacgggggaggcggcgtcccacgcggcgagcggcgcgccacgcagcgggcgcgggctccagcggaagggaccgaatccgggggcgcccatcgggggaggcggcggcggcggcgtgcgggactcgtcggtggagacggcgtcgtggtggtgctgcggctgccggagcggaggcgggggcgggggagggggcggctggtgggggaggaggtggaggcggcggatccagacggagttgagcgggtcggggtgctgctgctgcggcggcgggaggcggcggtggtggtggtaggacggcggcagcgcggagctgtggctcccgacggagctccgcagcgcgaggtgctccgacatggcggcggcggcggagggcgggatcgccggagaccgcgaggaggaccccgaaggcgaaggctagcttaagctagccctcgcacagctctggtcgtgtggctgggctcacctaggatggaggcgaggtggggaggaagcaagcaagcggggggaggaatataagctgccgggaggtcgccgtcgccggcgtcgtggtcgtcgtcgtcggcgtcgcggggagtggaggaagtgaagcgagagccgagagaagagggtgatgaggggataggggtggacacgaacacacgacccgctcatccgctggcgttgacacggcttccatagttgcatatgggatgctcacattgaagccaaaaattaggtaacatttgattataaggtctatattttcaatacggttttcagatttttattttattctatgatcctaataaatatgaaattagtatcacatgaaagtgcttcaatgtatgaatctagtgatatagcatgcataatacttagtatagatatagttagtatgattattagtcaaaagctacccagtttgattttccttaaaaaagggcgtcctataatttgggagtaatgtttttaaaattttgacaggatttcctatatatttattaaaatttgaaaaaaaaaactaaatggatgcgcaaatttagcaactctaccaaaagtgatatgatttaaagtggcatcattctgaacaagcccataggttttgtatgtctgttgaaaagccgcagctaattttcaacctttttttaaaaaaaacaaaatttagcgtgtttatggtttttacccttgctttttaaaatatagaataaaaattttagattatttgttttcatcggatctaattttctacttcctccatctcagaatgtaaccatttttttaggtacgcacgtgtattaagaaagtaggtagaaatgattggaagagggttgtgattggtggagaagagaaagtagacgaagagaatggttgtgatgggttgagaggagagggtaggtgaagaaatagctttattttaggacaagttactatgctagaaatagctatattttggacggggtagtatatatttccaatcagtctggcccaccaatcatgaatcactcgagtcatcttgggtgtgctctttcacaggtttaaccttatgatgtgaccattgtcagggttatggatactacatacctaatattagttgattaaatttcgacagaatccaccacataccatgtcttatacagatacaatcctcggatataggaggagttccggataaggaaagacaaccagagttctatatgaaaacgacaatgactactcggattgtatccatattgatttctctagttctacttagacaaggaggcatctatggatataaatacaaggccccctaggaggagaggggacacaatcaacatacacgaaacaatagatcaagatagaagatcaacatagaagccaacatacaccaagataagacaccggatatcgacttcagagataggcatggctagtccccgacggtgtctccggatactgataggagagacattgcgatgtctctgatctcgccggcacgaactcgaggaggaagactaccctgttgtcgactacgagtcagacctttagactgccatgtcaacaacagttagataggctaccccaaatattgtactggtgtgattatggtgaataagagcaataccggcttcggccaacaggatgtagggttattaactaacaattcaggggcccgaacctgtataaaaatcctcgtcactgtctcttttacctcagtctcgtatatatcctagtaccaacgatccccatactatgaaaatacccaaatcgcgacatcaaacgtcgacagtgccgcaccatagttgctattgatataaccgttgctcatatcatagcacagtagggagacaagctgcccacactctagaatccaattcggccaactgcagcaacgttgacttcaaacggccgccaaatatgcatacgatcttcgtttccgatccatgagtacttgatgaaaaactctcgaagtcctctttccaaaggatccagcctcatcaccaaattacatgttagtcatttgcaattgaagaaataaggtgatgcctacctatcttgggccattaggcttgtaacttcatttgggatcccggcccaactaggacccatgtagggtgcgcccaaacctaatggagcacgaccctacggaccctttggttgtccccccaccttcttaaatagctaggtaccatttagggtttttcgggttttgtatagattaaagtttagtcattgttactttcttacatcgcgcatgtcggctagtccgtttgtttgtcttcggaacccaacttatcatttgttttcaattcctatttgcaattcagattgcttttatcttgttattgcttgtttcttcgatttgcttgtagcaataaggttgatctgcatcggtgtatcaatcactaagacgcaacgcaacaacacctcgtacggctgtagttgggtcatcaacgtttctctcaaatcatagttatcttcaactcatcgaaaaatcgggccaatcatagccatgagtgtctcgagtggagcacagggtttgttaatgttatatcaatagcaactatgatcacatcaccttactagttaacagtttttaacaatgtacatatcaaagatactagtatgactgtatggatgcctctaatatccattatcaacatgagataaaactatgagctctctttctatcccaatccatgttctctgcagtactacttattggctgtagatccaaatatctgtggggtccacatatcagtgtgcagtaccgtggaggaccatcactctttccatccgtccgttggtaatgtacgggggacacatgtcacacatctacggttgttacacttacacacccacatagccggtcgtcggtcggtactactccattggaagcgtcagattccatagtgctaaactattacacatacacatgttttctttttgcttggagttgcatgcttcatgtctggaaaagaaggtgctcttcctccaggatcactatttggcttttttcaagatttgttttcttatgggaggggtcttcctctcattatttgcatgttattcaaatagttatgaaaatttttttaaaaaaattaagaagatatattaatatgtgatatatcactccacaaacatgcaagttcaaatttaatttctacatctcgcaacgaaaaaaataaattaaactacaatcaaatttgttttttccgttgcgagatgtaaaagttgaatttgtacttgcatgtttacagaatgacatatcacatgttaatacatcttctcaaatttttttaataaccatttaagtgacatataaacaataagtggatatcccctatagggatgtaaatagtttcccttttcttatttgttactcctacttatctgaacatgctacaatgggattccagtttcccttcgctgtttctctacaaccgaatgctgtataggacctgagctcctgcacagcattgggttgtatgctaaacatcataagttgtttgaagttcgacataccactctctaaaatcattttgtttcaaatattcatcaacctacttagttttattacaaaaagcatcccaatgcacacatgtttaaccaaatcaatatattttcataaagtgtgagctgttaatgtaatctttaccaaaattaaatactttgtattatcttgacaatttttttagatttcataaataaaattgatgataagaacttaaatgttatcacattcactaaatgagaaaaaaaaattcaatcaaacataaaaaaaaataaatctaattcaaacatttgaacaacattaattgactcaactaacttagtctgtggtgactttacatcaacgataacggactaatttggttaagcacgtgagcaaaaagatgatttttgcaacaaaattaagtaggggtgtatgtcggtaataaaataacctatatgatgaaattttaaactttaaatgatttatgggatgcttttttccttgcaatttctcatacttcgtgatattgaactgacgacacgcatcataaacacagtacagctgaatagctgatctgctgttcgagttgagaaattgcacgcaagtcgttaaccataacttattgcacggtcttgttcttttctatcaagatgctaaatatagtgtgtttcgtatgaaaactttttatataaaagttattttagaataaaaaaaatatcttctaaatttataataagagtaaattttagaaaactgcaactttagtgacaaatgtatcagtttgctgtaactttagcgatatgtttcagtttgctgcaacaataacacgagaaattatgataaaactgtaacttttatgttatatgttactacagttgtcacatatatgtactgtagcagcatataacgtaaaagttgcagttttgtgataatttttcatgctattgttgcagcaaactgaaatatgtcgctaatgttgcagtaaactgatagttttatcactaaacttgcagttttctaaaatttactcttataataattaaactcaattaataatatgctaatacttttttatttttgcgtgtcgtaatctaatcttcatgttcttcagattagcccgcaacgtt

SEQ ID NO: 74359 - DNA, 14337 bp, Oryza sativa
cacgtggcgtgccacgtaggcaaaaccacggtcaaaagtggctttggacctgaatgatacaataaatcaagtttaaggatctcgatgtgcgctttgcaagttcgtggacctaagtgaaatctcctgacaagtttaaggaccgttggtgcattttactcaaaattaattgatccatgacacataagccccctcatctagaggttcacaaactgcttaacattcagagacatccatcatatggagttgtttaatcagcatcaagaaccgcgtgtaacttattatgatggttatgcaccaaactttcattataatgtctatcagttccgaaggaaaaaaatatgttaatacgattttccatgttttgcacgagcagctacacgagaaaatagcacgagagttttggtagtacaaaattgggccaactcgctgccagccacactactagagataagataggtgtctaggttcgatgaaccacaagcggtaccgaccgtgaccggtccgtgttgtggatagacgtagccatcccaattgctgtggagctcccaaaagttgtggaccatccaagtcaaccacatcctgaatcaatggttcggttcacttctcaatcgacgatccaaagctctagtggagccaaggacgatggagcaccgttgtgcgaggttccagcccactactctcaccgccttacccctcttcttcctcccgctctcccttgccactctatacaagatacccctgtgggagcagcactagcccccatgaactagctacattggggcatggttgtcggtgatgctcctcagcggattgggaggagaagcagtgcagttgatgggagagtggaccggcgcggcggatggggaagaggcggcaggtgaaaggagaagcggcgcgacggatagaagagtgaagcggcacggtggataggaggcgaggcgatgcatcctgagagtaggactgagatacacttccttaccttggtcacatgcattgtaggctatgtgacctcaacaattactcaccctaatttaagctatgaaaaaagtaacgtgcaatggggcgttcgaggccttgggccaatttcttagtttcagaaggactagccacacccatagcgtatcttgcattgccgctgctcttatctactactaccagtagttgttgctatagaagaaacgcaccaacacagtgccaagtcgcagcgactattcatcattaacttacttgggatgacactgtgcacaagatgctgtgcaatacaggggttcaacattgacatatgcttgtaaacgtcgggaatggaagcatatcaagaagggttagaagacatgtcaacagctcaacatgacatagatgtttggttgtgtttagttcacgctaaaattaaaagtttggttgaaattggaacgatgtgatgaaaacgttgaaagtttgtgtgtaggaaagttttaatgtgatggaaaagttgaaaatttaaagaaaaagtttagaactaaactcggcctttatagtgacagatggtgtaatagacaactttccacgagggtaccagagcatatgaacattttctaatgtaggaatgtgggatcatataatttggttgttgatgttagaaacacacttaaaacggaacaacctagtacttgcatacgtaggccttgttcggaagacctacttaccacacggctgcagctgcacagcgcagccaaccaacggctgcaactagctaatagtagctacaacctatagatgttgaagctagcaagtgtagggagcagtagtttttgtgcagccgaacgaatgacggctgtaaaatttgggctaccgaacagacccgtaaaacgtaacgactcgttagaatataattaattaaatattagctattattttaacataaatatatcaatttatatattttaacataaatacattaacttttaagacaactttcgtataacggtttttccaaacatttatagtattttgataggctttgcatggaaaatgaattacaggttttttcaaaagtttagtattttgataagcgtgagaaattgagttagatagggtacagaaggcagcctcagttaccctttattactatctttttcatggttttacttcaatttctatcatagaaacgtacatgtcgcacttcttaaaatggttagttaccctaatgatttgccctcgtataaaaaataactcagtctgctctcaggcgagccacaattttgacactagtttgaatttccacaaaaatttaaacaagatataaacgcagcatgaaaccgtcagtaaagttataagtatgcaaaacccccaaccagccagaatatgggccagaaccagtgacagaagtgcagtggaacgcaaggagaaatccgtccaaagtgagctcacgaacttgtcaaatcaaaacaatatcgcatcaaaacaaggcggcaaacggagactgctgtgattccacgaaacatgaaacaacggagcgtttcgagaaataacgggtttaattccataatatttatgacacccagagcaatgtaggcagttctagcattttaggatagtagaatgtacctactcccagaagtagcataccacaaacccaagcgtaccaacgattatcagagtacagccataagcagtggcaccaagttcatgaatttgccaagttattcatgtataatcatgagagtaacgcgaggcccaattaataaaagttccaaaaggccaccagcctaagcagatgcaccaccacggcggcactcgttcagcatatccaggtagaattggcacttgctgatgtcacttccatagttgttgatgcactgcaatacaaaaaaaccaataattaggatttaggacaacctccatgctagtgcgtagactcttgttagttacaggtagtagcatgcatatacaaattaattcttatcaattcaatctatgttaacactatgaagaaatgaggatgctttcttctgttcacatagaattaatcagatgatggtaaccagagaatggtggggatcaacatgcaagccagaatgccagatagagttttaagagtaaaattaaaatagataaatgaagcatcatcaaattcattctcatggctgcatgggaaatgtaagcacgagtagatggaagcagccaggcaacaaaagataactaagccaaaatgggcaggaaaacatacgtcttggaaggccttggaatggatgctgcatgagtcagatggagtggcgttggccattggggtggcagaggcagcagcctcggagacaacagtctcatgctgaatggtacggggacccattacagcatcaacagccctatgtgccatggcactaccagtaccaaaagccatgcctgcatatatgtgcaaagaagtacttattagaaactgcattgttaatataatgctattcatttcaattaaaatgaagcaaaatgatgataccttgagcaatagtggaaccaattcctcccaggatagagccacctccgttctgggcaggagctggaggaggagcctgccttgctgcaatgaacaaattacagatgtcaatcaaagaacacaagacacaacttgacaagacaaaacactttaaaaccagtacagattatacaggtacaatgagaacataaggcacaacttgacaagacaaaacactttagaacagtaaagaataacacaaaatttgtgaaaccccaacatggacaaatcaatacctggctgcggagggttcctcacgggagcagcacgtggtgcagggcgagaccttgctgcaaaataaatgtcaaagcataaaaaagaatgaaatgggttgagatgtgtcacactaatctagagcatatgcatgtagaagggcataatacatacagttaacaacatcatagtcttcgtacataagaaaaaagaaaaaagaaacaccacttcatatcagaatctatctaagaagggatgaacagaaaatcaggccccttccctcaaaaaagattctatttgctatgtgccccagtctgaaccaaatgcaaatatactaagcagctggttattcatgaggcagtggtgccaagctgcatagaacattatagtacagtactaacttatacaagtggtctgcaaactaattttagtcattcagatcttttaatctttgaacactatatatatatatatatatatatatatataaaatcttaatattagtaaatctcacgaattttaaaggaaatggattgataagagagaaatgctggaatatgcaaggccgatcaatgaacaaacccagaaagaagggacttgcacttagagcagccaaagcagtcaataacatctctatatgccccataactaagccaagatagcatgaacaactacagtggctactcaaaaaggcaaacagtatttgcagcccaaagcaattgaaaaaaaaaagcttaatgcacaatgtgcaaggctgttcaacaatccctataaagaagggagttgtacttaaaacagctaaagcagtcaatagcctctctatatgccctctaactaagccaagatagcatgtataactagaatggctactcaaaaaggcaaatagcatgagctccccaaaggaaccgaattgaacaatcttaatgcatgttcaacaccactttctgatgaccaaatatgaaatagagatagttgtatggaactaaagactgcaggaacacgtagaagatgtacatctagaacatcttggtatcatttcttgttatagaagatgaggtacccaagcccaagcaaatttcaaaacttccacagctatgatggctactcattaagacagaatgaaattctacaatagtgatgaaataaacacaaacagttaactttaatgactaaggcaaaatgcaagggtgtagtttggattgtggatggaaaactgtagcaagaaatagtatgaacataagaatttgatggaatgtctagagctgcttggggagcaccgcatattatggtttacaaggcgctccctcaaaaggcccaagtgggcatcaaatgcccatctgtatgcacctcctaactaagccaggacagtatgcacaactgaagtggccactcaaagaggaacatggaatggaagccattggtttatcatagcacatgcacgatgcaattcgcaatgtatataaactaaagatatatatgttggtttatcatagcacatgcacgatgcaattcgcaatggaatataagacatatgtggagtccatctaagaaaggatcaatggaaatttcctttccctaatatattatggattcaaactttgttatatgcccctgtctgaaccgcctgcgcattttgccacaaaacaattcgcaaccggttattcaagaagcaatcttttccccgttcctgatctaaaaaaaaaaaagaaccccttcgataatcccccaaacacgggtagagtcctatgtatacaccgacgacagatctgaccaatctagcagctaaatacgccaatacaagagggagggcacttcctgatcctacatcccaccaaacgctaaacgtgagaccacgaatcgcccaatcgcgcggcgcagatcgatccgaatcgaaaatctacccaatccaaacgaaggccacagatccgaacaagaacaacaacgggcgcgttcaacgcgagaacccaatcccaaacgccgcatggctactggggctaggggggagagagaggatgggggttacctgagctgcggcgagccatggcggtcggcggcggaggagaagacgaaaccctagatggcggcgcggcgaggaggggagcgagcgaatgaagagggcagcaacgggtcgggaggttgaacggcagccacgcctagggttaggcttttatagccgcgagtccggatttttttttcttttttttttacccgttcttgctctctctctctctctctctccaacctcccaccttcttgcaagacacgccaagctgacatgtggggccagaaatctgcggtgacatgtggggccattacttgtggggtccacatgtcggcggcacgcaagctggctgggagcctttgaccgttggaggggatatgctcggaacactctggattcctccagatgaccggaagcagcacgaagccgtgaacggctacgttttcatttttcgtgctcccgtgatgataaggtgaaaaatgattcgtgattcttccgatttgtacaaaatgaattgagcaatttagtcaaaaatattaagctcaaattagcatgcatttataaatgccagatgaaatatctctaattaataatcttctagaaatctcaaactaatatccatattaaggtttggtccaaccagctagatcccacacacacaaccaaacgcatgttgcaattgcacacaccattggcattgaaaacaaaagagtatgctgcaaaacatcaggaaaatatgctattaatccatgccaaatgctcacacaaaaattgattcgacttgcagttgtaatcccctagacgagggtgtttaattgtacaactcgcagtggctccatgtataaaatctcaatcccctggcctataaccaaagtggctgaggagaccattgtacagttttgcgttggcttcatcatgtattggtaactactgctactatggtttcacttgaacatggaaatgtcgaagatgagggcagagccatccgtggacacggagacgatggagttgccatcagcagagacggcgagggactgcacgacgtcaccgtggccggcgaaggccctcacgcactccccggagaggctgtcccagattcgcaccatgccgtcgatgcaccccgacgccacgaacctggacgggcccagccatgccagggatgtcaccccctcctgtttgttgtccatcacacaggcagaacagatatactgtttgagtgcatatctaagaaatggaagtgacggtttttggcgcaggcagaatctaagaaatgggcgacggtttttggcgcttacatcgtggttgcaagtgcatcggatcgattggcgaccaaggtcccagatgatgagcttctgatccatgctccctgtagccacccaattgtaactgcagaaaatactccaggtcaatgtgagaaatgtgcggtgttcacgtgtttaccatactgctactctatggatccagtaccttggtgagatgccgacacactcaatagagccagtgtggccgtccagtgagccaacaacctgcaaaacgacagcgatgatgatggtaccaaaatgccagactgcatacattttcaaacaaaacaagaaaaaattccagcctatgtaccaacttacatgataaagacacactagcttgagtcataagaacacttacctggcctgagtttatgttcacaacacacacagaattatcctttgaaccactaacaattgtttgggaatccgaagtaactgataagcatgttaatccatccgtatgatagccatggcctggagacaaaaaagatcagaatttgatgttcacgactgattgagtatatatgaattcaatcatatggtaatttacctcgaacaacatgtctgctttgtgcagttcttgggtcccatattctcaatgatgcatcatctgatccagtacagataagtttaccttcagaagaaggtatgtgcattagcaaacaatattttcgttcaaaaactatgttgccactgtagaacttctatgtggacagctaaataaagatggtaggagaaaatttccatgctaaagcatcccaaacaacttgtttactcagggttaactaacaaaattaacataagcaaattgttattgatcaaggaaatatattggtaccatctggagtaaaatcaccacatgtcactgtgctactatggccagcaaaggtattcagaatggcattatggtcagcattccacatccacaaattacaatcttctgatcctgcaattatcaaatgccctcgtggatgccatttaagccactacaataccaaagacatacagttacaccacaggactaatcatgaagtattcatatattttgggagaggaaacaagagtttgtcagcggcaataagttcaactaacaaatgaaatggaacagaatcatctcacctcgaagccagatccagaaccctcaagggttccctgaagtgttcgtgtagctgtattccacacatttatgcgtccatcaaaacttccagaagccaaaagattcccatctgaactgaaagcaaccgtgcagacagtatctgtgtgccctgtattgcgaagctattgcataagttcaataaaataattccgagtatcaacactctgtgataataatgattatgtgatgactaattacaacaataatgtgcatgcagaaaaaaaagaaatccatgggccataggaaatctcaaaattctttgatacaaagtatcgagcacagaaagcttctgggttccattgctgatatgcatgataagagagagtaatttaacacaaaatggttaataaaaaaatgagtaaatgatttgtctgcataagatcaatatataacaattgaaatgctaatatgttgatttagagactacaggcagtataccaaaacattccattaacataaatgaatacatcaacttaataaataaaagaaatggaagtgaaagcatatacctgagagttaatattttttaaaggtggaaaggaacagagatgttcccatgaatattttagacacagcaaattaacactgtaatagtaattaataactaaatcataccggccagctccaaaacatcctctgctgatccaatcttccacaggaatcctctatcgtctttccctccagaagccacaagtgatgcatctgtaggactgcatgccacagcgaatatctcgtctgtgtagaacaagaacaggaagtatcagaatatgtataacaaaatctgcatggataagtataactggagactggagtacaaaaaaaaggagcaattgctgcctgagttatggatggtgtggctcagagaacagtgcatcaaagttacaccaatcaagtactatattgaccaatgatcagcaccaaaaaaatcataaattcattcttttcaaccaacttgcctgtatgagcacgaaatgcatattgggaatcatcctcttgcatatcacctgaaattgaaaggatagataattacaaaccaaatttcacaaatcacaagtaagacagttcagaatagttaaatgcttagcatgtaaatgagcaactgaagaacagattgcaactaaaattctagaaaagagaatgttcctctaggatctgacaggacagctgtagaaacataaatacacaaccattgcagttttctttataaatcaaattaaggctggacaaaatatgtccaactgtcatatttctcacaattgttccatcttttttaggacgcaataatattttcatttgcaagttagataaagaaagcagttagccgattgctaaatcatctaaatgcagttgcaccaaacgagattaccataatgcacctgaatgccaaatggagcataagataaacagtaaaacaggcaaaaagcataatactaaaacagaagtgcactcaaaataagttttccggatactaataaaacagaagtgcactcaagagaagtgatccagattgtagctttgcttaagagaaccaccaagacaccaacatcaacaaagcaaatgtcaaactacgccccatgtaactccaacaattatataggcagtataacagcataatagtaacacagaaatgcatccaaaataagtgttccagcttatgtagcccccaatctattgcccatgattgtaattctgcttaagagtcgaactcatgatattctacagaattccaacagtattggagaggaaaatgttatattctacaaagcatattgagccttagcatgcaacatacccatcccatcgtcatcctcatcatcatcccggtcagggagatctgaaaaacacaaccaataatagtaagcaccaagcaaagcagaaaacagatagatggatagtactactactagtagtaatacaaaccttcctcgtcgatgggtatctcgtgtatgatgtcctcctcattgatgaacacctcctctccatcagagccttcgccggcggggacctcgcccgagatgctcatcgtgacttcacctgagttgggggcgactcctcggccgcaagaaacgagaggggagaagggaggaggaggagcggcgcctgtgtcggcggaggtgtgcccgcgccgccgcgatgcttgcctgcgacgagccgggctggggcagactagggttctggacttctcggcttctcccgcctagtgtcactcgtgtagtaggatggcaatggggcgggtcggggccgggttggtctggaacggccccgcccccggcccaggagtggagggcgggtcgaaatcgatccccggccccggcccctccggggccccgctgcacccgcaggtgaggacgcttggaggaggcggcgcggcgacgggcagaggcggagcggagacggcggcgacgagcggaggcggagcggagacggtgcggcgacgggtcgaggcggagcgaagatggcggcggcgcggcgacgagcggaggcggcgatgggccttgggctttgatccgtgggctgtgggtaggttttcccccataggcccaatcccacgagaagatggaacatcaaaaggtaaaaaaaaaagccgtggcaaacccgtaattattcgcaggaagcatcacttcgccgcaagacggcggcgaccaccgctcctcggctggagggagccctcgtcgccggcgaagcccgcgcggccacctcccctgccggagttggccatggtgagctccacctctctctctgcgtgtggctgcgcgcctcgctccatgttccggtcggcttattccttactcgcttcctctctctcgcgcgcgcgtctccgcggcgctcgcagttctccatcgcggccatcaacgagagcgacaccggcgggcagtgggagccgctcgcgcctaccaaggaagctcaggcaagtctcctccccccttgtcgccccgagcattctctcttcctgcgtatctatctaatgcttcgcctccgtagcttgtgattttgggccccgttagggttttcggttcttcgagcgcaatgtgatggattgattggttttaagtgggtaaacgcagcttaatgttgtggcaagcagactctaggagatgtagaattcgatcaccctgttctttgatgtgatgtgatgtaaggtaccatgtgttctttagcttgtgttttcgacaatttgggagcttgaagtggggtttttactatctatggtttcttccgattctgcgacttgcgaattcaaaataactgttttttgttcctttgatttgatgtttgcttatcccctaataaaaggataatgtaagatttcggttttcattatcggttgtaggtgtaggagggcactcaggttagacctttcaggttaaggggcagtattcttgatgttgagctatacatgctcaattgctcatgatgtagacgaatgcgtgatagcatagtactacattttttttccaaaaaataaaattgttaggaggttaaggtcgttttgaaagctagctgttggtaaagattttggtgtcatctttagttatgctaggaaccgatttaattgaaatacggaataaatatcttctaaactgctttacgagaatcggaagattaacacagacaattattataagtaaataactttgggatggaaatttttaggattactagctaattaccaatcctccttgacatattttgaattaacataagttataaactttatgaaaagttgtatatgtttctcagaaggaaaacacgtatatctatatcatgtgcctagattatctattatctagaaaacatctcaccaactcaatccataggagccttttgatttagatgttctaatgctccttctctattcggaaggagagatatgcccccccccccaacccaaaaaagaaaaaaaaaaccctgaactaaacttggtttggtgcaagtctttttcatttttaattaaatggttaagaaggatatctcagggaaattccaagttattattgttaatagccctttattgaacatgctgccatctgattatatatgtggaactttgtttagttagaggcatgatcataaaaaggtgctccaacggaacaaaagggaatcttccaggggcagatttctactttattttactcttttttaatccttgaataacattggttctattatgtaaacattaatttaggatgattcattgaccactctgattgtcttgatgttgctctgctggtcctggattacaatggaatgcatgtattaatttatagtttgataggtaatatacttgttcatctgcccttttattgatgtgttgatgtgttgggatttgggattggggatggtgttctctgtgctggatttttatggacggatacatgattggtaatttaatgcattatgtatacatatctactccctccttccacaaaagttagacctgttacttttttcaccaagaccaagagaaattaactcatttgcatgtaacaaagatcaaggagtatatgcacgcatgcaaccaatgaacattaagatggctcatcgggttctgattaaacatcaaatttacctctccgtttaagtcttggatgcatagagactataaataggaacaacttatttggattttggaaaaactaaaatatgaaataggtcgaactcttgtggatggagagagttctggctggtacacatttttatttaattttagatttgaagataattatttcggtatctttaaaattagaatatgtgatctgtattgtttcgagaattgttgcgatgcacagtcagtcagtcactgtgctagtacttcctccatatcaatataaggacttttagagttgggcacagttattaaggagaaatgtaaaataaaatggatggttgtgattggttcagatgaggaagtaggtggagaaattaaatgggagatggttgtgattggttgagaggtggaaaggtagctatattttgggacaaattttgaatgctaaatgtgctatgttttgggacggagggagtatatcataatataccagttctgatgtagttttacctgcaccaactagatgtgcgtggctatcatatcatgtctgtccaaggaattgattctgccagtcttgtgcaataggtaggtcactgtaattgatctgagaacacgtttagtagttaattaacagtatttaactgaaggattcttttgtaaatctcttcctgtgctaaggtcattttttttagttttacaacttacaagctctcaattttgttgccgcaatattactgtgttattgaaattacttttcaaaatgcttcaggaatcagcactctctcagaagtaccacgaggggctcctcaagttgcaagaaaaaaattatgtaaaagctcgtgaacttctggaggatgtcttaaaggacccactaatatcaaaaattcaggcaatctctataagaacatttcagatatcagtttgtttagacctgtgctctctataacaccaagttgtttattttaaacaggctgataacattgtcagtgatcagcatttgctgcagctaaggttcttttctccatacctcatttgtaatgttcatgatgtaattccatttttatttgttggttaaaatcattgacatagcgcgaagaattataccaagtggaataaacactcataaaataatgaaatttcttagaactacaacagctcttaatttaagaaagatgcatttgtgtcatggggtaaccacacccccatcatctaattcaccatgttgcaatgattcataaaattccaaaagagaaacaaactcatgtgtagtacacataaagttatacaagcctgcaaaaattcattccagatatcgaggaacaaaaaagagaagcaatcaattggaactattcatcatgtgctagcattacaacttctcttttttggatctcagctctcttttttggatctcaacttgtaggatgaatctgtcattaaatttgtgcagatttataaacattatgtttatattaatttgtgaagcataggaatgtgttggattcaacatatatttgccgtggagatggtcgttccttaggacaccatattttttagaaccatattttttggtgggacaattctctctcatataaggaagcataatttgag

SEQ ID NO: 74360 - DNA, 57704 bp, Oryza sativa
ggtttggatcttgttcatggttcgtctaaacttaagaaagatcttgatttggtttgtacaccgtgtcgtcatgctaagatggttgcttcttcacatgctcctattatttcagggggaggatggtcgtatttttgaagacgagagcgacgaaaacgacgacgacgaggtcggctcggccggttagaccgggcgccaagccggtcagaccgccagcacacctccggtcagactggcataggaggtgcggtcagactggccaggatcgtcggctgaaggttctgttgatgctattcgagatggtcctccggaaactacaacttcgaccagtactgatacataacgtggatcaacttcagaagtcgtggctcctttgcacattcaacgatgacatccgccagaacaaattattggtaatataggtgagcggactacaaggtctaaggtaacgattcatgatgtttgtgcaaattctgcatttgttgcttcttttgaaaccaaagatgtgtcacgtgcattaactgatgaatcatggattaacgccatgcatgaagaacttgaaaattttgagagaaacaaagtttggactttagttgaaccaccttctggacataatattattggaaccaagtgggttttcaaaaataaacaaaatgaggatggtttgattgtgagaaataaagctagacttgttgctcaaggttttactcaaattgagggtttggattttgatgaaacttttgctcctgttgctagaattgaagcaattagacttttgttagcttttgctgcttcaaaaggttttaaattgtatcaaatggatgtgaaaagtgcttttctaaatggttttatacaagaggaagtttatgtcaaataaccatcaggttttgaaaatcctgatttttcccaaccatgtttttaaattgtctaaagctttgtatggtttgaaataagctcctagggcatggtatgataggcttaagaactttttgcttgcgaaaggttttacaatgcgaaaggttgacaaaactctttttgttcttaagcatggttataatcaacttttcgttcagatttatgtggatgatatcatttttgtttgttcgactcacgccttggttgtagattttgctgagactatgcgcagggaatttgagatgagcatgatgggtgagttatcgtactttttgggattgcaaattaagcaaacacctcaaggtgcttttgtgcatcaaacgaagtatacgaaggatcttttgagacggttcaaggtagagaattgcaagccaatttcaacaccaattggttctacagctgtgttggatcctgatgaagatggtgaagctgttgatcaaaaggaatatagaagtatgattggatcgttattgtatctaactgcttctaggccagacatacagtttgctctgtgtttgtgtgcacgttttcaagcttctcctcgtgcttcacgtcgtcaagcggtcaagcaaataatgaggtatttgaatcatacacttgagtttggaatttggtattctacttcatcttctatatgcttaagtggatattccgatgctgatttcggtggttgtagaattgatagaaaaagtactagtggaacatgtcattttcttggtacgtcattgattgcatggtcttctaggaaacaatctagtgttgctcaatcaactgctgaatctgaatatgttgctgctgctagttgttgttcacagattctttgacttttatctactttgaaagattatggtcttacttacctctcttttatgataatactagtgctattaacattgctaagaatcctgttcaacactcacacacaaagcacattgatatttgttttcactttttgagggatcatgttgaaaagggagatgttgaattgtagtttttggacaccaagttgcaaattactgatattttcactaaacctttggattctaatcgctttgcttttcttcatggtgaattgggcataattcatccttttggcatggtttgagggggagtttgtacctcatggttttatcaagcaataatatgacaatgagaaaattgagaaaagagagctttgtttatgcatatggtattttcttgtgcatgctagcaatactttgaaggtttatttgtctctaacatagcttgtatgcattctagtcttttcatgagatttagattttgcttttaagggagatgatgcatgacacttaaattctataattgaattaagaaaatatgcaacgttgatgctagcatatggtttgatctataaatgctctatatatatgctttgttgaattgttattcctcaaatagctttaattgctcattgtgaaaaggagaataaaaaatatgaaaaaaatgaataccgaatccttggaaatagtcttgacgacaaggacgtattcgatgtgagcaaaataatgggtgccgaatccctggaaacaatcttgacgacagggacgtacccggaataaaagagaaaaatatgagcaaaaaggctcaagaaaaagaaaagttataaaaagttctcttggttattttgtgctaaaggttatttgagaaagagtgataaatgcaataggtatatgtctttagtgtttattattcaacctatgtgcttgttaagatgttgcattacaaatcgtatgaaatcatgaattttgattgttgattcaagcttaattgtaaaatctttggttcatggttatactttaatgcatgcttgttctgttatagatgggtttatcttctttttattgcaacacatgacttgatatgctatatgtatgctaagctcttgaacattaatgaacataattcctatgcttgatgaaatcattgtcaaaagggggagaagtaatgtgaaatttatttttggaattttggagaagcaaggtgtattttcggagttgttgagaagagcatgtttttggttcatgagggaatttctttcttttaataagggggataagttttctttttgatttttgagcacgatgtgtacatttgtacgaagtgtgctttttaccacttttgtttttatttttccaaacaccaaaacatttttgatgagtttgccaatgtgttcatcaagggggagattgtaaaatcaaaggtgtttttgattattattctgtgatgaacaattggacattggagattattggttttgttatttggaatttattcacgaagtggttttggagatgattggattcacaggtgatcgcaggattctatcattttatgtgaccggtcagaccggcggtatgcgcgtggtcagaccggccagcccgcggtctgaccggccgacgctgtgtcggtttcgggttgtttgtttggatatccgtgattatttcatgattatgacttctagatggatactatacgtatataatactgttgtttgctactaatgagtcaagttggagatagcttggtctcggaatatggtttatttgtttatttcatatgtaggtgactcgatgcctcgggagagtatttgcggtgatggaccgggagtcggcttggggataagacaacgtccgtggtggtcagagatcatgcgggatatttaggctagagttgatgcacgtggttgatggagatttcatatggcatacgatgaaggtattgtgtgcgtatgggatgcagagtcgaatttggaaggagtccaaatttggtatgattggttatgtaaagtttgtttcttgtactagatggtttcctaaggtgtttaggactcttagtatgagtttggttcgtggctttaggctgcctacctcatgtataaatagagggggagcatgaggcttcccggtatcgcttttgagagcaattgagttgagttttgagttagggtttcgagtttagtcgaaatttttgtaaggagtgctgttggtgcactttgtaaacacagagagaatcaataaagtcgtcatccacttttagagttttttgatttgtgtttcaccgggtttcggcggtctaactggcgacacaccgacggtcagaccggcggcatcacggcggtcaaaccggcgggtaacctgcggtcagaccagcggcgacaacaggcgcggcagggattccagggcggtccaaccggaagatcaacaccggtcagaccggcggctacgcttcggtcagaccggaagatcaatctcggtcagactgacttccatcgatttcgagggtaacttttatttccgctaaaagttttcggttttttggtataccaaccatttaccctctctcctctggttggcttagttcttatgtttcaatcctacatatatagtagagatgatgaggaagtgttaatgaggaaatggtatagcagcgatgaataaaggaggaggtggctggtccgcaagtgtggtaaggatagatctacctggttgaaagtgcaataaaatgaaataaaactcgtccaattaaactaaatgatggaaagagataagatatacgctgatatatatttaaagaaggaactaagatataatgcaattatattaatgtgcaaacttaggtaacaaattctgacccaaagtacaatataatgtgcagacttaggtaacaaattctgacccaaagtacaataatgatttttccttttttcttttcgccctctcttaattgtcaggcttgatctccaggccagctagctagctgatctggttctgataagagacactgatgtttgatcaccccttgaaagcgacaacccacgacagggagacaacaatgagaatgttcccttttccacaattaattaggattgcaaaatatgcagtgatcgatcacttgcaagttgcggttgaaggctggcattttgtacgctcaagagaatatataatgcttggtgtttgtcaaattcctttctgctattgtcagtgtattgttaggtgtgaggtcatataattaaaggcgtagtacgttgataaatttgtcatcgacacattcgtaacggaaaataaccttggaacattacaacgcctatatttggaggaaaaagagccacgttccgtgtgctctgcgcacgtgtacttagggtttagaaacttccacgttaatcgttctttatttatttttttattgaatcggcgaaccgccaatttcattaaatatagaaggagaaaactgtacagtgtaaagggaaagaaaaaaaatcaggacctttggccctagtcaactaaggaacaagccaatttctcagatgatgcgcgtctgctaaggcccatatcttggcctcgtccttgatttttgtcagaagaccactcgatgggagcacgttaatcgttctcgatcgtgatgtaggctaataactgcatgtaaatacaattgtaagaagtgcatctacgggttttttaccatttttttctaacacattactaaatctactagcgctatttgtttatagaaaacaaaagtatgaattattaacaatataactctatttataggggagttcactttgattcctaaatcaacttgatcaaatattgatattggcaaattttagcattaccaatatttagtaattaattaaggttgagatgtgtaagttgtatttggtttgccacatttgtcaagattttgtgagaagacgatcctagaattatcaaactttggtagcttgccaaattttgataaagctaaaacctggtaggttaataaagtgatcatcaccttcaaatcttgctaagttaaaaaattaaaatatattatatgtgttggggaagggctccgaccctcgcgcccctttctaggtaatcagagggagggcctccgttgggaaggtcatccgtcggaggttgagttgtccttcaggcaacaagcacgtcgaccctaaggaggcgatggctcaggaggaatagagcggtttcccccttagcgtgaggaggagctcgtggctccgataatctggagtcagagccgaatacggagcatgctgagaaggggagccactaagtataaatatataaatgtaaccctcagaaggggagaggaacagaagaattcacagaaacacttgcttaacatccgtcatttcttttccaacaatatgttagcaatttttttttaccaacgaggtcataaatatccctctctatgactctatctacaactaggaggcatgtaggcaaacctaagattccattatgcatttacacaaagttaatttagttccacatggcgtgttctccgactgttgcctagcttttgcaagatcgatcgagggggggtgggggggggggtttgttaagttaattcgctcgatggctctgttgagcagcagggctacctcaatgatttggattagccatgtccaaagattggagggcaaagataaggcgatggcatctgggggctcccgggaaagagttggcggtacaaactctagtttgtccctttcacccttgtctcatggctctttgctgctacgtgacaagccccttgatccaaatccttctccaattgggtgtgacttgtgctgttctcccccccttgacgctttttgtttgtacacctttggtctctcgtgtgcaatgatgcgcaacgctgtgccacgacagcgaccactgaattctgctatccctagcagtgttcataagtgtagtagtgtagtaccacactactgagagcttaattatccaggggagacgtacacgtacctagctataggctgtgccctgccttgcttggtcatatgtgcatggactcgaacgtgtgtaacgaagcaaaagaaatgtaatccctccgtccaaaaaaaactcaaccgagaattgggatgtgacataggttgtgtttagtttcacaccaaaattaaaagtttgactaaaattaaaagtttaaagaaaaacgttggaagtttatgtgtgtaggaaagtttggatgtgatggaaaagttgaaagtttgaaaaaaaaagttgggaactaaacaagcacataatctagtataacttatgtccatatttgttgtactagattatctcatatttcagtcttaggttgagtttttttttacggagagagtatatgctcctaccaaaatattaatgaacccactagcttatcctgttaatttcttcttccaaaactgacgacacgcactatggcacagtactctgcaatctgcatgcagattgtacactagtaccggaataatttttctggacgggactaattttagattgcagacgggaccgtaaccggtcgcgtctgtaaaaaatcgtgctctatttttacgtgcagctctttaaaatgactgtacggtaaaattaatttttgcagacggaccacttaacatgtccgcacgtgaaaataagcttattttcgcgtgcggacctgttaaataacccgcacacggaaatagcccacctacatttttaatcccgcagttgccgcccatcccactcactcccatatcactctcaactcctcccactcctcccatctccctctcctcctcaccctcctcccatctcctgatcccggagacgacaatggaggcgacggcaacggctaggttggcggcggtggagcggatccatcgctggccaccgcagggaggccggattcgtcgccggcgatcgcgaggaggccggacccgtcgccaaccaccatggggaggcctgattcgtcgccggccatcgcggggaggctggattcatcgccagcaaccgcggggatgacagcatcgggcctcgggcaaggcggtgacaacaacggtggtggcagcgacgatgacagtggtgacggcggcggcggcagccgctggattagggttccgcttttgatttgtttttttaattttttttatttttccatgcgggcggcttaagtgcctgcacccgtacgaaaaaaaatcagattttcgcagacatctcgttccagacgggtggaagatccgcacgcgaaaaccgattctgactgcacggaaaaattgttattgtaccagtggtagctaatgtgttgataactaaatgcactatataatcatacttgcatatatgcagattatataaagcgtacatgtgcatatatagacatatataatttcgctggcttggctctagaggatgctatctatgctatgcatcatcgatcgaggccaagcaaggccattccctgtccacaaaaaaggcacaggacgacgacgacggcgacgacggcaagtacgtactgtcgcgatcgttctctgtcccctttcaatcccattgtacacatgtcgagctagcgtcgaacagtgaccaaagtgctgggaatcaacggctttaatcagtaggacatgaacaggcagctgcactgttcattcctctcgcccgcgagcgatcgtgctctgcattgggccagctctagctagccatgcatgcacggccggctgcagcacagtggcgactcgctgggtggccggccaatcgaccatgcacggctaattaagctaattgaagctagccatagctacatgtgtactggctagctacaaccctttgctttcgccacagggctctcggtcgatcgatcgatcgatcgagagagcagccgccgcgcgcggctggtcgcatccccttgtcgccgcgcacccggagggtcctttgccacggcgatctcgcggtgccttgcgtttgtacccgacctgccaccgttttattccctccgctcctcctccaattccacctgctgatagcttagctgctagatcgatcgatcagatgagatcgatgagatgagatcggtgcgtgcatgcacggcgtacacagtggtgatcgatctcgatcgatcggcctcttgatgatcaatcacatgccgtgctttaatttgcatggactgtgattaattgcatcgtccaagaagtgactggtgcgtgttcgtgtttttgtgtgtacgtacgcccgacagtggcacagcatgagcattgcgactgtaccccgtgctacttgctagctgccgatcggtgacggacgcagctagctatctgtgattaatcgggtgcatggatgcatgcattgtatatatgcatgtgatgcaacgcaactatgcaactaggcatgcgctagctacctagttgactagttgtacgtttcgggcatcgatcggatggtgatcgaggggaatatatattagcatcgtttattagtgatcaggttctttggagatatcgagatcgaagtggctgtagcctacatgtaattgtgtatgcaactagctgcagatagacagactgatagtttctattacacaacgcaatcggataaacctatatcaggggtgggaagaaaagaaaaaacaaaagctacaactaggtaaaagaaagagaaactattacggataaaagctacttcaatcaacgagatggtgaagatggagccacactacactaaaaaaaaccccaaaaacaactacgccagcgaaagatcacacatgactctccgagagaatagactccaaaaccatagagaccgagaagagcgccgagtcaagattaattattgttcgaattacatatttacatgtatggattaattaagagcttgaagggaccctcgatctgtcgatggatggatcgatggatcgtcggtcgacgggacgatgagccgacctggctgaggacgactagagctcaggcaaggagaatatatatatcagaacaagagctagctagtgggtgtgtgtactacgtggtttttggctcgtccacgtgcgtaggcacacgcaccggccggcatttcaacaccaagcgtttggctttaactgacttggcgatctctcgaaactttcaggcagcagtgacaagtgacaatgaacacatcaaagctatctgcaggatcgataatataatattaggtaagatcgttttcttctaacaatattgaatcgtagaatcggacgtaggatcatgatcctgtcatattttcataaagtgcatagttttatataaatgttataatacattgtaaaaaaattaatacaataatatcagttttgttaaattgtgtaaacttgagtagagttattcattttttttaaaaaaaatccaccttagttttgaacaatagcataattaatcatattatcgggatcccaggtaagatcgtccaccgatcttatggaatcaattaatactcttatgtgggaacatgatactataacatatttatggtaggatcaagatcatcgtgccgtttgataggaccatggtatcgtaactcgtaagatattactatgactaggtgttttgaacatttatgctgggcaacagaacttccgagatttcagatgttttggagttcgtttagcgatttttgtttttaaattctgcccggttatggctaaatttaaatagattttaaccaaattcacaaaaaataaaaaatcgccataatttcatactatgtggtagagggagggggggaggggacattgcaaacattgtcaagggcctatttagaaaaacttttgacaacggtaacttctcctataattaaaggctttattaaattcagtttttattcagattttatgaacatatggttacagaatctaaaaaataaactagaattcttcttaacttctctagattcttagaaagtggttagggcaagtactataagcctctacatattgcgcccctaaatttaccacataagattagataatgaggtggaagagagaagttaggagagagagaatgagccatccctcatgcaaggggcaacatctacacaatctccaagaaaagtgaaagatgatgtgagagtagactaatattggggtttgtgtattagatgtgatattttgtatgtgttacctcttaattaatgagaagatgacatggttcaaattagatgtgacatccacctctactataaaacttgcccttaccaaccatagccagctacttctcaaattttttaagctctccaaaaccgtaccagattataagctctccaaaaccgtaccatattataacttggatcgatcaggatcataacaacttgaacactactgtacagcatgtccttgtcgttgcattggccaccgtactccatccgtatatatctgcgtacgtcgtcggcagattagttcaatcgaaggataccaaaactagttctgttgcatgcctacctttttcaagtgcaactagctaactagcaaaatcgtaggagtaccctaaacctcgttaccaagccggaaatcattaggttggtatatcagttcttcagagattagcctgcacaatttaaccttaattaccacaattgatatatatttcgttgcactaatgtattgttaattctctgaactctttcagttaggcatatatcgattcctgctagctaagcataatgattaaactacaacatcagagttttcccccttaattagaaccaacccggccggtacactagatctagcttagttagttagaagctgctagcccaatcattcataatttcatactgatcagattaagttgaagttattaattattaagcagcaataagaggtctgaaagccacccccgacagatggagacatgggcgcgctgaaaaactaagctcaagtgcttgtcatgccctgtgttgcatgtaagttatgatgagttgtgactgttgggttaacatgagtttacaccaaggccagctaattaatgggaatagctgttcttgatgcctatcaacacagagccacttgggtgcttcttccctgtgcctaacatgctgccttttgtcaatttatcacccggctattcatcagttacagtatacgctgcagtcttctctcccttttattctacagaagatttaacacattttatccctatctcactgtcatcctaaaattaagctaagctcgtctactacatttgaacacatatatgtagttgagattacgaaatgtgcaagtacaattagagagagacacaatgatggttagctctttagctgggccaagtatcctgcttgcctcgtagtcatcattgatggttaagcaagaatgggtgggtccaggggggaggccagtctacgtgtgcaaggaagcacagggtgggcccgccttgccgtctcagatctcaaccatcggattcgtgggccaccttgctaagttcaaacgggccgagaggacagacttggggaccaggcccaatagtgacacccccttctcttggcaaagctcccccttcatcttcttcagctctccagtgttttttattttattttctgttgatattccacttgaaaggtttcatcgattgatatgctcagcccttttttaaaaaaagtaaaatgtaaggtttcctaattcctgtagaaattaaaccaattagttaccacgccattgcatagactctatttattatatatattaaaaattaatcatatatgctactatactttttttagaaagagtaaatttcacaaaactacagttattttgcacaatctatcacaaaactacatatttaagagcttgttttacaaaactacagatttagtgtctacttttatcacaaaactacaggtactttgtataatttatcacaaaactacatatttaagaacttgtttcacaaaactatagatttagtgtattcgtttatcccagaactacacatttagtgtcttcttttatcacaaaactacaggtttagtgtctccattattacaaaactacaagttttaacaatgctaaaacatgtagttttgtgataatgaagacactaaacttgtagttttatgataaatgaagatattaaatctgtaattttgtgaaacaagtttctaaatctgtagttgtgtgatgtattgtgcaaagtacctgtagttttgtgataaacatagacactaaatctgtagttttgtaaaataaattcttaaatatgtagttttgtgatagaatgtgcaaagtatatgtagttttatgaaatttactcttttagaaacagagtacaaacgtaggcgtccacaacgtgcacatactcatccctatgaacacgcacacacaccctaccaatatgagcaccctcaaggactggatcgacatgtcttgagattgacgaagttattacatatgtctcgctgttgacaaatatgccgtttaccgctgaaagaatatttagccgtaaatacgagcactcctgtcaatcataggacttgaacccaggtgaactggttccaccacaaaaaacttaacaagttgagttacgcttactttgcaatcatgtaataatatattggcatagttttcaattgtacccttagattaacagaaaagttatgccgattacaacttgttagaaattgctatttttttctagaaaatgtaattaataatttatattttagaattaaattaataataattataataataaattaagttgcaagatcgctacaatttcataattattaattgtgaatttaagaaatatttattttactaaaacaaacgagtcaatggtattttcaatgacatattttatttaacacatattttaatatgttccacgacaatgataatacgatgattgattcttaaattttattaacgttgcagctcatttgtaatgacaaattagcatactgatacacagatagaccgacatacatattctatataaaaacctcgttcaacagtcatatacagtgataatctttctatttttatgaataaccggccaacatatattgcttctccctgaatatatgcatacatactaattaattaactactgcactaatgggcattacccccacctcagagtgcccaattgcccatggatatgcaaaatactgaaaaggacaaaagggtattcttggaacttgccaaatccacacaagtgcaccatgcaggcatgtgcccaaacacatcatgctacagtcctcttctgcagagacaaattacctaagaacagtgacacagtatagctgaaaaaaagggccctttgaccatgacttcacaccttagagaaaaatattactatggggtataggatcgaatcacaagaattaagccaaccagaggggggtgaatggttggtatatccaaaaaccgaaaacttttagcggaaataaaagttaccctcgaaatcgacgcaagtcggtctaaccgagattaatctaccggtctgaccgagtggatgccgccggtctaaccggtgttgaatctccggtctaaccgccgaagttgcctgccgcgcctgtcgccgccgccggtctgaccgcccgtatgccgccggtctgaccgccggtagatcgccggttagaccgccgaaacccggtaaacacaaatcgaagaactcttaaagtggatgacgactttattgattctctctgtgtttacaaagtgcaccaacagcactccttacgaaaatttcgactaaactcgaaatcctaactcaaaactcaactcaattgctctctaaagcgataccgggaagcctcacgctccccctctatttatacccgaggtaggcagcctaaagccacgaaccaaactcatactagaagtcctaaacactttaggaaaccctctagtacaagaaagaaactttacataaccaatcgtaccaaatttggactccttccaaatttgactccgcatcccatacgcacacaatacctccatcgtatgccatatgaaatctccatcaacaacgtgcatcaactctagcctaagtatcccgcatgatctctgaccaccacggacgtcgtcttattcccaagccgactcccggtccatcaccgcaaatactgtcccgaggcatcgagtcacatacacatgaaataaacaaagaaaccatattccgataccaagctatctccaacttaactcattagtagcaaacaacagtattacatacgtatagtatccatctagaagtcataatcatgaaataatcacggatatccaaacaaacaacccgaaaccgaaaccgacacagtgtcggccggtcaaaccgcgggctggccggttcgaccgctcgatcaccgccggtctgaccggcatacacagcccggtctgaccggtcacataaaatgacgaatcctgcgatcacatgtgaaatccaatcatctccaaaaccacttcgtgaatagattccaaataacaaaaccaataatctacgatgcccaattgttcatcacagaataataatcaaaaacacctttgattttacaaggggggccatcagcaaattttatttccccatcacatcgaacgtttgaacacatttacggagtattaaatattaaaaaaaactaattacataatttacgtgtaaattacgagacgaatcttttaagtctaattatgctatgatcggacaatgtgggactacagtaaacatttgttaatgacggattaattacgtttaataaatttgtctcgcaacttacatacatattatgtaatttgttttgttattagtctacgtttaatacttcaaatgtgtgtccgtatatctgatgcgacccggcaaattttttgccggtgaaactaaacacagcctaacagccaacaggagggtagtagtaacagctactgtagcacgaaatggagcaaagattgtgagtgaaaaaagatccgaaaggcagaatgatgcggcgcaggaaacgggcgccgattctgatgaacacacagcatcacagctcgcccgtcttttttctactgcaccaggcgagcgagtataatcatcacgagcgtggttacccccccccccccccccccctctccctgctgctgcagcatccctgcgtgcgcttagctttccttttcccttctttttttaccgcgttgcagaaaagctcaattagtcggcaattccttggacacacgcatctctctctctctctcttccttcctttctctctcactctttcctgcgtattgccaggaattgcagatcatgccgcagcgagcagccaggcacagccttacctggtactactactcctacgctagctctcgctctcggttgctgcatgcagctgcagctgcagcggcagcataggactgattgcattccatgcttcggccaggtgcctttttctttcttcttttcgccatggtcttgcaaactttgcgttgcgtcgcacagtggccgtttcttcgctcgagaaatggtagcttgggattgggaatgtgtttttttaccgacactgatagtgatcgagctgggtgagtgtggactgtggagtgtgaggggggggggggggagcaggagcagggtgtcgttgatgcttctctcccagcgaagaattgcgcgccgcgccggattgataggtcatttcagggggagctgcatgattgcatcggccagagagaaaggcgagctacgcgctcaggtgcggctgcctgtgcggggttggacaccggactggagagagacgacggccctggaatacacagagaaagagagaggggaaagaaagaaagttactgcgacagctatgcatgcatggcctaattgtaaatcggtggctacggctactagcactgcatgggaatgggatgatgcatggaggagtgatcaaaagaggttccaaatttctcttttggggagaggaatttgggggtgatttgatttggtctaaatgattttgtctagcgatggtagtgctccggaattcgtaaccagggaattcctacggctagctgctgctgcggctgctgtttacaaaaccgtgtagttatcgcgatgatcacgtgcgataaccttttcagtttttgaaaccacgttataccttagggtaaccacacggttttcacgatgctaagaactttgcatttaggcccttccactacaatatactctcaaattgactcgcgacactcttaacaaaacatacctatgaccccgcaaaaaaaaacatacctatgaaagaggaggtgaagagacggagatagaaggtagggtgaggatgatcccacgaacccgatgcgacgtgattgtcgtcgtgaaggcagatggtggacctagaatgcgtgaggatcatggtgacaataacgctacaccggatttgcatgatcaccttattctcccgatcgtgtcatctatttcaattcgtctccctagaccttcaattgccgatgatcacaactatcctaatcgttgtttcttcccctcgtctcccatgggcatggtgagagtcggtttggaagtggtaggagtcaattttagggcatactctaattgaggatgtaaatgtaaaattctcacaactatggtctatggatggctacgtcagtgcccgagttgcatcatatgcactttggacctcggcgatacaccaaaccaatataagggatacaaatacatattttacaggtttataaaccaacatttagcctatttcaagttttaagtacaggctctgtattctactctttaaaaaatgaggacatgtagctagcatgctatatctaatctatgtcctatgctaataaactgacaaaggttatgttatacaagttacaaacgaccgttgttctctctttcagagaaggaaactcactttgtgtaatgcccttgtgaaatccacaattagcaattaaaatggtctccctactttttacaaaggtacccgatatatcggtgatcaccagtgtctttagctgaaaagaaactctgaaatgcaagatgtgtttagctgatgacatgacaaacacactgttgctgaactgaaatttatgtttgaaagcgagctccccagtatacttgcacagtgaaaatttatctttctgaaggatggcggcatggactctgaagcctgaaagtctgaaaaagcacgagaataattatagatcgacacacatggccgtaggcactagttcatgttggtaacctggttgggattcgagagcacgaggacatcctattgatctactactactacgcatatacatgtacacacattggcattggcattggcattggcaatatatattggcatgcacgaacttgcaaatgctatagcatgatgattgcgataactgagagcaacccagagataaaagcagctctctacctttgcaaactttggcgagcatgttgcatagcatggagacctaaatgatgaaacaggcgaacgaggagggagaaaggtactgctcgaaacgatatgttcttgataacctcttattaataacaccttctttttgctatataaaatcaataaacgtacgacgacacaaagtcgcatgttaatatacggtagtctacttgttgatgatgatgcttagtgctaaccagccagagagagagaacaagatggcactcatcatcgaattaacacttcagaatatagtacagtttcttcagtcctgtttgcatgcatgcgtatgtatgaggaaaggaatgccagacacctatagtttatgacattttgtcattttccccttaaatttatatatgcaatgaatacactattttcatacaggagatcaaaacaaatactaccaaacaatctggccatgcgttctattaattttatatgacgttttctagcattgagatcaataacaaagatagaagaattcagtagggccagtcctctgttcgtcatgaaaatcagctgctactagtctactatactagcagctattgtgcaaagtacagtactagtatttgttagtttcaatcaaagtccaaaagtaattgccaaaattctgttcaaaagaagatggattgttcgccggcccatcgtttagtttcctccaaaaaaagatgccatctttttctcctcctcctcatcgaatctatgcgtactactgcatgcagcttcgccaaaaggacaacttctgaatattgtaaagatcgagtagcagtagccggatgatgcatggtagtattaaaaaagacatgtgtgtgcaacttacttctaaaattttgttaatgagctacacatgcggccatcttagcagaaagtcgaaagggaggaaaagccaagagacaaataaactttagttgtttgaggagagaaagatgtcaatgccatctcattgcgaggctagtttatttagcgagagagagaaaagggagatcctagataggatcaaggcaagggccgggggcacttgtgggagaaaaatgatcgcctgcatgtgtgaagaatcttctcccccatcaccacccccattgctgatcactaacagttggggcgttttttcagcaaagcaatcacttcggtgacaaggatgagctgttcgtctgcatagtttatcattggcaaaaacactagctttaatttcatctccggtcagctatctaccacggcatcaacaactatatatatatatatatatatatatatatatatatatatatatatatatatatatttgcattcgtatatacgtggcgttttggagtagattttttttagtgtgtatatatatgtatttctagataaataaagaagaatgcgtgaactgaatttccatctagctgccaaactcctgtcaggacaacagaaaagaaggcaaagaggggggtcgagaggaaattaaaacgtacgcagagactaatcaaagagggtcatcagcttgctaatcaagttatgatgaaggtaatggacagtgctccattaattgcgttggcgagatcgatttggcagagactagccccctcatgatcccatcttaataaacccccaaaacaaacaaacaaagccttgataaaagctgcccatccaatgagtatatgagacacattcccccttcaaaaaaagggggccaacacccacacaccgatgcaggcacaaaagcaaagagatattgacaaagccctttttttcatctcaccttgcacacacacacacacacacacacacacaacccctctctctccctggcttaagctatatatgatcccctcatgccccagccctttctacaacacaaacacatacacacacaatgcaccttcacctttccaccccataaagcctcccttggcacccctatcccactaaggagcaaaaagagaaccaaaccaaggcagctgctgcagaggcagtagtagtagtagtagaagtagctgctgtgatctagcctcttgtggtggtagctctagctctagaagtggtattgtggtgataagcttaagcttaagcttattagtgatcctctcccttaaaaagaagaaaagctccttgcagttatggcactggtcaagagccaccaccaaatgttggcctcttcttccacctcgtcctcctcaccctcctcccagcagcagcagcctccaccgccggcgtcgaactcctccagcctcgccgccgccgccgccgaccagccctcccccgccaagcgcaagaggcgccctcccggcacgccaggtacgtatatacgtatgtgttggagacattgataccatcatgcatgcatggtgttcgatcatggagcccgtgtgtacgtagacccagatgcggaggtggtggcgctgtcgccgaggacgctgctggagtcggacaggtacgtgtgcgagatctgcgggcaggggttccagcgggagcagaacctgcagatgcaccggcgccggcacaaggtgccgtggcggctggtcaagcgccccgcggcggcgacggcggcggaggacggcggcgccgcgggtggcggcggcggcgccggcggcggcgcgggcggcggaggggcgcggaagcgcgtgttcgtgtgcccggagccgagctgcctccaccacgacccggcacacgcgctgggcgacctcgtcggcatcaagaagcacttccggcgcaagcacggcggccggcggcagtgggtgtgtgcccgctgcgccaagggctacgccgtccagtccgactacaaggcccacctcaagacctgcggcacccgcggccactcctgcgactgcggccgcgtcttctcccggtacgtacaccaccccctctcctcctcctcaaacctacgtagcgttcatggcggccggcgacgcatgcactactactactacgtacgaacgctaaccatccatgattagcgattgatacgatgacgtttgggtggttggatatatatcatgattatgtgcatacgtaattagatcttggagtatttagatttaaagagatgaatttcgaattgtttttggtgggagacagggttgcatggagataagacaaaagctatggtacgtttcagggtttaaaacctgccactgggctgtagatatgatatcgccactcggagagagaaaaaagaaaaaaagaaaattaaaaggatgtgtgtttttgtagccgacaccaattgactagctatagtttgatctgatcgatccgttgtttaactggctagctagctgaccaaagaaagagcatatttatgtacggactaattggatcgggactattactactacttcaggttcttgctgttgatgcatgctgatcacttacatacatacatcctgctaggtagctagggtccagtagtacgcatatatccatcgagattaatcgaaaactattttctagctagactgaaaaagggagagaaaaaattaaatcagaggagatcgatgagatcatggaagagatgaaaaagcagggcagacgcctggcatatgatcgtttcggtggcgggttgcggtaggaccgaaaattcctacaggaaagcgaccgcatatcgaccaaaaactgtctctgcgcatttcacccaacagctaagctaagtgtagtagtagcagcgatagctccagcttccggccagttacgctgataagatggctggttgttgtagtcctaactcaaagtaagtaaaacatgagcgccactgtttgttcatgtgcaaacataatgcctgccagagctaatcagccattaatagcttgtaggagtagcattttagcatgcgagttactagcagctatttatggatcttaattctgtgaaaacttatcaggtggctgtagtaactgctatcgtcacgtaactttaaccacaaattacttttaaataattacttcctccaatccatattatcagttgttttgtcaaagtcaaacttcttcaaatctaaccaagtttataggaaaaagtagtaacattttcaacccaaaacaaatttgttacgaaaatatattcaattattgatttgatgaaactaatttggtgttgtaaatattactatatttatctataaacttagtcaaatttaaagcagtttgattttgatcaaagtcaaaacgatttataacctgaaacggagggagaacattataattaagaaaacttgtgtggttatattaatgatgatgtacacttcggtaatataacatatttttaagtagtatttatttttttccagaaaaattaccagaagtttaaacctgtatagtgacatagccaattatttaagaatgaagtatataatatctctatcaaatatagcaatcaagtacgtgataggataatcctgacctgcctagatttacagtaatagaattagaatgtgtgtttgatcccgtaatagaacggacactagtactacatgtagatgtcctagggagtgagatgatgtggacgaggcaaggtgcaaggtgacgaagcagaggtcgctaggtaggtaaagacaagctgctccattcctcggacccctggatccaccaccaaagtacaaccacgcgcggacggggcacatcaccagatcgcccggagctaagctatacacaggccaccatgtgcacccatccatcatccatgcacacacaacagcatcatctcctcctctgtttttttctctccaggacaagagcttcccactaggcgatcgctttaataattggcagtagctaagccacactctcttgtcactgaccagcccataaatataccggacgagcagcagcatcagcagcatatgcagcatgttttcccctgcagataccgatatgatcgttgcttcttccatatgtcgtcgtcgtcgtcgacgactggttttctagctcgatcaataatggcgtaagtgcaggcgccatcactagctagctgtgtgtgtagtatatgtgtacagtgctgctgttggttggtcccttggacggactggtcgcgcgtggccatttagtcagcaatggaacgtagctagcttccttgatgggtttaacgatggcatatggtggtccatcccatgggtttcatctggttgtctcatgctctcatcgatctgtcagtgtgtgtcttgttcgagatcgatgcgttgctttcgatcgatctacatgtacagatgatcaatcagtcgatcagatcgatcgccgtgtttttgttgtgtttggtgataagatggtggttaagtggtatgattagtgtgtgctaatggcggtggttgtgtgtgttggttgcagagtggagagcttcatagagcaccaggatgcgtgtaactctggacgtgtgcgcggtgaggtcgtgcccgtggccacgacgctgccggtcatccgtcccgcggcgctgcggcatcatcaccatcatccgccgccgccgccgcctgagctgcagctcctcccggcgtccaccacggcgccgttggccgccgcgttctcgtccaactccacgaccaccggctcctcctcccacgagcaacacgcgacgacgatgacaacgacgaagctgcagctctcaatcggccccgccgccgtcgtcgccgcggcgtccggcggcggcggcgcctgcgccgcggcggcaggaggggaggaggagcagcagcgggaagaggtgaggcgcgcgctggaggagaagaccgcggcggacgcggcgcgggagcgggcgcgcgaggaggccgcggcggcggagcgcgcgctggaggacgcccgccgcgcgcgccaccgggcgcgcggggagctcgagaaggcgctcgcgctgcgggaccacgcggcgcgcctgatcgcgcaggtgacctgccacgcgtgccggcagcgctcgctcgccgtgatgtccatggccgccatcgacggccacggcgcgtcggcggtggcgcgcgagcacctgaggggcggcggcgtcggcgccggcatctagctgatatgtacatgcatgcacatgtacaacttgtacgttcacgtgtgtacgtgcacgcgtatgtatgtaaagcaaggggggttgggtgacgacggtgtaattcatctttttttttagccgcaaattgatgaagtgtacgtagtttcgtaggtcgtttcgagcttcggtcgatcgatgtcattgttgggaaaattatcaaaggtggtatttgcaacttttgcatgaatgcaccctggcaccattatactccctccgtatcgaaatatttaacaccgttgactttttagcatatgtttgaccgttcgccttattcaaaaacttttgtgaaatatgtaaaattatatgcctacataaaaatatatttaacaatgaatcaaatgataggaaaagaattaataattatttaaattttttgaataagacgaatggtcaaacatgtgctaaaaagtcaacggcgtcaaacatttcgaaacaaagggagtagtttttagggtgctaaaaagttgctcttttttttttactggaaaagttgctcctttaatctggactggtaatggttctaggttactacttaatggtgtatcgctgcatcaatctgtaaatgatacttcaatcactataaaataaattaatggtgtatcgcggcatcaatctgtaaatgatacttcaatcactataaaataaattaatggtgtatcgcggcatcaatctgtaaatgatacttcaatcactataaaataaattaatggtgtatcgcggcatcaataaaccgctgttttgaaacggaaatgtctgacttacactgaacttttggcctagtccggtttaccccataaaccgcaaaattagacatttttaactctaaacttttcaatccgaatgaagtactctctcactcaatccaatgcggttttggtttcacgtaacatgtgtaggcaataatttaactgatgtgataatccaattaacaaaataaaataaaaaaaattggtgaggccgacctattagtgttgctgttgctgcttgtttacctctctagcatcctctcttcttgatctctccatcctgaagcatctctatggttgggttagcctgaagatgtcctcccattcctcctccctccgtactctctctctctctctctctcatagagctgtaggatgccatgatgccttggcttccctttccttcccctttcttccatcctctcccatggcgactggcagctaaaggcacgtggattgcaccccaaattcacagtgccacagagaatggagggggcgataggggcaaatctcaggaagggaagaagaggcgtagtttgccatcttggggcgagaaggaatatgccccctcatcaccgggaagaagtaattgtggaagggaatttaagcggccacaaggtggtggcgttgacaagttcctacctgttgccacgtctacctggttgccccttttgttaatttggtagcgtcagaccttgcctatgttggttcagttgtgtacatcacccccatcaccattgcgggtcagcctgcaaatggggcgggtcggcccgttggaccgctggcccgaccctcaaaattcggctccagaaggtttatgggtcgacccatataattttagggtcaaacgagtccaggaaccagtgcaccctgggtcgacccgtaatcggcttatcacagcactgcgtaggggcgacgcactcctcagctagatcgaggcggcggcggcggcttcaggttggggcgacgcgccccaggctggatcgagggctcgaggcggcagcggcggcggcggcaacggcgacgacgacttcaggttggggcgacgcgtcccggctggagcggcggcggcggcggcttcgggttcggggcgacgcagtcccgggctccggcccggctggatcgagacggtagcagcggctccaagcttacaagctaggcggcgatgcgctcccgctgtccattattgatttagcccaaccttgcttcaggctgcagcttcagcagcgacgacgccggcgatcatcaggattatgagcatggagtgtgagtgttctttgttattgcgtcttgggcagaagagcatgttgttagattgggtgtcatttgcttgatgaagtactactggttgctagtagtgatgtttgtgttttagaatgcgaagatttgtgcaaaggaatcacaaattctgaatggaacatctaggaaagttaatggagttatatctgtttctttaaaatttctagattgaattttctgaatccaattcaatttgtttttcttttgcttctattctgaattgtttaaccatgatttgtcaatttatattatcatcttgtccggctgcattttatttgatgcttatcaactactgaactctgctatctttgcatgtcgctgcttggacaagtgcactgttatgttgtctggagtaggaacctaacggggcgaccagtgccaccagagaggggcgggccaatgtttgtctctggtttcaactggtgcccaaaagcaaatgggtcagagggtatagggaacgggcctacctgccccgccccatttgcaggctgaattgcgggctccacctttagcttctccgtcaccggctttcatcctctctgctcccctccttcctccggcacctgtgcatactcctctcttccctccttggcacgggtggcgtagatatataggttgaccctagagaggagcgcaagtagaaaagaatatgaagcaaacgacatataggtatagatatttctttctttatatatatataagttgattatcccacctggatgattgagtgccacctgatacaacgttgccacgagagtcaggggggattaggggaagcatgctacaccaaacgtttaggggggcaagtcaaacattttcttttcttaaaatgattatgcattttttttatatctccatcccaaaatgtaccaattttttactattcgggaacatagccaacaattattttaagatagtgtgagcacactcaaatatgtatatatgggatccgttactcattgctgaaaacaaaatatattatagtattaccgtggataaaaaaatagtaggatatttctaatagtcacatgcggattgatttaatttcgttgtattttctctatactaaaatatattaatttctatttccctacctacgtacctttgcttcatgaattgagaaatcccaattgctagaagtgaacatatttattgacggacgaagtagcattgtatctcaaaataaaaggatttctggctacatatatatctggataaacacgaataaaaaatatttatatcatgggatgagggagtaatgtctcttggatttacttaagaaatatatagccatatttgtgttgcgattgtattagagctctaacacacacacacacacacacacacacaaaatatcaaattacagcgtttggacaaagccgctatcaaagacgtagtagtacaatattctaggtacgtagatgaaacgatctctttaaccatacctcaatgcatatacagtactcatcttagactcttattagtgagcaaacaaatacagtagttgtggcaacagggatgccattgcatgatgcacatcgttcgagtattcgactcgtttacatcgagctggactcagcctggagtaataatcaatctgagccagtagtttacagcatcagtgcgtcactgaaaagaggctgcagcggcgtcaggaggaggattcagaggatgccgttcctttcgcaaaaggaaccaaaaaacgcctttactcatcctgcttttaaccgcacgatccaggcgcagagcccccccttcccggtcggcgcagctgcgagcaactgcagcgcgcaatccatttcgtcacccagtgcgctctgaattccccgtgaactctgccgcagtaaaaacgctcgattaccttcgcttttttcctttcttttttttcgcccagtcctcctgcacagcgagatgagggaatatgccctgattttatacatggctgggccggtctgtggggacgtgtgttcttgggcttcaccacatggcctgttcggtagtaaaaactttgcctcatctgaaacaaacctggcgacgtcgcggtgacttttaccagaagggtactcgagtcgttttgccagttgcattcgatctcttcgatggcgttgtcagtcaaatgtgtcgtgccactgtgtgcctgtgacttggccacatcgtacgaccatccggcgaggtacagtgctagtacagtatacaagttttgcaaggattttgtttgtacggtcgaaatgttcagaattgttttgcaagggggcaatgccaatgtgtcagagcacgctcttgggtaaataatcatcgatggagtactacagactacagagtgctccaacgttggagctcccggtcgaatagattgtgacaatgtagtttgacctactctagccgcttgcaaagcatttgcaaagcaaatgctcctccgatgactactactggttccttagctagacaccgccctacctagtactcctagcttagctatggtggcaacttgacaagcttgcattggcgaccaacatgtgattccataaaagctgtgaggtgaggtgagatgccatgagatgatcgatatatgtaatacactcttgcaaagctttgcccctagtacgctttctttcttcttcctttttgtttgattcttctcttttctcaagacgtgatcgatgcgagccgctttttggtcgcacgtatcggcgtaagcacgctctgccaggggcccctgcaccggcacgacgctgtcacggcggctcgtgacgagacgaggcgcggttcggttggttgggcggttgattccgccgagatcgacgaggacgacgcgacgacgcaaaagctagcgacgttcggttcgtacgtgccggtggcagatggcacggccggcgttcacaatgcgtataactggcattcaaccttaggcagccccagccaagattccacgccacgtcggatgtttccgttaccaagtgaagaaaatggagcctaaatgagtcgcatgtttctcgtcagatttgtcagggattcgtctggatagcccacgacggccaagggaggagggctgccggacggagaagaggacggaaggcgccaccgaggagagggtataggccacgccgccgctcgtcgtcgtcgccttggacaacgggcgccgacgaggaggggagatgagatttggcactagcaagctgaggggagaggggagatccgacgagccgctgccatcgcccaaggccagatctagcgagcccagatcggatatggccgccccgcctagcgccatcactgctcggaccaccgcttctcctgacgctattgccgcttaggctgctgctccgcccggccgccccgccacagtggaaggagaagaggagagcgtgcaagtcgccgctcgagcgtgagagggaaagagagagagaaagagagagagagagagagtggaaggcatgatagaggggaaaaaagaggagagaagggacttctgtatttttgtagaccccacttaaggctacagtattgtgacacgagtgtctaatactggtcttgagccaactgacatgtgagacttggcatgcgagtaagaagcactgtaaatgctctaatggaagcttttccttggctcggctcggcctcgtctataacaattttgatcgatttgacacgctcgatgtacctatatctctctctctcgcacgtgctagcgtgtgcactccggaattatgcaatcagagccgatgaaatcgtcacactttgctttattcaacacgatcgtcaagagccgcagtttttgttgttacgttcctcagagcagcacgcacgtcggccggcgcctggaaacacgaagcggtcgccggcgagtgctcatatctcgccgtcccagaggtcgtcgagcgacttgtagggcccgtggtcggagacgaagcggagggcacggttgatcttccgctgcgggatgccggcgatcctctgcctctcctcctccgtcagctcccatccgacgatgtccaggttctcccgcatccgcgcctcgtcgaagctcttcacgatcaggcagtccccttgctcgtacacccacctcaggcacacctgccaaatcaacacacacacgtcagttgctgctgagacgacggcgcgacacgaacacacgcgtgcaaatgtagacgtgacgtgcctgggctacggtcttgcccttggattgggcgatgtcgcggagcacggcggaggccatgacggagtcgctgccccagtgcgtgccgctggcgcccagcggcgagtaggcgcagatctggacgcccttctccctgcacagctccctcagcttcctctgctgccacaccgggttcacctccacctgcacgtacgtacgtaccgtgacaaaccaaacgcaacgcaaacccaacacaataagcaaatcaaccattaaaaaaaggttataacatttttggttgttgcagcattgtgaattgtgcaaaccaacctggttgacggcgggagggatggtggcgaaggagagcagggtgtcgagctttttgcaggagaagttgcagacgccgatggccttggcgaggcccaggcggtggcactcctccatggcctcccagacggcccgcatgtcgaacggcacgaagtcgtcggcggtgaagggggccttgtaccggcccggcttcatggacacaggccagtgcaccaggtacaagtccacgtactccatctgaaggttcctgcatatatacgtgtgggatgagcatgtgctttctgttaattaaggtgagtcttaacctttcataatcagttgattagtcgcatggtgcctcagatagaaattaaatgcactgcagttaatgagggactaatatctgtttggaggtggcagccaagatggtaatgaaagaatttgtctcgtggctaatgcagtatcttccaaaattaaaagcactcaaacagtttggtttttcaactacattcaaaattcaaaaaataaactagaaattagaaattaggttttctagcttttttaaattattagaaactagttaccaactagatactcaaggcatccctatactcaaggcataggagtggtcggcacgtgatatactcaaggcattcctatactcaaagatgagcatcagcacgacaaccaaagagtaagactttttataatttgtcttgttaagattaaagaataatatcacatacaattttgctatatatttgtcgataaattttcccccaaaaatttgacagatgtaattacagtacaatcatagtgtaattacactgtaacatgcatgtaattacactgtaactataatgtaacttctatgtaacttttaaaaatctctccgtaacatgttattttggtaaaatagaggttgtgggaacaaactatttcacatgtgtgtgtgctgtgattttttttcttcctcatcaaaacaaatcttataatagatctaacaattcaaaattacgtgaaacttacgtacaagttacactatagttatatagttatatgcaagttacagtgtaattacactacaattgtattataattacatctatcaaatttttaggagaaaatttgtcgacaaatgtataggtggtccctatcacatatcctaattccacaataaattttcctttatttaagataatgcctttgtttttcttataggcctggcccaaccgattactccaaacaactcgtaataatccactactaaaatcacaattcttcacttgattccgccggaatcttatacgggggcaaagagaaggggggggggggggggggggcatacataccatagcgtctgcctgagcgcggggagcaccctgtcgcggtgcgcgtcgctgcaccaaagcttggacgtgataaaaaggtcagcgcgggaggcaatggccccggaccgcacggcctcggcggcggcctcgccgatgggcgcctcggtctcgtagtgcgccgcggtgtcaaagtggcggtacccggcctcgatggccttgagcacggcgcgccggatgggctccggcctcggcccctgcaccgccgtgcccatgccgacgcgcggcatgccgaagcccgcgcccttggcgcctgcgccgccgtcgctcatggctggaggcagagtgtccccctctcttggacggactgcggcaatggattggaggatttcgtgggggtttttatggcaaattggcaaagcatatataaacacgacgacttgggtgcggtgttgacggaattcgccgtgacaccggttggttatttggttgtcgtcggtgaccagtacaaaactattcgatgctttcgcagaattttctcaaaaaagaggaggaaaaggtggatattttgaggcgcgcatcgcgcctgatcgttctcgttttcctctcggatttgtttttggatcgtaacggaagttcatttgcgatttgacgggaaaaggagagccgttactcaagcctatgctgatctaaggagaaggggaggcggcccatatcacgccatcctggttttgtagcatagcgagaccggccaagctcatgcagtcataggcttggttctttgcgttacatcacagattaatcttaacggtcaccgctagtagtgacttctcggagtgtcgatgcgatgtggatcagagcaagtgataatccaagtggcgttctaatacatccatatcgatggctatcatgctagtcattttctacaattaagagagggttgaaacttcttcgtactatctaaattataccccgaagcttaattatagtacaattttaagaattattttatgtacttacatctgtcccaaaataacttcaggcataagggctcaaaataacttcagacataagggttcaaattagcacagaaaaaagtggcactaattaatagaaatgttatattaatggatgggtagataagagatactgaaatgataaaaacttaattttagactgaatgataggtaagagcatagaatttgttttgggacaaatgttagatgttaaaataaagttatcttagtacagatggaataggtttttctgtctcattagcaatagaaaagatgtaacttttcagaaaatgcagtccaaaagcagaacaagcttcgctggattatgaagaacgaatcacatcaacaaatataacgtgtcaagcctagttgcacattggaagctgcttcgcactatcaatcaaaatgatcatgattctcaaaagtgaaaaaaaaagaatggttcagtatttcaatatttgacaatacataaccagcggtgggtacacgtataaatagacaagccgctctagaggcatcatctctacacttcagttattctgctataggaaataagacatgacatgatcttccagagatgctcaggtaggtcatgcatcaacaacgtgaaaatgtctagacatcacagggagaattacatgaccaaagaaaagacgatttatcacagcagtcgcacaaaaggagaacaaatttataggttcattacctgttcctatgaataatggcctaacctgaaacatggcaatctctagctgctcctgttgtgcgagagctaaccttttctatactgggacttcttagtggcaccaaaaaggagtacaactccgctgctctccagcctttgacaacagtattactcacacttgatggatttgtatatgtgacggacaaagaacaatgcggcacggaaaccgatcatgcccagcatcaggaagaaagcatagcagatgcaagccatgtagccgaagaagaatgatgtctgcataaatccagacatatctgatcgtgcataatagtagtacagacaatacccatagacaaaaaatccagttgatcctccacataggaatgacctgtataagagaaagggcagaaaaaaaatcatattgttgttcagcatttagtacaaaagaacagcattaaactggagttcctagataataaatagatggatgagagaacataaggattggtagaatatccataaatgggtggtgctcactgctcagcattgtataccttgctcatgacaaaaaaatgtagagttgcaacagatttcaagaactagtccctctagaatccattgagatgatacataattggttattgcattgtactcaaaatttcactacgataatactttgctaatcagcaactccaattgtaactatgggaaaacaacagaagggtgcccaggaaatacatatgaataagatgtcaaacaaacgaaaaaataactgcagaaaattgacagccacctgattgatctcagagctcaataaataaaagcaaatacccaaaatatcagtttcagtgtataaaatgaaatatatgatgcattcccatgccagtacttgtttaaaaaacataaagggaaatgaatgtacctccaccaccattcatggtcttcagcagcaagctgaaagtacgtcagtgcaacagtaatgaaggcagtaacaataaggaggatgatgaagactatgaagagaatgctgtaaattgtgtaaatcctgtggccccaaacactagcaaagatgtagtagagctcaatatagatggcactgaaaggtaaaaacccagccatagccatctgcgggattgtttgccggtaccacggaagtggaggaatctccctaggatatttggtggtacggcagggagcttggaattcagtcttgctgtttttaccagcaatgcctcccaaaactagaaggggaaatgtaactaaggtccagatgagcacaatgacacagatagtgccgaagggcaaagctgctgttgcactataagcaatagcaacagtgtttaggaagcagaaagtcaggaataggggtccacagaacaggcatcctgtcaacagcaagttcctcacctgagaagtataaaacgatagcattagtaataaaagaattataatcgatgcttttaaatttgcagtcttagcattgtagaagtgtctagggatgtattatgtatacatgtaacacatacccagtttgttccctctagctgacagtagaaagaggttgcaatatacccagcaattcctgaagtgagagcatagatgacaaccaatgcagtaaaaagagcaccacgattgtacgggtagaatactccaacaagtgcaagaaggaatataaaggttgtgctgcaatgtgccaaataaagattgttagctatctgcatgtctaaaaaggaacaacaggaggaagaattccagttaagcaaaataaaaccataatatatgtggcaagaaaaggcccatcaaaacttacagggcaaacagttgagttccggtgccgagagcagccgaaaaaaaggacttgttcttggggaaccggaagacatccccatggatatacttccatccagactcttcttggtcatcagctgcttcctcatcatgggcataccttcaaatgaaaaagggttaaactaaaaactacgagatgaaatgtagtcaagtcatcaagctcataaatcaaagagaagatcaaccttcaagtaataaattcataagcattacactacaaaggacatataatctgaacaccgttgacatagtagatctgctttatgcgcttcctttagcaagttaataatttaatatccatttcagaccaaaatatttgctctatgcatcatgcattagtttactctcaactgaagaacatggcaagaggaagaatagatgctcgtttagtagaatagaaaccactgtttggagtgagtttcgacagtcatgtcaattgtcaaaatgcatctccataggaaataaaaataatttatatgctgcaattttccatgttctatgggctggcatctgtctttactgtcactgctcattacatttcttttcttttagtgcttaactagcacatgtgcatagtgggctcaggcaaatatcgtgacatgcatggagtatcttccaaaatatctttaatacttaatgtaaatacgtaatgtatagatccttacttgacaaaatcgttcttcagtactcgcatgaggatggtcgccaagaatccagtcaaaaggaggactgtaacacaagagtttatgatagagaaccaatggacctccaaatggtgtgggaggttggaggaactggaatacttctccatcctcttctcaaatggtgtgggtgtctccttccacttgactgagtaaaggaattgaacatcagcttccttgtcctcagtcaggtcaactagtgcactctggtcagtgtgcacattgatctcaataacccggtcattgttgtagaggatgtcaaagatgatgtgcctgtacaggtaatacttccactctttcggatctgtcttgcctcccttctccaccttaccaatgaatccccacagtgggaggtcatcgtagtacatctggaagtagtagtcctttgctaccgcattccgaaacttggccacctcctccttggtgagcttcttcgagcaaaccggcttggagtcataatccacacggaaatcaagcttgtaaggtgcatcaaccaaccggtccccattgaggacctcaccgagtgcctcgctcttctccttcactttctctgtaattaacaccatttattagcaaacaactaactgggattcttcagcaatgaagaggaagcatgaatctgtgactaactaacctggagagcagaaaggcaggtcaaagtaccgatacgtctcactgcaaggaaaaaggaaaatatcatgacaacggcattcgcgtgacattatcgcctttaagaataaaaaatctactttacaaatagatccgattcccagcaagtctagaatccgctctccgaacacctatacttgctaaaactgaaacgaaaacagagcccgacgcgaagatctgggcagtcaacagtgcagtgatcgatcgttatcccgtccaaatcactacgaacgtcatctctcggatctccgaaactagcctctctgcgtttgaccagacaaacctaaacccacgacgactcagcccacacacacctcgaggcgagatcggggggcgggaacaactaacccaacccacacccacgaatctaacggatccgacgatgggatctgagcgggggaggagagagagagagcctcacctggggttgtggaaggggccgaccttgttggcgtagagcgggacgagctcgttggccttgtagcggtggtcggagccgtcggcgacgacgccggtcgccgcgagggccgcggcgagaaggacgagcagcgccgcgggggccgccgctgccggcgaggccatcgctctcgtcggggcgggggcgggggcgcgcgcgttgacgaggagagagagcgcgcgcgcgagggtttgggggtggtgggatgcacgcgcggagatctgagccggagtggccgctttgcttgctccttaatagagagagagaccgagacgagacgagacgaggcggaggggagatctggagagggtggcgttttcagggttgggtgggggggaggaaggtggaggcgtactgtggccctaatattgtagtactagtataatggggtcagctaagctaaaggctagtagtagcccacattttggtgcgtcggtcggtttgacacgatccaaatcagagcgctctctcgctccccgggggtcggggttgagtccagcgcaagttttctttccactttttggcctagtcacattctgatttttttttgtcaaatattatcggttagctccagtagtgaatagtgaaagtagtacggaaaactaataagatgaagattaagtaatggtacggaaaacgggaaagtcattagcgtatgattgattaggttttaacttattataaagttgaaaatggatttatttgatagtttatagtaacttttatgtataaatttttcacatgaaacatattgtttaacggtttaaaaagcgtgataatgaaaactgaagtagactacatacattttaatccaaaaagaacgggcagtagggcttccctgctctcaagaaaatcaaagtttagtgtatagcatatgtccatgtaacaatgttgtagaaacttgaacaagggaggaatgagggcaggaatttggtacaacattgctggatggacatatgcttcagccaaactttgttcaagtttggtacaacattgctggatggacatatgcttcagccaaacttgaactcagaaacgaatcgggctggatggagtacattgctggaagagaagcattactgcataagctcactggccatccctggaaggatggaagcgaagcacatgcttgattttttttaaggtagaaaaaattgctaggtcattcaaagaatctacaatagtgactactgcaggagtgtaatattcagttttatgctgctaagaaggtcactgcctatagagatgaaaatcacaaacatcatgagagttgacagtaccgcaagaatggcaacgggccatgtactaccaaagtgagcttatgcagtaataccatctgcagcagttaccaacttagcagggctatgcaaatgctgaaagaaaagaataccacaacgcaacctttgcttttcacctgccctcactagcgccatgcaaatgccaccaattcagtgagcttcacttcccctagtttcataatcctttcctgcagttacgctgtcatcaggtttcctctacatacgcatgctgacttcaagtgctggtaggaactaactctgtcggtcgacaatgacacctcttagctctctgcatgtgatgtatggagtatgcagctcatttccctgacaatttctcatgaataaatgggaaccgttgagagaactgataagtttcagtcaaaaaagaaccatccgcaggcggcagccacagcgaggtggttctcatttctactccctccatcaaaagaaaaaaaaaacaaacctaatattagatataatatttcctaatacaataaaattggacaggagtatgttcggatttgttgtataaaaatatatcatttaataatagatttttttcgattttgctatatctcactcgaaagatttttttcttatctctcactcgattttctcactcaaatttacagtgcattttcttgtaagttacagtgtaatttatgaaacttacacggtaacttttgtaagttacactgtaatttttgaatcttcgcatgtaaattttaaattttgtattggatttggtctttttcttgaggatatggtaatttagtgtccattatggtgtttcttaattactttttgctttttattatatctatcggattttaatccaaagattaaaaatctgtgcgataccatcataaaaatctttcgaaagatgtataggtacttccgatttttttttgaacagacggagcaacacactagttatcgggaaaaaaaaaaacccttccaagacactgcaataagctaattgctagcgttattttcttccctaaaaatcttaccttttccgaaggcatcggcttaatgctttacttatttggaggggccatgcctctttccagatgattgctgaagaattcttaatgtttactccatgaatgattgtatccccggcgtgattttctgcgtgatggaaattttgcacaaactttggaatcactacggttttgtactcatgtatctaagtaaaataatctctcattcaacaaacttaaattagcttaaaacacaagttagcattaaattcaactgaggcaacctttgcttcctccatacagtcaagtcaattcggcagttgaatttggtgaggccacgagaaatggatatgctccatcgatttgggggataaccgcgagaaatcgtgtggaaccaacagacgacagataacgagttctgggcaactaattgctcagataagaaagagagcgtacaacattgcacatattactttcatctatttaatagtatttaagaataataatcgaatgaaaccgctagaaaaaaaaaaagaaatccacaaatcttaggagtcaggcatagacacttcgtaagaaaaggatcaagattccattcaaatttacagcaaatacctcagttatcataagaatgtaataaaactacctcacaattgcggctgaccttaacctttctaaacatgcagaataatcttgggcatcattagtcgtgatgacaaggaatggacggtatttacatcagtacgaaggtaacaaaatcttgatgatacggcgaatgagcttgagcaattatatattaaacactaactttacaagactggctacagatgatccgaattgatacaacactcctaagatacaacatcacctgttgcagtttgcgaacagcgattgcacctatgctatcttgtccgagcagtgatttgacagctggactcgagggctaacgttagcatgtctgtggagaattgatcgtctggtttcaaccataaagcctgaccaaaatagcgagaaaatattagtaactaaccctgcgctacatgaaaacaacgaacaaactgaatagaaaggcattggtctccactgttatatctcttcagttttaaacttcaaaaacttaattgcatatatacacggtgaagatacattacgcacaagaaagtccctatgctgaactattggcagctccaagcggcttgtttggtaactggagggaagaggattgggagtttacacgagggaattgatgatgagattaagatggaaatttgatttttaatcccaatatcttgtttggtagaggtgatggaaattgatagggagtttagttggagattaggtcattaataaaaacggatggctgagatttgcttagacaaagtaaaggaggaattccctcccaattacctgcccctacccaggtattgaaaaggagggagttccttcctcaattccccatccccatcccaccaaaattcccatatctcccaaccaaacaaaacacttaatagcctcatccctctaaactcccaatcccttctaaaaactccctccaaccaaacaggccgaaggtgtttgattagaaagatgtattctaaacatgacagctaagtacaaatgatcatagagcgtcaccttgtggtagtaagttatcgcagcctcgaatttatcctgtgttatgaaaagatgatattagtaaaattcagatatactcagaaagtaactgtggaagtgtcaaactgaaacaatgaatcaagcatatcaggtctcattcttaaaactaaaaaatattgcttctacaaatgcaacttaagcttaaaggtcaattgtccttcgtgattttcatgtaaattagcaaggaatctctgaccgaaattttttttcctgaaaacactactactagaacttaaatcaccctctcattactctgttctcgattcttccaatggcatctctatgccttgtctagttgtttctcacttatgcctatgggaactaacaaataccaagtatcccgatgtttcaacggtaaacgctcagcacacatatatgaattgatgttgtaattgaagtagcaggttacataaaacttagttttgaacttctgatcatatagatatccaatagataattaaatataagtctatgtggaaagaccatgatctaacacgtatcatcttccaggttcttttgtcagaatttgcagaacttctgccctatgcacatgatacatcgcctttacagcatgccagtgcagcataacagagatagtaccattcaaagcagtggataagaaaggaacagaagagtaccataaggtggtaagtataagcaagaccagcaaacgcgctcaaacttttggtttgaaaggtgagtgccttttcataatatgatattgccttttgatatttcctgttgcaacaaaaaaaaaaggttagctcaagaatgatattttaacaactgatgacaacaaccaaaaagaaagagaaccagtataattcggttaattattattccatcagtcaaaactaacagcaaagctgctgttcatcgcaaagaaatgctattcaggtcaggatatgctaggcacaaaatctaaggcatattttcttattaaagtttcatgcaatttaggcttgactggctctggatacaaagaaatccacaagttcgaacttaccctcacacacactggcccaaataataacactggcatattgctgatttattttgttctagtctgtaataaaaggtcttcaaacaaagcaaccacagctgcacaactgagatgactgaactaaatcaacacttcctttcccattctctcatgtataacaaaaatcataaattgagcatataaatgggattggaacttgacaaatctattgctaaactaacataaaaaagtcatatgccaacagacttatgaaattaaatgtaacaatgtgatgcgatggttcccttacttgagtttccgcaatgcatgcccaagattcaccaatgttggttcccacatttcattcaaggaggatgaagtatgctccagtgttagctcaaaccactgaactgctttttgatacctaaacattttttttaaaaaaaacagaatatcaaattctcaactactttaatagcagcacaaacagttctttttactgaaaccactagaactggatgtgtcaaacatttttttcagcagagaaccaaatctaatgggatgaaattttataagttgaagagaatttgaaaagcaaataaaaaccaaacttgtatatggatcatggacatcaatcacacgtttcaaactctaatgatcatactataaatgcataaaacacacttgttatcgtgattgcgttaatgcagggcccagctggtgcagcattagttggaaactaaggggaaaaaaattagttgctctcttacttgggtttacttcactgaatactatgtgaagatcttgtcgatacaaagggaacagcaaagcatccgttacaaatcaatcaagaaagatgaaacattttttctccccaaagttcatcataatagcctatcctttcttatttatcctggagccattccccttcttttattcttcttttatcccaaagttcctccggtgtagccagtttctacatgctaaccttaacatgaactagggttcacatcattcccacttcaaaaagctttccatacaatactatgcatactacatccatattctattcaaaatttcagaaccaccaaatcaaccttgtatatcatggacatctttcaaaacatccatgttagcataacatttttcctataggaatatcagatatagaacttataggaatgctttccctttcatgagagcaaagcatcttacaagggaaagtggagcatcactggttccaataataataggataagcagacaaaagaaacctttagaacagagaaactcttactctttcatattataagctacaacccccatctcgttatatataagcggatcagatgggcagatagattttgcttgcgtgaagaactgcatcacagcagaaagaaaagggggtttaaaaaaatgatgacaaaactattatgccttgccaaataaaactttgcaaataacatactctccatgataggctctcattgtgagctacaacaaacagtattcactaagtaaaaggaagttgtgcatgataatatctcattttctataacccatccaatattacaaatacaggatgtattttcagcatctgaccaactactattaccacattaaacctccttttttgccaaaaacaaaatatggaatgagaaaatatagggaaaaaagtcagctctaagtatagtttctttatcagagtggaagcctcataagaaaattagtctcggtaggatttctcaagttattacctgctctgcaagtttgaaattgtgcattcgcaaatattgcatgcccatgtataaagttggcagatgacatctgaaatagaaaacaatttcaacaaatagtgagccgaaggacagacaacaacagaggtgaagtaattgaagtgcaacaagaatctacactccaaaacaaagagaggaactcaatccacaatgctcataatcagtaatgtgtagtagatacaaaagcttgccagtgtcccaaaaaacacgaatagcagtttccagaacagaaggccaaaaaatgaaagaaagtagaaaggatccacaatgctcataatcggtaatgcatagcagatacaaaagcttgtcacacccaaaaaaaatacgaatatcaatttccagaataaaaggccaaaacaattgaaagatagtacaaaggaaaattaatgcaactaattgtgttaagataattgctccttagacaaacaagtacaagtatgctctggtgttaatattgagttgacttaagtgtaaaaagaatcaaattaatttaattaatattttgctaaactgtacacagcataataacataacaaataaagaagtttttttacacaaacaattacttcgaaaggaattactgacccaggaaatagccgagctgctgtccgaaatgcagccattgcttgatcaccctcctcctgtgcagcataagcaataccagtaccaatccaagcaggaggaaatgtcccatctaaccctgtagctttgctgataggaaatatattagtgcaaaacatattacagctacttaaaattgaacaagaatacaaggtataagaagttgtaagagggttaaacccatccatgattaaattcaatgaacaatgagcattgaacaaataagaaacaaaataacctgcaacctttggactggtataactgagacacatgtcttaagaaaatatatattgtttatttgaacttggactctggagaattattggacagatatgtttcaccttacaaaccatctgacagactgatactacatgagtagaacctactcatttctgtctttttatcacattgttctatcattccagacaactaaaaatatttaacaaagaaatatattgtttgttataagaaatcaatcagtcagttggatatgcgtagatttcaggaggcaatggcacctatggacactgttctctccatcagatggtaacactattgtagcacacatgttataccatgtctgccatgttttcatgacaaaagtgttgccttacgcaggaacatggttgtgatttgcagtgcagaggatattcactaatcacaccctattttattttacatcccaacatcgaaggcacagcaggattatcttctaagctatcctaaggcaaaaatgcatagtgaaggttcaaataaaaataatacagtagaaattaagagaagaatatgcttacccaaagtatctgcgtgcttgatcatacttcttaatacagtagtaataacacccaacagcaaaccaggaaagagctctacagatggaaccacagctgacattaaaataatatactttgtttgctcatgtctgactacaaacaatcaagtgtactttagtattatgtccctccaactattggagtctatataaccaacatgaagggggggggggggggtcaatctcttcttgttcatcacataaataaaggtcagttaacatattttaccccaatcccgatgctattaaaggctagattttacaagttgcattaaagtttgcagaaagatgaataatgtgcacaacactgtcattatatctaagattgttacatgcaaatgaaagggggaaaagcccatctagcaggataacaaatattatgtgggtctgaatgtgggcaggccagtgggaatactcacttctgaggatagtccttcactagattgcaggccaaaatataaaggtcatttgaatggccaagctccattgcagctgccaaatgaactaacgtgcatttcaaatgaaaagggtccctttcaagtaacctgaggcacatatagcatcacaagaatgataaaccaatattgatcaaggaaacatatgtaccgacaatgaatcatttaccaacttacgcagatgtgagttcgaaacatttttggtactctccactctgatgatagtattcagctttgcaagccaacacgtcaatattatttttcagtgtcagtcctgaactcaaagatgaaatactacaagattctcgttcaaattccttgaactttgcttccactatatattctttttcatgctaaagccataaaacaaaacaaaccatgatcaaaagaaatataagtgaatgcagatacacatattgtttattaaattgcaaagcaatgcagttaataagtcgtgtaccttccttatcaaacaagagtagaatgctgagagccacccatcttcttttccaaattttagagaggacaatagctcagattctgatatcattgcataacaataagtaccaagaacaaagagaggattgaaggtccaacattaagcatatcttcttaaaactagtccagtaataacaataaacattgtattatttaaaagaaatatcctaagaggatggacatgacagatgggaagattgattttgtaaaacttaccttcctcgcatgtcaacatgtagttatcaacaaggcattcaagggcctgccatgtacagacataagaagttaggaatgaactaactggggttaccacagaggcccaattccatgttagcatctggatgccaaattccatatttagtagaaccaaaaatacaaaataatggtggttcatgtaattgaaaaggtattgtactaaagagtcacatgattcttctcacctcatagcacaaaggatcagccttcactgcagctttgtacctgagataacagcagaacaaagccataaaaccatcttaaccaagctatttggccagatatgcccaaaaaaaaacactgattagacaatcctgcttaaatcttaatttcaaacaaagaaaattagcagtacttccaggtagcaacagttatttcaactattagcagtgtgtcctcgttttacaagaaaaactcattttctttatatcttctaaagagtatcgaataacccaacattctcagtgaagatattgagtaaaaggtgtaagagaagaaagacttcaaaataactgcatcgtcattcaccagaaccactgaatacactcaattagacaaaaaatgaaatgatgctttaccattgtcgagcaaggtcacagttgtccagtgcttcgtatgccttgccacgtaaaaaacatattgccgctttgatctggcaagcaaatattactatcaatcaccatactaagagagagagagagaggcatggggaagagaaagaagagtcaacacacattgatctcatggtcttcagcatccttatcaaagtaaatgtcactgccatcatcctgatcaacaacgtttccatgctcatctatttttgcatctccaagtatgatcaaacactgatgccattctttcaactcctcctaacaaaccaaaacaaaacgatgaaacagtagctaagataaaaggaaagacggtagataaaataaaggactacacaggactgtacaccagagcacaaatcagaaaaatctatactgaatcataatattttctggtatggttcaattttctaaagtaaaatcttagaagtacattaaaaaaatcactaatcctatacagttcttttgatctttcctataagaaaccagatttttgtttcgagtgtcatggatattgattgaataagcagtcaaaatcatatgtgcagtttatatatctgacatatatagaacttaaacaaaattctcatttatctaaaagtccgaagcaggaagcacatattataatcaaccaaactcccagatcagaccagctattaagaaccaagctaagcacccgttcattgatggaatgcccaagtaaaaatattctggtcgagaaaatgcaggtgtatcatgttaattattttgaagcatcagcagagcattggacttgaagccaaaaaaatgaaatcccccagtgcaagccattgggcgcaccttgtgtgaagtaaacgaccctatctcaactcatacagctaaagctaaaagctgatcaagcaaaattttatcgagtgcttgcaaacacacagaatcaaatcgtcaaaaaaactgccaaacaatgcccagagtgaaagaacattgaggccaccatacaaccacaagctgttcataaggaagctcaagcgcagccacgcactggaacattaacaggggcagtgaaactaaaccttctatctacacacagcatgcacccaacatgttcgacaaaatggcagactaaacaagggcgtgggtggggaagctcacgaggcacttggctgcgaggaagcggaagcggaggtcgcggaggagcttggaggagttgaggatgtggagcgcgcggcggaagtggcggcccaggaagagcgcctgcgcgagcatgtagacgtcggcggggtcccccgtggccgcggccaccttgtcggcgaggaagatggcggacgcgtacaggtgcttcccgacgctgtcccgcaccaccccgcgcagccgctccaccgcctcctccctcatctccgccgccacctccccctccgcctccgcctctctcctccgcttgggatttttctgcgctgcggcggcggtggtgggcggcgctgctggagggaaaccgaattttgtatcccacattcgccactagggttcgcggcggagagtggtggtttttggaaatttctcacggggaaaaaaaaatggagtcccgacgcgccgcggatcgcagcaagtgatcgatggatggaacgtgcaagcagtatggcttatgggccacgggcccacggcccacaacatatgcaaacgaaccagaaagcctgtataggagaggacacacgggccaggcccatcatctggccggattcggaatctacctctgtgaaattgcgatcaaaacctacggaaatgtatagatttcgtggtatacaaatgttgattttgccagcttacattgacgttcttcaccttagtcgtccctgtttgaatttacttttctattattattaacacgggagaaacgataatttgaaatgattcctttggaattcctgcaaattcttatgtctatcttacaattgctgcactgttctttttttttttatcatgtgaagacgaattaatgtgcacgaacgtcgtccatcggagccgaaagcggtcgctacacgccgccggtgatggccctcgttgccggagtagcggtcatcgcctgtgagccgcaccgctggaaatcggcgacgcggggcggcggcatgccgcggggagccgtcgctctcaccggcggcgagacgccgacggcgccggccgggtgcgccgccgccagggcttcttcgccgtcggctgcgaggtcgccgccgccgcaggagaggaggcacgaggcggtctgggagcagcccagcgtggtcacgatgacgtagctgccgttctcgtacagcttcatgacgtagcactcctcgtcctcgagggtctcgcgcgggacgccgcccacccgtcgcgcaggcgccgccggcgaggccacgggaacggcggcgacgtcgtcggcggcggcggcggtggagggcgcgtcgtcaaagcagttgaggtggcagtagtcccagtagatggggcacctcctgatcaggatcgggttgcgcccggtgcagaggtagcagatgtacatctccgtgtcgtcgccgccagtcgtcgccgtggcggtggcattgccgggcgccgtgttgccgtcgccgcccgtggtggacacggcggcggcggcgaggaggaggagaacttggtaggatgcacggttgatggaagctgctgagagaggcatatcacaaattgatgagagatgatgcgtgcagcctgtctcatttataagggttttttttatggcggggatatttataggtcattttggctgcagctgcattttgacgtcaggagcgtagtagtatgaaattatgattatgttgggagaccaacaaaatctcagtcaatgaatggatactacaatttgactatacgagaataagtgcttacctgtttctgcgtaagagtgctatctgaattctgaagggtggtatcaaatttcaatcgagcaatctgctaattatctcttcccatgtagaggttacatgtttttcttcatcaagataaaccagaaaaatcggttgcatacatatgttattttgtaattaagattcggattgtatctctgtttcgttagcacgcttttaaactattaaacggtatatttcatgcaaaaactttctatatataggttgctttaaaatattaaagatacccatttataaaggctgtaataattatattttaattaatcatgcactaatagttttctcgtttcacgcgcatcaacttaatatttcatcctcatctgaaaaatagctttctagctgtactcattttccagatcaaacgtctagggtatacatttcctattttcctctgtacaaattttctaacaaggttcatactcatgaatacccggtacatatccctttcaaaaaaaaaacatagtacatgcacgtagactacgcatatcgctatgaacagcaaacaaatgtagtgcaaatcagtagtggaatagtgatttactaattcagctgttcagcaactacgcgctccggcggtggatggtactatttgtcagcggtggacacggttaattagcaagcccaggaagcaatggattctgtttgaaagtggtgagcaacaagcaaagtgtgttgtgctgccgcagccatttaccaaaaaacaaaccaccgaaacggcaggttgggacgtttttagccatagaacgaggagacttctcgtgttgctgccgcaagccgcaagatcgatccgatcagtaagaaattaaacggctgtgaatttatcccaagaacacacactcgtaatttggttaacagagacagatcgtagtttgcaaatatgagctggttgattcttccacattaactactacttcctgaaaaaaaattgtgaaacctaaagtgttactcgtattattatttttatttgttttgcttgcttgaatttcttttggttttctctctaccatactgcctatatatttatgcacagattgacacgaggtttagtgctatgtccaacgttacattcgtcggatcggatcatcaaacggcacgtacgcgttgtcgacatgggctcgcggacggcggcacccgggcacggctagcgctggtcgccgcaccgctcgaactcggtcaggccgcgcggcagcgggctaccgatggcggccggggtgatctcgccggaagcggcgcccgacgacgacgacgacggcagcgcgtcgccgtagctgcacacgaggtagcatcccgcggacgcctggcagctgaccacgtcgacgacgacccagctgccgtcagggtacaccttcatgacgtagcagtcgtcgtggcccccgccccggccgttgtcgccgccatcgtcgtcggcggcggaaaaaggcagcgcgcgcggcggagacgaggaggaggagcgcgacgccgacgacggcgacgagaggcaggcgatgtggcactcgtccttgtcgagggggcaccagctgatcatcagcgtgttgcgcccgcggcagaggtagcagatgtactgctgctcctcctccgtcgtcgccgtcgatagcggcgaggagcggccgcggcgcgccatcacggttgcgttggcggcggccgccgtggcattggtgccacgagccacgacggcggacgtggctggcctggcggccgccgtgcctaccaagaggacggcggcgacggcgaaggagtaaaaggagaagatggaagccgagaaagccattggcaaataataattgaaggcgtgtgcgcggtgacactgacacacgcagcgcgtggcttatataggatggtatttaggtggagagattagtactatggtcatgtttggaaaataggtttgggatatgatttcccacacctcaaaggataagtcttaatcttagctatccatcattctcaccatatttcatcctatcgcttcattcatttccgtttcctaattccacctctcctaacctattttccaaacaccctatagtactaaattagcgagaagattggatgtccttgagctttactgcagaggagtatatgcaaagaagttatcatgggttttaaaatttaatcatttcctcccaataaaactttgtcagtgatatgggcccggggttatcatgtttagagggaggaggctgccccccccccaaaatgccacatggccctcccccaaggggagtcaggcccgaggtggggtggcggccactccttcccaaatactagtcggaggaggccgccccccaatgccacgtggccctcccccaaggagagtcaggcccgaggtgggatggcggccactccctggccgagactagagggaaaaggctgccccaggcgccacgtggccctcccccgaggggggatcgagcccgaggtcgggcggcggcggccacctcccgtgactaggggtcgggctcccccgaccacctctctaggtcaccacgtacaggtgcccacctacccgcatttatggcgacccgagcggtcgcgccacgccggcgtgcagtgtactcaaccggtctgtgaccggtcgaataaccgatggaactggctagtgcacctgtgcgctgctcgtgtgttaggcggcgtgcagcctgacatgtcccatcaaataatgatggtgagaggttctcatcctcttatcccagccggagtcggtcctcccgctctggtcaaagctaggctcccgttccccgatgtaataggagcccagaagtcttcacccattaaatggtgaatgacatgggcgtccctcgtgtcaggcggcatggtgtggtaggccccacgaccgaggcgacgtggatgcggcttccaagttaaggaacaagacatgcatttaatgcaaagatggtaatacttctcgaggaagttagttgttgggcctatgtggtatccccttgaactataaaaggaggaccttgcccactgagaaaagggacgatgacgacgacgacgacactcagtaggcctgaactctaggagaagaagagcgagaatgctctccggagtttaggaacccttgtaacactcaaccataattccaaacacaggagtagggtattacgcttcttagcggagcgaacctgtataaatctcttttgtctcatcgtctttggggattgaacgccctcaagatcacacagcttcgctcaccaagccctcgaatctcacccgctgcccccggccgaactcacaaaggggggcctcacggttccctgatggaggagttcattctccgacatctggcgcgccaggtagggggcgcgttcgtgatttttgaggttctttcgagcgccggcgcgataagtgttgcgccgccaatgcgggggaaggcgcagcttcctcaggagtgccgcaccaccccaggcagggggccaggcccccctcatcttcaccggataaggctggcggccaggtctttatggcgagtcttcggaatgaccgatgacccccaaagtttcggcccagcctcaccgaaaggtaccacggtagcatcaacccctccgagtccctccagatccacacgacgatcatagaggcggcgtggggtgacgaccgggtcaaggcgagtttcttccccatggcccttcatggccaagcgcggggatcgctcatgaacctgccacctgcctcggtctactcctgagaggactcttgcagttgagctccgggtgtcgtcgaagcccgggaccccctgtgctggctcttccatagcggctagttttggtcccgccggctggctacggtgctcggcccggctcaactaatcgtcctttcaagcttcaagtattttcattttttcaattcatcagcttaatacagcttgaagtcttatatttattttcccccgttcttttctcatggccatatgacgctcgcgtgttgcgcatttgtttgctccctcggtggtaaaagcccaacctctctcccatctacatgaatgtttcctcgctaggtgtgggggctaagttttctagccctattctagccttaagttgagtgtcgggtgccgtcgaagcccgggaccccctgtgctggctcttccgtagcggctagctttggtcccaccggttggctacggtgcccggcctggctcaactgtggacggggatcgctggctctagagtttttcggctctcacacacgggcgaaagtagtcgtccgtgtagaaggaagagatattgaaaggaggccaccgaaaggaaagatcaaacagaatgtgtagcgtggggacacaggcttgtgggaacctaacctcgtttgctaagtggtcgcaggcttcccaaagtggttagggacccatggagggaggccctcttcaagctaaaggtttgaaaggtcgcgacatgcaagcaaggtttgtgtttgcttcattcatacaaacgattctttgctaaaagtatgggggctacgattcctagctctatcctagccctgcgtcgagctttgggcgccgtcgacgtctgggtccccctgtgctggctcttccgtagcggctggttttggccccgtcggctggctacagcgcccagcttggcttgatcgtgggtgaagattgttggctatggaaaatttagtcctcgcactcgcgcaaagatgatcatttgcatagaattattattgcttatgtttatctctcgcccatctcttcctcgcggtcccgcggtacccacgtgtcgcgcgctggcttgcctcccttggtaacaaaaagtttgtattcacctcatccattcaaacgattctttgctagaagtgtgggagctatgattcctagctctatcctagccctgcgtcgagctctggtcgccgtcgacgcctggggtcccctgtgctggctcttccatagcagctagttttggccccaccagctggctacggcgcccagcctggcttgatcgcgggtaaagattgttgactatggaaagttcagtccccacgctcacgcaaaaataatcgttttgaatagatgaagtataacacgaacagaggttaacaagaggcaggggcaagcaaggtacgcggcgtaaggtcacgggcccgagagagtctaacaacatttgctgagtatatacaggaaataagttcacgacctaaggtatgggctaaactcccgagcccgcagtgcctcggagaccgggaggaaagtgggaagttaaggcgacgtatgaacgtgactaaactcccaccgcccaactcccagaatgataggacagaagatcgggcccgcatgtcaactgactagcagattggtgtcaaccctgatcacctgggaaaggttttggccagggctaacgccgggggctactgtcggtgatatgagcccgggggtatcatgtttagagggaggaggctggggtggcggccactccttcccaaagactagtcggaggaggctgcccccaatgccatgtggccctcccccaaggggagtcaggcccgaggtggggtggcggccactccttcccaaagactagtcggaggaggccgccccccaatgccacatggccctcccccaaggggagtcaggcctgaggtggggtggcggccactccctggccaagactagagggagaaggctgccccaggcgccatgtggccctcccccgaggggggatcgagcccgaggtcgggcggcggcggccccttcccgtgactagggatcgggctcccccgaccccctctctaggtcaccacgtacaggtgcccacctactcgcatttatggtgacccgagcggtcgtgcggcgtgcagtgtactcaaccggtctgtgaccggtcgaataaccgatgggactggctagtgcgcctgtgcgctgcttttgtgtcaggcggcgtgcagcctgacatgtcccatcaaataatgatggtgagaagttctcaccctcttatcccagtgtcatgaccggcaatggtgacactgaaaaagttgtaatcaataaagctgtgagagctgccagaatccaccaaaagtaacaagactttactgtgaaccaatgctctcaaacgaatagcagtaggaaggtgagctcctgtcaactgcagaccttatcgctattctccgttacaaaaagacgagattgagaaacaggtgaaagaaatgattgatgctggtttaattacacctagtatgagtccctatgcatcacctgttttacttgtcaagaaaaaggatggtagttggcgtttttgtgtggattacagaagattaaatgctctcaccattaaaagtaagtttcctatgccggttgttgatgaattattggatgagctctcaggcactaaattcttctctaaactggacttgaaagctgggtatcatcaaattcgaatggtggaaactgatgaagccaagacagcctttaagacacatcatgggcaatttcagtttagggttatgccatttggtctcacgaatgcaccctccacctttcagtgccttatgaactcagtccttgcaccatttatcaggaagtttgtgttggtgtttatggatgatatcttagtttatagccctgaccttgatagtcatttgcatcatcttcagcaagtttttgttattttgaggcagcaccagttgtttgctaggaggtctaaatgctcttttgcttgcactcaactggaatacttaggacatatcatttctgacaaaggagttagtactgatcctgagaagacagcagcaatgctggcttggcctgtgcctacttctgttactgaattgaggggatttttgggactgacaggctattacagaaaatttgttcagggttatagtatcatagcacgaccattgacactcttgttgaagaagaaggcctttctttggactgatgctgctcagcttgcttttgatcagttgaagacagctatgagtaacactccaatgttagctttgcccaattttcagcttccttttactttggagactgatgcatgtgcttatggtcttggtgctgttttaagtcagcagggtcaccctattgcttattatagcaaaactttgggccctgttaatcagaaattgtccatttacgaaaaagagtttctagctattatgatggctgtggataagtggagatgttatctgcagagaggtccatttatcattaaaacatatcacaaaatcttgtgtcatttggatgatcaaatattggggactgaattacagcaaaaggcaatgactaaattgatgggtttgcaatattcttttcaatacaagagaggggttaataatattgttgctgatgctttatctagaatgccttcctcctctcaattttgtgctttttctgtggtccaaccgatctggattcaggagatgatcaattcttatacagtggatcctcaagctcagcagctactagctgagttggctgtgcattctcctaattctcaagggtattcattgacacaagggattattagattccagaataagatttggattggatccaatgcaggactgcatactaag

SEQ ID NO: 74361 - DNA, 4739 bp, Oryza sativa
tgcaccccaacacatgggtattcaactagtaactgcataaatgaatatcttctatactacctgtagatgaatctgccaagaatgtcaactggctcactaacattttattttatcttccaaaaatgtcaagtgattcactgacaccttggtaaacaccccacgcagagcaacaacagaatttttttttatctagcaggggaaaccccataacacaatttattgaaactataaatatgacaggagtgcctatcggagctctggaaaatccacttttaagtaaagacactttgagagcagtaatgctaaactgaaactcttaataggtcaatgctagtatgctgttccaacatagataacaagatcacttctcacagaggttaaagataaaacatatatatttattctaggagtgtacgtaatcagagaataaagatcatgtgttttactgagcgcaagagaagacactatgaatgccatggaaatacctcatatacttttctgcggtcgtgaagtaggtgttgtggctccaattcattcactaaaaaaggcctgacatttatagaggataagactgctgttacaaaatgcaagacaactgggagatatgggcaaactaaaatcaccaaatgtaacagaaaaggtaacctctattcacttcaaggaaaaaaaaaatcaccctcaataaggtgagctggtgagggtgtgaggcggttcttactttaacattttatttaaagtaattaacagcaaagaaattccagtggttgtaagaaacagtaaaagttttccactttctcaatgctctcttgatcaactcatgtccagtgagatatctggtatactacacagatcaatagcaatgttccaatatctagatgcatataagaagcttgttgataagagttggtgatggaagatggtgatgatgtgcagtgtgctccacactacactgattttctgtggatgggtctttgcaggcaagggtgaacctttctagggttgtagaaaataattgcatcgtgtacacatgtgtatatatggatgaatagtccatatggttgtatttagtttacatttaaatataactatttgggcattttttgaatgagaatgcatgacatttatatgaaaaccagtgcaacgtatggtactacactagcaaaagcttaaaataagacgtaagataatattgaagaggaacaaacagaacttcaaaaataaaaggaacacttccttgacgccggcctagttgtctaaatgttgtataagaatcatcatgtacattccaagaaaaatgatacgacaaattataataaaaattttgagaagtgctctataaatcattttagaaacagggatgtatttgctaaatcataatagaatttatgccaacataacaatgtagaaggaaacagttcataccttcgtaaagcagcataagcctcagcttttttaagagggaaaccagatgaatagaaggcaatcaagcaatcgcattttggccaactggacataaaatgcagataagtgagacattactcgtaaacttacagccaagcatgcactacatttatgccataaaaaaatactacagaagtagtgtggataaacctatacttgaaaagaacaatgattaagttatcaataacctgagttgtcattacatacatctcaataggatcctcgagaataactttatccccaaatattataatctgcaagacaaataaataatgctgaatgacaattgatctgaaacatttcaactttctgcacataacttaaacatcaattaataaaatgaagttcagatagagtaattaataatgagattaagtatgcctgagataaaaaatagagaaatttgaagcgtaaaataataagtacagtccaggtttatcaacaggtttgataaaatatatgaagtatggaacataaaacaaaagaagcaacatgatgaattaatggaagcaaggagtaattagtgacatgtgatgtagctcgaactacggtaatgcataaagaatgacgaagtggtcagtggtcccgagtagaatgcaaagaacaacatgcaaatggattaatatatgcatgccgtggaccaaatccgatgccttatcgtctgcagaaagttaagatttccattgcatttcacaccattgtttaattgatagggaatcccggttcatattaaagcaccgctcaatagcttatatacttaaaaggagtcaacattggtgcataaaaaatgggggatatggagtactcaagtgctaacattcaaatatttaattgacaatagtggctaaattatcggtaaagcaaagtaggcgaacttaagtccacccaaaaagaatattgcaaagaaactgagagatcactcgtgtccagtacagattaagggacctagttgctataagacaaaacatttggggacaaaccgcaaaagcaaccacatgatggggacctcaagtactggtatccacaaagaaaagatgcagaataaattggtatccacaaagattcacggatgtctcgccataaaatatttcgaaaaagcaattttttttaccaaaaagaagaaaatttatcgtatgcaattccatccacccatccactgatccacatgacaagcttcaatcgcacacccgtttccacttttgcaaattgatcgaacaaagaaagagaaacggcttggaaaaaaaaatctcgcgtacctcgaattctccaaatgcacggagcctctcaagaatctgctccataggagagcagaacacctgcagagaaaaacaaaaaaaaaatcaagagattgattagaccatatcataatcatagtcaagaaccagcggcgcgactagaaacctcattcctcaagaaccggccaaatcaatcaataggcagccgcagtaacggcaacaaggcgaatcaaatcaagaaccagaaacgcacggcaacagcacgaatcgatcaaggaaccagagacgtccaaaagaaagaacagataagtgattagtgaacacaggagagatcgaaaaggaaaaaaaacgaaaggaaaaccaaatcaaacagccatatccatgcgttcgcggatcacgtgaaccacccaaaaaaaaagaagagaagaagaagaaaaagaaaagaaaacgagagtcctagaaccaaagggcggcaagatccccccgaccttcttctccatgacgcagacgccaatggtgatcgagtcggcgcggccattcccctccaccaccattacgtccccctccccgctcccgatccgcgtccacggagcgtgcgcgcgaatctggaaagattcccacgcggacgcggggggcctgactcgagaggccaagatttgatctcctcctcgggtggaaactttggaagagaccggagacgctctccacctctccgtgttccacacagctttctcctctccgccgccgccgccgccgccgggttggtagccgcgggctcccgctcgcagtcgcaggaaggaggaaggaggagaaggccgaggctggctcttatcggttgcacagtggagggtggaggcggtgctgtgggggattgccttggttttaatgctgtggccacccccgttaggttaatgaatcccgtttgctttcaaaaggacgtgactattcagagaccgcaatctatactgtcttaactgagactcatcttgcctactaggacactaaataatacatgtattttttcttcttcttacagatttttcttttaaattatttatctgatttataatccgattacactattatgttcgttgcaattaaatctttataacaagatattacatgactatattttaataaaagaaatatctatgttataaattacttttattataggaaaaagtacgaattacccacatgaactatcgcggtcgtccgaattaccccctgaaccacaaaaccggacattcttcaccctcagttatataaaccggacgaattacccctccttacccaatccacggtagttttggtctacgtggcgtacacatggcagttcagtcagcattatatatatgtatatatatatatatatatatatatatatatatatatatatatatatatataattgtaggacccacctgtcatacactcttcctctctctctcactcttcccctctctctctcacggtcatctgcaggctggggcggcagcctcggcacggagctacggcggcgtcggacggtgacacggaggcggcgactgagggaggcggcctccgcgcggagctgcgacggcggtggtgacgcggaggcggaggcggcggcctcggcgcggagctgcgcgttggcgaggcggacgaggcccgcgcggccgcgggcggcgtgccgtcctcagcctcagcgcggagctacgcgttggcgagctcgcagttgcagcgcttccagccgccgccctctctctcctccctttggcgcgccctctctctcctccctccccttgctgcagttgtaggggttggccgggaaccggggagccttgaagaggtcctcgtctttctctgcttgtgtggcaaacaacaaaggcaacgaaatgcatagcatatatctccatgaccgacctccataacacggtgacagaaaagaatcagatcgcgaggagacgaagaagacgattgatgaccaactatttcaggagacaggagagagagggcgcgccaaagggaggagagagagagggagggaggagagagagggtg

SEQ ID NO: 74362 - DNA, 7621 bp, Oryza sativa
accatggcctatacataatttttattaagatctctagtaaattattaaggagcgtgttgtgtatgcatggcactatggcccaaatataataaatcgtgaagacatgaattaattgaggggatatatataagcttcttttgtatatacggacgttctaatatattgacgtgcaatcctttggcgcgttcgaaaaaaagtatatacatatgtttcttcacttatccaatagtggcattctcctcgttttctatatgctctctcatgaaattcattgcctgctgacacatgcattcgtagtttcctactccctctggtatcaaatatatggatgtttgagggttgtgctctttggatgcaaattattgacgttttggtatttgattgccactttggactgctatacctttgcatgcatgtaatgcttgtcttcagtagctcatcaactgtagcaggctcccaacttcccaagcaacgacgcattaactccagctttgaaactaaaggccatagccacacaggtcgcatgggagtttttgataaaagagctacactaaagtttttaataggggtaaaacaggaaataggcaacctaattaatcacttcttggtaagtgagatcctgtccaaaacgtcaattaatatagaaccggatgagtactaattactccctccattccataatataaggcacaaccactttttttagatgttccataatataaggcatacatgcatgcctacaattaactactgacatcttctccattaaattattaacttttttaaatccttcactctcacatcctctaattctattggatacatgcattgtatttattaggatgatccaaactacaagatgataataattatttcttgatatttgggttaagagtggttgtgccttatattttggaatggagggagtagtaaactccactgctgctagctaccccctccgtcccaaaaaaaaaacccaaacctagctaggaacctacgtatatacatgtctagattcgtagttagggtttatcttcttttttttttggaacagactagtagttaataggattactgtaacaaaactatattggtgtatatctcaatagtgcttctataaggtcagagacagaccaacctggtatgaaacagattaatggctgtgttcgtgtatagaggttaggaacacatgccctgcacacggaaaacaaaacagtctattagcgtgtgattaattaagtattagctatttttttaaaaaaatggatcaatatgattttttaagcaactttcgtatagaaattttttgcaaaaaacacattgtttagcagtttgaaaagcgtgcatgcggaatacgagagacaggggttgggaacccatgattccaaacacaccctaaaagtactcaacctcagtagatcttggatcagatttatactcatattactccctcaatcccgtaatataaggcgcccacgcatttcaagattcctatcttcaaaatattttgaccaatatttatgacaatatgaattgaattttacttgctaaaagttatattattggattgacatttgaatttactttcatatgattacaattttgttactacacagattagttataatatatgagaaattataagacaaaaattagttttggaggccgtgtcaagtttgatcctgccttatattatgggatagagggagtattgctcaaagagtaagactcatatgtggttttgctatgtctaaatattgttgaagtagctgattgatttttcactgcggcgtctgaaagttccctcggtttattctaggttcctttacctgaaaaaggtgagatgtcaacaaaagaagccattgaacatagaattcagcttgttaagaacaaacacagttttttttcaaagaaaggaactaatatcataaacattaatttatttactgatccagctgcgaaatgtggaattctagaagaaaaagatactaaatagatgatcccttacatatgtgattggtccctctggatttcttgttctcgatgcctccgattctcattgacacataagttgacatagcaaaactgaaggataagtagactccattctcctgtgcttcttggtagctactcctacatgccatctgtgctctgttttaaaaacaactggtttggcctttcttctattttcccctcggctcgttttgatacctcatataaccttgagtagctgcaaggcgagatgcagaactggctacggagaggggggagggatggtggatagagtgattacagcaggtacaatagatcgtttttgttggctacactgcatccatgctggagaaattgacgagctggagtaggaatgaatggaaagagagtgaaagcgagcgactaaataagcatcgattgctcacccgctcttattggatctctgcagtagttctattctcacagagagaatgattgaacagggatcaaaaggatatggacatgcgtgaaaagcttagattaaaaaattaagaatagatgcatagtgtttgtaccataaattggcttataattagtgcatttactcaggctaaattatgtaaaatagttggtgtgattgtttagtggtttaattataagagtagcgcaatttatatgtgtgcaggattatttggtgcactggaaggttaaatctggtgctagcttgttgctcgatggtctgcatgacggtgattaaacagaagcagatggatggatggatgtggtcatctgattttatggatgcattaggctggctgctggtgctggcgtggcgtgttagagctgatgaagccggttagcgcgtgttgcggcaagatagatagaaacggattagccggttagtttgtttcctttccgattaaacttttccatatttttgtgggatcaattaggattgttaaagattgattagagtgaccagtatatatactggtgacgacagattagaggaaaccccgaacaaaattatcaatctactattttcctgttatttactttcctgttattttctattttgttttcatggctgagttttgacaaccctagaatttagttaatctttgccgttttgcgctgaaaaacggtcgtgcttctccaaaaaacgagaagattatcctttgctagttgctcggaaactagtcgttcatcgtcacgtaagtacgatatttatcctctttgctaatttgcttgtaaattagtcgtgtgattccgcgaaagtgaattaatctcgaaatcggtttcactagccgattttgatctatcgattttggcgactctattgtttacaccgcaaatcattaggtgatattgtgttggccacaaaaaaacgtcaacacatagcaaattgggtgtagataattttacatctacttattgtacacatactacttttattcactatttctattactgatgtggagatttttggagccagcgatcggctatactattaaacttgctcttattgaaacagatagtttggaggtggtggggatgctaacacagattggagtaaaccgttctatctatgggacaatgatccaagacctcaagaacatgttaaagacgtacttcctgggaaatgaaggtccaatgggtgcagcgatcggcgaataaaagctgctcatttggtagtcatggatgcgtgacgggcgaaacatcgaattggttgtcgattccaccagtctttattgaccatattttaaaggaagaatgtaattttgatagctatatttggtagttcattttgtgaggtcttaccctaaaataaatttttccggaagcaaatacatgacaaaaggtctctgtcttagtgtattactccctacgtatttcatattataagccgtttgattttttttcctagtcaaactttgttaagtttgaccaagtttataaaaaattctagcaacatttaaattattaaattagtttcattaaattaaaaatttgatgtattttgataatatatttgttttgtgttcaaaatactactctatttttctataaacttagtcaaactaagagaagtttgattagaaaaaaagttaaacaacttatgatttttattttgtttttccatggtgcttcccatcctcacacttcggcagatctctgaggaacgggtgtcacatgagatctgtaaccagatggactctacaatgctagtgcataattatcagtcatcactttgtgaatagtcaccactgactcttgatcaactttgcactgcccgctgctctgtttcatatcactgaaaaagtaggtcaatcagaaaaaaacatgttacaagatcagatatacataactggagaatagttctccagtttgtttcatcaaaaaaaaaaaaggtgcaccacaaactgaattttcttaccatcactcctagtgtcggtgagtttcttttacctaatgcttcccatccccatgcacatatacttccagaaaacgaacaatgacgctgctgggacagtagacagagtctacaatgctaccaatgttcagatcgattccccttcgtcattgccttctgtcctcagttctttctcctgtttcattttggaagttatattaaggaagatagggatcagacactgcaagggaaatgtggtaggtgttccattgatgttggtgtttgttagtagccgctgccattgcatatgccattttgcctaagatgaaaccaggaaagcaaagattttgtaaattagcgtaagaattcagatgtcccctccttctaagtgcactggtggagctcggaggcaaaccggataagattttactccctccgtcccagaatataagaacctagtataggatgggacgcatcgtagtactacgaatctggactaacccagtccagattcgtagtaataggatgtgtcccatccggtattagattcttatattctgggacggaggtagtaatttattgccaccgatcacggcgattttatcttcttttcttgttagggaagaaaaccaatggaatttaatctcatcccttaatttgtataggtagttcaatgatatgatcatcccctaaaatgtcatttcatagttttatagaacagatgtaaagcagattcagcctgtgctagttcactcccaaactgcagttcactagaatatgtccatatgcttctttatttaggttatactccaaagtgattttgaattttgaagtttgatttttaaagaatagttttaggtaaaattcgtacttcttagggatcatgaaaagagaataggctaacgaaaatgatagagaaatccctaaaattaaccttacaaatcaaattctagccatcaaaatcagatttggattagctcagccaagcagttacacgttcgctcattaggggcctgttcaaattgtagccaaaataaaccttatcaaattttggtattgccaaaattttagtaagaaggtaatattgctaaaattttggcaggatttcttatgtatttatcaaattcagcaacaaattgaacgtaaacattttttttggcaactttataaaaaaatggtatggttaaaaatggcatcaaggtgaacagttcctaggtcttcgtgtagtgattactaggattaaagtttgattcaccgagttggatcttacctattaattgtatgatatattaggattagggaggcctgttgtgtatgccccagatataatatagatcatgaactaattaagtgatatcagcttctgttctacatatcattcggatgtttttgcagtttctactatatatttgagaatatcaaaatttttactcaaaacaacgaaactccgataggagatacatacatctacagtagtttttatgctttctcatgcatgccaaccctgccattttctgatacacaattgttcggcttgttctactccatgtattagtaaaaccaaacaatcagattagctcctctgaaacggagagaaccaccctggtctgcaataaactcaactgttccagaccttgggccatgtctggactcgggtccatctacggtttcgttgtcagagtacggttgaaggctttgaagcaaagaagcagtaggaggcttatggaatgttgtgctgcgaagtgctgtatgagttcattctaatatggttctcatacctgaaaaattagacgagtaaaatcaacaaaagagggcactgaacatactaaaattcagcgttttgaaggaaaacacagcaaaagtgttttaaagaaaagagttatttctatcataaacatttgttcgctgatctatctgaccagtgaaattctagaagaaaaaagatttggttacttacaatttaggctacatgatttggatttcttgttcttgatgcctccaattctcatggacacgtacaggagttgaggcagcaaaaccgaaggaaaagtgcagtctattttccagtgctacttgctatctagctacttctagagtgtgtttagttcacgctaaaattaaaagtttagttaaaattggaacgatgtgatagaaaaattggaagtttgtgtgtgtaggaaagttttaatgtgatggaaaagttgaaagtttaaagaaaaaatttggaactaaacttggccctagtcatttgtgctatgctataaacctagacccaaaccaaattggtttggtctgtcttttttttttcttttcctcggctagttatgatgccctaggctacatatatatactcattctgttatttaatcacaattagtccaaatagaaatacggtatcatgacttttccccttcaaaaccaccatattactcctctagtttaggcgccagaactcatgaaggaataatgccaaaatcaccaatttaatggaatcgtatcctctgtcattctaattggaatggtagagaactacagtggtccatgccataagctatttatagccgttagatcaaatttggatggacaatattaattgctacagtacattccattgtttctacggtgatttaactgtttgtgaaccccaatttaatacacaagtagtacacagatagatgcaataaataggtaatcaatcatgtatgcaaatccaaccaatcaagcatttttgaaaaaaaaatgatatattacagtttactaatacgccatcagtaaaatgatgttttcacgtaaccatttttttgtattagttaaaaacgtgctccgttttactcttttccaactcaatttagacgaggagaggaacagggagaaaataaaaatgtcacgggatttcctcgataaaccaccatgttcagtgacatgccttagcctcagtttgcgaataatcatcactgtctccaaaccagtgctggctcctccatattatatccctgaaaaaaaaaagatacattggagagaacatgttacaagatcagatgtacacaactggagagtagtttcctagtgtgtttcataacaaaatcatgccatgtgcaccaaatttctcaccatcactcttggcttctctggccttgtttatgctgatgcttcccatccccatgcacattagcacatatactttcagaacccaacactttgtgggaaactagatatactctaaaatatgctaccaat

SEQ ID NO: 74363 - DNA, 25846 bp, Oryza sativa
ccctccccaaccctaaccctagcccccgcctccgctcctcgccgacgcctcgtcctcctcgccgccgcggcgccgcaccaccaccatcaccaccgccgccgccgcgtctaccgtcgccagcgcgcggcgccgacgcagacgcgggcgccgaggaggacgttgtcggcgtccaatgcggcccgcggggaggaggacctcgaggaggcgatctacgagttcatgcggcggtccgacaagccgggggcgttccccacccgcgccgagctcgtcgccgcggggagggccgacctcgccgccgccgtggacgcctgcggcggctggctctcgctcgggtggtcctccggtggcgcggaggcaggcagggcctcctcgtcggtcggcgtgcaccctgactaccctcccgaggcgggggcggcggcggcggcggggggcgcctccgacctagcgcagggagccgtgtgggcgtcgtccaggtggggttttgctattcccttctactggggtattttcttccttgcccccctctcccgtatgaattccagctgaaattcccgtgcgtttcagggaggcggaagcttcgccgtccgggcgccagccggagacggaggaggaggagacgtgggtttctgctcggcatcgttgctctgtttgctcccttggggtgttcgtttcttcctgattgtgttcgtttgcttgcgcggtggtttgcagggagacgaaatttgggactgggttggacgggatgcttaccaggctgcagagggaaagggagagggtccggccgccgctcccacggagcagcgatggagcgggaggggaacgcgacaatgttggtgcgttgggttttcaattcccagcatattcttcagaaacatcaattgttttcaattgtgcatcatatatacttgcttcgcaaaaatagttttacgtgtccctagggaagcattaatctgactacatttgagatgatagcattgatctgactacatttgagatgatagcattaatctgactacatttgagatgattagtccgtgtatcagtgcacttgttgcccccatggttacagcttgtggaatcgtggctggctcctattcagtgcagtactgcagttccttgctggcaaaaagaggcattcatgtcagtttatccaagccgtctgatttttgcggatgacggtcttgtccacaaaccttccctacttctgcctccagtagggaatttcctaaatcaaccattacaattcttcactcttgagtactccctccgtactcataaaggaagtcgtttaggacaatgtttaagttaaaccttgggaatataaatcataaataattctcaagttgttgagtttgaaaatctaaaaattatatgaatagatttgtcttgaaaaatactttcataaaagtatacatatatcacttttcaataaatatttttatagaaacaagacgtcaaagttgtgttttgtagaccgtgtcgctgtcctaaacgacttcctttatgagtatggagggagtacctagtaaaatagttgcttatcagttgtccacatatagctgcacagggggccaaaagttgcctttttcacagtgatgtgtctttctgattttaacaccagttacaatcaagagtaatagtaaaacaaacatcatatgattaaacttcaaatgtagtgtgtgcatgtatgttatattctaagattgaccatgttttaggtattttatcgattatcgcacattcatggtagtcttagttcacttttagtatcatcgaacgacagttatgtcacccactagaaacttataaataggagaagtgaaattgaatgtttgactactgatatcactgattaaatcatgcattgtaattggcaatattgtaaatgaagtaaaacgaaatatgaagtgattatacaccccacaatttacaatattattaatgaacttttggtttgtcgttattggataacttgtttgtacatatttgtggtgttccttttggatgtattatctacttccttttctagtttgtatttgcatataatgtgtataactgaaatcatccttctgtgttgcatatatgcagctttaatgggtcagagtggagcacccagtcactctgcaactggtggcaggtacactccaaaggtacctgataatggaaatatacatagttatcatcctcaaaatggagcactagaacataacaaaagctcaaagagtttgactaatgatgcatggcgaacatggtcccttgacaagggtggtttttcagattttcaaggtcatatgactaactttcttccgtactgcatcccatttgtttgatgattatttgttgacaaggtcaattgttgcagctgctgaaatccattcaactaacagcaggaaatcatttagacatgatggcctagacattcttgcacaagatgacgtgcacgggccatctaatggtgtggctgtacatgattatgatattaatgatgtagactctgaaagagacgatatacatgcacgccttcaaaatttggagttggatcttactgccgctcttcatacattaagatcaagattcgacaaggttatatcagatatggtgtgtatatttcccctaacatcatcaattttgctttcatttgttgtgaattactagtggactataattttttgtgcacgaagtgttttttctgcatctgtaaagctgttagttttacgtaaaaattctgctgccacacaaacaaaagaagaaagatagttccatttatttaattaaacttttgtatgtctaatactccatctgctttatgctctcgggaagtgtgcaataaaaaaatgtattttgagtttttaacttgcagtttcctgattaaaatgcagattagagacgtggaaatgatatgacttgattttccattgaaatttcgttcataatattgtaatttttaactataatgtatatttagcaacacttccatctggcagctacttttgtattgcaatatggcagttacagggcatacaaatacatgaaacactagtggatgaagttgtgctttgtgcctctcaccttgatcttgccagaggcactgtactcattgttctaagcatccaactttgttgtttttttccagtccgaaggtgacggagcaaaagcaccaaatgggctctccgacgattgggaatttgaagagaccaaagtaatgcaagctcaggaagagctgcggtcaatccgtgcaaaaatagcagtattagaaggaaagatggcactggagataatgtatgtccacctaatatctgattacctatgctttaaattttgtatgttcccttttagtaattgtataccatgtcatcagtgagaagaacaaaataattgaagagaaacaaagaaggcttgatgaagctgagaaggccttgagtgagctccgtactgtttatattgtgtggtctaatcctgcttcagaggttctattgactggatcttttgatggctggacaagccaggtgaacatttcaaccagctctcgattacctttcgtaatatttgaacttcgctaaggcttaggatgattgttctgccatgtggtgctaattttgaaagataatatgaaaaataactatcatgcgtctatgtggctagtaggtttagaatcctcatatggatatcattgattttgcccatttaagtatttgaagttcagtgggaatggcttgaacaattcagattgtcctgcacttgcttaaagtagatttggtccagaaggcataactgcatcatacctgactggttctggttttgaatcgtaattggcaattcgatgtaacaagcacttgtatttcatataatataattttaatgttaatgaagccaatctgacactctacatagctctgtacttccatgcttgataacattcgcattgttaccttgttatgcttattattatggggcaattgcaaatttaccactactttgaatcattattgcaaaactgccactagaaaattgcaaaaatgccactagaactgtcattcgagtggtatccttgcaatattcaaaaaaccggtggcaaatttgcaaatgcccctattattatatgttcaaattggaaagttttttaaataagtgttgtgtgtacatttttttatcatctgaaatctgatgataatctaattccataacattgttgactttgtgcagagaagaatggaaagatcagaaagaggcaccttttccttaaacctgaggttgtatcctggtagatatgaggtaatggtctgtcttattatgcttccaggcattattattttcatctcatctgatagcccctctgcctattctccagattaaatttattgttgatggtgtttggaggaatgatcctctgcgcccccttgtgagcaataacgggcatgaaaacaaccttctgactgtcacttgacttgaagctccatttgtcaatcctggtagcatttttgtagattgttatctagatctttatcaacatgattaggccaatccatccagaatggaaacaaaaaaaatgagtgagctggttagctctgttccaccctgtaattatctgcttcgccttaagtcgtcgttctttttctttggtagagattcttacaatttaaacagtgtaagggtgttgtcagaatgcctcaccctgttagataggagaagagaatagttgtgtattcttttcttccccgtcttttgcccggagaagtatagttgtgtgatgggtatccaggtgtctggttgtacaccttcatggaatgtggttgtacatctcttttgtggtgacaaaaactccccccgccggtaactttgcacttgcagaagctttaggttttaaaggtggtcgcctcacttgcgagttgttactacgccttaattacgcaatcttcttatgccagcacagaggatctgatatcacagaggattgaattgtgtgctatgcaagaagagagctctgttgaaattgtgattttctgacgctttgagtatgaaattattgtatctgagaccaggttgaactctgatggagtgtggctgcatgaagaggaaaaggcaaacaaagtcatacaagtgcaaacagcaaacctgaaggttcattcaaaactatttcatttacttccttgtgaatcagtcaaacagcaagtagcgatttactaggattgaagattcatttatctttgaattttaaccacttacaagaaaccaacccttttgtttctttccttctctttcctcacccacttaatcctatagattttataattcaagacaccacagatacaaaaatacaagagagaaatgatgaggcagaaaaaaaaaacccagctaaaagcactccaccaattaattatctgccattgacataattaattaaccacccaaacgaacaaacttcacttcacttgcatctcagttggcggctgcccccttgaacctgtaccacttggcgcagatcatgaagtagatgatgttgaagatgccgatgccggcgatcatccagtagaagaggtcgagcctccccttgttgaggtcctgcgccagccagttgctcccggcgccggtggtccggtgcacgatggtgacgaggaacccactgaggtagttccccagcgccaggttgcagaaggcgagcgcgccggccacgctccgcatgtgctccgggatctccttgtagtagaactcgatctggctgatgaggttgaacgcctccgagagccccagcaccatgagctgcggcaccatccacaggctggacatggccgagatggcgcccccggtgatggtcgtccccagcgtcggctgcgtcagcgcgatgtgccgcctccggtcctccaccacggccgacatcaccatcgccaccgtcgacagcgcgatcccgatcccctgccgctgcaggagggtgaggccctcgtccttgcccgtgaccctgcggaggcgcggcacgaggaggcggtcgtagatggggatccacagcgtctgcgccagcatggcgaacaccgtgaacgacgccgcggggatctggaagctccggccgaggtgtcggtcggactgcagcgcggacaacaccacgtaggtcgactgctgcacgacggcgacgtagtagatgatccccgtggaccagacgggcacgatgcggatgaggcacttcacctcctccacctgctgcacgctgcacagcctccacgggttcgacggcgcggcgcccccggcgcgcacgtcgtcggggccggacacgatggccgccttgtcgaggcaccggaactggtccgtgtgcgccagcttggtgacgatggcgctggtgtgcggcgggtcgaacaggtcctgcttggggtccttgggctgcttgagcgaccgcttcctcgccgcggcggcgaacacctggacgatgctggtgaagggggagccctcgggggtgacgcggacgtagagcctggtgcccatgaagaagaggacgcaggcgaggagcatgagcgcggtggggatgccgaggccgatgggccagctgacgttgctctggacgtagatgatgacggtggcggagacgagcatggcggaggtgaaggtgaagtagtaccagttgaagaagctgttgatgccgcgcttgccggactccgtgtgggggtcgaactggtcggcgccgaacggcatgctgcacggccggatccccgccgaccccagcaccaggaacgcgaacgacatgaacagcaccgcgaactgccccgacgtcgccttcgagcacgtctcccccaccccgcactccgccgggtgcagcccgtccgcggcggccgtcatcgtcagcaagaacatgccctgtccgtccatcattggaaggaaaccatgcgttagtacattggagccatcgttattttgcaaacgaaaagtaatttgtgaataaaacttttatatacttgttcttagcgatttaaaagcaaaggttgaaaaataaacttcgatgagaaaacctcaaaatcagcttcaaatttaagattgaaaattcaaattttagttgataagttataagcataagcgaaaaacgagggcctttgaattggatgattatgggctttgagtttcgtgtaataacccatgtgaacttaaatgggccattagttgggccgagttctgtctgcacaaccagtcggcccaaaacaacagatgcatgcgagcacagcacacaaaccgggaaaactgtttaaattaaatttgtaatctgatgatttgaacactcttatggctgattatcagctgtgtgatcctttttttacttaaataataacataaaatttgaaaaaattatccaatataaaattatgttaccgttccaatagaagtgaccttcagaatcaagcagctggcccaccgcccccacgagcaccagcggcgcaagcatcattcgtcagaagtggctctcgctatcaaaccatactattacacgcttagtactactacctaaatggggctcatgattacactacgtcattagtactagtacgtggttggtgatagtcaggttggttatggttagggaggtggtgtgacattgatgccgcgacgtgggcagctcactagtcaattcctggagctttggatggcagcactgactctcacttgggagcatatcgttttcgtgcgagcaagtgcgagaaactaattgatttttttgtacaggtgtaccgaaatgcaagcgcagctaagtactaatggtgtacagtaatgctgatatattccaggaattgggggtgagctagctagctggtcaatgtcgatggccacaccaggacactaccccacttgcgcagttagttggcagtcacctccatacagattgtccggataagatggccggatccccaacctcacttcagcctcaatggctgccactgttcatcatctcattgcactttgcacttggcagcacagcacagagcagaaagttcttatgcttagcctaggccccccaagattctagcacttgtactcctactagatgaaccgtacaaaattactgcaaatccaaacaaaacgcaagagatttccccgttctaactaatagtgtcttgatagtctaatcaggtactattatcagtgtgaaaacatgacataatgtaaccaggttggatcttgggatttcagtgctacggccttccagagtttggccttagaaaaagacaccgttcaagtcaaaacacaactacaaattgaactggacagtggacactgcatctcaccaaccaagcccctgtactacgtagtactattattgttgaacagagttaattaaaacttgaaaattatccgtgttgcatgcctggcaagccaaggcaccgtttggtccccatgttatttttgtactgaaattaatacaggcgaaaggttaaacaaactgaggagaggaagcgagtccacttcaggattcagcacagatcgagatgatccactaacccaatccaaatgctcaacaagttcccttacaaacacagtttcctatgtttaaaacttaaaattagcgacgtgagatccacaaataatacagacccagccaactgcctcgactcctaaataatgcattttttttgcaaaagttcttttttagaaaaagagctttaaaaatcatattattccttttttagaaaaatactaataaatcatatgctaataactaataaaaagagttaacttaactaatcatatgctaataaaccactctgttttccgtgcacgggagattaactctcaaccccatctaacgaacacaacctaagtgactatttggtagagctcaaacttataaatttagcttcaggagttgggtctgaagtggagttgtggatcggtctaaacccagctccacttctttagatcattttgtgagagcgctctacccaaccccactcctattttagatggagctgaaactttagctgggctccaactacaatagaggtgtagctgaagctattcaaaacagaactaggtgtactactcctatatatttgtacatataattgtaaatatgtccacgtcaaataggccataccttttttcttttacaagaaaactagggtgagcatgcaacaactactagcttagactgatgatgtgttgttgttgtacatgggttatcagaaaaagaaaaccagctgctagtgtgggcagaattaatactgctgcccacaaagatagataaaagtggattatagggcatataatacggattagaagagcgctaatcatgagccactgcgccgctgcaaagtgccgctttggcaaaaggggagcagataatgcagggcacgaggctaaccgatgtaggccgccgcctctttgggaaagctactactagtattggcagattaacccattatttccagcaaaaatttggatataaatttcaccacagaactaaattatactaatgtcgtttcaatttaccgcccaaataattaaggattgaactcttctaatccacattcgccgtgaattaattaattaaaaataatcacgagcgcacaagcgcacgtggttcctcgctcactttgccgcccatttccatcgcagagaaaagaaaaataaaaataagaataacaaaaaagaggccaactcgaaagtccaacacccaaccgagctactgacaagccagaggccaccaactcccgattttctttttttttttaaaaaaaaaaacaaatctgaatccgagaagcgaaatcgcgccgcccccaaatcgcagcgacatccgcctcaaaattcgaagcccggcctcgaattgggaggcgaatgcgtggcggcggcggcggaggaggaggggaggtgggcttacgatgagggaggcgacggaggcgatggcgagggcgaggtagcggccgaggtaggcgtcggagaggaaggcgccgatgatgggggcgaggctggtggtgccgttgaggccgttgagcagcgtcgccgcgtccacgctccgcatgtggaacacctgcgtcaggtacaccagcaggttcgccgacgtccccagcgtccccagcttctcgaacgtctcgttccctgcacacccaaaccccccacacctccatcagccgccgatcgccgctcgccggcgccgccggagggggaaaacgatcgaatcggcgatctcgccgtacctatgatgaagggcatggccctccagccgtggtacttgagggcgggcttgtcgccgccgttctccagcttgtcgacgtccatgctcttcagcttctggccggcctcctcgccgccgccgccgccgccgccgccgccgccgcgcatcctctctcaccaaccaccacctctgctctcctccagtagaagcgaagcgaccgacgcgggggaggagacagagtgagagtatactgactgcctcgccgagccgagttgccggtttataaaagggaaggaggaggagacgcgcgattcgtactagtcgtcagtcgtcacggggggaagggccttttttttgcttcaaacaacctagacttttcgtttattgcaacaaggtccctgctgccaaacttttttcttctttcttctttgctagttagttaatgctctcccttcacactgcgtcatgatatttttgctatatcttcgtcgccactgacttgcacgcgctttttttgttgagacaaaatgtcttaagggcacgtttgcgaagggtgaaaacggagcgaattcgaacggatagtggtcatactatatcctaacccatattttttttgagtggattcggagcagatgcaaataatgtacggatgcggatgcggagcggattgtttcagatgtcagaaatggtgcggagtcagtgtggaatcagttcggaaacagattaaatttatcggatgctacgtgtatatgcgatcaatgcaacatccagttagaaatccaaggaacaacgatacaataatcaataaatgatccatcgtaataattatatgattaagtgctaaacaacataaacacatgatgttcataatataaaaaatatagctacgtgagtgtgacatgagacgataaaaaccttagactaaaaaatctttgttaattgatgaattagggtattggatgtaccaacttatgttatatgcaatagatagagtggttatatatgttgataatttcggattattcggcaaacagcttattggataatccgataaaaatgtcggataatccgcatccgccggattttagagatatcatatccgcatccatatccgccggatttctaaaagcccatactatatcctcgtttcggacggattcgatatccgccggatttctaaaagcccatactatatcctcgtttcggacggattcgatatccgccggatttctaaaagcccatactatatcctcgtttcggacggattcgaagcggatcagatcagatattatccgaatcgttttcaccgctaacgtttgccatgtacaagttttgtacgatctttttgttttatgaattggttcattttaggcctggtgccaaaaggtttgaaatttggttcaaaagttcaatgttgttgaaggttgagatttatggctatatctattgtactaaaaaataatctagctttatataatgcaagttaaatttttacctcaaaatatctgctcctacatctatatagaagtttctttaaaaaattaaataaatacaattttaatgttataatatttaattaatcatgtactattgactcaaatcgttttttataatgtctatcatctcagccaaactactgaatcgaacgaaaccgtaatgttggaggacagagctgaaaccgatggaaatcactagttccaagtcaattgggtgacttcgcatggttgaaaaatttgaaaatggacaaatggaatgatcttgagctacctaactcaaggtcctaaagcatctccaacagcctccacatcccactcttcaagccaaattttagttattctagcttaaaaagcgctccaacagcctctccaaccagatggctaagccttccagctggccaaaaccctccttccactagccaaatttgaccactctatttggctagccaatggtgggcccacacagccaatctcctccatccccacacggcaaccgaggagaggcacgggaggagcacgagcatgaggacgagcacggcgaccgccggcctcttttcgccgccgcaccaagccagtcgccagcctccacgtggcgccgcctgccgccttcgctcgccacggccgccggcctccacgcggcgccacccgccgcctccgcgcggcgaggctcggcgccaccgccgctcgctgttctccgtcggcccgtcgtcgcttcacgtgcccgctgtccgccgtcgccgtatcaaagaagatgatgtggggatgatgcaatagtccagtaggaggaagggaaatatatgtgtggggaaaatgggttggaagaggaggaagaagagtagtagagactgacatatgggtcctatttgtaatagacttgtaatagagagggtagatggagagactgttgaagtgaataactagtttaactagccaaatcagatggagagttgactatatgagtgtttggagagtttgatttggagagactattggagatgctcttactactaccacactccctcactcaatcttcctaaaacaccctatccatcatccatattacatatttcgtaacttatatctctctttttcacgcgcatattttccaaactgctaaacggattttatttcaaaaaagttctatacaaaagttacttaaaaaaattatattaatccacttttttaaataatagctaatatttatattaatcatatgtgcaaatgaattactccgttttgcgtttgcaagaggttagttctcaaactcaataaaaaaaactcagcctgataaactgtaacaattatttaaaaacgaagacggcgttttctgacaacacgataaacatcggggagtcaagtagtttaggagctagctggccgtggtcctcccctgagatcgctgtcgagttaggacggactaattgaacgaacgaacgaacgatcgatcgatcgagttttgcctttgagtccaccgcacggcggcattccggtgagcagtgcaagctgctgctgtctctgtcgccgtcgttgcctgccgcgacaaagtccattgctgttggacccttgtgcaaaaatttccaagcgagtctgttcagtgatgcacacagctcgtgtcctcttcctttgtgtgtatcgatctctagtgatctgataacgtagcgtcgtcgttgagtccgagtttgtttttacacccgaaaacctgccaaatttcagctgaatcttgcactccatgctaattagcgtcatcgtctgtccctactacatctttttccaattttgttaaagtttctgaggttacaatagtaattgctggattatctggttttattttttaggttatttgagggttttaacgaatgaattaacagtttgtacgaaatattttatgaaagcattgataaacagtttggaaaacatgtgaacgaaaaaccataatcatgaaagtacagggccttggagtagtacctaaatgatgtgctaaaccaaccggttggcctctcttaattagctttccggtgagacgtgaggggcatgttgaaacgtttgacctttccagctgctagtccaagaaatgagaagcagaaacagagccgagcagaaagagtgatggttaggtcagttaggtgcccttgagagaagagaagaccaagaagatcagtgcaggacaggatcagcgtgtggtatttgggggggttgttgaggggtgcttaaaccgattgataattgcattgtttagctaccaaagcatgcatcatccatcgatcaagagttgttagcatggcagcatcccggtgactagtacgctactgtcatcgagtgagtgagtgagtgagtgagagcaaaatgcaaacctcctccttttcctctctctctctctctctctctctctctctctctctagctttgccatgtttgcaatggccaattggccattattgagctcatgaggttccttaccacatgcacaacaacacgcaaagcgacgccattttctttctttccttccttcctcctttctttcttcccttttgggcccatggccatggccaatggatgatgtatggggcatgcacatcaacatcgaatgacacacaaaactttctcctttctgttactagggtgcttgtagtgtgcaattgattgttgtgtccaatgtgtgacctacgttagggacggacatgggagaggaatccgagttgccagtcctaggattgcctgcccttgtgtatgcatacaaggtccttttgctttgaaatggtaaaggaaagtaacatgtactataatttgtaaaagtaacactccctctgttcctctttacttgtcaccattgaccaatcatgtagaacactaatctttctaagcatttataattaaatattttttgcccaaaagacgatctttcaatgtttaattataaattgtatatggtgacaggtacatataaaaagaatgagtatttttttataataaaaaaggtaattttatcataaggtaccaggagatactatatttttttataaaatttgataccttcaactaattaagtacctcgagatgcctagcgtaaaattttgatacctactaacactttcttaatgatcctgaaatttacatcttcagtctccaccatttagatacatagccagagttgtttgcatctttatttacctgtcattgttgtttagttgactggcatctgtcattggtccgttttgttaatcacgctgtggaatgcaagcaattgacctctcatctgaatctcgttagctctcaggaattccttatttcaaaattcatttttttctctgtccagagatgcatccttttctattgtgcatgatgcatgaaccattttggttaactgatgattggtcgcctcaaaaaagtttctcaaagattcgtcaaaatgagtgggcgtgtccgtccttttgcatcgcattggattttaaacaagtgaaccaaacaaaacactaccactactgtacctaccttgatcgatcgatcacatggttgttcactaactaaataataattcaaaaatgattcttcacatgcacgaagcttcagctatgcttgaaattatatttatatacaggccgtgtacatccattcatgtatgcatgatgcattttgttaattgctagttggtgcttgcttttggtcgttatggatcgacctacccactaaatatctgtattattagtactaatctgtaaactaaatcaaggaaaatatattattggtatacatggttgtctcctggatctaagggtgtgagtgtgtgactgatatgtgtggagaagcaaggttgactagctggaagctggttaactgtaccagtattagatagactatgggcatgttcactttgatgttatttttaactttaccaaattttggtaaagttgccaaaaaaagtggctacatttagtttgttactaatttttggtaactatataagaaatcatgtcaaaattttggcacaactatactaatatcaaaatttagtaaggtttttttttttgccattaaagtgaataggccctatcatactctagtaccatgcatgcaacatcatgaacagtggttgagaacaatgcaatgcagtgcaatgcaatggcttgaagaattaattgagacaagatagtctctgacgtggacttggtttggattaattgtagtactaacaatacttgatcagtcaggctttgggggtgaaagaatctcttatgggttaaactaagggtgtgtttagttcacgctaattttaaaaatttgattgaaattggaacgatgtgatggaaaagttgaaagtttatatgtatagaaaagttttgatgtgatgaaaaagttaaaagtttaaagaaaaagttggaaactaatccagacctaagagttaacaagtgaggagttaaggagtactttactgacacgaacattattacccttatcaccaatccgattgcgacgtactgacatgtgatacagccagtgagtgccactgctcattggagaatttttcttatcctgttgacagagatggagtagtttcagtacagtaccgtctaaccttcagagaagaagaacctgaatgcatgtttatgagggcatccgatggcgatcacaagttgaaaaacagtctaatcacccttctaaaatgtgcacgcgattaagcagcaaccatggactatgtgctacagaaaccactagtacagtaggactagtggactactagtaattgacactgtcaaatagtaacatgacaaaacttagactgatcgggcacgtgacggtgacacaccaacatgccgtccttgtgttgcgtttgtgtactactccatccgttctaaaacaaattaatctaattacaaaatatataacacattataatataacgaattagattattatatcttgtcctaatcgtgattggttgattttgagacggacgactggagacctgagtatcatctgtggggcccacattttcggggtgtagcggtcgctgttttgggctgcttgtgtaccctgcaatccatgcattgcagatttgcaatcgccaatttggccttccattcgtcattgtcagagttacagtaggcaggtcagagtcaaggcgagagagaaaagacacggggattcgtgtctattcctttgtagcgctgtgtttagatccaaactttggatctaaattttcaactttttccatcacattacatacacacacaattttttggtcacatcgtatcaatatcaacccaaactttcaactttggaagaaactaaacaggctgcaggaatactagtacaagccaggatcagaggaggttggtagccacgaagaactcgttcggttgttgcttgctgcgttgaattgaatgcagatatacggctcgaatgatttcttccatccatgtacggtgcatgcacgcacaaagcttttggtacagctttggacagatttatgccaaagctagcaccaaatttacactgtagatttgctacccacccagaggatatctcatattctcatgtttccaactaaaacagaggcttaacggatcaccttatcgtagtcggttcatacacaaccagcggcggccaaccgacattaatcgatgttaccgggtaattcttgttataggacatgttattgagttacagtataaaagtattatgctgctgactttagaatacatatttgatcatttgtcttattaaaaatgttatgtaaatatataagatataaatcatgtttaaagtactttgaacgataaaacaactcacaacaaaataaattgtaattatgtaaatttttagaataaaataaattatcaaacgtgtgacaaaaaatcagtggcgtcatctattaaaagacagaggcagtaagatataccgaacatgaccatatactgaaatcagatcactgtatttttttaaagtagtgtcaagaaggctaattgacacattttctttcaatatatgtttatcctttatgatccaagcaattaggctattattttacatacgatgatagcagcatgtggagactggagagttgttgtgcatgcatgtccaactgatcaagcgtttgattcattccaggaaaaaaagaagcttctgtcacccaagaccggggaagaacctgatgcgtgcacgcgatgctacttatattattggtgctatctacagataatattggcacaaatcattatgatcgttataataacttcgttatagctatgcttaactacccagaattgacgtctccaatatatatatatatatatatatatatatatatatatatatatatatatatatatatatatgtactttagcatatatttgttgctatatgctgcattgcaatcagtacaggcgatgaaaaaaaaaagtgtacagacacacacaagaaagttggcagctataaagtgtaggagagccttgtctgttcttctgtctctcgcaataagatagaacttgctgctgtacaccaccgaacgcccagcccatttaagggctctttggaacaagtaatcttggaattttcgaagaaatttaatataaagttttttcctatataatcatttagattaaaggaatggctatctaaaacttataagaatatatacatttggattggcttaaaccataatttttttgaagggattctaacatgaactttaacctcttagctagaaaaaaaaatcatcctacgtttttctatttatatatatgtatttcaaagaagtcctaattgagtaataacacatataatagaccatttctgatcgttggatttgaactatgcatatatattactatacttttccctattaaattaactcgatatgcactactaccttgggagaaaaatgcgaccgatattgatcattcattcatttctagcagcaacaaccaaattcctaaccgttctcgttggtaggctgtgcgtccttggtactccagcttgagtggccatatgcatgcagattgcagaggcagaggccaggcaccacggttaggggtgtgtttagatcacaccaaaattaaaagtttggttgaaattggaacgatgtgatgaaaaagttagaagtttatgtgtatagaaaagttttgatgtgatagaaaagttaaaagtttaaagaaaaaatttggaactaaacaaggcctagatacatcgaaatatggaatgagctaaaagatagaggcaagacaaggacgtgcactgatggacgcacgcaccaccacaacaacctaaagctaaaactaaaggtgtgaagcactcctatgctccctcaatcgcccactctatctatacatgactacatatatatatctcacctgatctttttttcatatacatgtatgaaagatgctgaagctttatctaatttattcatccctctactatttctatcaggatccatccctggtagtcatggaatcgatcatcttgcttctgtgaaatcaatttgttgatttagccttgatgatgaacaattgtcaaaggtaaccaaaaaaaatggttgagttgatgtttgtaaaattgtggtgaaattggtaaagtgtcagaacactggggttcttactaatacagggtaagttcgatttataccatagcagtgagtattgtctgcagtactacacgttcagtagcaaccgctgatatgtgggattgggtccacctatcagccactgctactgtagatgcagtactaaggcctttcacagtgcaacaccgtggaccggtgctccagctcgacacgtcggattcgagcttgtgtggcgtcagggtccgctccccagcagaggagctcgctcccacgaagggatgcgcgattccactttgccgtgagcccacgcgaggcgaggaaacgacggcttttttgcgctgtggagcacctcgccccgctcgctcgtgccctcgcgccgcctgtggaagggttttccccaagatcaccctccaaaatcgcggcaacaaatcaacaaatcgacagcagccgtcctcctgcttctgctcctccttctcgcggcggcggcggcggcggcagtggctgtcacacgagtaggtggtagccggtgctgcgcggctcctccgcggggtctggaggcatgggaggagcaagcggcgtgggtggcgcggctcctccgaaggccgttgtcgaagaagagagcgccacctcgccagtgcaagcaccccaacccggtgctcacctcgcccgcttcctcctcgccggccattcttgagccgctgccgccacgcacgccgagcccgtcgacgccgtgttccgccgctttggccaggttgatgctgagctccactgccacacgtgttgagcccgtcgacgctgagctccgccgcggcagccggggacgccacccgccaccgaccgcgccgaccaaagccgccacggcatgggaggcacggcggcatgggaggagaggagaaagatgcacgacggcggaccgggaggaggagcggcagttgaggcggagtgggaggaggcgaggcgcgagctcgcgaccgggaggaggagagttcgagagaagctaagggtaggtggggaaattttatcgccccactaccccatgtccacgcgcccgaggtcacgcgcaccgtggatttggaccgaatcattcggttacctcccacactacattaatccaattaaccctttcggctaactttttaagttaaaagtacggatctcatagcttgcactgtgaaaggtctagagaggatccatgtccataccataggtgtttgaacgatcactcagaggggccggataacggcgatctgacttcgatcctacagcttcgatcgatcagcagccttggatgcgatgcgatgcgtggatggatcgatcaggtggcatatcgctttcgtaccgacgagacgacgaccaaagtgcatgcaggctatagctttggatcgattcgtcgtcggttgggcttttgttggggcacctgcaaggtagctaggctaaggtaggcgcttgcttgcattgcacacacactcgcattatattgttggatcgttccgttccaacgcgtccggagtaacaaaagttggttggttggttgggttgggttgggttagttagttgacaagtagtagtactaatttgatttagacgtgaaacgattatatatatattggtggttcgttggttgcctgggtcgtggaggccatgaattcagaagcttaattagcagctgcgtttaattattattagcggatgcaacactggtggattcgctagtctctccttactatatatacatacatatgatctactgttctaagtatatatatacacgacctaactactttgctcggccgctatcatctctgtttttttttcttttcactctgcatatcatttccaaactccaattctgcttcatttgtttttttcagcttgattctgccggcttcatgttggttagttatagtatcttattaggggctaattttaaagtagaatggggcttttgagtccaccaaattaacacctcttttccttcggtagtcaaacctcgcttggatgggccgtccgtctgcagcccacggggatcacctgctacagcaccaaaccagagcaatgtggatacaacatgttcgtctcgtcgaaatggggctgattgatgcttgcttcgttttaccaaagttctatagctaaagtgtggcataccgcaatttatgtggctacgaaattcttggccataagttagacaaatgttggcaaagatatgtgactatgacaaatagggtcacaaaatcaaaaagtgtgacatgacaaagatgtggcaactaagcaaacactaggctaagttggccaaaatagcttgccaaagttgtggcaaagtatggtcaccatccaaacaaccccggaatgcttcaactggaacagcctttttatggccatttgctgttatgagattatgacctcaataacatgggctgtgtttagttcgcgtgccaaattttttgaaactatacggacacacatttgaagtattaaacgtacaaaacaaattacagattccacctgtaaactgtgagacgaatttattaagcctaattaatctatcattagtaaatatttactgtagcgtcacattgtcaaatcatggtgtaattaggctcaaaagattcgtcttgcgattatatgcaaactgtgcaattggtttttttcgtccacatttaatgctctatgcatgtgtccaaacatttgatgtgacgaaaaaattagaagtttgaagaaaaatttttgaatctaaacacggccatgttttcagggtgtgtttagtttatgttaaaattaaaagtttgattaaaattgaaatgattgatggagaagttgaaaatttatatgtgtagaaaaattttagtgtgatgaaaaagttaaaagtctaaagaaaaagttacgaactaaacctggcctcggttagattgctgagaattcatttcacgaaatgtcacagccaaccctaagctcaatcatgtacagagaccgaagaggattttaactcttgcacgcaataaaaccttgtgccatctcagtcaaagtctacttcctaattggacacatcatataaattaaataccttctgttctgtactgtgtgtcctactccctccgtatcattttaagtgcaaccataaattttcatagccaactttgatattccgtcttattttttaaaaaatatgattagtatttttattgttattagatgataaaacatgaataatattttatgcgtgacttatacttttattttttttaataaaacaaactattaaagttagacacgaaaaattatgactatacttaaattaggaccgagggagtgctttagattcagttgagctagctcgatcacatccacgatgaccagttaatcagagtccacttaatttcaaggtcagcatgtggccatgggctccattgattcttctactcctaccttgtcaacatgagattgagacttgacttgagagagtgtgtaaagtgacgacatgaacccccaaaaaaaaaacaacaacaaaaaaaaaactgtagttgaaacagagaggaaagagtgtggactgaaatggacagaaggccaggaatctaggcaaacgtatgtacggcttatggatagatagcaagaccgacacttgtaatggcgtcgaaactattcaccgtccttttctgacctgtcgagtagcaaaattaatttgtgtggactgttgttagcgcatccccatcaagagccgtcagtgttctatctttgtgtgatgaatgccaacagcttagaaaaacaatgagtagaacgagattttaaaggggaactaacattgttagtttagtaaaatatgcaaagcatccggatgcatatatatgaattgaacttcatggttatagctaagtaccaatatatatagtacatgaagttgctaaatgctaagtgaggagcatttcagaatggaggtagcaagactaacctttgttattcaactggttattagcaacactctagtcggtatcatcaaacgttccatctttcaatccggcaaatctgcaaattttgggttactatcaaggatgggcctatgtggttgccctgtttttggttgggctagtggacaactttgctccatccatctttctctgtcggctgagcccatgcaaccttcgcctcctcctctgttcaacttcgtttataaccatcttgccttctactaatctgcacttctgcagttaacaggtcaaaaatagcactccctccagttccatgattcttgtcattttgtacaatatcacgatctcttcatcaaagttctaatagtttaaccacaactttatccaaaacaagaagaattacagaaccggagagagtattaatcaagtcgattacatcataaatacaagaggggcaaacaaaaaatgttcagcaacatagagcctttctcatggcaaaactgttgtataagtgcacgcaatgctttatttccgaggtatacaagcatcgtgagagatgtggcacattgcatctccctatctatacggctatatatggtgccaccagattctacaaacatgcaggttagtagtggcacccagcaccaatgaccaaacacatcggtgtgttggatttggataccatgcaacggatatggggcaaatttacaatttacaggttgccccaaaaatgccgccagctccagcctccttaagctatagtattacgttgtgaattgagttactgcatgctattccagagagcagagaatttatgccctcaatgatgcattggccggctgtcaagttgccccgctcattttcctgaacttcagagggaggaaattgcttgaatcggcgttcctcttcttgccaaaactgctaggtgtgacaccagtcggtgagaccaaggaagtggtggtgtttcgccgaaacctccccatgttccaatatgagaatccatcatgttggcttccagaactaggagaacgcatagcaaaatttcttggtatcacactttgctgtcggtcatggatatcctgcaagagatcaagagttaatctgcagtaatacaacatgtaaagttgtaaacaaacaaatgaatccagccttggactactacaattcaattggtagttattggtatcctacagtttctgtttatgataagatctctatatgttatcctggaacaaatcaccaaccaacaattcaacatacaattatggcaactagcatggcctgccatcccttcagccaggaaaaaacaactcaagagtaacaatcacaggcactgacgttagaaagatccaaggtgaatctgctgttcacttagatggttcaattaatttaagattaagacttgagtatggaccatgaataagagttggttgctgacaatggaaaattatgagctcttgctagcaagattactcttagacaacatgcttctaggaaatgtcaccttataagttgagtgccactagttactaggtactccctccattccaaaatataaggcataaccacccctaacccaaagaccaagaaacaattattatcatcttgtagtttggatcatcctaatcatatcttactataaagttatcccgcactaactccttaagcttaacatgcaaagatgccacatcatcatccactaacaagatgccacatcatcatccactaattaacaagatgtcacatcatcatccactaacaatcatcacatttaaacatcatgcaaacatgctatatctttatagtttttataatttaagagcttttcaaatacaaacatgttaaattatcatccaacataattcacataatgtttcaatgtatatcttcatgcaaagatgccacatcatcatccactaattaacaagatgccacatcatcatccactaacaatcatcacatttggacatcatgcaaacatgctatatctttatagtttttataatttaagagcttttcaaacacaaacatgttaaattatcatccgacataattcaaataatgtttcaatgtatatcttcatactaaattcccgcagcaatacgcggagtttcacctagtaaatacaatgcatgcatccaatagaattagagaacatgagagtgtaggatttaaaaaagtaataatttaatggagaatggatcatagttaattgcctacatgtatgcatgccttatattatggaacatctaaaaaaaaagtggttgtgccttatattatggaatggagggagtaatgattagcaagatacaattgaagacatgggagaatgaagacgtgtggtgtctaggaaactgaacttttgaaagaacgacacgagttaaagccaaaaatatttaactttttatggtaccatgtcaacgattagacctattttctttattttcgtctattcggattttagttaccgcttgaagcactgaacatcttcaattcaccacatatagatcttgcacaccttccttttgatctaacttgatataactcacctacaatcacgcacaatcactatgtaaataaatttctatgggtaatgcacttgtgcagcactccagctttacggcattctaattaacttgatagctggcaaaacctgacagaaatttactcatcccttcaacattaatgatgtttgatatctagtaagctgaattgtgtaaacttaagtga

SEQ ID NO: 74364 - DNA, 23667 bp, Oryza sativa
attcctgcagcccctgcttctccgcggggggggaaacgcgatgggttgggcgggaggggggaggcgacgacacgagaaagatgaggaggagggggggagcgagacggccagccactgctgccaccagtggcgactggcgactggcgagcgatccctctgacgcatggggccctgggcaacccaacccctgttgctcctcccttcttggacctttctgcactgcagagtgcagatcccaatttggcaatttgcaaccttagcaccgcgacctgctcaggtggctacagctagtagcctgcgtttatgcctgctattgtacaactctatccgtctcattttaagtgcagccgtgaatttatttgtttaatgtttgaccgttcatcttattttaatattatcattattatcagataaaaaatatgaataatactttatactccctccgtcccgaaatatagcaacctatgactagatgggacatcacctagtacgacctatgactagataggacatcacctagtacgacttatgtccagatacatcgtactagatgatgtctcatctagtcataggttgttatattttgggacagagggagtacattacttaaattttaaactttttcataaatttttcaaataagacggacagtagaacgttggatttagaaatacacagatttaaaatgggacggagggagtagtagtaacagagtagatatgcgcaaacaaggagcatgtgactgatggttggtcctttgatgcgacttgggattttgtggatatggaggagactgtacaatgtgccatcgtggcgttctctccctattttgatagggaacgagatcatatatgctacattatttggatttgagtcactaatatatggtttatttattatgatttatgtgtaagtgatctagagtcacctggcatcatggtagagaatccgtgtctatttgattgagctaaatatggtgatggcggtgactatggcaatgaaaaatgatgtcggtggtgaactggtgatggtaataaatagaactgcctgtgtttgtaatttaatgacatgacgtgcaaatttgtattgttgggttgttttgttccagttgtgtgaatgtaaatagcgttgatggagaaaatataatagtgtagtaaaaaagatttcatttcgaaattgatttggactacattgaaaaggctcatttgtgacatgtgaaagggaacacgggtggttgctatatccgagagatagacacaaacacctatgggtatgtccatacctctcacatccttgtcatcgtacgcccgacaaatataggacaacatcaacctcacatcatcgattcgttgataacttatcgtaaacatttgagaaatttttcagtgagcataaaaatgcacatctccgatgatattcaacattctccgcggcttgtctgattggattgccacgcaattcgttcaagcagaaaacggtgacagctttgacagtgaggagcatatgacaaaaaggccaagaggcagacacttccgttttgttattatgggctgaagagagaatagagaaagctggaaaatcacagctatggaggatagccggtgccaattatttcatcgttggtcgagacggttactggttactggatgcatgagaggccatgaagttatttccactgaactgattgtgtgagctggatggttgatgagcaaacaaacagcaaaattaaattttgagtttatgagtgatggcatggggtgtagacagctgcggttcaatgttaccatcggattctccgttcatcattaagcagttcttccatttcaaaattttgccaaaatttaagctggactttttcctcgggccgatttgagagacggctactccttgccaagccaacctgggattttccttaccttcgcatgctttagttcaatatagttcatgctgcgagagtacgccgtgccaaattgtcgatacacagattttgaaggcgtacctgcatatatatggattgagatcctctgacttcaagttagagaggcgtgatcattgacatgtggatccgattgccagtgacaatgacttcgactaccattagatgacatgttaacatcatcttccgcgagcacatcgtctctggccatcatgtccaaatgatttcctgctgttggttgaatgaatgtcagcggctgcaacaatattaaccatgtcaacaaatgtttatccaacaaatgggatgcaagtatagaagaatgttaagttctaatatgacctcgaaaatctgaaaaaacaacccttgtcaagacattccgaaaatctgaaacttttacggcagcttcggttctaacaaaaaaaaaaaagggaagctattgcagtagttccgaatcaaaggcaccatatcccgtatcttgaatttaagtagacatatcctataatatttccataactacaggcggtttcccatttaagtgactaaacaataatccatctgccacaaacatgccaaatcttgttgcgtgcgcaggatttataaccatttactagatgtgtagcctctttaacgtatcatgtttggctagtgctacatgaatagagacaccaaacgaacacatcatgaatttaaatataacggaattccgcaacagtatcagttaatctgtatgatgatacatcggttgacacaccccttgttcctgggtcaccacggggatcttctcgaacgagaagagggaggacaccagctgagctccaagctttggatacagaatcacttgcatcacccaaaatcaatgaggaaactgcatcaaaactgcatgcagcaagtcaagatctcgtgcagctgcactgtcactagaaagttcacccaaacataaaaggctaacagctccaagatagtgaagaagagctgcaactattgatgtcgtcatggcagctgatgacccaagtccagttttggcaacttcaggtttgctccagtcattgttccataattccattagcaacttctgaattaaatgtaattggacagaatggaggcagcgaaagcaatacttctggtctggagttagagggaggccacgtgcttcaatctggagaaacggtggaaaaagacaagttaattatttaacagcggcacaatgctccaaaagtgagttatattcagacataagttaatcatggaaagagagtatatttgcagtttataaaaccatgcaacccatccgcattgatttttaatttttatttttgcagctggttcatccttcacagttccattgaatatttatttgtggacacaatagaggatatcatatcatgaccacacagagtacaatacaaaaacttttcaactttataaagtacataagagaaaggatagacctcaaagcaatgccattacattataaccaatcgtgttcaatttattgcagttacagataggtgaaatgtaaacatttgccaatggaatgataattcaattagcagagaatctaacatcaccaggtatcagatatacagagagaaaatacttattacaaagcataaagcatatcttctcccttatggttctgcctgagccaccccttttcagtaaattatccgagtagtcatgaaaaattaccaaaagttttgttcagacatctatccaggaaaaaaaaatcagctgaaaattactacagattgtcaggagggaaagaatagaaggctttttcttaaatccttaattaggcactggcaagtggcaaccgtgtttgttagtgcttttcgtgggatgcgaagaaaatatatgttcaagattaggtggtcagcaaagctgaaagaatcaactagggccacgttcagattaagtcacacttctttgttaaattctaacctgggattggtgagttaagctcttggctaaaggaaagcaaatgcgtgacaacgcaagctaattcagaaaagaagctttacctgttctctataggaataaaaaatcgttgcaacctacaaaaaatagagatgagaatttaacaacgatacgaaatcaaattatagcgtggtattcaaaatgattcggacaggagcaaaacttgagactaaaatcgcaaaaccttgcaaaagcaaagcttgtccagtgcatccttcccctctttgtcagcgactgtcacttccgcagctgccaccgagaattgcactgtcttgttccacaaaagggtttgcagattccctgcaacatcaagtcattaaccactatcaccaaacatgattacatgaggtccaagtctccaatgacaactacagagcagagttctgctgcgcaaatggtacaatcccagcaaatgatcatggactacttaccttgaggacgtcgatttcttcggggagagcttgtaggtggcctcccgggagagctgaggagatgtcactttcacattcgtccacgcctagtagcaatttaccatatgggacaggtaccacacagagtaaggattagttctccctgatggtgatggctactaaattgtgtgagaaataatctggggtttcgggggctcacccatgcccaggattcgtcgtgggtgagctggtcgcggggcgggaggacgacggcgtagaagcgagcggtggtgatgaggacgaggccggcgttggggcgctccagcacctaggaaacctcccgcgacgagcaccttccccggcgccgacgccgacgccgcccccctgccctgccctgccacagggatcggtcgaacggtcagacctggatcgagggctaggcaatcgaggtcaagtagagaaagagaaacactcacacttccattctcggcttcggcggcgaggggggacgcgatccggagctcacggccggcggcgggaaatgccgggtagcgcgcgcggcgcggcgcaagcacgacgacgcacgccgcctttcgaggtcgctccgcttacggcggggcggggcataggaagcgaggggcatcgcgagcgcgcgggcgcacgcggtggccggggggaaggacgacgacggcggcggcggcgccggcggcgagatggccttttgcagttacgcgggctcgaggactgggcttggtgaaatggcctcctgggccatgaggcccgctactcttagcttcaatataaaaattttatcctcttttttgtttcttttttgtttaggacaaaaggattcctccgtttccattcatgaaggattcgaattttatcctaaaatataaggaatttgcatgtctaacgtgtactcctgatgactctttatatatataacgactttgtagatattaacatgcatgtcgtgtttaggcgcatttagattttagggcctgttcactttgctgccaaaaaaaaccttaccaaaaatgttggcaagatttcttatatagttaccaaaatttggcaacaaactaaatgtagccactttttttagcaactttactaaaatttagtaaggttgaaaatggcaccaaagtgaacaggcctttagaacacatgatgagtatagcacgatctagtttctatgtgcacaaaattactttaaataaaaatcatatgctacacatggtgtaaaccgtctttattctcccagtcttgtttggcactcggaaaaaaaaaggaattggctgatgttttccctcgttatgcatgctcacacacttttatatcctgtgcgaatgcaaaaaatcatgcttgaagtgtttatactttatagtgataaaaacaaattttaaaaattaattaattaatcttttaagtataacaaatagttaaatgtgtctctaaaattaacgatgtcaattatttattagtagtactatgcaacatatcgtaccatccaatatataaaccactccaatagtaaatcttttggaccagatattaatttcaaggtcatgtggaggtttaattgcatatatgctagtactatagaaatctaagcattagatctggggttgctaaccaatccaattaacaaaagacagccattttgctggctaattctcctgcagcacgtgcccaacaccgaacccgacatcccatttacttttaagcaattttcacaaaactcatatattatactcccttcgtcctaaattacaatgtataaatttttacacatgttttaatgacatactttaaccaataatttattatattttatattcctagcagatataaaattaacatcacattaaagcactttaaaatatgaatctagttttttactgaaagttaaactatgaatctagtgatataacatacataatatttagcataaatatatggttaatatgcttattagtcaaaaactaccaagtttgatcttcctaaaaagaaataggacatcctataatttaggatggagggagtagtccaatttgttttataaccattataaccttatagagtcataaaccacaacattaaacattttttctttgactagtaaggtgcccgtgcgttgcaacgggaaatgctatatatcaatttcaaattatattaagtgaaaagatattaaataatcattgagtgaaaatttattgaacacggaaaaaaaatctggcaatccaaaaaaactacaaatcataattgttctatagattactttcaaagcaagaaatatgttatcattatagaagtatagtgcaaactttctgccacatatataaaacaatctcatggtgtttattaaattataaaaagacaacatagatagaagactttcttatggatgatcacctcaaaattaaattactacatataggtaaataactattctaatgttgtgcacttgcgatacacttaaaaaatcccgtgcaccgctagggtgttgctttcacactcattttgttggtacatcagtagatttagcaaaaaaaaaattgccttagctcgtcaccatcctggacatgttaaatatttataattataaaatatagttacaagcccgcgctagcgctatggtgacgatttatatcgtaaatgaaacaatcataagattggctattaagtatgtcgacgtttgatgtcacgactacagtatttggacagtatggggatcgttggtgctaggatatatgcgagactgaggtaaaagagatggtgacagggatttttatacaggttcaggcccctgagctatcaggtaatagccctacatcctgttggccggagccgatgttgctttttattcaccataatcacaccaatacaatatgtggggtagcctatctaactattgtcgacatggcggtctgaaggtctgactcgtagttgacaacagggtagccttcctcctcgagctcgtgcccgacggaatcagagacagtgctagatccctacggccggcctctgaaggtaccggatagggtcgatccaggcgtatctctgatgtcgatatccgacggcttgtcttggcgtatgtaggcttctatgttgattgaggtggccgtgtctcttcccttcctagggggtcttgtatttatacccatagatgttccattatccaagtagaactagggaaaccaatatggatacaatccgagtagtccttgtcgtttccatgtagaactctggttgtctttccttaccggaactcctcctatatctgaaggttgtttccgtataggacatgatatgtggtgggtcctgccgagatttagtcaacttctattaagtatgtggtatccataaccatgacaaagtatatattcaagacattaattaagacttaagtatcagatagttcaagcaggcaggtttaatgagctgagtacagaagctctttgtcaaaatataatataatacgcaattcttttaaagaatagaccacgctaaacttattgcaataagtttcggtccatttttgcaataagattttagcacgatctattcttcaaataaaattttcaaaatggtcaaattgtcaaaatttcagaaaatactctttgtcacaatataatgcaatatgcaattctttataccataaatactgcttaaacagacaaaacgctaattttagcgaagttacattaagaaggttttcacttcacgtcagaccagcacaaagagcctattacaaggtccttagttttactatagtgtaataaaccagcagccaaagaaactacatccaagacaaggtccatgattcagtcgacgatgttttatcaactccatgttatgcttgatgtcttcagcgtctttctcccacgtctcacgccagtaaccaaagaacgaaagtctgaaccaatttcaggacacatccaatcaatttgttcgaatacataattcatggcttttcaacgttaattaaagcatcacattcatatatcagtacatgacatggcaaaccacaaagccaaggttgccataatctaagctacgaccaaattacagaaatctttgcatttgcgaataaatgaccaagagagaatagattaaatcgcatgcactatttcagacacgtttggtattcacttccaaatatgagagtatgtactaaaccttaggagatatatgattgcgtccatattctaatacagaagtatatgatacttgcttcagataaaatctgacaaggagaacaaaagttcaaactcgtcataaaaaaatgtgtgcgtgttgagaagtaaaattataaaggtaccattttgccatcgttctgaaggagctaactctgttattgaatatctgatcctttttttcataaactcactaatacgtatgagctagctttgattgatcatcatcagctagaagtgaaattgtaagtcaatagtgaagataaatgatggtttagagagagagagagagagagagagagagagagaggggagagggtggggtggggaagggggatgaactcaccaaaatatcccaactgcatacaaccatcaagggtcacgcattcgtgtgtgatagagagctagctaaagggctggcacaggcaacaaaatcaaggcagcaagtgccagaataatgggacatgatcacattcaacgacaagaaatatatagtattttccgagaattgcccatcctctgctagaaaaattcccatgttgagctattttgatctgaatccaaagaaactattaatcaaaaaagagaaggtgcagatttgcagttcactgggtacaaaagttagatgcacctctttaacatttagcagattgctctcgacatatgacaacaacttcccagtcaattgagctattgtcctttagaccctcaaacagctcctccttttgtgtatatatgccttcattatatatatgtctgaaaaaaaccaaacaaaagggggaaatttatgaacatccctgctagttggttattttacaaggcattggaaaaaataagaaaaaaaatatgatctactccatagtaatgacaccctgaaacaaacagatacaagaacaccaataaccgagcacatgggaaatcctaataattaaattgacaacacaaaaaagaaactaccaagaccacaggcagcaagcatgacttggagtgaagaaagctgctaacaacatagggcaggctcccatctgccaccagccggctcagattgcaccagcagcaagcatgttggagtatgcagcaacaatcatgaagcaggataggcttagttggtgatcttggggttggtgtggttgttcatcttgagctgaacaatacaaccataaaatgttagtcctactgctaggtatgaaaactcagttcaaatttttaagaaggtatcagatctatcacaactgagggttattaatagtagaaaatgtaagcagtgtcaactgtagagcagatttacaacatattaattcttgggctagctttaacatatgttatgcagatttacagagatgtagttcactaattaataacctgcaaatttttgtatttgtgcaatggccatctatgagaatttcaggatcgatatatcacgaacattgcttacataatcttcactgcatcgttccattttttattttcatccactctgaaacaatcaaggaccagattagttttgagactgcaagatccaaattagtttgctccaacatataatttgaatctttctgcttggtagcaacactctcaacttcccagcagttcatagccctagagtctatacatagtaattggatatttcattacattagcataaataacaacagagagaatcctgcaatcattagtataaataacaacataggggacatgacaatatgacattctcacttacagagaaatcaatttctggtaatacattggctaagcagcatttcgttgaacaccttttgggcaaaaaagagcattagtgatcctgcaatctgtaataaccctcgacactcacagtgatgattcttgacaaatgaatgggttgcaacgtaaagagaacgaaccaattaaccatgcgtcccttctccggcagaagttctgccggagggatcgtgctcggatggtaccgggggcatggagcgctggaggcgggcacaggtgtcacctctcccatggagcgggcgaggcggctgggaagcagattggcgaacctcgcccttggcaccgacctgggcgaggggcgagtgagggatcggcggcggcgttgatctgggcaaggacgaacaaccccgtcgcaccttgcacttcattctctccctcaacgcctggtagtgtcaccgcgcgcagccgtcgttggagtgaggtcttcaacatctcccatctgtcggctgttgtggcgtcgatgcagggtcagcgtccggtccccaatcggcggggtgtcgggcgacgagcggtggcgacgagcgtgtgaccttgagaggcggaggcgtgcgatggcgatctgcagtggatggatggaagcgggggtgcggccgacggcgagacgcggcggatggatggaggcggtgccgggggggggagtgttggggcgatagggcgggagggaccgggagagcaggcggcagaggaggaatggatcggtggtgcgaccggcggcgagacgcggcggatggatggaggcagtgccggcggggaggagtgcgataggaggagcggcgatgtcgacccgcgacgacggcggcgtcgattcgggcgagcaggagtggcggtcggtgaaggcgtggtgggggcgcggcgaaggatgaggggagcggcgtcgacggttggatagcgagcgcgatccggcctgtgggggagaaaagtgtgattcgcggaggggaggagtgcgtgcgatgggatcctcagcaccgtccgatctgccaatcccacggttaataagtcgcgtgtctgctagggttggagtgactgtcaccactacagaattttaaaaagtagtagagatacaccatgcatgcatatgatatcctgcaaattatatccaaaacatatgttttattaattcaaccgtagtaattttaagttattgttttttattttttacaaaattaagatatggttaacattgtggttctataaaaccttatgaccaaaatacccatgattatacgaacatgcctaacctcctatgtagggatggtaattgtgcccgtttgcccgtttatccgtgggtaaaaaccctattagggttggttttgttcgctattttatacccatgggttttttattgggtcaaaggctatgtccgatgggtaaatgggcataggtattgtcagggttacggatagggtataccctctacccttagatatacgttgtatactgatacggtatacccgcgcgtatacggatatttcccgtgtacattaaggaaattcatcacaagatagatgcggaatccacagatagaaggagtcctactcggacagaactgggtcgttcctgtatcgtgtggggtccgatgtctccgagttctacttagagaccaactgacctgcggtataaaagtgaccccccgggaggacctaaggcattgaatcttactgccaacacatccaccacagcctacgaagtcggagcctacaagagccaagttgccgggtgatctagtcgaaccaactcgactacggtctcgtcggtatcatcgagttctgctattccatttgtaatctgtggattccattatataatcccatatcaactggattagggctattacctattaaggagcctgaaccagtataatccttgtttcctgtttgcttgatgtcgtactacgtagatcctcgtaccagcgtaccccaataccctctatatccggtctacgggtatcccccgtcgacaggtatgggtaacactacgtatgcccgctttgcccatttacccgtgaaatctaacttatattgtaggctagaagcaaaatccactagaatacatcactactacaaaatcaatttttcatggcgtcactctatttttttctctggcggccatacgcataaaccgccattaaaaatatattgaggggtgaggggctaagtaccaccagcgaaaatagattttcactagcggccgagttaacttaaaatcgctcccaacctcacacttctccccaaccttatccgctcctctcccatccccatcccatcgctcctacccatctctgtctccgtgagcccttcctcctccgctcctctcctttccgccgccgccaccgcgcgctcttcctcctccgctcctctctcgcccaccaccgcgcgccctttcctcctccgctccactcccacccgtcgccgccaccgcgtgcccttcctcctgcactccgctcccacccgccaccaccgcgcgccgtcgacactcggcgaccacgacgacgacgccggccgagagagcggatccaccgccaactcaggatccggaggctcctcccctccctctgtaccctctccttctcccagatctagctggaagggagtggttggcgcagaggaggtgatgacgcggtggaggaagaggatgaaggggaggcgcggtggaggaaagggtggggtgtgccgatcagcgacgggggtacacgagagctctggatctgtcgggcggcggcggtgctcggcagtgcacgggtgtcagcggtggtcggcggtgcacgggcggagagacgtgcgagcagcagagctcggtgcgggaggcagatggcggatccggcggcgactcgttcaagtcctgcattggcaagttctccatcggcaagccattaggcaatccggcagccccaagtcctcggatcgacgacggcgtggagctccttcctccgtgacgagctgccgccgtggagctccgtcctccaccgccgtggagctccttccttcgcatcgagccgctgccgggagctcggagccttgggttcagcaaccgctgctgttcttctcgtggtgaggcaatgggtgatgcatgctgggattgaaacattttttttgttccgcaggatcgacagcatggttggcaaaattaattttgatttttgtgatggtgaaattgcactgtgaggccaacatatttgaatcgatgcttgaatttgtgattgtggacttgtatttgtgatttggtgagaagaagaggatgcttgaatttgtaattgagggcatatctgaatcggtttgaatttgagtttttgtatttttgcaccggagaatattttcgcaggcgatcctcttaagaatgcgcctgtgaaaattggttttcgcaggcggccttcttaagaacgcgcttgcgaaaaattgattttcgtaggcggctcttttaataacgcccttaaaaaattggttttcgcaggtggccctcttaagaacgcgcttgcaaaaattgattttcgcaagcggtattatgaccgcttgtgaaaaccaatgattctctggcctttacttactggcggggctgctcagccgccagcacaaacctctttttaccgccagcataaatgtttttttaagtagtgcataagctacgttctttgttttatgtggttttctttttatttcccttattatttttctcccacttcctctatcaccgccagaggagagaccccacaccaaggcagagaatatttaatgttttcagttcgattcaaacttagaagcttgtagacttttgtttcactgattttgttgtagccggtaaacgggcacgcccgcgagcgatgggcatgggcaacaatctttgcccgtcatgtagtaacgggcatacctacgggcaagggtatgggtaggcactgcccgtgcccgtcgcacccgattgccatccctactcctatggttttttgcaacttaaggtttgtttgtatgactaccgtcaagtgttgggtagtaccaaattaaacataggcaagtttggcactaccaattgtttgattgggtaattttgtatttagtttatagtgaagaaagttctagactgctaccaaaattagtatgggtgctaccaaaagtattggcttcaatccaaattaaccaatagtagaacaaattttggtagcaattcaaaactgcccttaaagcataatactggggttttgtaaaaattatttatttcttattttcaccctcgacttaacaagaaataacgaagcggtgacgataacaagtcaaacaggatagcaatttgcttagcttggtgtggcccagtagtttagtttggagttgaaacgatgatagcgaagtgtaaaaggcggtttggatttctcggattttccttctgtgcagcttagcccttttaattagaacaggtcaagcaaaactttgagcctttcgttctgtgagactgatagactacgaccctgtttggatcagggcacatcgaatgcttaacactaattaaaaatattaaacatatactaatgataaaacccaggactaattcgcgagacgaatctattaagcctaattaatctatgattagcctatgtaatactacagtaaacatgtgttggctatggattaattaggcttaaaaaatttatctcgcgaattagctctcatttatataattttattattatacttctaattagtatttaaacattcgatgtgacagcgactaaaatttaattcctagatccaaacaccacctaactacgccatgatttggatttcatgacatgcaccaaggacacacattggtggatccatgtacatgattccgcacgtgtagaaactatagaacagattttctgagctaaacgtagcatccatgattttcacatatatagaccagcaagttaatgttacttgtcaatttcatgaaacttcaataccagttattatgattcttttgctaatttatttttgagataatccaagaaatatcattgacaaacatccaaatccaagaaatatcattgacaagtgtaagttttaagatatgctatcgtacaaacgactttgtctaaaaatgccatcgccgttaggttccgttcattccgcgccgttaaatactataggatgaacaatgcatttaacgacgtggattggatggaaccctaacggtgatggtatttttaggataaagtcgtatgtacgatggtattttttggaactcacacttgtcgatgacgttttctagatttggacgcttgttaattatatttctttattaatttataaaaccaataatctgggatgatggcgtgggtcccttcctcttccccttcagatgttgattcaatcttccacttcccctttatacgttgattcagcagtaacattttatgatttaatttctgtgatttgtttttagtttttggaggctgcgtttgtttcagcctgttactaatctctctccctcgttttccacgtacatgattttcaaaccgctaaacagtgtattttttaaaaaaaagtttctatacgaagattgcttaaaaaatcaaattaatctatttttaaaaaaatagtaatacttaattaatcacgcgccaaagaactagtctgttttccgtacagaggagatgggttactaacccagtaacgaacacagcctaagacttgaatggagtgtgtagaccggatgatgggggtcggcgccatgcaaattggctccaaagtttaagagcaaggataacaatagatctgacggcttattattagccaatcttaaaaccaatatatataatagattagctataagattggctacaattttcttctcccatctctatcttttacttatacatttattgtatttgtcttggagtttgtgttaagctagctcttgcattagagccaacacctttgatttttttatctctcctccatataagcttagagcaagtttaataatatagcccactactagctacaaatcatctatagccaatgtaatagccaattcatacaatagttactcactatactattaatatctagtcccacctatcatacacacattatgtcttggagtctgtgctgcagctggctacagatctgtagcccgctgatcttctctctcttcctttatctcttgaaaatatgtttatagctagcttatagcctgctattgtacctgctcttacagtaggtttgttcccaactccctactctcgttttccgcgcgcacgcttttcaaactgctaaacggtatatttttttaaaaaaagtttatatacgaaagttgcttaaaaaatcatattatctattttttaaaaaaaatagcaaatacttaattaatcatattttaatggaccgctctgttttccgtgtttactgtttgtgttgagaacatgttcgtgtgaacacaccctaaagactcagtgccaagttttgatcaatttatataataagcatgtgtttggtttggggacgaagtgggatgtgttgggttcatccctattttctggaatatgatggttctattttttgtttggttagagggatggagcgcaccctattttttgttttgttagagggatggagtgagatggaatggtcccatcacctgtttggatagagggataaggtgggatatctggataaaaatacttcctcaactagaattggtgaggttacttctcacatgaacaatatatttttagcacctacaaaaatttaataaactctcacacaaaaaatacattcgtagcagccccaaaaatttaacaaaaagataaatatgttgccatatcatgctcaagcactaattaatcatctcatcacaaattacttgcacacatcacaaactaattcttgctcacatgaaaaaaatgtctactgaaagaacatgtacagatctgaaacgaaatccccatccaatgctgtcgttgggattctaggaggattggagaaggaacatcacgcatgctgctgacattggaggccgacggcggatggaggctggttggacaccgccgtggccgccgacggctcacccctgctcgcgtgctcctgtcaaatgagtttccgcaaaaggtctcgaataaaaaaaatccagagtcagcagtcagcactcgggtaacgcaatcgacaagggttgagctagttccaagcaagtgtttccttcaacttctctcttcttttttttttttgaactgctgagattgtgttttcttgcacggatcctggtactatttggacagacgcaggcaggggaaccttgaagtcttccccggcacagaggatcgggtgtgtttcggggggcaacaaggtggcgtggcgtggcccccacatccagcctagaagtagaaggccgcgagacatcctggcctgacctcaaaagcagctccccccctccccagtctctcatccgctctaccgtgcgcgagcgagaattttaaaataacataactttaataaaaaaaatataaaaatacattttgattgattaaaaaaacacaaatttagcaccttatcaaataatcaatatctattgaacaatcattattcgatttgtatttatcaaacaacgattgttcaacaggttagggtggtctaccgaactcgataggacccacagcccacacgcatgcatgcacacacatcgaattctctatttttttaaactctatcgaacaatgtttgtttgacacggttattcgataaggtgttaaatttatgattttagttaataaacatttatttttataatcttccattaaagatgtactatttcaaaaagaaagaaagttccgagcgtgatgcggctctcgtgtggctggactgggacggcaggcagcggctggccacacgagctccgccacacgatgccgcggaccggaggggcagtctcgtccactcggtggacgggcggtgcgctctcgcgcgtcacgccgcgaaaaaccaacgctgcacgctatatagactatagccggttgctgacggcggctggtggtgtggccgaaagcgtgccggccacacgggcaaatagccatattacaataggggaggaggaggaaaaaaaaagaaactatatgctctgctttgagctttctggtggttgatggtcagttggtcacacaagaaaaaattgcaacttgagtcctcccatctctaaccgtttttcctttttcttccttttttctgcgtttcatttgctgtcatgagtcctgacaccctcctatatggaaaaaataagaagagtcttgacaccctggtcctatgaagctgtgctcgtactcctgtggcgtagacatgcaggtgcatgtggtaatgtgggataaagggcctgttcggctgtctggtacagccactgtacgtagctgttgctgctacagcagcagactcaacttactgtttgggttggctgcacaacaataaagttaagtgcagccgaataggcccataatccttgagaacgttagaaaccatgcaggaagcccattaaaaaaataatgaggtttcctataatttcgtatgttttgtttaagttccacacaaccccaagatcctatggccctctttgaaatggaaggattgtcaaaataattttagaggatttatttttctaaggatttttttaataaaatcctttgattcataggaagatgatatgaaaattttcgtaggattgttttcaccaattctttagggaaatgagcaagtgactagacctcttgtgatatttttatttggttgatttttttctatggtacaatcaactggctcatctttccgattattgtgttctcaattactataggattataaaacatacttcctccgttttatattataagactttctagcattattctcattcgtatgtctagattaattaacatctactccttccgtcccacaatataagggattttgagtttttgcttgcaacatttaaccactcgtcttattcaaatttttttctccaaatataaaaaacaaaaagttatgcttaaaatactgtagataataaagtaagtcacaaataaaataaataataatttcaaatttttttgaataagacgagtggtcaaacattcaagcaaaaactcaaaatcccttatattatgggacggagggagtatatgaatatgagcaatgttagaaagtcttatagtaatatgaaagggaggaagtattattttaattcaaatgttttttctgttcctatgtgttttttcacctgtgtttcaaaaggggacttaaattactttttatggcaacctatgttattgaaatgtcgggcacagaacattttcagtgtaggagaaaataaccattttttcttgaggaccaataccaggggagtgaaacttgatatagttattgaagttcagagtcatcattactgaccggtcatctttatgattttgaattttatatggataatgaaaaagactagaagggcaatactaatatatatagagttaaaaaaagagaacaaaatattggaacatcactttgaattctacacaaacctatattttgtgcttaacataacattaatatcgagtgcatctttttctcttcacatgctagtgttttgtgagcgggcaaacgttgttccgaggaagtaacgcttaagccatcaataaaaactattttcacatacaatgttttaactgttaatccctctctttttaatcaccatcacatattatattatacatccccctcctatttgaagaagaagtacatacctacaaaaatgtttagtaaccttccgattgacaccctttatttattttcttttcaatcataaggactaaaacgaaaatgccaagaggaaaaaaagtgaaattccgagaagtacaagcccttgaagcgaaaagcgcaggtattttagctgccttgctccaagagagcagaattcctcggttctttcaaaacgcaagggaactaaaaacgaaacaacctgtaattaccatttctgtccctttcccctcccctccacgactccgccgccgccgccgccgccgccgccgccgtcatcgccgccgtcgccgacgacgaagccgacacagagccacacggcggcgcgctcgaagcaatcgaaccaacaagcagccgcgtcgaatcgcataggaggaagagagaagttgggggcagcaaccaacagctaggggtgggtaggtggtggtggcaaagcagcgggggtagcgggaggagaccggggcggcgggcgcgcgcggtgccctcgggagctagcccttggccccgccgcctgcgccgtcgcgccgatctccatcgccaccggcgagcagcggcgccgggggcgtcccgctgctgcttccgccgcgtgctctgagcgtctgattcccctcggccccgcggctcccgtctcctcgcgagctcgtctgcccgccgcctgcgccgatctccatccatcgcgagcagcggtgccgccgccgtcgtcatggtgagcaccccgtaccgacgcgcatcctcttcctttctcatctccatctcgttctacgcacacttttctcgaattcgcgttatccatatcttctcttctagatctgggactggaagctaggttttctatttgtcttaactttagtacgaaaacagcattttttccccaaaacaaaaagttaggggttcaactgaaattgctcatagtagttccatcattacttggtactactacacaatttttcattgctctcactgtagtgtagttacaaattgtttagctgcctagtttgccaccttacgagaaacctggactcatgcaaaattgggatagagcaacttggtttggagctttggatagtagtaacttggtaggtgaaatggctcctgcgagtgacatggatgacaacaatggttagctattatttgcggagaaattgattgtgcaataatgtgaaggacgcggaataagatgtttgcttatagcttcgtgtgaagcatggtattgtgttttacttttggtgtgcttgttgaagtttgctaggtgatgtttgaaatggaaccgtgccctttcatatgcattatgagcagtttttaggtcccgagtcctgacacaactttctgaactcgaatatttattcgaaaagctctaactaaaacaatttgaggagactgatattttcatgtttttgaaccaactagctaggattaagcttaaatattactgaaactctgcaaaacttaaatactaaggttttgaagcaactagtaaggaaatgctattatactttgcaaaacttataaatactgaggttttgaaagaactagtaaggaaacactattatactttgcaaaacttaaataccaaggtttttatatcatgaattcatgatactctgataccgcaaaagacaaatactaaggttttcaagccttaacaagtttgcacatcacaaaactgattttgacatattgcatggtaagtggactagtggagtgaatgttagcctgatgttttagtgctctgatttttgaatcttatcaatcttctagatgagaccccgtgtttttgctgtgggaaaattgcatgataaaatggtaggcataatgagcgaagtcggaattttcttgttaccaaatggtttatttcatgtgctttgtacgataagaacctttaatcatttctccaaaggctatacataattgatatgcatggtgtggaaaagagagacaatttgtaccttagacaatcacctaaaatactatgaaaacaattgaggtaatgtgtctacatgagagatgagagaattagcacttactacagttagtgggaggcaactatgtaagtataggatacaatcattggaggaattgttaactaaaattcacctgcgagatctactatgaatccacctatgacctacacgttggaggaaaaaaaaagaagaggacatcgaatcactcattccactaaagcaaatcctgtgtttacctttcggctaaaatccctatttcttgaaaagccttttaatgatatgtcatatgacgtattcgtcaaccctgagtgtctgatgcttggtaaagttggcagcgatacgtcatggacgtctcctttttatcctctgtcatgtccaacatacttatgcatattctcagttgtcagttatatatgacaatttcgcaagatgtaacacaaccctctgcatgagaatgagggaggagtattagatcatccatcaaagccttaaattattcttagttctgttttatctaggcatctgtttgattactgcaccatgtgttttgcaggggactcctgttaatattattgttggttctcatgtttgggtcgaggacccaattctagcctggatagatggagaggttgttagcataaaagacaatgaagttcatgtgcagacttcaaatgggaaaaaggtacagtttgcagtttcttatcttgcattctgcagatcatctctttctagttcttagtatttccttaaaatccttcaatggatctattttgctctgttttaatgtacaaggagaacttcgcaatactgtttgtttagttatttatatgtggcttcattgtaaccatggattgtatcattttgacataaaatggattacgagtttcatcacaagtaatgcttttgcacaggttaagacaaataaatcaaaagttttccccaaggatatggaagctccaccaggaggagtggacgatatgacaagattatcatacttacatgaacctggtgttctacagaatcttgctacccgttatgagctaaatgaaatatatgtgagtgccttatcatttctgcccaaaatcttactttagatgcactacatgactagcgcatgattatcattctgttgcattcccagacttacactggcagcattttgattgcggtaaacccatttcaaagattgccacatctctatgatacccatatgatggaacaatacaaaggtgcagattttggggagctgagtcctcatgtcttcgcagttgcagatgttgcttacaggtgaactgttgtataatattgatattgccatatatatgatcctgtcagcagattgtactttttatatacctacatttccctgatatgacctattaatgcgagcaaccagagcaatgataaatgaagggaaaagcaactctatattggtcagtggtgaaagtggtgctggcaagaccgaaacaacaaagatgcttatgagatatctggcacacttaggtgggcgatcaggagtagaaggaagaactgtagaacagcaagttctagaggcaattcattagccttctctttgtctgcatagtaatttatttttcaaataaaaaaaattccgttggctgattacctaataactgatataatttcagtcaaacccagttcttg

SEQ ID NO: 74365 - DNA, 21720 bp, Oryza sativa
tttctgtcaccgtgttatggaggtgagtcatggagatatatgctttgcatttcgttgcctttgttctttgcaacacaagcagagaaagacgaggacctcttcaaggctccccggttcccggccaacccctacaactgcagcaaggggagggaggagagagaggcgcgccaaagggaggagagagagggcggcggctggaagcgctgcaactgcgagctcgccaacgcgtagctccgcgctgaggctgaggacggcacgccgcccgcggccgcgcgggcctcgtccgcctcgccaacgcgcagctccgcgccgaggccgccgcctccgcctccgcgtcaccaccgccgtcgcagctccgcgcggaggccgcctccctcagtcgccgcctctgtgtcaccgtccaacgccgcagcagctccgcaccgaggccgccgcccccgcctgccgatgaccgagagagagagaagggaagagtgagagagagagaggaaggctctatgacaggtgggtcccaatattatatatatatatatatatatatatatatatatatatatatatatatatatatatatatatatatataatactgactggactgccacgcgtacgccatgtagaccaaaactactacggattgggtcgaggggggtaattcgtccggtttgtatagttgggggtgaagaatgtcggttttatggttcagggggtaattcggacgaccgtgatagtttaggggggtaattcgtactttttcctttattatatatctaagttacttttatcatatatataaattactttttcgagttgattaaattacttattatacattcataatatttttgagttgtttattttattatcatttttagtcaattccattatttgtgttgattaaatttaatttctagatatactcacgcttttacctccataacggatctacttttaatgtcatgacaaagttacttcctttttgttttaagttacttctataatatatgtaaattaattttaagctttactgaaattacttttatatgtttaagaagtagtttagtgaaatctaaaagtaatttagatatactataaaagtaatttgtaatttttcatcaaaatataatcatatgagatcttgttagaaagatttaattcttacgaacataaccgtgtaatcggatgagtagtttaagagaaaattttatttgaaacataggtgataggaatatattttctatttacttgatgagaactagtactacagttaaagtatctagatagagactcgttagcactaaaacgagaggcctacacgtgaacagttacagacgaatgtcgtgcatgaatacacgtcatgctagagtattagaaacgcaaacgtttcccatgcatgcacgtaaattggttggagttcacgtcacaactaaaagttatactataacggagacatgcaacggtctaattctaccgccattagttattatagcacgatagggctaacataaatgcgattgttgtcatgtatgtacgtggaagatgagaagggctaatcacctgtcgacgaatttttatttcgctatttgtagcccgctagctctaaatttgttaagacaaacttactatatagttctcatgggacaatgtatttgtttaattatatatatttttatagtggtttactgttatcattaaaacaatactattttaaaagggtgtgccaactatgtattttcatatgtttttttcaatggtaataaagctgtggtacaagaatattgtttggttctgtccaaatagcaaggttatccacgtttgtctatcatgacgcgtgctaccagtaccaactaatgacttgctgctatataccgatcgggtttatttgatcgttctcgagtgattttaaattcaaaaataataatcaattattggagctaatttaacataaggtagacataatcatagccgatcatatactttttatattgaactagctggacactcctagtagttgctttttatggaactagctagacgctcctaattgatgaattgctttggacaggggatggaacaagaaatactggagttgttacattgaaagttgcttaattgcttcaaggcaggttttgagatgctttgatcagattagcgtaatcaacgctcctgatttcatccttagccaaccagcaatgcatcataatctccgaaatttaaaatgagaaaacgaaattacatgagtcattttgtagctactactacaaagcagagggcttggataataaccattgattccatttcataagtaaatactacttttgtgtcgtaataattctatttctgtgatttaaatttgtactaaaataattgtcacaatagaatactaatggtcctattaatcacatatcattcaaatgtctccatattttaccctcaactacctttttactcttacctatacatcatttaataaggggtatcatattttttttctttttaaatcttaatgtgtactaaataacttagaatcacaattattttatgacagaggtagtattaggtaatctacatacacatcactaattttctcttacaaatttagagagagaaaaaaaaagacaactcaacatgtatcccaccgccaacaccacctcacatacttgtttttttaaactgctataatgtggatagaagtattgaaacggctagttcgttaacatttttttactattttggtttactcggatttaacatactcgaatatagggatagcaatttcccccacagggccggggccgggtgaggtttttaccccgcagggagtcggggccggggccccgcaattaggcgagtgaggggccgggggaggcattccacccgcggggctccggaggaggtatatcggacttttaaatatagcgtcaatcctaaatatagcccattagacccaacccgacttgagaaaaaccctacccataacacaaccccaccacccatcactcatggcgtactctccccctcctcacctagccgccaccgccacgccactgcgccggcgcgcccctctatctcgccctctcccctccggccatcctctttccctccgcctccagtcgcacgcgggccgcagccacacgcccttctccctcctgtttccaggcaacggcgcgcgggttggcggcacaagggcggcgcatgggcggcaaacgaggagcgaacaagcgacgcgcgggctggcggtgggcggagcgagggcgacacgcgggcaacgcacagccacggcaagcccgacgactgacaagcaggcgacgcacgcgagcctcttcctccgccagtcctcccctggtgactgcgggtccccagtcgggttgcggggccccgtaggggccggggccgagggttgatttggccccgcaactccactcggggctagggccgggtggaggccggggtcgttccagcccaacccggccctgacccaccctattgccaaccctactcaaatgaattggttacttttcttagttactcctagttattgctaaaaaaacaggtggctaattatcgtaatcatctatcaacgaagaagaaagcaagtaaaacgctacaaaattacacatatttatatatatttttaagaaaagtctaattagacattgacaataaataacatttattcagcgtttgccttttcaattgagaagttttttaggtcttgtgtaactcacggagctgatcgaccatcagttctcggggactcgtagcagtttaacatatatttactggtatgatatatggttggatggcaacaggtggagcccaggtgaatgtgagatccgggatcgtagctttagttacattatctccatgtgggcccagaaggtctcttccatactccatccgtcctataatatattaatctattatcagatatgatatattctaatattatgaatctggataaagctttaggttgattttttatagcacaaaaggaatagcatattgttgacttattttagtctttgaattgtaaactagagaggtaatattcagtagtaatcactatggtctattcgctatgattcgggggttaagcactattttttttcacgaactcgtaaaaagattgtatgtcaatatattagaaaaaagagtgtttgtttacacaatgcaatcaaccataccggcttatgccaagggaaatgagaaaagacaaaaaaaaaacaaggaaaaatgaagagactgctacgacggctggacacagctccaatcagcggggagggggcagagccacactaccctctaaaaaaacccgaaagaagcaacgccagctaacgatcatagatggccctcagtgaggatggactctagaaccactgagaccgaagagagagtaaagtcgaaaaccctaaagtttcgttccttctacagttgccaagaaaccaggagggccagagagtcgaagccggcacagagatgatcaggtaagcatgtcctaaaagatggccaccaattctggagccaattgccacgaggaggagagagggcagcccaatcacaaggcgacaacaacggaaccaagacctgccaagcgaacacgcagtcaaggaggatgtggttcaccgtctcaagctcctgagcgtaaaagagatagattgagtggcgctgctgaaatacaaatcaaaggaataacttgcatttagcatcttcacgtggggggtaagcactaccattgttgatttgatccctttcacaataatcccactgtacaaaggaaataattaatacaggttccatctgtgaataatagtatatgcaacccttgtttttagggggatatatgccacccttaaaaaaaaaaaaggaagatgtacttatgcagtactactagattatactggtgcagtacagttatttccacatgagatcgttatagttgacttcttgtctataacctcagctccgtcataaaatatgtttaaatttatagttacaaattactatattttacaaaacagggagtagtatatgttcgtcccgaattcctcatggaatagaatatcttgaaacgaaagcaaaataaccttcacctaccctggctaaattgtaaaaccatcgtaatatcatactccctccgtcccataatataagggattttgagtttttttcttgcattgattgacactcgtcttattcaaaaaattttggaattatttttttgacttactttattatccaaaatactttaagcacaacttttcgttttttatatttgcacaaatttttttaataagacgagtggtcaaacaatacaaacgaaaaatcaaaatatcttatattatgggacggagggagtaatatataccaatgctgctattgtatatgtaactgatgtttcaaaaaagatgtttttagtaatgcctaaactagcacgattaaattaatgagcttgatattgatatgacttttgctcctgcaattttttggtcgcatgcgtaatctacatggaagtcaacaaaagatcaggtcaaaagtcacgcttttgtcaagtagaagtaaaactttccagtagagacttcacaagttgacatcaaagttttgtttagtactactgttaaagcgtcaatgaactaaaactaacagcgaccaaaccatttaccatctgtctgtaaagccaaactggcaaaattaatcacatcacgcagtgtgctggagtttggttccattccataaaagaagaagaggaaaattgaaaagaaaagaataattgcagggatcagtcatcactgtcctcgtttaattttggctgtgctgacatatactgatctttatcctcgatctgatggcgatcagatggttagagtactttctcaattattgggagaattaaatcgattttcctcgcagaaaattatatcggtttgtaagagaagccaaagcgaaagcgatgacacacacaaaacgatatatatgcacccgtggcgatcggtaggcatgcagttccatctcaatctctaagtgcgttatatataacggttagcattagctagttagctgtactaattaaaaaggtataagttactagcacattattacttaagtatttttgaagatgattacttaagtgttgtctattgtaaacttgaaaaataaatttattaaatattttagataaacttatatttagtatgaagcatacttatttaacagtttgtgctcgtgataaacgaggaattagtttagctcaaatccactttaactagaacacaacttaagacatgtttcgaaactttttctcatttaaattttctctaaaattttttacttccgatataatccagactctcatttaaactattttaagattacatatatagctataagtatagagaataagtagaactcacaagctaaaaaaaagatcatttttaaaaaataaatcttatgagctggttgctttctcgtaatctcacgagctcccagacatgacacaagctcgaacagctcgagcattctcggcgaccgtagctactactagtcggcagagagaaacaggcggttgtaaataaaacaagcaaacgacgtcggaaaagaacaaggctttgacgacagccaaactgttggtttctctgggcaatgtacagcagaaaacgccaagaaagctacgactactgctagcgtggagtcaggtagagcaagcagccagagaaactgacgtgccgccgccgcgtgttcgttctcatcgcgacgcgcatccgccgcttggtccgtagctgcgatcaggattcccaaaccgtttaaaataagatgatcgtcatctcataatttaacggccaccacgataattacgtagttacggtataaatcgtacaattaccatgagatatatcgtggtttaaaaattaaaaatgttaccgtacatggataaccgtgtgataactaaccggttttttaaaacttgcctgggatatctcagcccacaacatttaccgtgagatatgtcgtggtttgaaaatttaaaatgttactgttcgttgataaccgcgagataaataaccggtttattaaaacctgcctgcgatatcccagccggcgacatgcatgtgctcgcgccaatacagcaatttatctacgccctcttgcccaacctcgcaaaaggaaaagaaaaaaacaactactgtagtaatctcagttcagattcgtcgtcagttgttactaataatcagttaattaactaatcccgaaaagagtgtcagctactcttttgagatattgcaactggccaactacatctcgctaaaacttgggttggttttatatatgcaggattaggacaaatgcgaataaatgaagcaaaatcaattagcgataagcactgcacgttaattattggatgaatagccaatacgtccctaaaatttcgctttggctcaatttagttcttaatgtttcaaatcgtctaaacaagtcctccaaattaatcatttgggttaatataatacttgaacccacaaaaaataccacgtgagcatgccaagtcatcctcgcatacagcggtatgaatgaaattaccattctacccttatataccatatagaaaaaaaagaaaagacaaataaaaaaacaggccagcccatgtcagcattgttgcgaatgggtggctgacaaagaaatttacgtgatcagtgcttggctgcagcaatcgtaagtgacaattctaaaacaatcatacatgcgtgaaccatttatcttcttcttttctttcttttctatatggtatataagggtataatggtcatttcattcatagcactgcatgcgaagatgacttggtatactcacgtgacactttttttttcaaggactatattaatctaaatgattaatttagatgacttgtttggacaatttaaaacctcaaggactaaaataaactcgaagcgatacttcaggataattcggatcctctgcattagaggtactaatgcagaggatgaacagtaccacgcattagaataactgtggaccgtcggatcaagagtgaaaggaccagattgtgtgctacagtaaattcggaacagtaccaaatagtgtactacagtgttttgaatcctgtagctacagtaaaatagacactgttcatggcattagctgctgttcccctcacatgaacagtgctcttctgcattacggcagacgatccggatccacttcaggactgtattaactatttgcccttaattattaaccattcccattccccgaataaggcgccaatcgccatgtgtttgtgcagcagtgggcctcgtgataattctcgtatcatcgttgtcacctttacggagagtaatggacacgtagagatcaaagatgattctccttgcttctttctttcatgtatttgtcacgttgtgccatgaaaggaaccaccgctggattccatctctgcgtgcatgtggctagctggataatgtgacattattaagaaattatgagaattatttttatgaaattgtttcacctgtttttttttctacttatatacatgcagagtacagtgagttttagtgtgcttataataatattgttttagttataaaaagtccatttcatcatatacgtatattccaggctatttagttcaagatcttcccgtcataataacaaatgaacacaatagagataaatggcgaacatatgttgattattcataacttatgaatcggacaaaacttatatataatatgtgtgtgtacattacgatttaaaaactaatggtaaaaaattaactttgatgacaaaaaaaatcaaaatcatattttataaaagttaaattttagcagcgtcttataagctgagcaaaagatgctgagccttaacaaatcgagaatacaattgaacggtcaaaaacagagtaggacccggcgaaaaaaagtaatgcagcgctgtgtacctcagcaaagcctctagcgcacagaatttatgttcctgacgatattcttaattcagtgtgccaattactccctccgtttctaaatatttaataccgttgtctttttagcatatgtttgattcaaaaactttcatgaaatatgtaaagctatatgtatacatataattatatttaataatgaatcaaatgataagaaaagaattaataattactttttttaataagatgaacagtcaaacatatttaaaaaaattaaatatttagaaacggatggagtattaatcaagtcagggccatcgaggaatgagatcacgcgcgccggaggtgatcggtgaacaggaggtagcttgccggcggcgggcgtctcgccgtcgccggagcttgctctgatcagtgccacccacctaatcccggacttgtgaattccggcccatccacagggcatggcctgggaagcctcaagccgctccgtgacggcccaccaggctctcgttgatagtcttcggtgcttcaccggcacggccagagcacgatcggacccgggctgaaatcagtcgggttggcacgacccgacctacacggtgggccgggccatgcccacctacttgctgcaccatcagcccaagcacgatccaataagactcgggtcgtgccggaccgacccgaagacacgaaaacccaccgtgctcctccttaaataaagtatatcttgcctccctaatctcgttgggtcatctcttataggaaaaagtacaccgaaggtctctcaacttgtcatcgagttacaaaatcgtcctcgaaccacaaaaccagatacaacgtatccctcaacttataaaaaccaatgcaaaatagatccctcgacggttttgatccggtttgtccgatgtagcagctgactcagcgtgggacccacacgggtcctgcatgtcagcctctcattcccctcccttctccacctctcttcctctctgctcttcttttctctcactgggcactggcagcgcagccgacgggtgggaggaggctggtgggggaggcgggagtccgacggcaaggaggcggcggtggaagcggccgcgcgacgaggcgacgacgcggaagcaggagagcctcccccatgctgccgccaccgccgccgccgacggcacgggcgccagatcccgccgccgcgggtgaccatgccgtcgccgtggaggccttccgcgccatggtccggcgaaggcgcgctcctgaatgcctgcacctacactgtcgtcatcgagcacctcgcctccgcgggattcgtggaccaggtggtcgacgactcgatgtgttccgcctcctcctgtcgctgcgcgcgcggcggaccacccggcagtacaacgtgctcgccgtggcgcttgcatcggcggggaagttttagctgctccggtggctcgttcgcgagatgaggtaaggggaataagaggttgacatgtgggatccacgtgtgtcccgcactgagtcagctgccacatcggataaaatcagagttaaaaaccaccaggagatctagtttgcactggttttgtaagttgagagatacgttgtatctggttttgtggttcaaggacgattttgtaactcgatgacaagttgagggaccttcggtgtactttttcctctcttatatggctgaaaataagtctattttgtatcctcgtctctgtcggccatgtcttgaatgggaacatggcgtgatctcaaaaacaacagggactcgaacacagtaaaattaagatatcgtctgttcggaatggaaacacgaaacacacacgaagtcagtaaccgaacgctgagacactactactagtacagtcagggcggaacttgagcatacgaaggggtgccgagtgaccaggttttttttaacctatagctagtatattttgtacatccactcaatacaaacttaaacatccgtaccagtttaaacaagatccatgataaagtaaattaaacaagtaacacactcctcaatttcattctagctccgcaccggatacactactacactagagatacgtttattcagagaaacagcaggtatgcagcaacgcagccacgcaccacgatcaataaagcaaagcaaagcagcaaccagagtaatttcgagaatcctaattctcgcgcgcgccggtagcgtgcactcccggcccacgcggcacgcgcgcgcaattttttcttcggtaaccaccgccgttttccttttttttcgctttctttttttccgtgattttttttcgctttcctttttttttttgcgttttttcctgattactttttaatcttccagcagcaagtgtttttaattttttttaaagtttttaattcttaacttgaaaatttttaaatcttaatttaaaaattctcaaatctcgaattgaaagttttcaaattttgagttgaaagtttttaatcccgagttgaaagttttcaatcttgagttgaaagttttcaaatctcgagttgaaagtttttaaaaccgagttgaaagtttttaaatccgagttaaaagttttcaaatctaggttgaaagttttcaaatttgacttaaaaaatttaaatttcgagttgaaagttttcaaatctaggtttaaaattttgaaactgtaacttcacatgtagatttctttttaatttgttagttaaaaaaatctcacagaaaaaataaaatcttatctactaccatcattatcctaaactgttattatctaatatactaatagattagtataactacttagctcgaaaaaacgagcaccgccgacgctcacgcgccagctagcgatgcccgagtaatttagcatcaggcgccgtggctgtgagcccgcagcagctgcacgaagctcttgttcgcgatcacacggaccacggcgagcgcctcgccggcacgcctcctcagcagctcagtgaacgggctgtcccacctcccggtgcgcctccaccagaggacctcgaacgacatggtgtaccagtgctcgatgtacggcaggtgctccgccgccacgcgcgcctcaccgctctcccacctgctcgacacggtctccccgactggccttagccgcagggcttgggtcagcaccatcgacagtgttgccacgccacgcctcatcgcctcctcgccggtggcaccggcgtcgtaggaggacagtgccccgatggcgcgcagcgaggccgccctcctgagcggcaggccggggatgttctcgaggccgccaataaggtcgcggtaggtgttgcggaacgggagacgcctggcgttgtcggggaggacgtcctcattaccggggaagacgtgccaatggccgcttcggttggcgaagccagcgaaggagtagtcgtgtttgtgcacggccaggtgcacggtgcaccacgtcgccgtcggcgcctttcatgctgacaccgtacttctccaccaccaggtggtggtctcgcccggccacggccgagaggaggaagaagaggaggaggagagcggcatggaagctcgccgccatggtgaaccaggacgccgagcaaaaacaaagctacgtgcaatgcaagaatattagtggtggatctagcatttaggatatgggtggtccgacctaatttttttttctaaacacagtaaatctaacgatactaatatatacaatgcaagtatagataatagaatagaccaaattgtaaaaaaattaccatgatatatcacaatgcataagagtttaataagattttaaaactaaaaattgaaaaacgtatacacatagaaaacctaaaattgttgccttgttggcgcgggcggctgatcagctcgacgacggctcctcgcggcggcacacgcacagcaggtcagcaccaatgtagtgccagccagacgcagcacagcagcggccaaggcggcagagtgcgggactcgcgcgtggcggcgtggccgtgggggcgccgggcgcgggcgctggccgctgggtcgcgcgtgccggcgtgggctggccgctggcgccgtggccctgccctgtgattggttgtctggctgctgatcgcgtcgcgtcacgtctgacgtggagtgatcagatgagatcgcggcgaagggcgaggaggactcgcgtcgcgtgatcgcgtgtgggcctgtgggcgccgcgagtcgggactcgggaacgacgggaggaagaggattagatcgctttttttccttttcaaaaatcgctattttcatttttcttaatatatacgggtccatcgccgtttttccccggaccaccctctatatccgcctacgatgaatatgaaacttcgcactgtcttgtgtgtggtcgttaaaaaaaaaaagctatgtgcagcgtgatattatagtgaaactgtccaacgaggagattatttcggcggcgccatgaaaaaagagcgtgtcctccctaccgccgacgagaaaagctgacaagagattttgtgtgaataacctgatgtttcatatgcatattagtacagatcatcacaatgaatttgctgtaaatttgcttgattaccaccgttaccacataattacacccgacgcaatttcaaacacgtacaacgaatgctgaaacaatcccagcgttcactaacacatcctacacaaagaaggttcagatagacgaccgatcgatctacagtagattgtacaaaagaaaaattggacgaaatggaaaacccaaattcaaattcgaatgaagtatgcatcaaaaaaaaaaaattcgagcattgcatcgacctcatattctcaatgaattctcaagcctgaatcgactgaattcgtcgagctagctagcgcgccatggtgatcgagccgtccttgatgaggctgttgctgagcgtcttgaaccgctccctcgagtattgccgcgacgccttcctccaatccgtcccggatttcatcatcgccacgaactcctcgtagctgatccgcccatcctgcatgcaaattcagagattgatcagtttcagagtttatttgggagagctctaacgcctaaatttaactccgagagccgagtttgaagtggagttgtggaggaggctaaacccagttacatttctccagttcattttgtaagagcgcttcaactaatttcactctaattctgagtggagttcaaactatctggctaggcttcaaaagagatagagctgaattgaagaacatttttgttgcaaatggagtagtggaagggaagcgtgtgtgtttaccttgtcggtgtcgacttctctaaggatgtggtcgagcacggcgtcgtcggcgtggccggagtcgtcggcgagggcgtcggcgagctcggcgcggtcgatgtagccgctgccgtccttgtcgaagaagaggaaggccgtgcggaggtggttgtcgttggagaggcgctgcaggtggatggtcaccgccacgaactcgccgtagtccaggtacccattgccatccacatccgcctgccaatgcaaaatcaagaactcgccattgccgccattgctatcttgaagaagggtaaagaagcttacggcctccatgagaagctccatctcgggctcggcgagcttggagccgaccttggtgaggccgtccttgagctcctggagcgtgaccctgccgttgttgtcggtgtccatgagcgcgaacatgtccttgatcacctccacctcctctaccgacaggtgttccgcgatcacctgcgtgcatcgctgggcggtcagacacagaaacgggctcgccgtcgccggagacgacatcaagagcagagcacgcacgccacgtacccgcatggccttcttcttgaggcggttcatgagggagaactgcttgaggcgggcgcggacgacgtcgccgagggggacgttgggggcgcgggcggcgtggtggagccaggggtggtcgagcacctgctgcgccgtggggcggcggcgcgggtccacgtcgagcatctggcggacgagggacttggcggcgcgggagatgcgcggccatggctcccggtcgaagtcggcggcgccgcggaggatggcgcgcgccacgccctgctccgtctcggcccagaacggcgggacgccgcacaggaggatgtagaggatgacgccggcggaccagatgtccacctccgggccgtagtctcgccggagcacctccggcgccatgtagtacgggctccccacgatctccctgaacctctcccctgtttcctttcacttgccaagtcagttttttttctcttttttttctgtatatttatcggcaaattttctcataaaaatttaacaaatgtaaatatgtgtaatcacacatgtaactataatgtaatttgtacgtaactttcacatacttttaaaccgttcgattttgctttaaaattcatgcaaggtagataagaaaaaatcacattgcacacgcatgtaagggaattcggttccattacctccatttcatggaaataacatgtcgcctattgatttttgaaagttacttacaagttacatgatactaaattataatatagttacaacacaattgtgctataattacatctttgacaacaaatgtataactagttttttggtgaggttgaagaaaaggctggatttgaaacatgggccgtatgaaatctactgggcctatctgcacagattgcatgtaggccggcccatctcagagtcacactctcactaggctctatctcgtcacaaatattgtactgtggttagtacaaatttatccacaaatgtatacttaaccccatattttgatgctttagatatgcatttagacttaaggtataaataaaaatccattttaaacgttcaagatggataagcaaaatacactggaattttatcactgtatatattatgatgcaaagtgatggtcaatattatgtttgaaagatcatgtcaatgtgcaaaatgtcttttttttttgcttgaacatgaatgtgcaaaatggagagcctctgtttataacaaaggacttgtcaaggagttttgtagaattcaaatctttccatttatttgaggaaaggattggagatctaaaaatctcatgaaattcctttggactgctcaatgcattaatattttggagtaaggttaaaacaacccccgtctctctgatccaattcttgtacttcttttattatacggatcctttgttatgcaaatgtatttatattaaaactctgcttatttgctattcatatgttttaccaccattcttacattccaagcaataacggtacgagttgactgtattctgaaatgatctgtccagctcaatctattcggccatgcaacatcaaagaggaacaataattaagaacaagagtgacagtttttttctcccctgaggactcaacaagagcgagtcgtctattatcgtaagatccttgacaccgatcttgcttatcttaattaagatcttgacagcaatctgctgccgaccacgacctcttaacagtctggacgcaactatggaaaaaaaaaactcggcgtgtggtggtgattttgttctcttttttaatcactgtttttcgtggctgcgtatattcggtctagatataaacacatggttttccaatccattttttttcaaaataaaaatattcaggttatacttttatattcttttctactatcgttaattaaaaaagaaattcagctttgtggtaggttgacgaactcactgaccgagtaagctaaacacaggggacggcgtgatgcgtgtctgcagagaggagtagcatcatctgatgacccagcatccacagactttttctctgaaaatttcgggcagaattggctcggtttttcggctcaccgtcacgatcagctgccatttcaaatgcagactgttcttaatttcttccaccggtgaaagtgaaattcaggcgcaagagggcaccgaaacgccgacctgttctattttcactgcacaccaaatttactaagggagggggtcaaatttgggttggttagccgaccaactatgggttcacattttgttagaaataatgtgttcttattgatgtttatgattcttttttaatacgagtgattttgcggttttttatgaggcatcgtattttcggtatctctctctgcaaaatttgattctccctccctcgcggttcatttatatttgacgttaacagaattacgattggttcttccaacgtcaagtacaaatgattggagagagcacctcttttaagtaccataaaatttctcttaaagatatgtttttcatatataaaaacataaaaggctctactgaggttttatatgtactcccacctacccattgatcatttgggggtgttttgtgctttatgatttggcacccgtgaaaagataacgtgtttaagaaatgggataaaatttcaccttttataacagaagggatcttttgaaaagttgtagcaggggactaattaactattcccaactgtgcttatagtattataattctcaaagaatccacgtgcaacccaaaaaaacaactgcaaaactagtttgagcatttctggaaaatctctgttttcatgcaattagatcttttgacattgtgaaggaaaaaatatcctcttttttttgcaatttcatctttgatattttgaaaaagctcccaatttatttacatttcaatctttgagattgtgaaaaattattgtgaaaagctccaaatttatttgcagatcaatttttcatatagtgaaaatctccaaaatttcttgcaatgggattttttgaggtactgaaaatctctaaaaaaattctttgaatgggatttttgagaatatctactaccactaaaaaattttgagaatatgttctaaaaaaattaaatggggaagagaggcaaaaaaaaaaaagttttgttcaagcgtgcatgcattgcagaggaagaagaagggaagaagctgaccaggtcggaagaagacggagaggccgaaatcgatggccttgagctgcgcgtcctcggccttgccggcgtagaggaagttctccggcttgaggtcgcggtgcatcacgccgtgggcgtggcacgcgcgcaccacctccgccaccgtccgcgccgcggcggccgcggcgcgctccgtgtaccggcccctcgccacgatccggtcgaacagctcgccgccgtcgcagagctccatcaccaggtgcaccgcgtcggcgtcctcgtaggcggcgcggaggcgcaccagcgccgggtggtccgggagcgacgccatgatggccacctcgcgccgcacgtcggcgacgtccacggcggtgcggaggcggcgcttcgggatggacttgcacgccagccgctcccgcgtcgcgcggtccgtggcgaggtgcgtcaccccgaactcgccgcgccccagctcgcggccgagctggtacttgtccgtgacgcgcagccgcgggtggtgcggcaccacgccctccagcacgcgcaccgcggacgcggcggcgccgcccctcgccggcagcacccgcggcggcgcccagtcgtacgggttgggcttcgccctcgccctgggcttgggcttgggcttgggttcttggccatgcctctgcctcgtcgccgtcgtcgtcgtcgccgacggcgccggcgacttcttggccgcgtgatgatgatctcgcggcggcgcgcccacctcatcggtggtagccggagcgacgcagcacgtgttgcccatggcgatcttctagaaccttctggaaacttcctcaccacagctatatatctacctctctagctagcttaattctatctacttctacatctctcgcccatctcagctcagctcagcttagcttggatgaacaagaagcataaagaaacaagggaaattaagccgcaaaatatatatatatatatagtgtgaatcaaatggtggagagagacgggcgggaggaagagaggagggataagaagaggtcgatgtcttgaagtggtctactacgcaattgcaatgagatcaaatcgacagagaaagagagaagaaaaaaatgagacaggaatcaatcaaatatagttttttgatgaatgatatgagctgatctgagtaaaaaaaaaacttaatttgatcggtaagaagcatcagtgtgcacgcatgatgctttgccatgcatggtcgatcgatcaaagcagggggtagaaagagggaggcagtgacgaccagtgagggagggagctttgcttcagggctacgtcgtgtcgagagatgggatcagtgagtagtagagatgagaaatgaagaaagaaagggaccatatatatcatgcatactcctactgcatgatgatgcatactagtagtatatgaacaagttgcagcgaaagaacaaattaaaccgaaactagttaacgtaaatttacagctatattctttttcttttaaaggcttgtaggtgtttatctcatattaatatatcttattaagtttccttttaaaaatgtaactatttagctaacatgtttatataaacgagatggtatccttgagaaaacactttaatttccctgtacgaatctgaagttttgatgcggatgaaaggatgcgtagcttcctagtacgagggacagctctaccaagaggcaggattactataaaattacctgatacctttgctgtctcgatctccaactagctacaaccatttctagctcgaactgttcttttttattcaacttctttttctcccatacctttctgttgctgtcgaagtgtcgagttgctgctgcctcttgcattgcgtcggtccattgagttggtctcccggtgtaggcgtgtatagctaggtgcctttggctcaaatgcagaatttggcctcgtatcgtatatactcgctacgtctcaaaataaatcgatcttgtacgatcgtaccagatataaacatttattgtactacaacatatccagcctcaacgtttggcatattttttgaatatttgcaaacaaaaattaatttgtgaataaaatttttatatatgtgttcttagcgatctaaaagcaaaggctgaaaaataaacttcaatgaaaaaaccccaaaatcagctccaaatttaacgttgaaaatttaaattttggcttataagcatatgaatatgccaaacgatgaggcccgtcatatccgatatgagattggtttattttaggacggatggagtatgcagctagtcagctgatctattagcctgcggtttgtgcatgcttaatttagcttttctgtgtgttgttccctgatctgtttgttgttcatcatgccgcgcagctggggtcgatctagctgatgccgtgtggattccagcacaaagggtacaaaacgacctgggcttcaggcatgcaagtgtctgtggtttcttcgaaaaaagttaagaatttattcggttatttaaaaatatacaagtgggcaatactattgctcgtacaaagacccatttaaatattttatatcctaaaaattttagaagaaaaaataaactagaattataataatcagggaaaaaaactgcttgtctactccactggcatccctagcgctacctgaagacggatgcgcgtagagcttaagccgtatttgttttgttcctacaacaaagcgagaaaaaatatatcatttttcatgcgcacactttccgaactgttaaatggtacgttttttattgaaaaaaagagaaaaaaaaattactttagaaaccatattaattatttttagaatttaaaatagctaatactcaattaaacatgtgctaatagattaacttgttttacctatataatttttccttcccacctctcaacaacacacccactacaaaatgaatggatgaaaaatgagctgttgtgtgagctaccccccttaattgcatcgctagtaatgcgtcccaatccctcagatatagctaagctagctactaccgtttgtttgtttgttgcgatcaagacacaattgaaatgtggacacgtcttctgaccaagtgaccagacgtacgtgtgcacaatgttttgttcgtgatcaattcatatgacatgacacatatccaactcccaacatctcgccataacccatactataggagtagtaggagtgaggtgactcgagaaaccaaaatttctctcttgcaatctccaccacaagcatggcagctgatgcaattaatgaaccttaatcaagcttagaatttaggaatgccggaaaagcacttgtgtggtgtcgaatcgtaggaaaatgacccatccattagggctaattttataaatcctaattatcacaaatattacacacaacgaagggaactttcaatcgaagtttacagccacattgtttcgcctatttgtagaataagcgaaacgacattttggaaacgaaaaataatttgtgaataaaatttatatatatatatatatgtatatatatgtatatatatatatatgtatatatatatatatgtgtatgtattcttagcgatcgaaaactaaaaattgaaaaataaactttgatgaaaaaaccctaaaatcagtttcaaatttaaggttgaaaatttaatttttggctgataaacataaatataaacgaaaagatgatgccctaagtgtgataagagatgtaccgtcaacttatgtccttttagcatgtataatattgtgtgttccgccgtataattgaaaaaaaattgcccatcctgcaagtaagagaggaccacttattaaacagggcagtgagagctaacgatggaatcggcgcgaaaggacg

SEQ ID NO: 74366 - DNA, 25572 bp, Oryza sativa
aaataagagagaggtggtgaggtggcatcctgagatatgggtcctacgctgactcagccgccacgtcagataaaaccggggtaaaaaccaccgaaggacctaaaataaacggttttgttaagttgagggatgttatatatctagttttgtggttgggggacgattttgtaactcgatgataagttgagggactttcggtgtactttttcctccggtggagtaataaagatgaagtccagtttgactccccaatcataggtcgagtctaatttgtatccctcgaaagaacggttataacggcttgttcaagtattaaaaccaatacgctctctcggcactgttgaacaacgtttttcgctgatgtggcacttaggtgacatgttgacgtagtcttcgtcctaagtaacgcggaatcacacttggcaaagaaaataaaaaaactaaatgggaccacatgtcattgataatttcacaaaaaaataagaagaatctgtggcccccctctctctctctcccttcttcctcctacctagcgaacctcatcgaacccaaccacgctagtctatcactgacctccgtgtcggagctctatggctctcagtgaagagatagaggcagacacggagaaaggaaggtagcggccagcgaaccccatcgagctccctctgtcgttgacctatgcctcaacattagagcagcattgaccgatggatgacgcttcgagcaatgcagtccccatcctagcgctcctcaggctccccgccactactcccacagcccatgggccaatagacgaggagcaacacgatgtggtcaccgtccatggggaagaggaaagcaacacgatgtgttgtggcatggagaagcttagggtcgcccagcactacggtcggcgtggttgaggtcgcgagcactgtggtgaagctccgtcaccggtgcgccactgccattttttcttcccctcctacggctgagttctctctccccgccgccctaggtgccttcttctcgtcacctccccatcatcgctctctctccacagctgcaagtaactctgtatgtttatatttttataatagtagatgtacagaaatagagttatatgcccagttgaactttggttcgcccagtaatgcagtttattttcttcgtgcaacaagcacacaacacatgtacataaccattttgtgcgtgaaggtgttggtttttttttttcattaatgcatgcaatgctgtctaggacatgttacatgtatgtacattccgatcgatcaagttggttgtacagagtgaatcacgaagaattgattcataaattttggatcaccatatatcgagcgcaaattcctaccggaaacacataatgatgatcgatacggagtatgaaacggatgacacacatcacagaaaacggaacagcacatcacatataattaattaagacaccagctaggccgatctcctgctggaagtagcccagaaatgatcacgacggtaacttttgccgcgcgctaacacaacgttgttaacccctgttcttctgagtgacgatgagttaattaactagagatctccatcagagtatcccatcgaacgggggctcaggtcgggcatggtggcgccgcgcagcaggtgatcccggaacgccaccccgatgacggcgagcgcgtcctccgcgctgccgatgttggcgcgctccctcagcacgccggtgaacggccccccccacgcgccgccgccgctcctcctccaccgcgtcagctcctcccacatggcgtcccagtgctcgatgtacggcaggtgctcgtcggcgacgcgggcccccagcccgccgaacaggagggtgtccatgaccggccggagccgctgcgcctcgccgatcgccaccgtgagcgtcgccagcgcccgcttcagcgccgcctcgccgtcgccgccggcggcggcggtggccgggtcgtagccggagagcaccgtggcggcgcggttcgtgaagggcatcgagatgggcaggccgcgcaggttggcgacgccgccgacgaggtcggcgtaggtgttcccgaacgggaggcgggccgcggcgagcccgagggcgtcgaacaggtgcccgttgccccgcagcgcgtgccagtggccgctccggttggcgaagccggcggcgtggatggtgtcgaccctcatggccagcgtccccgcgccgctcccgtactccagcaggtcgaccatgatcagcttgcccctactcgtcgccgccgactccacggcgacttgccctccgccggcgagcaggatgagcgggatcagaaggacgaagaagagcgcggccatggcggcgacggcgaggcgagtgcgcgcggcgcggcgtcgtacgtggtgcaaccgcctctgcattgcaagagaggcgatttttatcgacggtaagatcgaggcggacgggtagtaactagtaagcaggtgccgcgcgcgatcggcgtgagcgagcgaaaatttctggtttatcggatcacccggtacgaatgatttcggtttctcgtgttttgaatttggcagaaaattgtttgaacttgaccaaatttaatttaaaaattcaaattattttggaccaaaattaccgattttcggccatatcggtgaccctgatagaaatagcgaaatcgaaaaattgaaccctgccgggaatcgcttgaccggcgaggtgaagagtagagaggtcctcgtcaacgctccggcgagacggtggggggcagggcggtgccgggagagaaaaaggttgcaaagatttgcaggtggtgacacacacatgatcttttggtgtgtttgctgtgccaggggctaactgaaattcatactgctgtgcctgtgctgatcgtgtttttttaactttacgcagctgaaagtgggacagacttgcaggcggtcaaggatggaacatctccagcagcgggatgccgaaccaagctaaccgtgatcaactcaccacctacagcaatggccgatacagaattacagacattcattcaggctgtgtgttagatcaggggtgaaaagttttgacgtgtcacatcggatatacggatacacatttaaagtattaaacatagactaatgacaaaacaaattacagatttcacatgtaaattgcaagacgaatttattaagcctaattaattcgtcattagcaaatatttattgtagtaacacattgtcaaatcatgacgtgatcgtgattaggcttaaaagattcgtctcgcaatttgcacgtaatctgtgtaattaatttttttttcgtttatatttaatactccatatatatgtccaaacattcgatctaacagggtgaaaaatttagccagaggatctaaacagaccctcggacatgttcccattcctcgggaaactgctttaatcacccattcctctcagaaactttggatgggacacaaagtagtaaagagctttaactggcaggaaaatcccttaagcacctatgtgcagttgggaaatagatcccctgactttatgcagtctacagttgtgtcactggcagggcccacatgtcagtggcacaactgcaaattgcacactagaactagccaccacatgtttgcatgtggattcagatatatccaggtgagaaaaacaatgtcactaggagaaattatagcatgtatcagagcatttccaacaacctctccaaattgaactctccaaatacccatatagcaaactctccatccgatttggctagccaaactagttgttcactccaacaacctctccatctaccctctctactttgactctatgacatcgggacccatatgtcagcctctcccttcttcttcctcctatttcttcccctcttccccaccaaactcctcttttatccctttcttggttcttcctcctctcctctgctcttgtacgcctgagattgggagggggtggccggcgcatggtggtggggggttagcgcagggcggcgcgctggggaggaggagtccagggcgccggtggaaggaggctggggccggacggcgtggtgcgcggcggttcgatggctgagtgcggcggcgcggcagggcatggcgcgcggcggcggtgtaggatcgagatgtcgactagaggggggtgaataggcgatttaaaaactaaatgacacctaaacaaaactaacctaagttgctaggctcggtgagggttaagtctaactaagtaactaagttatgttttgcaaacctagggtgatagtggctcaattaattctctaggaaagtaaatcacactcctatgtcaatgttttgcaatcctagggtgatatgatctcaagtatgtctctagaaatataaattgcacaaatgtaaatgcgacaatcaaatgagataaggagacaagagatttttcaccgaggttcgaaaactcgccggtttcctactccctgttgaggcgagcccaactccaccgctcaaccatgaagccaccgcacgcccccttcgtcaaggggtgggcaaggtggaaagcaggcccacggggaggactacccaagcctcgatcactcgtggtagttcttccttcactccgaaggtggtgaaatccaaaccactcacaaaccggcaccgggcctcctccacaatcttctcggagaggtcaccgggcaactcctccacaagccgtctaggaggcggtaacctccaagagtaacaagcgatggcgcggctcggagatgatcaagtgccacactagctctacaatggaagcaattgcacttaactcttggctagaacaaccctcaaacacactagaaggatgaacacaaagctcaagtgggtgtgtgagagatgaaaggggtgtatgcaattgaagtggtgccaagagagtccccttgctgctggagagggagtatttatactcccaccaaccaaaactagccattgggggagaaatcccctaactctgtgtactgccgctctgaccggaggtgtgtggccggtcagacagtgctactctgcaacggctagaaaactagccgttgtagccctgttagagggccccattagcctggccggtcagaccgcaattgagtggccggtcagactggcctcggcttggtcagaccgccctcagctcggtctgaccgaatatggcttcatcggctctgtatcggccaccttgagcaacaccatcccagcctccagggggccggtctgaccgcacaagtgtcgtcagtcagaccgaccttgtgcgccggtcggaccgcccgcttggggccggtcagaccggacagggcacgccggtcagaccgtcactaggtggccggtctgaccgcccctggtcaggccaaaacacagtgaaactgcgtgtgttgtgaaaagtgtgtgtgtgtgtgtgatgaaatgtgagcacaagtctaaatgcataatgacctaatgtggcaattaagatcatctctttgctaggtcattacccctcttaatagtacggcaaagctataaataaactagcacaattttgatcgcccaacgcctcgatcaatttaaaaagaaaaacactagttaaccgtcttctattccttttgctttgcgccgttaattttaatccatcgataatcatccatgcgcacacataatatgaatctaacttaaaatatatagctcaaagacaacagttagtccacaattagtgcttgtcattaattaccaaaattaacaacgggggcctagatgcttcaggcagggcgctacgcggtggggcggcgtgtggcggaggcggcgcagagggcagcgtcggcacagccgtgcccggctgcgcgccggccggcgcagcggccgcctgaaggcagcttgtcggcgtcgaggaagggggcggaggcaggagtgaggggcgccgacggtcgcggcgagcgaaggatggcggctggccggcgagcggaggccggtggctgcagcgccgcctcgctgcaatccgccgccctgccaccgccgctcgcatgggagaggatgcgcgcacggatggcggcctcgtcgttgtcgtcgccgttgtccaccatcacaaggggtggccctctgctcctcgccggccttgcctgctcctccgctgcctcatcgctgtgtctcgtccacgacacctccgcctccaccgatgatgactacttcttgtcggacgacgtccacgatagcgccttcctgatccagtcctcctcctcatcggtggcgcgccaaggaagccgaggcagagagaatgctgagaaagagaggggagagaaaagtatggtcatgggtcccacaatcccaaggttggcgaaccagttttggctggccaagtttggccagctagggagcccatttagccagtcaaatagcttggagagtggaatagctagtctgttggagctcgtttttttttttcaaaattaccaaattttagcttggagagtgagatagctatactgttggagatgctctcatgagacgagaaagacaacggtgtgggggctcctcatcgcggccggatcaagggggcgtgcggtggcgatggaggagagggccacactaaggggaaaaggaaaagagaatgaaggtattattacttgtgattatcaatcaaaaattgaattgtcaatcttaaacttagagttgattttgaggttttttttatcgaagtttattttttaacctttgatttaaatcgttaagaacacatatatagaagttttattcacaagttacatatcagttacatattgttgttacatgcaagtttatattacactatagttatactatatttacatttgattcttttttttaaggaaatctgtcgataaaatatcgcaaaatctatttcgagaggcatctcgatttaggcttaacgagcgacgcggacaattacgtgagaagtactaatagcgctacagacatgcatgcaagtagtttttgctattaggttatacattttttttcttcttatgaaattttctcttaaattacttatccgatctatgatccgattacaccgttgtgttcgtaacaattaaatctttacaacaagatctcacatgattatattttgatgaaaaatcacaaattacttttataacatgtctaaattacttttagattccactaagttacttcttagacatacaaaagtaaattcagtaaaggctaaaaataatttacatatattatagaagtaacttagaacaaaacaaatgtaactttggcatgtcatttgaaataaatccgttgtagagataaaaacatgactctatctagaaattaaattaatcagcacaaattataaaattaactaaaaacaataatgaaagtaatcacctcagagcattatgaatgtataggaagtattttaatcaaatctaaaagtaacttatatatgataattatatatatgataatttgttcaatgaaaaaatgtattaattaaatttactttctttttgttataagttaactctataatatatgtgaattacttttaagctttactgaatttacttttgtatgtctaagaagtaacttagtgaaatctaaaagtaattaagacatatcataaaagtaatttgtgatttttcatcaaaatataatcatgtgagatcttgttgtaaagatttaattattacgaacacaacggtgtaattggatcgtagattggatgagtagtttaagagaaaattgtgtttgaagtatagctaccattagctgtgtagtgatgtctatgaaatatgtagtaaaattttaaccggtgcttgccggtaggtgttggcctgttgggtgcgtaacaaaaagtgcgtgactgatcaacgaaccaatcacattcgttcttctccacccagtgctacaacaacctataaaaccttctcctcctccgcacgtacacatccagaatggcgctctttctgccactactagtggcggcgtcgttgttctcgccagcagcagcgctgctcgccggcggcgagcatggcgtcgtcgtcgtcgagccgaggcaagtggagatcatgttcgacctcgccacgcagtcatggtaccacgagctctacaggcccctcaaagccgcgctcaccgacgacggggccggtccggagctcatgggccacgccgtcgtggacctgctcgacgacgaccagccgccgtcgaagcagatcacggtccgcctgttcgccagcggcggcggcggcgacgaggcgaagctcctcgtcgcggaggacgacgcctacgtggccggcttcgccaaccggacgggccactggcacacgttccgcggcgggcgctgccaccacccggtgatcatccccgccggcggcgcggcgccgtgcacggagctcccgttcgggggcacgtaccgcgaactcatcggcggcgtggccaacctgcgcgccgtgccgctggggagggcgtcggcggagagcgccatgcgggtgctgtcccgctacgacccggcgaccaccccggccgccgacgccaagatggtcgtggccaagttcatggtgatggtcaccgagcccatgcggctgaaggccgtgtcgcgcgccgtcggcggccggtgggaggaggagagctacctgagctccgacgaggccaagtacgtgccgtactggggcgagatatcggccatgctggtggagtggaacagcaccggccggtggggtgagctcggcccccggagcaagatggacagggcgcggtgcccgcggcccgccggatgcgaggacgacggcggcgacggcgacgacggcggaggcaagctattcatgatataagatttcatgattgtatatgcacggtctggtctgatcggttcattgtcggcacttccataatctggagtgattaggttgatctgcacctgtgtctctgtgtgctctgctgctaattaataaagtctctgctgtgttttggttgatcaagtttgcttaattactattgttgctctaattttacaagctgtaatggaagaagttaattaaacttggtcttgccaaagatgtagaatgaacaaattaaatgggagggagaggatggatacagtggccgttagatctagtatgctcggtccagattaaggcagcaagcagagatgggatattaactatatactctctgtcccataatataagagattttggagggatgtgacactttatagtattatgaatctggataaagtgcctgtccagatttaaagtatcacatcccttcataatcccttatattttgggatggagagagtattgttaaagtattaaactcgtgagaacaagttaaccttaggacatgtttgacgtataatatttgaataggttttaagtcaggttagcttcaccgaggtatatataacacctcttccacaatgcaaggagggtgtgttaagctaagccgcacccatcttttaccatttcaccttttagtaagatgagataattaaattaagttgcagcacataatagtgattttttttattttttacgagtgatccttagggctaatgggatcatataaaggatcagtataaggatcactctataatatacatgtagccttaatagaggggacttaatacgtccacctattttcacatcatcacaaatttgtgtcggctttccttgtgagttgtgacagtgagactgtgtgaaaagcaagctataaggggtgctttactaactacttggcggaatgtttggctagaaaggaataggaggatttttcaaaacaccccttgctcggcaagtgaagtagctcattttgtaaagcaagacttagcaagatttccgaaagacggcctttagaccaccttgaggttcttttgattgcttgaactcctatcccttcaatgggattgtaaatgcttttggttttttcctcctttcaattaaattccagtagttctcctgccggttctgccaaaaaaaaaaaagacagtgggactgtgcgagtggccacacgaaccagcagaatcacacatacagctcgggagaacatgaagggctatagctagcttaggtttcctcacttcctctggccaatttcactgtgccgctttcattgatgattattagatcatggttgtctcattggtgttcaccgatggatcagcttccattgagtacaaattaatttgcatcatattatctcaaaatttttcaatacgaactgcccttctcaatttatatcagagaatcaagtttttttaaaaaaaaattgaagaagcaggagctcctctactaaattaggacgaataatttggtctagaaacgaagaggagacagcgcggtgaaaagaccggcagctgcctcacgcgcggcgcaccgggatatttaactttttgctacactttcataatagagtaaactatacccacaatacataatttggtagctgtgtgtaatttggtgcaagaacatgagaaatgagctagtgccttttataatagagtaaattgcacccacggtacatagcttggtaggtttgtacaatttggtgaaaaacatgacaatgagcgttttagtgcaacgactcgacagatgggtataatttagtataagaagtttataagtgatcgtataaatacaacaactttcaaggtagatacgattttgatacaataagttaagaatttatatgataacttaattatttggtgtattttttatacatgtttaatttttaagtacttattttgacaatttactagtgtggatttgtttaagcatatttatatttttatcgtaacaactaataactgaaagtcaatataagtggatgtagaaattattatatatatttcggttgagatttaaaaaggtgaaggaaacaaacattattaaaggtaatgggatgtaaattggatgtgcaacgtaatttttaaagactaaaatcaatattatgatgtaatatccgtaggattgctgtgtaatggtatattgatatcgtgaaaaaaaaactcacctaagatatacttaactaatacttaactaagttgatgcaccaaaatactaataacttatcaagttcttgtactagaatacacctgcttttcaagttgttgcacttggacgttcaattctcaagttttgcactatatcacgcacacctgccaagttattgaatcgtatgtgcaatttatactctaataggtcctcatatgtgtgtggatctaatggtaaatttttaatggaagtagctatatttatggcgccatatttttcaccaaaagttagtcggcatgtatttatattgtaaggcactaaattacatatgtaattttagtgtatttacaatgtaagtcccaaaattacatatgtaagtactaaaattacatatgtaagtcacaaaattacatactaattacatatgtaagtagtgtgtaaatagggtgtaactactgtctaaatatactactaatatatactaattacatatttatactttaattacatatgtgtttcgctggtcggtacaaatactcatacttgatcgagtgcatgcagtgaagaaaaaaatagtagcaaagttctccagtagaccgctaattagcaacctgtaacctatgaagcacaactagttacgcgtaattaagtatgcgagcacgaatcctatgaccgatccaatggctcaacaagcgactgtaatcaaccagaaaatgtgtcgccaaaaatttagcaaaaccgtttttaattaccacgttaataaaaagtttaattattcccggcgcgcttgcctccgggctccggcgccgctcacctgccaagccactggaccgcgctataaaaccgccgtcgcactcttgcgaacccgagccactgtgctgcggcttgcacgccttcctcgccatggccaccgcgctctccgtctccctcctcctgccgctcctgcttcttctccatctcgccggcaacctccccgcggtcgtcgtcggcaagccgcacatcgagggtcccccggggcccgagatgatgatggtggatctgcgggactacgggagcggcgtgggtaccttggccgtgaggatggacggcctctccgtcgccggcttcgccaaccggagcggccactggcacgccctgcgaggcaacgagcacctgttccgcgtggcggcggcgacccctctcccgttcggcagcagctacggcgatctcgtcggcggcgtcaagaacctgccggacctccccttggaggaagacccggccaccgtggtgatctccgcctacgaccccgccgccgccgccgccgacgacgacgacgaggtggagctcaagcgggcgctggcgacgctgacggtggtgatctgcgagacgcagcggcttcgccccgtcatggacaccgtcctggcgacgggcggcgggcgccgcggggcggctcgcgtcgccgccgagcacctgccgtacatcgagcactgggacgccatgtgggacgagctgaagcggtggcggaggaccggcgagtggggcggcgggccgttcgccggcgagctgcgggagagggccaagatcggcagcgcgaaggaggcgctcgccgtcatcgggtggaccttccgccatattctgctgcgccgcgatggctccatgcctgagaggaggaccgaggacgtgccacgctatgggacattcgtctgacctctaactcgcgagtatgacgttgtagtagcggcaagtttatatcgttgacgtgcgtgctgtttacaagagcagatcaggtggctatagcctatatattgccttgatgaatttttttgagaattaatattatttttatggaaaatcgcaaaagtagtggccaatcggggaaaatcgcaaaagtaggtccctgtcgaacgggtgcaattcgatagggcacctatcgaacgacgggcagtcgacaaagccctgtcgaacggctggcgttcgacacgctcacttgtcgaacggagggaattcgacagggcccaccacccggcgccgcgaggcctgtcgaaccgggggcgttcgacagggccctccaccgaccctgtcgaacaatgggcgttcgacaggccggcttaaagccccgtccacccaggccgcgagttcgatttgtttgaggaccacatcgccagccgccgccgagagtcgccacatcgtcggcgtgagcgccggagggagcgaggggaggggatagcaggccagagaggaggctgaggaggcgccggccgggaggaaagggttggtgacgccctccagcagtgaagttaaggtatacattagtaatccctaagtacaatgcatatgaaagtttaataaaaaattggtttaagagttgttaattgtttcgtattgttcgatgttagtatgtatggttagcacatatttgttattgctaaatgttggtagaggtatttaagtaattgtacggttaaattagttcttagttagtacatattattgatatgttgtgtgttaaaataggtacaaaggtgttatattttatttggattattaaactagttgtttgttactaatagttgtaaattagtacacggcaatatagtataagttgtaatagggtaattatcgaatgattaaatgattaaacgtgagactatttgtcatgttttatcaggatgtcaggtgatatgcccattcgtctgtattatggcgatgctcctatacaaatatgtgatagcggggtggatttgactgtatatgtcttccatgatactagtctgaatgcaccggagcatatgggtttgaacgacgtgttagggtggttgtataatatatttggggtagatccagtgcacgataaatttgtcataaatgccgtgtggccagtgaggggtcaacatggatggcagtggagagtagtggaggttgcgtcaactgggagttggaggaagtttgttagtaaagtaagggagaaaggctatagcctagcaatagtggtgtagaagacaacatgtgttgatcgatcgggggagtcaagtcatgccgtggtggaagaaactccgttggaaggtggacaagctgaaaatgtttggcggactgagcaaggtcgaggggaagaagtagtagagggtaatacacaaggagaggtcattgttcgtggtactaatcgtgaggccaacgactcggacgatgaagaaccggattcgcctatgcgtgttgatgcagcggaggagaataaggcggtagtggatcagatggaagtggaaaacgaggaataccttgcgcttggtggaaggagaagatacaaccctgtagggcaacaaaactaacatacccgatgattggacggccatatcaatgagttgtatgaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatttccttggagagtgcatggttacaagccacaacatgacactttatgggtagcttcgagggttgagcaacatacgtgtttgttggagaatacccgtctggtgcacagaaacctgacagcggcatttgttgcacaaatggtatattcaaaggtggttagaaaaacatctttgtcccctttcaccataatgcatgacgttgagaaagagtacggatatgagatatcgtacgacaaggcttggagggcaaaacagaaagcattggagatgaggtttggaacttatgaggattcttatcacaatcttcccccactattggaggtgatgcaggcaagaaacccgggcacacacatggctattctcgatgaggtgaatgaatatggggagaatgttcttcgtcgggctttctggtcatttgggtgcatgatagaggcctttagaaattgcattcctttgctctgtgttgatggcactttcatgacaggcaagtacagaggaacaattctaaccgcgatcggagtcgacgcggatagccatgtcgttcctgttgcttttgcatttgttgaaagcgagaacacatcaagctggctatggtttttgcggcacattaaaatgtgtgttgttgaaaatagaccaaatgtgtgtgttctacatgaccgacacgccggtttgctatcagcgatacagaagcttcaagaagatgtcacacagtccgtgccatggccagatttacatagcagacggaactctctcttcttttgtgccacaattccctcgggaacctgtgctttattgaaactatgacaaaactctgtccaagtaacttctgccccagttggacgggtcaccatgtagttgtcccaccaaatagaagcgggaccttgcagctggtgtgtagcaaaagcaaccttctcttgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgctgctgtgcttgctgctgcacctgctgcaacacctgatggtactgttgctgcatctgttgcatcatcattgtcatcatctgagtctgattgtccaacacctgagcaattgttgggttctcgggcggtggggacggactgttgtcagatgcactgttggcacgtgctccattgatcggctcttcgctgccactggcgttgttcgagtcgcgtgaaccattccttatctccatctgaaggagataggtagaaatatgagaaaaggaagaaaaacagggggctcagaaactaatctttcttatgaatttaagtgcaattatcttaatcttgattaaaacactgaaaaagaggcacacaactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgattttatgcatagaacaacatttttcacgaaccgagacaaaagacactaatgcaactgactaaacaataacttaatgcatgaaatagatgcatagtcatactgatacgcataaacttaccccacctgaacatagacacgacctaatgcatatcacccgacaattcccgaccgactgccgaataaattccgaataaacttttactaaatccctagactgtcccaagtcgagaaatccaattaaataagcgaccaagatttttcccacaaatcaaaagaacaaaccccaaaattttcccgaaacaaaatccaagtgcaaaagggcatatgcataagaaaaaaaaagggttcagagggctcttaggtttccagttggcttgtcctacggtcaaggtcggctctgataccaacttgtcacacccagaaattctcgaaccagaatttctaagctgaatgtgcattaaatccctgtccaggaccagccaaggcacacaaacgacaattgttgacatacagacccacgtcttacaaaaatataaaagattacaaatgcagcgggaaagattaaagcgagctaaaccgggaagcttgacttcagcagcgggcgactccactccacaggcaaaccttgacggcagcaacgaaaccaacctctctgagacggctccaactgagaagaacttcaactctggtgtgggggaaaagagagcaagactgagtactacccactgtactcagcaagtcataccggaagatgaggtatgatgcaggatataaccaaaggaagctaggggttcttttgcataaagcaggcatttcaaagcagtagttgaaagcagtaaaacagctgtagtatacccaagttatcaatggcataaggtaaccaatatgtggctgaggaataggacccatcccacattacattgtaaaagaatgcaacatttaatagaaatgcaggatgttggtaaattgggtacaatatgatcaaacgtattgcatgacttgccttgctctcgaactgatgagacctcagcaacgtcttcgagaaaccgcggatcaacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaaagtccttaattaattattgcgcaataatacccagggctgacgtcatccagggggacggtggcgccgacaggcggggcccatgggtcagcttctcaaaggggagaggaagggggcgccggcacgtgggccccacgggtcagcggctccaaaaggagggaggtggcgcctagcaggtgggccccaccgggcggtggctcaaaggggaggcgagggaggcgccggccgggctcggctcggcctcaagaccgaccggccgaccaaggcgaggcggcggcgaggcacggccaccgacggcggtgaccggcggtgcgggaagcggcggcgacggccgaaaggcggcggcgcttggccgaagcagcggcgtggccggcgctcgcgggaaggtgaggaaaggagggggagggaggactcaccggcgacacggcggccggagcggaagacgaaggcggcgacgacgacctgacgagaggaggggcggacgagcggcggcgacacctagaggaggggaggagaggagttagggatggagaaggcgaccgcgacgaccaaagtggctggccggagacagaggggaatggatagctccccggctcacgagggagatggggttccggtggggttccggcgacgcgaggcggtggccgagatggcccacacggcggcggagctagcggcggcggcggcttggcgcggcggcggccctagtggcaacggcacgcggccggagatgggcggcggcgacggagctcggcgagcgtggcgcgacggcggtagagggcgtgggagaggacggtgaatgggggaaatgagagagagagctcgagtgagggtttttatgggcgagggaggggcgaaaacggccggggatggcccctatttggccagcgacgtggagaggtggaggagagagagagggtgttgggggatttcaaatcccccaccacttgcgggcgcgcgcgcgggagatgcggggagagggcggcgacgtgggcgccaggtgcgggcgcggagtggaggcgcgatgtggagcggagaaggcggcggcgcgggcggttggagctccggctccaacgaccggaggtaggggacgaccgacaggtggaccccacctgtcggcgcccgaaagagaaagggagggagggaggacttcggggaggggaaaggaggagcgggccggcccaggaaaggggtgccgagcgcggggagagagatgggccgacggcccatctagagaaaaaggaaggaaaagaaaagaaaaagaggagaaggattttcctgggattaaatattgcactttggtgatttttaattggttaaaattatttccaaggctatgaaaattccactaaaaatcttgttaatgcattggagcatgggaaactcaagaaaaattccaccacgctatttccgattattaattgcatttattaactagggatttagctctaggttaattaagataatttcttcgggcaatttatttaaccaatttttaaagcaagaaaagggggaaacttctgggcgtgatagagtagctgtgctgaatttttctggaggggctttgcaatggttacagtccactagagctcatgaaacgtgtagaaattgggaggagtttgttagggcagtgtgtgcaaaatttggtaaagaggaatttcaaactctgattcggcagttcaaccgcctgcaacaaacgggctctgtggttgaatatgctgagaagtttaatgggatcatgcatagtctccatgcacatcattgttcatggagtcatctcttttttttttactcaatttattgatgggctgcgagcagagatcagagctgctgttattttacatagacctatcgaattggatactgcggtagatttggcttgtttacaggaggaggttttggaatctgttcgaagggaaaatcgtagagccgaggttgtgggaggagcacgcggcagtttcaaatctgggggtttctcttctgtgtcagctcgtgcaattcctggtgttggtggacgagcggatgatcggcgtagtcaggatgatcatcgcacacctgaggacaagattgcagccctacaagcctatcgtcgagcgaagggtttgtgtcacacatgtggggagaaatggagtaaggaatacaagtgtggaccaacagtgcaattgcatatagtggaagaattgttgggtatgttccctagtgaggctgctgatgggtgtgacagtgattgccgggaagatgaagttactgaatctgagggagttctctgtcaaatctccaaagaagctatactcggtacttagtcagctcgttctgtcaagttgcagggattgatacaacatcatgaggtgcttatgttagtcgattcgggcagtacgcacagttttgtttctgcagaatttgctgataagctttctacccagcaatatttctgtccagctattaaggtgaaagtggctgatggaggggtactgagttgttcccgggaattgtggaattgtcagtggtaggtacaagggcagtcctttgttacaactttgaaatttttgccactgggttgttatgaggtaattcttggaatggattggttggaagatcattcccctatgcaagtggattggtgacacaaaacgctatcattccaacacttgggttctcctgttactcttaagggagttcagtctcgggtggatacttgtccggttatttcagcacttcaggtgcaagggttgctacaccggaatgccattgtacaaactgtcgaactgtgtatggtcagcactgattcagctcaggttgccttacctcctgaaattgatgccctgttaaccgaatttcagtctatttttgatgaaccacaagggttgccaccatctcgagtgtttgatcactctattccattgcttccgggtgcaaaacctgtcaatttgcatccttatcgctacaacccagcacaaaaagatgaaatcgaaaagcaagtacgtgagatgctgcaacaaggtgtaattcagcccagtgccaaccctttttcttctcttgtccttttggtactgaaaaaggatgggacatggcggttttgtatcgattaccatcatttgaatgctattattgtcaagaacagatatccccttccaattattgatgagttgttggacgaattgttgggtgcttgtgtgtttactagtttggatcttcgagcaggctttcataaaatccatatgaagctggaagatgaacacaagacagctttcaagactcacaatgggtattacgaattccgggtaatggcttatggtttgactggggcagcggctaccttccaatgactcatgaacaccattctgtcaccattattgtgcaaaggagtgcttgtgttcattgacgatattttgatttacagtaagacaatggctgaacatgtgctgcttctgaagtcagtgttccaactgcttgctcaacatcaattgaaggttaagcgctcgaagtgtacctttgccagttcacaactcacatatttggggcatgtcattagtgatgcgggtgtgtccaccgaccctaagaatattgcagctgttgttcgttgggcagtacctcaaaatgtgaaggaagtgcgcggatttttgggcttagcaggatactaccgcaagtttgtgcgccattttggggtgatcagccgtccccttactgatctcctaaagaagcatgtcgtgtttgtttggactagcgagcatcaagctgcttttgatgcgttaaaggcagctttgacttcggcaccggtgcttgcacttcctgactttactcaaacttttgagattgaaactgatgcttcagaccggggagtgggagctgttttgatgcaaggtggtcaccctttggcttttcttagtaaatctcttgggcctcgcaattgagggttgtcgacttatgaaaaggaatgtcttgctatattattggcagtggaccattggcgttcatatttacaatttggggagtttatcatccgtactgatcaaagaagccttattcatttgggggatcagcgtcttgctaccctttggcagcaaaaagcactcaccaaattgcttggactgcagtacaaactggtgtataggaaaggtgttgagaatcgggcagctgacgctctgtcgcgctgtgactctcctgagattcttcagttaagtgctttatctgtgtgtgttccctcctggttggatgaggttcgggacagttatgctagtcacccacatacatccagcttgctttctcaagtacttttgcaaccagaatcagctcctcattttagtgtaacagatggagtattacgttacaaggggcgcatttggttgggccataatgtgggactacagcagaaggttcttggagcattgcacaatgctgctgttggtgaccattctggagtgcaggtaacctatacccgattgcgcagactgtttgcttggcctggtctcaagaagtcggtgcagctctttgtggattcctgttctatgtgtaaacaagctaaggcagaacgggtgcgatacccgggacttcttcagccattacctgtcccagaacatgcctggcaagtggtgtctttggattttatcgaaggattacctctctcattgggattcaactgcattttggtggttgtggataagttttctcgctatgcacactttattgccttggctcatccgttcacagcttttgatgtggctttagcatatatgcaaaatgtgtacaagcttcatggtctgcctcaatctatgatttcagatcgtgactgtatcttcaccagtaatttatggtctgaattgttcaaattgactgatactcagttgcgcatgagttcggcatatcatcctcaaactgatggacaaacggagcgcgtgaatcagtgcttggaaacctttcttcggtgctttgtccatgcttgcccgcgtaaatggtttcggtggttggcgttggcagaattttggtacaatacaactcctcactctgctctcggtaccactccttttgaagctttatatggtcatcctcctcgccacttcggtgtacgttatattgctgaatgtgcggtacctgacttgactgaatggttgcaagagcgtcagatcatcactaatctcttgcgtcagcaccatcttcgtgcacaacaaaggactaaatctcaagcggacaagcatcgttctgatcgggtcttcgctgttggggattgggtttttctgaaggtccagccatatgcgcaaacatctgtggctgcgcgtgttaacaacaaactttctttccgctattttggtcccttttaggtgacggcgcgtgttggtccggtggcttaccgtttgcagccgccttacgactgtgctatccatcctgtcgttcacgtatctcagctccgcaaggcttcacctccacaatcagctgttgcagttcggcctcttcctcttgttgagtctgaagaattgattccagttcagatcatcgctcgtcgtctgtacaagcgtggcgcggctgctgtggagcaagttaaggtgcgttggatggggcaatcgtcttctgatgctacttgggaggatcttgctgtgctgaagcagaagtttccaactgtgccggcttggggacaagccggttgcccagaaggggggcatgttacagctgatgataaccctatcaagactatcagacgctcagctagagagagacggcccaacactcgtgtaactgggccggagtgggtctgaaagtgggtcttgggtatgtgtctataaatacccaggcgtgagtgggaagaggtaacgaatgagaaatctgtacacagaactatccctcaatctaatacaaatcctcttcctgctcatttgcttctctgtctttttcctatctgcttcccttgttcttcccgttcttccacgcaaggtgttcgacgaaattcccttgagaaagatcgtaacactttaatagcaagataaaagagcaaagcttcgatcgatcagctgggatgaaaacagaagcgatgaaactttaattaggagttattaccttcatacttgtaacatagaaataaatgttactcaatctagttcttcgaatctagattatggttataaattttattttgggccaaaatctctatgcgccaaaatttacgaacaaatcagtaacttctatacttttttgctagaaattatttgcaaattcaacaaaatttgattgagttttaataagctttgaccaattttttttaaaggaaattaaaaaccaaaaattccgggtgacatattcgcttgtatgtagggggtgaaactatcagaattaacaaaattttgctcagaaattgacaacctgatcttggcatgattcatattcctacaatcctttgtttcgaatgcaaatgagaaacgttcaggggttttttggttagctccacagagtagtgggctagacgatctgggttcaaatcctcactccttttaattattgatattagatcatttcctaatattcccatatttgtttgggatgcaaactaaagttgttaatttagaaacagggcggtggcacataacgaagcaggattaattaggtgtaacgtagccgcctttctaataaatcagttattatggaggatatagctacctaacattatctcttgtacatgtttatagatataatgacaaacttgattttcttattgcgcgtagttaattggtagtctctatctacacacgcaaaagttgaccttgcgtgatcgagtacgacatattttttttcttactttatcacacaaaacctgctagtataatcatatggaattggccctacctacctaatccaaaaactcactcaagctgattcaagctagcagtccaactctcactctcgtaactcttgtatgcatgcatgcaaaataccaaacaacaattaagtaatattaagcacaacagtaatatgtacgtggtgaatcatttcttgctaattaattaagctactacacaaagtgacttagtgacacacgggtagctagctagtaggatctcttagatacttatatactccatccgtcccaaaatataagcatttttagcatagtaataagtcaaaaaatttttactttaactattaatagcaaaaaaataaaagatcaataatgtaaaattgatgttactagatttattattaaacaaattatcataatatgcaactcttattatttaaaacatttacttttatagatattgttggtcaaagtaacatctcggagaccgtgtaagagtctaaaaatacttatatttgggatagaagagtacttttgttgttcttgttaataaagtttgatgtttagagcgagagctataagaaacctgaatgcagaggtggatgagagagaagaggagaaagaagagaaacaagttgtaagcatacaaccggtttaggcacatgaatcaaaaaaatatgtgagactgacatgtggaccatatatttatagtaaagagttaaccactatctgagtaagttgagagatagactataaagatctatacaataagtagccggttatattattagtcttgctattattaattatacctttattaagcagtattattttgtgattaactttttagtggcaagtatagctagtaactaaagctaggcgatgttgtagcaaatcttcttgaactcttctagatggttctcgaagagtggcacgtagacgtcgatgctgccgtcgccgaggaaggaggggacgaggaagatggtgccttccatggcgaggtaggacggcatgaagtacagggggcagccgccgccgaagtcgaggtcgtagaagctcatgcccagccagctgtccacctccatgtccgggcacaccaccacctcgccggcgtcggcggtggggacgaggccctccgcctcgacggcgccggaggacgcgaagtcgacgaacgagcggaagtaggcgtcgtcgatgcccgccacggcgcggtggatgagctccgcggcgtggtgcgacgggcgcgcgacgagctcgccggcgtcgcagcgcgggaacgcccagagcaccaggttgccgaagtagtcgcgcggcaccggcgggcgcatgcgggcgcggccgttgacggcgatgcggaccctggtggtgg

SEQ ID NO: 74367 - DNA, 36468 bp, Oryza sativa
  unsure (1)..(36468): unsure at all n locations
gggctgcgcggcggcgctggacgagcactacgcgcacaccatgagcttcggccggggccgtggccacgccgtgctccgcgccgccgccgccgacccgcggtgcgcgctcgcctcctccctcgccgcgcaccacgtcgccccgcgggaccccgcccgggccgccgccttcctcgccgccgccgccgacaacctcgtaagcgtcgtcgcccctcacgttgtcgctcgccgccttaattttttcccccctcctcgaatcctccatttactcggtgagcttgcgctttcgtgttgctctaaacttccaccagggtgcagcgacggagtacgagagggcggtgttccgcgcgctgtcggcgctgatcggggaggagagggacgagcaggtggcgatcgagcggcacttcgaggtttgggggtagcttgtctccattttttgtaaattgagagtatgtgctgctggataaattgattaatggcaagaattgattggtggtgtgtgctttacatgtggcagttgctgaaggaattccccagggatctcatgtctctaaagagagctcagctcatctgcttctacatgggacgccctgatacatcgctcaaatttgttgaacaggtaagttcactacaaaggctcgtgtatgtttatatgcttacaaagtggaaatatcgtatataactaatgaaaccgaagttgaatctaacactgtttgttattatttaaaggaacacccatggtagcaactttattgaatcatcacttcaaaactttggataaaaataaaatattttacaacagttgatcaaaaaagcatcacttttagtgctgggattttgtgtgcatgcgcgtgtgtgtggaatagaagaatgcaggattttctggatgtgcttcaaaacacttcctcttatcaatgtaccatagttctaggtactattcttttcattagctttgttgtactcattcttgatcaggttttgccagagaatcaagaccagaactacatttacggcatgcttgctttcccattactagaacttggaaggatggatgacgctgaaaaagctgctcggaaaggcttggccataaacaagaacgactgctggtcacagcataatgtatgcgggtggttttgacataattttgttattttaagaagtttatcggcataacagattgtgttatgcatttatacctaatcgttcatattctaccgacaaacttctttaatacaagcttcatctgccattccatcttgcagctgtgccatgttttccagcaggaatgccatttcaaagaagctactgagttcatgaaatcgtgttctccatcatgggcagcatgctcatcgtttatgtatacaattttccacatgatgctctctcgtttgatgctagtaataactaataaccacagaaatagttcttacaaaatcattttcttctttctgtaggctaacccacaactggtggcatgttgctgtttgttacttggaaggtgaattccctacaagtaaagttctggagatatacgatcataacttcatgacagagcttgagaaaagtgattgtgaggcagcagaggtattaatgctggccatttttcctgtacatcaatgttttagagacactgagtaatttctcatgcatcaggtgtaccttaatgcactagggctgctactccgtttgcatattcgtggtcaggttgatctggccaaagatagattggcagcattgctagatgcacttacgaatgaggtactgtctcagcttcaataatttcaaatatattcgtaaaaactgttcagatttaagcttcaataatttcaaatatattcataaaaactgttcagatttaagtaagctgtatactgctgactgccaagagcattttacaggtctgaactaaagctgtgcaggactcatttttctgactatttcgatttgaactttgtactttgttcagaaaatatggcatgtggaatggctccttgatctacttgtattatgggcactgtcaagtatgggtgagattacaagagcagacaacttgttggaatcacttaggtcaaggtcagatacattaaacttttcttcagggaacacaagactctgctattaatactagtcaataatgctagaataacccattaaccttgcagagttagttcgatggacacaaaaaaacagcaagtgatgcaaaaggcaatccaggtatgctgaattctgtttgcaagattaagtaccaagacacaagcaatatataactcatgcacaatgaaaagtgtggactatcatttgtctagtgtttctgaaaaatgaacaccattcacttctgatgcctcaatatcattacattgtatgtttttgtggcattactattacctgctaactaattttaagatatgtttgctttcctgtagctattagtttgtaatttatttaactttttacatgcatgcctactgtactgttgaggagtattttgaaagataaaattgcatatttattctataaaagatactatatttttgctgttatttaattctttccttggcacagctagcagaggctgtgtatgaatatggaaaaggagagcacaagaaagtctttgacatcttgggtccagatttcgatgcactcagttgtaaagtatgattaacaaacctgttttcgttcaagacaagtagttatcgtatttgttttcttttactgaacatcaacatacgtacaagtagatgattggggcatcagatgagcaagtggatgtcttcaatgaagtttggtacactgtgctaataaataccggagagagttccagaggtatttgcctatttgttcttcatcattagaaaactaaattactgttttgtcgctccttaaggagctaatgcaatttggattgtacacagcaattgaggtgctcgagaaacaaattaggaaacgagagggtgcacccttcttgtggcgcttgctggtaagtatttactatttatccattttgcattttcttctcgctaatgtttcttaactgacttgttaaagatccgaaacattaactccaataatctttaaaatatcttgtcatgacacgtaatgttggttgctatagatcgatggttgcctgaacatagcattttgacaacaatctactagtactttcagataagttggtggctgtgctataggcaaaatagaaatatttgcgtcaactttgtatcatctgtagagactgctggcattcatctttgcatataagcagaatgctacaaggcatttgagattaatacgtgtttctgtctagtatcaacacatcaactgatatctccatgccaaatgtaacatgtgaactaaggaatgaccttcggtgcaatcttggcctaaccttggacttcttgcaaacttattttatcggccagaccaattagtaccattctgatattcatcccaggccctattctgaatacaactaccctcagggtttgtggctttaaaaaggtcaagccaattcagttgttgcttggtaatccgtaatcatacagaagacactagtgaggtacacatatttccattgtatttctaataggatttagttgttttctctctaccaggagaaggcatactcattgcatggcagagctgcagatgcttcagtcgcatccgaaaaggcaaatgctctacaggctgcttattctcgttaatttcgagttatgaaatacagtataccaatatgcttacatgccctatagagtgcacattcgctgtttgacataataagtggccgcgaaccaatttatatatgatttgatgggacccttacgagttactccctccgtctcaaaaaaagacaaatattgggtttccgtgtccaacgtttaaccgtccgtcttatttaaaaaaattatgaaaaaaattagaaagacaagtcacataaagtattatcatgttttatcatctaacaataatgaaaatactaattataaaaaaatttcatataagatgaacagttaaacgttagacacggaaattcaggtttatcattttttaggacagagggagtacgaccggaccaatgagcaaatatgttgttttttcactcttgttctatctgatgctacgaggaaattgtgcccagcgttccctgcactgctgtcgtctgacagcattggatatgacaaaggaatggatggcagctactccctccgtttcatatgctttaactgaaatggtcgatttttttttaagtttgacaaaaatataaacattttaaacacaaaacaatcatattatcaatatatattaaatgtttgttttagttaaactaatttgatgttatagatgttagatatttctataaacttgatcaaactttaaaaagtttaactaggaaaaaatcaaagcaacttataatatgaaatggaggaagttgtaatttggtgaaatcatggattttcactccacaaaactgtgtgtacaagttctacgagattttgaaaatactaccacaagcagggaagtaccttgtactaccatgcaaaatttcaagagcaaaggattaaaaagtggttgggcccacgtgtcatatcttctctcatcctctattgccctcttctcccgagctcgaatggcagatgtggcagtggcaatgaggaggctgctgttgtggggaagaaaaagagagatgagggaggggaccgaattaaatttgaaactatactgtttattcaattttttgctagaaatattcgggatgcaaaatcttttacaaaaatataccatcggtttcgcacaacaattgcgcgaaaatgacatgaaaataacgtcgcgaccggtatcgcacaatgaaaatgcgagaccgcacggtctcgctcaagcaaacagcgataccgtgccttgccgatttaattagcggttaattatgataattaatcactaattattattagttaattgttaattaattacttaatcactaatcaaatggatcccattggacaatatcgctgatggcttctgcgagaccgttcggtctcgctcttccatcccacgagacggtctcgcgctgttgccgcacgagaccgtgcggtctcacgctttcgccgcgcgataccgtccgcgacgtcatccccacgtcatttttgcgcaactgaagtgcgacaccgatggcatatttctacacaagtttttgcatcccgaatattcctgaaaaaaagtgaatgaacagtatattttcaaatttagggaccatgacggagctaggctggtggctactggccatggctctcttctttggtggcggtggctgcggctacttccggtagggtgtggcgggtctcggcgatggtggcgatggtgacggcggcaaggtcacgaggcagctgtggaatttaatgttcaaaatttgatactgttggcatattttatggatcatgtgtggccatgtttgtgaaaaagaccagcataacatctaattaaacaacccacatggcacacattgatatattttgaacacacgaagtgaaattcacgatcagggttcacaatattgatattggatcaaaactgctccccagcggtatcttcggattttatgggaaaccatctattaaaccgataaaatcctaacaaatcttgtaaaaaaataaaaatcaacttgaccgaaaaattgagtggtttatgtagtccatgtttggtttcaatcggttctgtaaacaccgtttgtgacttgctttgcaattttacaaaataagtaaataaataatactccttattctttgtgtcgtctgttacatagattgaaaataagtctctttcgcatccctgaacttcgtgctggaccgtgctggcccagcttgccgaggtagtagcccaggcacagcacagctatcgggccgggccagcatgggtacaacccgactcccgagtcgaaccgtgttgtgcctgggacgggccaaatcaccgggccttgggtcaggccgtcggacctcgggccatatggccatttatacttgaaggttctgttctttgttatttttatttatagtttgcatacacttgtggtaccgcatcctttaggctacggtcgtgcactcaacccagtccaggtcagtcttctctctattcttcaatctgcatccttattttgcatttggtagcagttagtctattagaaaagacgagcagtcctttaaaatcatttaactccagtctagtaagtccactccaacctcaggtgctgtcctctctttcgctgttcatgcccagctaatctggaaatgctccaaacttctgattccccaactctaggtcaggtcttcagttcttcaccttgcactgtgtaatattgagtcgattaggattttgctaatctggattttagtttgttttagtctaatggattactggacgaagataagcagagcattgcaatcgttttgtcaagttcggtacaatgaattcaccctataaatagtaggagccagagctagtatattagtaattagcaaaataatttgttgtattgtgcttggttcgaatgtctttgttatgggctctaggtttctcacaccaattgaatgaattagatctaaaaattagggatgttgttagaggagggcacaactggttgtgcatgcaattttatggttgaaaaggcacaattggttggataggagtacactgatgctaagaataacctatggttgaaaactatggtattgaatgctaaaggataatgcgttgtggagttaaaatttccactaaattctgtatttttaattacatagaattataatagatcatctgcgtaccggtgagccagggcggccgcccggcgatggatccactagtgagtagacatggatagttttagcctttatgtttaagccctactaggcttgaagagatcctggcccaccactgatcatagatcttcgcccatatctgcttcaaacgagtacggatccttagtgtagaagatgtgccggtcaaccttatcctccgttgatctcttcccatatgccttcagtagctggacgtgctggatcttttcccactcatagctgccatcttgcaaggatatgagtttaagcaatcttagactgcagtacacgtccagcttatttagctctgtctctcgtaggtactctgggagggcatcagcatccaaatccttccaaatgacgctcctaagtgattgcaaatccttcactaccttcagccctgggcatctgataacgacgatatgtcgcagtcttggactgttggagatcctctgcagcttcgggttgtcagctgacgtgagctccacaagtgacgggaagttctctacggagatcaggtgcggcgcatttctgagattcagcacccttagtgcggttgcatggtgcacaagtccaagcggaagataacgtagtttacaaccggtgatggtaacaacgtctaaggcgggcatccctggtgtttgctgatcccagttctacactctccatcccaacatcccctttaaacccagtgtttctagctttggaaatgcaacaccagcatcaccgcgagaaagaccatggagctgcagcttcntagtgatccttgttccagttgtgactttctggtcatcagcactagaggaggagaggaagaggagatcatggccaatgctcacgatggatggagcatgatcaatccaaatataatcaagaaaagggagctggcccaagccgacaggcagctgcttgcagcatacgtagtccttcagctccaaacgccttaagcttggaaagtccgacattgttctcatccatcggggtagtcgatatccaaagtaaccattgaccgtaagacattctacgcaaggcggaggacagagattactcaacacaacctcggctcgttcctgctcctcgattacattgctggttccttcgatcatcccgttgtcggtgagcctactggcaaatgtcaagtctaagattttcaagtgctttttactgttgagcattgctgtagcagccatagagcctgaagatgcaagctctagacctcttaaatcaagccattttaggttcgacaaagaccgtagttcttccaagctgctccaggcatgtcccctgtcatccaaataagttgggaaccccaacatgttcaccaagttttctagctttcccatacctggaggaattgaggttaacctcgtgcccctgaagtcgagaaacctcatattctgtagcttcaagatgctgtcaggaagctgatgaaaattccgacaccccataaggtcaatgaactgtagaaattttagatttcctatgcctcgagggattgcagatatgcctgtatttgcaagccccaagtatcttagatgcttgagatggcatatatagtccggcaggtcaacaagatctacaccttgtaaatgtagtactcttaggcaagagatattgttcctgaaatacgtcaactcagttatacatctcccaaagagcaacaatgtcctcaatgacacttgcttttgtatagcgacccgctctattgcagttttggatacagacaagtgacgcagctttgaagcacctgcaataccatgcacatcttgtctgtcattgacaagtagtccttcatctttaactatctgttgagcaaaggagcgaataacatcatgcattgtgcttgctgatagatcataggatcgtttgtatggctctagaagattccgtgacaccaactcattgtaatattcaactcccaaatcttcaggtagcgtcgatctcattatgtcatgtccgtaaccttgtgcaatccacatcctgactattactcctcttatgatcagttcatctttagggaaaagtgagcagaacacgaagcactgtttcaaatgcggaggcagctcttcgtagctcagatagaccgctttgttgatgtcgtcattgcttcttgtcattgaccatgcaaagtgattagagacgttcacccaagcatctctcgttttgcccttgttcagtaagagtccacccacaaccttaatcgcaagtggcaagccatcacatctttctacgatcttcaatccgatgtcctctagtccacaatctcagattcatcgccctcgttcagaactacctgttggagaattgccacatcagagagcaagagaggaacaaaactagggagaaaaaacctagtactagtaaaatatattgcatcaagttgttttccgctggtctcaacggcttaatttgtgctaaaaacacttgttttcctctgagcagaaatactagtaacagcctcacattttgtaggagcaagagaaataccatccaccaacgcatgtatgtgctgctgtgaataattgaatatagaatagaatgtgcatctcactaattagtacttcctccgtcccaataagaacaccggataggacatttcctagtactacgaatctagacaggctatatgtccagattcatagtactaggaaatatccagattcgtaatcctagaaattgtcctattcggtgttcttatattttgggacggagtagtacagagatacacatttctattctatattcaattattcccagtactaatactccctccgtcccacaatataagggaattttagtttttacttgtaacatttgaccactcgtcttattcaaatttttttttgcaaatataaaaaacgaaaagttatgcttaaagtactgtagataataaagtaagtcacaaataaaataattaataatttcaaaaaaaattgaataagacgagtggtcaaacgttgcaaggaaaaactcaaaatcccttatattatgggatggagggagtaataattagtactccctccatctagttttgatagtcatatttccaaatctgaaaaatttatttttaataggcatatttcaatccaacaacctatcatcttaatgattttctcagatttaatgcgtgactcttcattcttccacacaagattggctgcatgggcatcgagaaatgtaaatattaatgaatcgcttgttaacgagaaataacatgtttaaatggatgataagtagaattacttatccttggtcagtatgccaaaataaaatatgactattaaaattagatggagggagtaattagtaatgtgcatctcagtactaattagtaattaactagctgggtagcccgcgcaattgcgcggctagcacccaaacaaaatcatatattttttaaatatgattttacttaaaatttatttaatagctatctcattgtattaagactttgaaagaccaaaacttatcatcctcgtgtttctaattatatagttttgaaaagtcacaccagttgctacctcttatgctatctctttctttatttgcttgctcgatctaccactatttctatccattcttcttggaacatttaaaaattggattttgtagtttttagagtttattgtcacgttgagtttcatttttataatttctagatgtcccgtcaaacgttgccattacactcctgtacggcccgtccactgtctcttctctttattgtcattgagattttaaaaattgaacataattatcgtttgggttcatttttactttttagaagtcccgccaaaccgtcagtagctttgccattgtactcctctatggctcgtccgctatctcctttctttattgtcattgagattttaaaatcgaacctgattatcattgttttttttttactttttagaaattccgaacctttaaaaaatgaacttgttgttttattttttataatttttagaagtcccatcaaacgaggccactatgcccctttacagcccgtccgccgcatactctttattgtcattgtgattctaaaaattgaacataactatcattggaattcattttttattttctagaagtcccatcaaccgtcggcggctctgcaactatactcttatacaccccgcccgctgcttctcctttttattgtcattgagattttaaaaatcgaaatgattataaatgttttttttactttctagaagtcctggccaccaccttacttgtttgcttcacggtctgcctgacgtccctccttttaatcgtcattaggattttatttgatgttttattaacaatttttatatgtcgtatcaaccaccaccactctacttctttataggcatgttacttaatttatttcgtcatgtgttttagatggtcttttattttaatagtctttatttttatcacaaattttagttatttaaaaattgtattcctaattgaaattttatttttctttttctaattccagaatttatttcataaaaaattagctaatactgtattgtgttcttttaatgtttttatttttttattttcaattttcgttgttttataattgtattcctacttgaactctcttttaatttttctaattttggttattattttattttttattctaaattttaattaatctcgtattgggttcttatatggattcttcttttaatattgcttattttcaattcctaattccagctaattttaaattgtattcctacttgaactcttcttttattttcttttgctaattttggatttatttttatttttattccgaattttaattaatctcgtattggattcttatatggattcttcttttaatattccttatttttaatttcgaatttcagctgtttttaaattgtattcctacttggattctccttttcttttctaattttgaattttattttatttttatttcgaattttgattaatctcgtattgggttcttatatgaaaaattctttcaatattgcttatttttaattaagaatttcagatttttttatattgtattcctacatggactcacattttctttttctaattttagattttattttatttttatttcgaattttaattaatctcgtattgggttcttatatagaaatttctttcaatattgcttatttttaattcctaatttcagctcttttttcgattgtatttctacttggactctctttttcttttttttcttttcctccgattaatgtggaaatttctagcctccacagcgaacgtggtgccttcttttcgagctgtctgatagtagatagatagatagatagataatagatagatagatactatgtgatagtcttacctgcttctttagcagtgaccaagaatcacctagatccagcttctcaacccggtggaggtgctgggctctcatcccacgagcaactccgtcgttcctcgtcgtcaccaacactcggcttccaggagcacaagcaccgagcggtgctcggagcagatcgctccacaccctatcgctccacacgtcatccatcaccagcaggaacctcttctgcctcacggcatgcttcaacgtgtcctcgagcagggccttgtccccggcgcagccatggtagcttcccccaaacgcggcgatcacgccgtgcaggaggtgaacctcgttgacctcctgattcacgctcagccataccttcttgtcgaagtggctctccaacacggcgtcgttgaagaccatcctggcaagcgtggtcttgcctatcccccagcgccggtgatagcgacggcgatgacatcgcctgacgatcttgcgcgcgtgcgaccatccgccagcttgttgccaatcagcagatcaacgaggttccttgtgtgaagatctatcttgtcgccgacaacatcggatcgaatgatggatggtcccgtcttgcggttgcggctgctttctgacgagcaagaacacatgggtctatcggttagacgaagggccgaggaggagtggattacttgggagacaaatccaaagcgggagctcctcttcgcgatctcctccaccctccggttgagctcctggatcttcctcccgatcttgcgcgtagcggcagggctgcggcggcagagggcgctccagcacgccgacggcgccggagcagctcttggcggtgagccggggtcttctccgccctccatggcgcggaagaggtcaaggatgtcgtcggcgtcgtacatggcgtccttgagctccctcacccaccgctccacgcccgggtcgtggatgcgcctccggtcggcgtcggccaggatgctgctcaggtcggcgagcgtcgtctcgagcttggcgatcgcgccgggcacgcccaggagcgtctccacctcctccttcgccatccccaccaggacgttcgccagcttggccgcgaatgcttccagcgccgccgccatgagcagagaagatcagacccccaatgacaatgttgtgtatcgctgcaatgataggggcgtgcattttttttttattctccgcagcatgattttgactttgacttttttttcaagtcgtcacatcaatatacgaatatatatatttaaaatctaataacaaaataaattgcagattccattagaaaactgcgagacgaatttattaagcctaattaatccgttattgctaaatgtttactataacatcacattaccaaatcatggtacaattagatttaaaagatttgtctcacaattattttttacctatatttaatactctattcatacgtttgatagggtaaaaattttttgttttgagaactaaaaagggcagcgatcagttgactttcctgtactctaaaaaaatatataataacggtggtaagtaataaatctgttcactccatcaccaactcattatcttttttacaatggaaaaaggacgaatggggtctcagaacccacattaaaatcacaactttttttaagagaaaaatgataatgtgaggaaaaatggttcacaagttagtaataaatttatataaacaaatatcaagagatgatgtataaaaataataatattaacaatggattaatgatagttttcattaattaagtgcaatgcgcgggcaatatgcccatcattaaaaataagccggttgagccatccgagaatggataataacattcgatcccgctaatctaatctaatgcagtataagtaaatatataatttcttaagtagattttcattatgggtcatcttttattacccatgtttcgctttaacatactttaaccaatgtatttactttggacgaggtaatcttgactttgttttattttggattatccttttttttaagcatatgaacgatgttgagtacatcggctcctatttatcaataaacttcctcagttgtatggtgtagaccgtttaaattttaaaatatactgttcattcaattttttctcaaaaatattcggtatgtaaaaaattttacagaaatataccgtcggtctcgcacaaacattacgtgaagatgacgtgggaatgacgtggcagacggtatcacgcaggaaaagcgcgagactgcgcggtctcgcggaatgaaagagcgagaccgttcggtctcactgaagcaatgcgcgataccatgccatgccgatttcattagcgattaattatccttattagcgtttaattaattattaattattaattcgttaattatgataattaatcactaattattattagttaattgagtaattaatcactaattaaaagaagctgtcagacagtgtcgctcgttgcttcagcgagtgtcgacgggtgatacccgtagaacggatatagagggtattggggtacgttggtacaaggatctacgtaatacgacatcgagcaaacaaaagacgaggattatactggttcaggccccttaataggtaatagccctaattcagttgatatgggattatatgatggaaaaccacaggttacaaagggaacgatggaactcgatgaaaccggcgagatcgtaatcgagttggttcgactagatctcccggcgacttggctcctgcaggctccgacttcgtaggctgtgggggtggtgttggctgtgagattcgatgccttaggtcttcccagggggtcccttttatatcgcagatcaggtggtctccagtagaactcggagacatcggaccctacacgatacattaacgaccctgtcttgtccgagtaggactcaaacactgtggagaatttccttagtgcatgcagataatgtccgtgtatgcgcgggtatgccatgtcgatatgtggcgcatatcgaagggtaaggggtatacctaatccgtaaccctgacagtagcccctgatttctgcttaaatgaactcgtgcgaccaatagcgacttctgatgtcgagactgatgtcgttctcggtgtgggaaccgtagagacaggacatgatcgagaacaccgtgtgaagcccaacggtcacgagtgaatttaaactgaagtctgaaaaactgccgcacgtaacggacccagaaatttccggcggccatctctctcctttccttggaattcgcaccgtcggtagtgcgtctatttaaaggaattttggggatccatcttgaagtccgcccaccatgcagaaaacattccgcctgtaagcgctcttcgccttcctcgctgccacaagaaaccctagttttagcaacatatgctctttctccggcgatcttcgatcagcgatggacctcggcaaatcatcttccaccagtgcgtcgctgaagaagcttcaggaagacggcgcccttcctggtcgtggaagcatggagagggaagcaagaggtattaatccccagcccgtcttaggtcgcatggttgcgatcgaagtctatattctctgcggttttctccccccgccttccgaatttcttctcctggttttgaacttctatggtctttctcttcttcatttgaatctcaattctatcgcctttcttaacatctttgctcatctttgtgaggcctacattggggtagagccttttcttgatctttttcgcttctactacgagttgcgttggatggagtccaacagggtatctggttgcgttgggttccgacttcgggatggcctgaagtcgcgttatatccccttccagtgcccttcttctcgcagcaaatggtggaatatgtggttctatcttgagatcaaagattcagaccttgtcttcgttgttcccgatgaacaaccggacaagatttcgtcttggactgcaaagccccctttgaccccctatcttcagtcgtttatcgacatcatcgacgatctccgattacggggcttgtcggggtatgaagtcgttgcagacttcgttggtaggcggatccagccgctccaggctcgggcccatccagcctttaaatattccggaccagaggacgcgacccgggtttctcctcggggtatctttctcgcatttatcctgacatgcttatgttcgcgttccccttgatttatcgaaacttggttctcgtttcataggtctgaacagcgaaaccgtggagcgccgcgtcggccaggtgatgatcagtggtccgacaacggcgagtaacatcctcgtgcccctttgtgaaaagggggcggctgaacgtgatgacgctatcaacgtaagtatactcgataggcatcccgcattttcctttcgagatcaccttatgacttgattaagcgtaggctcttcctctgactgacatcatcgggccgctcgcggaccatcaggtggcagcgtctctaaaagagaaggtcgccaaggaggcgtctgatgctgttgcggccactactagtggtgacaatgttccgacaaaggggaggaagttctcctctgtaagcggacatcgtcgcaagacatcgaccccctcggtaagttatcctgtcgccagatcgtgccgccagaaggattttgccttacttcgcattggttgtctttcaggcctcggacgcgtctcccccgcctccacgacgacaatgtcttgtgacggttggcgagaagtaagtagatggatttttaggtttctgtgattccattcaagctttgtctgatccgtggtcgttccatagggaggcgcgggcaaaggctgcgcaaaacaagtctggagggacttccagcgcgtcgcctgccgcgccctcaacggatgtcgtactcgtagccgagagtcgggaggcaacgcctagcggcccagtcagcgatcccgcggcaggtcgtggtccacccgctgccgtcctcacctgggaggagctccaagtcgaaatggggcgcctcctcgaagctggtgctcgcggcattggccgcgagattgcagaggcgaggtcggaagtagtgttggcgaatgcgcgtgctgaccggctggtgcgcgagttggcggaagctcgtgaagacctcacgaagatgagggaattggtggccggcaacgagcgacaacgacaggggctcgaggactgtatgtcggaactcgggaacaacctgtcggaaatccgaggctcgttgcgggtcacctacactggcctgcaccagcttgccggggagtgtggcatcaagtctaccatcccggtgaatcctgacgaattctcgctgacatcctcccttgcggaactggcgacggcgatgggggagatcccctccaagcatgcggccaggatcgcggaggagacgtcgaacgggatctacaccggggcgtgtcatgtcctcgcgtgtgtaaagctgtcgcgtcctgaactcgatctgcgtgagatcttggatcagggggcggctagcaacacgcgtaagaaggtgatggaagaagtcggtgatctgggggagtctgttctccccctatttgaagagtaggacttcttgtacttccaagacacgctgtgtaaaacttgaattctgaccgccttcgtgcgagcaattatcattctagtttactcttgtatgttgacctcgggaacttttgtcctttgtagagatgtcgatgtcgaggatgtccagcagcgtgggcagcctaaattgtcagcgatccctccggatcttgcgtctgtgggacacgcgttgctggacaacgtgggtgaaattttgcccgcgaggacagggacaacgacgacttccttaggtttgtggtctcttcatcacttttcgctcctccgatttaatcagtcgtgttctcgagagagagaagcagtctgacgtagtcgtttccgtgttggacagacctcgaggacgcacttgctggccaagatcgtcgtatccaatattggaagacgaaatttgaagtggcggaactcgagagagccatgttggaagtaaaaaaggagcaggccgtggaaacgctccgaggtcgtgaggtgtggtttaactcgtatttgaagagctgctgcacatccatggccagagtttgcagagaacttcgagtggtctgcggagaacctgaggagtcggcggctggatacatctcgtggctgaacgggtgaaggcgtcggcaagcggattgacgaagctctgaaacaggagtgccgtcggtcgagccgatatgccggagggcatgtgttggcttgcatacgagatcattgtccgcaaatgcacctcgagtttcttcatgaagggttcactcgttctcggaggactcctgcggagatagaccacctggcgaagtcgatggcaccgttagcggagaaggttttcaagtctatggactggcgttggccttcttggtagtattcgtacctctggatatagtgtgtaagagtgtttcctcagttcacgactttggtcagtcgtttgagtcgtacactctccctagcccccagccttgtcgtcggaggattcttctcgggggacaaggctcttggacctttgacctgccttggttgagaaagcactgatcctagcccccagccgtgaagttggaaagttaattttccgattacacggcttggttaatacgcacggcgagaactcttacacgaccaggtcttacatggtctttcgtctctacaggatccgacaaggccttatcggctctgggcgtccccagccgaagatcccttaggttcctcggaggccttgtcaggacggcgtaaagggacatgaggataggtttcaacgctaggtgtcatctaggtaagggatcatcaggcaggaacactgtgattgtaatatgtgcctaaaaataggctttattgatactgtaaggtgtcttacaggtatggattatattgactcatacatagaatttacgtagttggtcaatgttctaagagtttgccaactcgcggccatcgccgtctgctatcttgaatgcacctggtcacaagacttgtgtgatcgtgtaaggtccttcccatttgggtgagagcttgtttcgccctgcttggctttgaacccatcggaggacgtagtcgccgatcgaaagtatgcgtgctcggatgtgcttctcgtgataatggcggagggcctgttggtaactggctgctcggactgcaactcgttcgcgatattcctcgagtagattcacatcgtcgtttccctgttcctcctgatcctcgtcggaatacttctgtactcgtgtactttgatatcgtagctcgctggggagcatggcctcagagccgtacacgaggaagaagggtgtttccttgttagacgtggtcggtgtggtgcgtacggcccatagtactaatgggagttcttcgacccatttcttgtcgtgtgacatgagcctgtcgtagacacgggtcttgatcccttgtagcactatgccgtttgccctctcgacttgtccgttgctttgaggatgagagaccgaagcgaagcatatcttgactcccagcccgatgcagtaatcttggaaatcggcgctgatgaactgggagccgttgtcggtgatgatgcgatgtggtagtccgtatctgcaaaatatccctttgataaatttgatggcgttgtcggccttgatttcccccgtgggtatcgcctcgatccattttgtgaatttgtcgatcgccacgaataggaacctgtagccgccctgtcctcgtgggaatggcccgagtatatctagcccccaacacgagaacagccaagtaagaaggatagtctggagcgcttgtgtgggtagctttgtgtgtttactgtgaaattaataggcttcacaccgctggactatgtcgcatgcatctttgagggcggttggctagaaaaacccttgttgaaaagcattcccgaccaacgtccgaccggcggcatgtgacccacagatgccttcatgtatatcgaggaggaggtgtctaccgtcgtcggacgaaacgcatttgagaagtaccccgtttggcgctttcttgtatagatcgttgccgattatgcaatagatttttgttttacgggttattttctcagcctctgcgtcatcctcgggcaactcatcgctgttgatgaatttgatcagtggggtgcgccaatcgtctgtggtttcaatatcggcaacgacgcgttctgcctctgtggcctccgagctgatgtcgggggcgtctaggttaacgtcgccgctgacctcttttactgatggttttgtcaggacgtccagaaaagtgccgggttcgagcggttctcgtctggacgcgcgccgtgctagatcgtttggctcgatgttgtccttgcggtatacgtgtcggacttcgatcccatcgaaccttttctccagcttcctgacttctgcgagatacttggataactcagggttagagcatttataatctttgtgcacctggtttgcgactagttcggagtcccctttcacgatcagtcgtttgactccaagtgcggctgcagctcttatcccggcgagtagtccttcgtacttggctgtgttgttggttgccctgaagttgaggtggattgcgtgcttgaattgatctccggaaggagatgtcaagatgaatcctgcccctgctccttggctgttgagtgcaccatcgaacgccattatccacgtttcattgtcgatttggttgtctgatttgttatcaggcatagtccagtcagctacgaagtcggcgagcacctgggacttgatggctgttcgtggcacaaagtggacatcaaactggcttagctcgactacccatttcgcaatgcggccgacaacgtctttgtttctcacgacttcgccgagagggaaggaggagacaactgtgactctgtgggcctgaaagtagtggcgtagctttcttgacgtcatgattactgtataaagcagcttttggatctgaggatatcttgactttgcgtcgtggagagcttgcgtcgtggagagcttcgctgacgtagtagactggtcatcgtactttctctctctcgacgacaatgacggtgctaacggaatatggcgtggcggcaatgtagaggaataattcttcattaggttggggagcaacaagtacaggggggtttgataggtagcacttgagtgcaataaatgcctcttcggcttccagtgtccatacaaatttgtcttgcttctccagcagagcgaagaagggttgtcctcgttctcccatcctagcgacgaacctgcttagtgctgccatgcatccggttagcttttgtactttcttgagtcttgtgggcgacttcatgttctcgattgccttgatcttctcgggatttgcttttattcctctgccagagacgaggaaaccgagcaacttgcccgacggtactccgaacgtgcacttcactagattgagcatgaggcggtatcattagaggttgtcgaacgtttcccgtagatcgtcaatcaatgagtcgcttgtcttggtcttgacaacgatgtcgtcgacgtattcctcgacgttgttgccgagctggttgctaagcgcgccctggaccgtgcgctggaaagtattccctacggttatcagtccgaaaggcatcttaacataacaaaataccccgaacggcgtgatgaatgctgtcttctcttcgtcctctttcgccatgctgatttggtggtagccagagtaagcgtcgaggaagctcaatagctcacagccggctgttgagtccaccggttgatctattcgatgaagagggaagtgatccttgggacacgccttgttgaggtcggtgaaatcgacgcacatcctccattttccgttggcctcccgcaccatgactggattggctagccactctagatggagcacctctctgataaagccagctttgagaagtttgtcgagctcttctcatatggcttgttttcggtctggtgcaaatcgccgcagtctttgctttactggcttcgcatcgggtcgcaccatgagtttgtgctcaatcacctccctagggacccctggcatgtcggacggctgccaagcgaacacgtcagcattgtcgcggaggaaggtgatgagcgcgagttcctatttctcgcttagtgatgccccgatcttaacggtcttgttggggttgccactagtgagtggaacgatcttgatcgcgctgtctggtttcggcatcttgtttgtcttgctcactttcttgggaggctcagttgtggcgggtgggctgggcgtttgctcgaccatgtcgaggctcgacttgtcgcattgtaccgctagcttagcgttcccttgaatagtgattgttcctttcggtcccggcatcttgagcacttgatatgcatagtgagatgcggccatgaacttcgcaagtgcagttctcccgatgatggcgttatacgctgtatcaaattcagcgacatcaaaggtgatctgctctgttcggaagttgtttgcttgaccgaaagtcacaggcaacgtgattttgcccaatggtttggacgaggactggggagtaattccatgaaagggttgatcggtaggtgtcaactcgcttcgtgggattcccatcgcgtccaaggtgctggcgaaaagaaggttgattgagctgccaccgtcgatgagaactcgcgcgaccttgatgtttcgaatggtgggctcgaccacgatcggattgcgtcctgggatgacggcagtcttgggatggtcttcttccgagaattctatcttctgttcagaccacttcatcttgggtgcagccccctgccatgtcgagcagacttcacgttccactttcttgtattctcgcttggaggagtacgctgtggagcctccgaaaatgtgtgagacgtggaggtcggagtctggatatgctgagtctgattcctgagcagccgcctccacatccttttcgaccacgcgtactcgcttgcatttttccaacgccatatgtttcttgagcgacttcttcaaaacgaggcagtcttccaaagagtgtctatccgtcttgtgtattgggcaccatgctttctttgcgtcgctaccctgtgggtctaggcatttggatgggttcgcgtattctgctgcgagaacttctgcttgagcttttcttttcccactcttgcgactttaactctagtcgtgatgcgtcttgtcgccaactcctgggtggtatagcgatctcggactccagacttaaaggcgcgaattacagaagcgtcggtgatctcagggattgtattcctgcactcgttaaagcgccgaacaaattcccgtagggattcacccgagttatgtgtcaacgcatgtaggtcatcttcaatcgcgtggcgcttgtaagttccttggaaattggcgatgaactgctgccacaggtctgcccacaaagaaatcgagtagggcgggaagtgcatcagccatgagcgtgtagagccttttaatgcagatggcaaataatttgccaacgcgttgtcgtccgctccggcagcatagagtactgtggagtagacttgaaggaattcttctgggtcagtactcccatcgtacttctctattgctccgggtcggaatatctcaggccatcggacatcacacagggaacgaccgaaagctctacatccagcgctgggggcggtgggttgtcggcgatcgtgtgtccttcgtggatgtctgtctgacgatgaggatgaataagaagatgacgatgacgatgaatcgcttggttccggtgtgggattacggggtcgtcggctgggttctcgagaatcctgtcgtcgccctccgttgttgtcccggcgccgatctccgtcgtcctcgtcgttatggcggcgtcctcgaccagtatcgccctgcgtacgcctctcgcgatcatcatgatcgtggcgattgtggcgattagcgcggtctcggtcttcgctcgagcggccctctcgttcttcgcgatgtcgggaagagacgcgatgttgggagcgattcccgtcgtctcgcatgcgccgtgcctctcggcggccgttgagatggtcacggagatcgccggtgccacgaggtggaggggtagcttgatggggtgactcccgctgttcgggattttcgccatcgacaccgccggttggtggttgttcccggtgcgtagcagcagcggcttctttgaacgcgtggctgaggttggttactgattcccgtagccgttcctgccaccacgcgagatcattgttcagaacgggatcgtaaggtctctctctcagtattgtgttaagggtcctgatgtgctgggccggtgtagtcacttgattttctgcctccgcattagcgtgtgctgacgtgctggtcccgtcgatagctaatacctcgcgtggcgtactcgttggagatgagctgtagtcctcgagtagatgcaggactgatggttcgtgggaatcgatgtcgattacgccgacgaatcgatctgagaccagcgttcgttgttccttgtcttcatctctaagggatatgcctgactgttggtccttaggaggtgacgtcttcgtggcgctgagaaagaccttgcagcttgagaggtcgtgattctttgtcttgtgaataggacagtaaacatcacgcgttggagaaatacgctgaattccacgctcgttgcaagcgcgaatttcggcgcggacgttgagaaaaacccagcaggcttgcaaagtgtgtttcctggttttgtggataggacaccaggaccttgtcgcttcagaagttgttctcgtcggctcgtggttcttgtcggaacaacaaggttcggccgcattagaatccttctcgagcttagatgttgtcgacgttctgttctccgcttcggcgggaggatccttcgacacggagtcgtcttgggttgcaaccactgcgttctcgtttccggtcattgacggaccggctgagatcggtatcgtggtgtaaaccgggaagacgatttcaccgacttgagtccacaccaacattgttgaagcaggaaacccgtggttgaggttggtgttgacgctgttgtcaacgaagctggatgacatagtagtagaaccttgagcaccaagtccccctacctggcgcgccactgtcgacgggtgatacccgtagaccggatatagagggtattggggtacgttggtacaaggatctacgtaatacgacatcgagcaaacaaaagatgaggattatactggttcaggccccttgataggtaatagccctaatccagttgatatgggattatatgatggaaaaccacaggttacaaagggaacgatggaactcgaagaaaccggcgagatcgtaatcgagttagttcgactagatctcccggcgacttggctcctgcaggctccgacttcgtaggctgtgggggtggtgttggctgtgagattcgatgccttaggtcctcccagggagtcccttttatatcgcagatcaggtggtctccaagtagaactcggagacatcggaccctacacgatacattgacgaccctgtcttgtccgagtaggactcaaatactatggagaatttccttagtgtatgcagataatgtccgtgtatgcgcgggtatgccatgtcgatatgtggcgcatatcgaagggtaagaggtatacctaatccgtaaccctaacagcgagaccgttcggtctcgctcttccattccgcgagaccgtgcggtctcgtggcgcgagaccgcgcagtctcgcgcgataccattcgcgatgtcattcccacgtcatcttcgcgcaacggttgtgcgagaccgatggtatatttctgtaaaaaattttgcatcccgaatatttctgagaaaaaaatgaatgaacagtatattttaaaatttaattcttctttgatatatgacaaattagatgcaaatgaataaaaaaattaagttgtccaaaatgatacataaaactacatggaccaaagtaaaaacattacttgaagggtaatcgatagcgaaacatcggtaaaaataagtatcttaaattcaaatgtagtctgttaaaaaagtgaagcgaataatcggaaaaagaggtatacccacccccacggcccaccccgccaagctcatcgtgtggcggagcggggagaggacttgttcaccggtgttgtgagaagaggggatctttgacgcgtggggtggaaaaatgctttgcaaatggcatccaacaaattagactcgggaagaccaacgatgaagaaaatagttttgtcacttgcatgtgagctcgctagtttaaagtgcaaagatgcaaactttggtaacaaaacatggtctaaagtgaaaatattttctattgcctagtgcaatatgcaacttgctcatttcgtcctataaaaaccaacctagcactggatttggcatattctattactatgaattttgactgattcagcttggcggacattgggtaggcaagtcacaacgttacattgggtagatctggaccatccaaaacaaatccaacggagatttatgtattattaaaaaaatttcttttcacgaactaaacacaccctaagagcagctccagtgtgagacaaaaatcaacgcacgggcagagaaaccgaaccaaatactccctccgtctcataatataaattttgactttttgcttgcactatttgaccactcgtcttattcaaaaaatttgtgcaaatataaaaaacgaaaagttatgcttaaagtaatttggataataaagtaagtcacaaataaaataaataataatttcaattttttttgaataagatgaatagtcaaacagttaaagtaaaaagtcaaaatcccttatattatgggacggagggagtagtacactataggagtcggccggaaatgctgttgggtgatcgatcgccctggggatggggcagcgatcgatcccctccctcctccctccctccacccctccacctgatttccttttttggcatcgcattactttcctatttcagtaaatttatatacctaaagttaatacgcctcaagtttacacatctaaagtttagagaccaaaagtttataagtcaaaagtttatatatccgattcaaatttgaatttgaattcaaatttttttatatataatatttctatacatctaaagtttatacatctaaagtttatacacctaaagtttatagacctaaagtttataactcaaaagtttatatacgcgtttcaaatttgaatttgaattatatctgattcaaatttgaatttgaattcaaatatttttaaagtttatacacctaaagtttatagatccaaagtttataagtcaaaagtttacatacctgattcaaatttgaatttgaattatatctgattcaaatttgaatttgaattcaaatattttctatatatagtatttctatacatctaaagtttatacacctaaagtttatagacccaaagtttataagtcaaaagtttacatacccgattcaaatttgaatttgaattcaaattttttatatatagtcataaatttttctaacttttgtttttcaaaaaaaaattgtgtggtgtactgtagtaaaaagaaaagaaggggaggaggaagggggagaagagagaggagtacagggggaggaggggcaaaccgatcactgggcgacggcaatcgatcgcccattagagcaggtacaatagcatgctataagccagctgtaaacatattttaaagagaaaaaggaagagaaagaatagcagcggactacagatctgtagccagctgcagcacggactccaagacgtaatgtatatatgacagataggaccatgtattaatattatagtaagcactattgtatgagttggctattacattagctatagatgatttggagttagtagtgagatatgctattaaacttgctcttataccctccggagtcggctgctatgtgtcagaccgaaaatcgacgccccaaaatgagtcgaactcagctgattaaacaagtgtttatcacggggagaatagaatggagaaaggaacggttggctgatagatcggcaaatgcagcagtatgggtcccacaaatcgacgccaacactggaaaaagtgtgacaagtctgtgtattcagaaaagtttggatttgatagaaaagttgaaagattgaagaataatttggaactaaacacgatggaaattggtttgggtggactcgtgatcatggacgtggagcagtcgcagaggtttggagttttgactatgtgagtatctgtcggcgcaagcaacttcaactctccgtctcttcctttttttttcccagcacagtgtgtcggcggcgatcatggcggcgatgctggacgccttcgcgtcgagcctcgcacgcattctggcggagacggcgaaggaggaggtcgaggcgctgctgggcgtgcccggcgagatctccaggctcgaggcgacgctcggcgacctgcgcgccgtcctctccgacgcggagagggcgcgcgaccgcgacgcggccgtggaccggtgggtgcgggagctcagggacgccatgtacgacgccgacgacatcctcgacgagtgccaggccgccgcggggggcgaggccgcgacgcccgttgccatggcgggctgctgctgctgcttccgcggcgtccgcgtccctgccctctcctgcttccgcgaccccgtccgggcacgcgagatcgggaagagggtcagggcgctcaaccggaggctggacggcatcgagaggaggagctcccgcttcggcttcgtctcccagactaggatcatctcctcgtctccctccccttgctgctctcggcgcgcagattcaggcgacggccgccgcaccgcgctgggcctcatccgatccgacgtcgtcggggagaagatcgcggaagacacgaggatgctcgccgacatccttgtcagtaagacgacggacctggacgacgccggcggcggctgcaatctcatccccaccattgccgtcaccggcgccggcggcataggcaagaccaccctcgccaggatggtcttcggcgacgccacggtccaagagagcttcgacgccaggatctggctgttcgtcggccgggacgccgacgaggtcacgatgctgcgcagcgccatcgcccatgccgccggggcggccagctgcgagggcctcgccgtcgccggggacaaggacctgctggagcgcgccctgcagcgcgcggtgacgcacaggaaggtcctgctggtgatggatgacgtgtggagcgacgcggcgtggaacgagctgctcagggtcccgcttagccatggcgccccggggagccggatcctggtgaccacgagaaacgatggcgttgctcacaggatgaaggtgaggtacctccaccgtgttgacaagctgcggcgacaggatgcttggtccttgctcaagaagcaggtcagtatcacaaacaaatctgatcaattgtgccaattgcaagtttgggactgaaattcggatttcacacgatgagcttcgatgtttaagctattgtagatcttgaagaatccttaaataaatggtttacaactatctactttctaactgcaattatgagagttttttttaagtaaatcacatgataaaaaagcatggttgttattaggtaaaaatgaatgttgcaggtttttttttttgttgttgtttactgtatttgagaatagcttatattcaatggatgttattaggtatacacttcatttttaagtaagatagctttttactattccaacagatagttttgaacaagagtgatgaagctgaattggatgagttggaggatattgggatgcaaattgtggacaggtgtgatggtttaccgctcgcgattaagatgattgggggcctcttacttagtaagagcagaacaagaggtgcctggatggaggtttctagacattctgcatggtgtaaacatgaagtgaatgatgaaattaacaaagtggtctgcttgagctatggagagttgccttctcatttgaagcaatgctttgtgtactgctcacttttcccacgaggtgaggtgatcgaatcaagaaccattgtccgaatgtggatcgctgaagggttcgtgcaagatagcacgggttcaggattgccagaggctgtagcagctcagtactacaaagagttagtcttaaggaaccttttggacccaagtgatgggtactatgatcaactaggatgcaccatgcatgatgttgtccggtcttttgcccaacatgtagcgaaggacgagggattgtccattaacgagatgcagaaacagaccataggtgatgcacttggtactctgaagtttcgtcggctctgtatttcaaacaagcaagtcgagtgggatgctttacagaggcaagtatcactaaggacgttgatactattcaggagcatcgttactaagcacaagaatttcttgaataatctttcttgccttcgggtgctacatcttgaggatgcaaatctgatagtactaccagactccatctgtcaccttaagcatttgagatacctaggtctcaaaggcacatacatatctgcactccctaacctcatagggaatttgaggtttctacagcacattgatctctgtggttgcataaatgtgtctgaacttcctgaaagcattgttcgactgcggaagctaagatcactggacatcagacacacaatggtatcttcagttcctaggggtttcggaaagctagaaaatttggttgagatgttggggttcccaaccgatttggatgacagtacacatgattggtgtagcttggaagagctaggatctttgccaaatctcagtgcactacatttggaggttctggaaaaggcaacacttggccaaatggcagcaagatcaaagctcagcagcaagcagaatctcacacaactggagctgagatgcactagcaggatcagcgcaaacggcaccgtgcaaggtggtatcagcgaggaggattgcgagagaatcgagaacgtttttgagcatctccgccctccaccttcaattgaccgtcttacgattgcaggttactttggacatcggctaccgcagtggatggccacggcgaccgcctttcggagcttgaggcggctggtgctagaagactacgcgtgctgcgaccggctgcccggtggcttgggccaactcccttaccttgactacctctggattgagcatgcaccatccattgagcatgtcagtcatgatttcatcctccctccggtaggcattgctgtcgatggcaacgcaccatcgacgacgacaacaacaactaagactgaaggtgcaggcattgcgtttcccaagctgaagcggctgggtttccaggggatgttgagatgggcatcgtgggactgggacgagcatgtccaagcaatgcctgctctggagtcgctcacagtggagaacagcaaactgaatcgtctccctccggggcttgtgtaccacaccagagcactgaaagctttggtgctgacgaacgccgtgagccttgaatccgtagagaacttgcattcgctggttgaactttacctggctgacaacccaaagctagagatggttgtaaactgctcgagcttgacgaagattgagatcctcagatgcccagagctgaaggcgtttgacaggttgcctgcagtccggagcatcgtttgggaggacttggatgctgacacgctcccggggtacttacaggaggcaaaggtaaagaggttacacataaactgcaacttgagcttgctcaacctgatatccttgcaggatgccagctctgaagagtggaggagcgtccggcatgtgcaacaattgaaggttttcgggttcaaaccacagagcgaaacgtctgaatgttacttcctttataccaaagagccatatcacgtcgaaacaaacatctccaaagcctgaacttctgctagatgtatttgtcatttgtcttgaaaaagaatgttgtattactatctgtttcctctactttgttattctcatttctgatttgcacgttctgtttactgcaatcaggctgattctgaagcttcagcagtcagcttatcgaatttcaccagctccatctgaaatgctttacatgcagaaaacagagagcttccaatggaaaatgcatgcgcaactgcaattttgcttttttttaaaaaaaagatcgttcagtgaacaatttgcacatacctaacccccaggataaaaattaaaagaaaagtttattcatgcatccatttcctttcaagaaaggagatgagacaactttcactttttaaggtgtgacattttgaagcttcctactgaacaagctattttatattcgttcaggggaaaagtggaatggaaacaacccattccatgaattcgcggtcagacgtacgaaaatataaaccataacacaatggtatcacacatgggaggcctccaatttaagggacaatacatataggaaaacaccgacaaaaacggataatctcaacaatcccctttgatgatttgatttatagattgtatgaactgttggttgattacatttatgttagctgagaggagataaaaactactaattagatgaaacgaaacagttcctctgcagcaaccatattactcttgttagataagagtctatcacactgtgtaggactggtgaatggtatcaatgtccaggcccttcagcttcacaactgactccacatgccccttcagcgtatgaagctccctgagcctgcaagtgtagcatcaacagcaagaacaagcacatagttagttagctttacatcgttttcacgccacgtgttccagggggatgcaaattggcattgtgcagctagaaagggagatgcttcttgatcttggaaggaacatggcaaaagcaactgagaattgatgcaatataaaggacatggtgcttctatatgattcttaaggtgacagatcatggaaaagaattatacaagtgtctactgcagatttaggtcctaccttgcaatctcggccctccgtttcgcctcttccgccatctgattcagctcactgtagccggtcttctctgggaagggcttcgcatccggtggctgcaggccatggagtgtcctatgtgcatgtgcccacttgagttccctctcttccttgccaaaatccttcttccttgtaaacgcaatctgtcgaaatcgatgggccattagtcacaaatgcatggaaattcagtcgaaataggtaaggagccaagacaactatgcagggtgcattagcattactctctgctcaatgacaagatcccatgctttcccactcagagcatatcggatgaggaacttgatgatatcgagcgggaagtagaaaacgagattgtagagccacacgataccggcccagccccatccaatgcctttgattgaagtgaatgcccagttagcataaacagctatcaatgtagctatctgcatttgaaggggaagaaagttagattaacacaattctacccagaagagaatttatcagtttgcggtaatagggagagagcataccagctgtgcaacgaagaaagcaaagacaagtagaaagccagggcgttcgataaatgaccagctgcgagaccttgtgacaaagataagagcttggctgatggtgctaacttgaagatatacagcagatgcaagcttttggtagtcatcttgagctgtcttctcaaggctttcgacgtgaaagatcctctgaaaatcaatgcaacattaagtttcaaagcgaatacaagaatcaatcacaaaatgtggtaggccaacagttcaattagaaccatttgttatcattttttggcacttcttacagggaaaaagttggtcttgtatgcagcccagaagaatataacagtcatcattgccaagtatccacccagcacaactccagttgtgaaaatttcagccaacttccagctgtcaggtagtggagaaggctttactagatccttagatatagtcattatggtacctgtttgtgccagaaaatggttgaagtgaacatcatgaaaatagtttctacttactactgaagttttaggagagatagcagggatggagggaacaagaatgtgacataccatcattcagaattgcaatgatcagaaccataaatggcgggaaatcaaactcccatataagggcaagcagcataaacccaaactgtcaaaagagcagtcaatatacattaagtgctagctaaaacataaagttgatacacattgtttggcatagtaagatgaaaacatcatattggggatcatcaaagttaatgtgtacaaaaggttatacactggaatcatttagtgcttagttctgttaaatttatctgaatggttagttctgattgacctgtagttaaactaaaatacctacgagaacaatcaactatttatttaccaaatgagaggaaatccataatttctagttctccagtaaagaaaacataccacaatacgtattgtaatcgagacagcatatatctgcaaacatggaaatgaattagcaaaataacccaaggaaaaaggcagaatattaaaagacactatgtttgtttccatctgacttacagtgtagttcttcattcgctggaaaatcgcccgactggtaagaacagcactaatgatcacactcaagccaggttctgtgagtacaatatcagatgcactccttgctgcatcagtcgcatcagcaactgctataccaatatcagctttctttagggctggagcatcgtttacaccatcaccagtcattccacagatgtgcttccgtgcttgcagacgttttacaatctcatacttgtgctctgagaaaagagagaacttcacagttatatttttctttgtgactttcaaccatttggtttttattctgcaattgattgcatacaaacctgggaatacaccagcaaaaccatcagctttctcgattagatcgtcaactggtaaagcagcaacagactcatccttgttctgtcccaacaaagcagatgaagggtacatgtttgtacccattcctagacgacgccctgtttctttcccaatcgctagttggtcacctgaagataaagaaataattttaattcccataattcagaaagattaacaaaattgcaataaatttccatgacatgatccagtaatgacacttggtagaccaactctcaacttaccacaattttttaggcatgtttacagtgttaattttaaaaaaatgttgaatcagaattaaatataaattatcctcacaaaaataatttaaataagttatataaacaagaaagagtctctataaacattaagttagacctgtaaatggatacatataagcaatggtgaagactggaaccgctacaaagaccactatctgcagctttgaactggtgatggtccccatggctccaaacaatgacagaagagcaatggatggtttatttttttttaatgatgaaaattgagtttcttctttatgatacatcataatcatgcatttcttattgaacagattgcagtactgcaaatttatgctagttgttcttcctattgtactccctccgtcccaaaatataagggattttgggtgaatgtgactctctgtccagattcattgtcctaggaagtgtcatatccacccaaaatctcttatattttgggacggatggagtagattaggattctagtaactgatgcaccatataataactggacatggagtaccctctcaccaccacaacgaccagaaaagaataataaaaaatatatataacaaataaaccatctagattttttttttcaatcagaagagtacctgtgatcatcttaacatttacaccaaggttaagtgcccttcgaattgtttctgcactatcatgccttggaggatcaaagagtggaaggagagcaacaaagcgccatggcccaccaggactctctttccttccatctggaacttcctacatgacagggaaaggagaccataatgaaaattaaactggcccagggaacaatgatttttcaacatatataatgactctggatagttcctaatcttaattaactcaaaatgttaaaacattcaaattgtgcaaagagtatccgaagaagtgctaacctgatatgctacagcaagtgatcgaagtccacgttctgcaaacttatcaattacagcatggactcgtcgttctatctgtgtcttgttgtgtgccaggttgagaatctgcatg

SEQ ID NO: 74368 - DNA, 23579 bp, Oryza sativa
tgctattgttgcagcaaactgaaatatgtcgctaatgttgcagtaaactgatagttttatcactaaacttgcagttttctaaaatttactcttataataattaaactcaattaataatatgctaatacttttttatttttgcgtgtcgtaatctaatcttcatgttcttcagattagcaccgcaacgtttagtaatgttgttcccgccaagtttcgattagagctcagcacggcacatcgccggaatggagccgtcgcccagcagcagctgccggaacgtccacccgacgacggcgagcgcctcctccgcgctgccgatgctggcgcgctccctcagctcgccggcgaacggcccgccgccccactcgccggtccgcctccaccgcttcagctcctcccacatggcgtcccagtgctcgatgtacggcaggtgctcggcggcgacgcgcgcccctcgcccccgcgtcaggatggtctccaggatcgggtggagccgctgcccctcgcagatcaccgccgccagcgtcgccagcgcccgcttcaccgccgccgcctcgccgccgccgccgccgtcgtagccggagagcaccacggtggcgtagctcgtgaagggcgaccccagggggaggccgagcaggttgttgacgccgccgacgaggtcgccgtagctgctgccgaaagggagaggggtcgccacgaggtcgccgcggaacaggtggtcgttgcctcgcagggcgtgccagtggccggtccggttggcgaagccggcgacggagaagacgtcgggcctcacggcgagcgtccccacgccgctgccgtagtcctggaggtccaccaagatcaggtcgcgctcgactcgcacctcgccgagaacggccgccgggaggttcccggcgagggggagaagcaggagcggcgccgggaggaggaggaggaggaggaagaaggagagcgcggcggccatggcgtcgtacgtgcaacaaacctggagagctagctagccagtggcccggttcttccacgatggcgacgattttgtagccggcggcgcgcggtcgagtgggttggcaggtgagcggcgattttgtcgccggagaccggaggcgggcgcggccggcgtgcgtgatcggcgtgcccggaatctctattgacagcgctgtaaaaactaaaaaaaaaaaagtcaaatatactcctccattttggattacaagtcatttttttactttgtcaaagataaattgttttaagtttgattaaatttatagaaaaaacatgaacattttttacctaagacaaatatgttatgaaaatatattcgatcattgaattttgattattgatttaatgaaactaatttgttgttgtaaatatgattgtatttaggaaaaagtacgaaataccccctgaactatcgcggtcgaccgaattaccctcctaaattcaaataacggatattttacaccataaactatacataccggacaaacgacccctaacaccgttctgggcggttttgatttcagctatcacacgtgccgccaatgtggcagcctaatcagaaaaaaaattaaaaaaatccctgggcccatctgtcatccaacttctcccagctcccttgcgctctctctctctctcgtgcgcgtactcgggctaggggcggaggcgagccagttcccccaaatccagccgccgccgccgccctcttcttccctttggccgcccgcggaggaggcagccggagctcatggtggacggcggcgcggggatgggaagatggcgacggcacggggacgggaggtgtgcggggtcggcgacggcgaacttcttcgcgccgccctgggaggaacgaggcggaggcccagccgccgccggtgaggaacgaggccggaggcggaggcggcggagaggaagaccggcgtcgtgtggtggcgagcacgaaaggggcggcgagcgcggaaggacctgtccgcgagcgtggcacgcaccagcgcggcggggaagggaggcggaggaggtgatcgccgagtacctcgacgctgcccgtcgccggccctcgcgcgccgaccgcaagcgccgctcgacctgcgcccgcgcggccgccacctcgacgccgcccgtcgccagccctcgcgcgccgacccccgcgccgctcgaccagggaccgcgcggccgccacctaggcgccacccgtcaccggccctcgcgcgccgacccccgcgccgcttgacctggaaccgcgcggccgccacctcaacgccgctcgtccgatgctttgtggatagccgactggcgccttcgccgccggccaatccggcgacccctcccgccgcctgccggaacccgaaccggtagttggcgttcatctggctggcgagcagctcggtggcggagggccccgttggacgcggcgatgggaagtttaacatctccgagaacgcgcacgatccatgcccggccggcgcctctgcgtggtcgtacatggcggcaggctgggcgtgctcatcgccgtcgatgcggagcaagccatggcctcccctctcacccggccggcgggtcgaagccctgctgcaccctcaggcctcagcttgtcgaggcggctctgctgcgccaagtgatgttgctgctgctcgtgctgtttggtcttagctggagccagggaagtcgaaggcctgttgctgctgctgttcctatgccggcgatggtcatttggccaacaagttcctcttatttctctgcagctacctgagctcatcaccacaagaaaccggatggcaagctgccggcggcgagcgcccatcgcctcgcccgtccccccgcgccactgcccacggcgcgtccccgcgcaccgccgcccaccgcccgtccgcagccgcgtgcatgggagagagagagagcgcgcgaccgaggagagggagaccgggaaggaagagagatgaaatgtgggcccaagaagtctttttctgactagattgccgcgttggcgccacgtgtacaagctcaagtcaaaaccgctcaaaatagtatcgatgggggtaattcatccggtattaaaagtttagggtgcgttatgtctggtttcgggttcagaaggtaattcagccaaccgtgatagttcagggtaatccatactttttccttgtatttatgtataaacttagtcttgaagtaattttacttttatcataatctggtggtagtagatattgctgcattttgtgagtggtgacatctgcatttgactgcatgttgaacgaattgtgttgttgctgtgcagaatgtgatgtgaagcacgtaggtgcgtgaactgtcaaaggtgtaacttaattcgtcaaatttgattgctgattttgaattgacaatggtagttcgtgtttttctttaaggtgatggaataaatggtttacgtctctgacatataccgacaggcacatatccaataagttttgttgttggaagaaaaaaaaggcaacacagggtgatgccgatttggatcaaataaactacggagttgctagaaatatggcgccatatgctacagtcgattttttttcagccacttacacagtagttacacctcatttacaacccacttacatatgtaattagtatgtaattttcgaatttacatatgtaattttagtacttacatatgtaattttgagacttacattgtaaatacactaaaattacatatgtaatttagggacttacaatgtaaatacataccgactattctttgatgaaaaatatggcgccataaatatagctacacccatcaaacggttctcattgtaacaagcgcgtgatatgatctggaaaacgaccaccacaataggacttaaatcaaacacactgaaatttaagatcatcccattcagaaagggaacaacgaacacagacatcacggtgacacacgaactgacactagagcatagagagcaacgttttattcagagaaacagcacccgtgcaaatgcagaatatactccatataagtatcaggcgctgtggctgtgatcctgcagcagctgcacgaagctgcggttcgcgagcagcttggcaatggcgagcgcctcgccggcgctgcggatgccggcgcgcctcctcagcacctcggtgaagggcccgtcccactcgccggtgcgcctccaccggaggacctcgaacgacatggtgtcccagtgctcgatgtacggcaggtgctccgccgccacgcgcgcctcgccgctctcccacccgctcgacaccgtctccctgatcggctccagccgcagggcctgggtgaacatcaccgacagcgccgccaccgcccgcttcaccgccgccgtcccctcctcggcgtcggggtcgtaggaggcgagcaccccggcggcccgcgccgcggccgctttcccgagcggcaggccggggacgtggtggaggccgccgatgaggtcgcggtaggtgttgcggaacgggaggcgcctggcgttggggatggcgtcctcgtcgccgcggaagacgtgccagtggtggctcccgttggtgaagccggcgaaggagatgtcgtggcggtgcatggccaggacggtgccgtcgccgtcgccgctacgcagtttgagaaagaccaggtcgtcgccgggtgggtcttgctgctgcgccgccgagaccgagagaacctctccgcggtggccggcgagattgaggaggaagcggaggaggaggaggagcagcgcggcctggaagttcgccatggtgagatcgagctagctagctccctaagctttgatgctctcctcagcaaagcaaagctatatatgcgcagtgtgtagtgatgaatcctcgcaatttgcgttgggcaactgcaccaggagggtgaactggttgaatgctgatagagctgtttacacctaaagttggcatttaggtttaaaattgaagagaattgtcaagatttgataaagttactggttttctctacaaggctggtctaaccgccgtgtattggccggtcagaccgttgcttgcgggccggtctgatcggcgtgccaacaagagcctagctcgtctacaatattttggtcgcgccatgaaaaaagcgtgtccctcctagcgttaggcagctagagaaagggaagaaaaactctcgcaattttcacacgtatgctcctagactgctaaacatcatgcattttttgaaaagaaaaaactagaaatattgccgcgcctgaccatgatgctgctgaattgagtatacacaattgctcaaactggttcaagagaattaacaattgaacattgtatcaaacataattatctcaacatattgaagagacttatttaccattatctcgtacacacgacaggaggtcgtttgcaagtttgctttggcacataaatctgaaagtagagaaatcaacacatcgtgtaccgataaactattgtgtcacttgattgtgaaggatcagaccagctttgtattgcatcagtgttaagcagtgataagaagcgaatactacttcccagtagtctttcaatgcaaaggaaaggatattaaggaacgatcatatcaatgcttaccaatcatcaatgcttgccaatgacagtaatttcaaattgatagattaagatacttaaatatcacacatcgatacaaaattacaacacttttgagtagttttgtaatttctctcccatatcaactctggtgaaaagaaatactatactaaaaaggctagacagttgtgatactatataaaactttgcttgttcgtattctggaaatgctccacacaaatatttccattttaggtaagaaatgaatgagtgtatagttggattggaaattttgacctgaactctgcatatacaacacaattaattttgtagtgctaaaaaaagctagcaatatgctaaagtgggtgagaatacttgatgtgtctaaactggctttaactcaatgcaaaataggatgtagtgattggagaagctttctgggatggatcaacatggtggagaaaaaccacttttatcctgccgtcactccttggtggactatagaaagtcacctatgttttcagttgcaaatattttggcattgtgaggttacagattactaattcagatttagaagatagacaaatgcatagaaaggaagaagctcacttcagatataatggctataatataataacattaccttaaaccacggtacaaccaactgtcctgaagggtatagggttaaaaaaggtggggagcaacaaaccaatagggaaaattagcgtttcatgggaagaaacaaaagaatttatatgtttgcattaagcacctagatatttaagtacagaccacatagactgtgagtaataacattatgtgaatatctttttctaaatatgcaaccacttttcagtttgttaagctagttaagctaggaaataagtattgatctggcttgcttgttcgaagaagaaaccacccccaataactgcagtcaccttgcctagcttagaaaagaagaaaagcaattctctcacgcaaaaatattgttttgaactggtcgaacgctgatagcacacaccataatcacgaaaacgtaacaacacagcattttttccgcgttcgttcaatcaggatcccaacctccactccctcgcttttcgcgcgcacacttttcaaactgttaagcggtgtatttttttttaaaaaaaaatttaatatgaaagttacttaaaaaatcaaattaatcatttttttaaaaaataactaatacttaattaatcgcgcgctaataaacggttccgtttttcgtgcagaggggatggtttccaaccccaacaatcgaacacaggcgcaagctaatctgctgctggaaattgtggactcacacacatacacaaatgaacgagaacttgtcgctaatggaaacgttattactactactctacaactaactttaacagtttatcatagaggtcagtagactcagtgcggcacatcgccgccgccgagccgtcgccgagcagcttttgccgactgccggaacgtccagccgacgacggcgagcgcctcctccgcgctgccgatgttggcgcgctccctcagcacgccggtgaacggcccgccccactcgccgcgccgcctccacctcccgagctcgtgccacatggcgtcccagtgctcgatgtacggcaggtgctcgtcggcgatccgggcctgctccccggcgggcgccctccccatccggctggcctccagcacggcccgcgcgatcggccggagcagcaggggccgtgctcgctggtggtggtggtcgccgcggtggaacaggtggtcgctgccgcgcagggcgtgccagtggccgctccggttggcgaagccggcgacgaacatggtgtcgaccctcaccgccagcgccccggcgccgctcccgaagtcgagcaggtccaccatggacagcttgcccctcaggctcgtgggggacagctcgacgtgccccctgcgctgagagagacgagcgggaggaggaggaggacgaagaggaatggtgcggcggccatggtgaggagtgaggaatgcgtgcaaaccttgggcaagcgggcggcgatttatccgccggcccggcaagagggcggcgtgagatctcggcggagtggcaggtgtgcggcgagtttgttgccggaggcggcggtggctcgccgcgcgcgatcggcgtgagcgaaactcttgaccgcgaaggcgaaaagtagagccgctgacaggtgcaggggtgggcattccgtctaaccgaaaaaatcggttcggtttttcggtcttttaaaaaattcggtttttagaatcactcggtcttcaagaaaactcaggaccgagcgattcggtcttcggtttgttcggttcggtctcggtcataaaccgaactaaccgtaacactaactgtggtttgaacggcagaaaaaaataatcacaaaaatagtactcgtaaaagatcgatgaatcaaatcaactcagatcgaatcaaagcagctcggatgaacgacaggtcgacagcaatatgatgatcccacgagcaagtagcaggtagagcacgactcagagaaaagaagcaaatcaagcaaattaatcctactgtgacttggatcccgtcgatctccatcgcccctccgaaagctccatatctcatccatctcgtctcccatcgtcgttgttcccggctacccgcggctgccatcgctttaatcacaagctcacggccggcgtcctccgccagcgaggtctcttccaccaccgtccaccagggtgcagctgggcgaccgggctagagtgcgtcgggttgggaagggatcgccacagccgcacgaccttcttgggaggcgctcctccgtcgggcggcgttgggcggtgctgcaccgtcgggcatcgggactgggagttgcagaggataagatcgtggcttcgtgagcagggactaggtggttgttgctcacgtgatgaggtattgggcctagtgggctgagatgtcacatgtggtattgggcctctgatatatttcggttttttcggtcaattcagttaaccgagcctcaagaccgaattgaccgaactaaattcggttagttgaaagtgcataccgaatttatgaccgaatttctcggtctcggttagttcggttttggtctcggtcatttcggttcggtttttttctgtccacccctagacaggtggggcatgagtatacaagattttttgcgcatgatctggtggcacacacattggaacgtattttgtgtgaatttgaatcatccgatgatccgtgcagccatttgcattggcagaaggaaaacggagaaatttgtttggacgcttctgtttgatcatttcagaagcgtgtggccggcctagaatgagtttggctaatgcccagatcctcgtgccttgctctgatctagaatgagtttggcaaatgtcccaaatcctcatgaactgaacaaggagtatcaagcctgtgccgaagaacaggtccagtaaaagaagtatccccattcggtccaacactttggcacttggaattgacgctcgtgctgatcgattgtgttttcaaacagtatatgcaactagaagtgtaacagaatcattggcggccgcttaacttgcagacggtgaaagaagaaatctgttaccactgtacatatccaacagttcttttttttcgtaggagccatattcttttttttgacagtatgttcaacaatgcttgcagctgttaatttgctgtagatgtgatgtgtcaacactctcaaaggtgcagttagattcatgaaattttgatgctgaatttaatttggattaaccatcacaataccaatctgtatgaaacggaactcccatcagtaaacagcactgaggcacaaaacatttactgcataataatcgtcagaggcggctcaccaaattaagttctaaacactttgatctgaaaacacaaaacacaacatcacaacacacaacaatatttttattcagcgagcagccgcgcgtgagacgatgaagcaagcaagcactgcaagctgcagtgatcagatgccgtgagcaagctgcagctcctccaggtcgcgatcgatcagcacgccggcgacggcgcccgcctcctccgcgccgccgatgccggcgtccttcctcagcagctcggtgaacgggccgtcccacctcccggtgcgcctcaagcggaggagctcgaacgacatggtgtcccagtgctcgatgtacggcaggtgctcggcggcgacgcgggcctccccccccccccccccacccgctcgacacggtctcgttgatcggcttcacccgcgccgcctcgctgatcatcaccgtcaccgccgccagcgcccgcccgagctcctccacctcgttcccctcggcggcgaacgccgccgggtcgtaggaggagagcacgcgggcggcgcgcaccatggcgtcgcggccgagggggacgccggggaggttctggatgccgccgatgaggtcgcggtaggtgtcgccgccgaaggggaggacgctggccgcggacgggacgaggccctcgcggccgcggaaggcgtgccagtggcgcgtccggttggcgaagccggcgagggagaggtcgtggccctggagcgccacggcggctagctcgtcggcgtcgaggcctccggtgaggccgacgacgaagaggccgtcggagggcggctcgaggtcggagacggagaggacgtcgctgcggtagccgccgaggtcgaggaggaagtagaggaagaaggcggcttggaaatgcatggccaaatcgatcaatcgatcagcttgcacccctacttctcccaatctctctagctatagcttcgttctgagcaagtgtgatactggaatataaatacgagagagatattagctcgatcgcttttagcacgtcaaaagagcgtgtcctctctacctctccggagaaaggggatgacaggtggggccaggaccccgggcactgttgggagaaactaattgtatgactccgctggttcagtatgaattttattttttttatatactccctccatcccctaaatgtttgacgccgttgactttttaaaatatatttgaccgttcgtcttattcaaaaaatttaagcaattattaattctttttctaccatttgatttattgttaaatatacttttatgtatacatatagttttacatatttcacaaaagttcttgaataagacgaacgatcaaacatgtttaaaaaagtcaacggcgtcaaacatttagggaatgaggtagtaactatttaaaccacatgcatactcctagatatgatagcatccatatgtagaaaatactttccaagatccatctctactttcaagctttccatgtcgtgaggaggaagagggtgcagactccttttttttcgtttgtcccttaccgattgctagtgctgtccatcattcataaaccattgtggttacactccatttcgacgatttgagatgttcgtaggtcgtctaattagataagatatctcagtttttctcgtgtatctatatttcactaataagttaaaggacatatctagtgtgtggtgataaagcacgcggtatgtgttgtttggccaaccatgcatttcgctaggaggtggaagcacatatctagtgtgtggtgggtatgcgttgtttggccattcacaggttaccaatttatcgaagcacaaactattttttgcacaactattcaagaaaagagcttgcatttttttttcgagatctatggttttcaggtcaatattttttcgaggtatatggtttccaggactccaggtcaatatcttagtacttcctccgtttcacaatgtaagtctgttaacagtgaaatttggtaatcagcaaagacgtcatcggcttagagtcattatcggctgcagcatctcgggatcagccgatgggagttatcaagtcgccaatagtcaaattcctgctatattcggctaaggaaatcaatctactaacggaagcttatccataagtgaccgagtttaaaaagaatgcggcatggcaagttatctattaaatagaaatagtttgttagtttccttttatctttagaaaaatgtgtttagtgtcctataaggactttatctgttccttttatctttaggaaggtttctttcttgtccgacaaagacttgtatcaacccatgggtataaatatgtacaccctgggtcattgtaatctatcctcacgatcaatacaattcggcgcatcgccaccttttaccttttctactttattttatcgtccggtaggatttggcacctgacgcggggctgcatcggtgttcgatctctgacgaaggggtaagtccaatgttccgtcggcccaggcaattgtatcgtttacgtcggcgtcgttcaaggctgcatcagtacattcgacctcttggattgctctggtttggatgatatatttgcctacctatttatcatgtctctgttaatctagtcttagcatatcaatttagctctatcagctgtctctcgctttagggtttctgccggtatcggctaaatcgcattgctagattagattagcctaggcatctaccaccctgaaaatcagtcaacggcttgattgtctagatattgtgtttgatctactaagtcgtgcttagaaccataatctctagcctgcctcttgattgccaataagggtttcatcgaggtttcagccggtgagttatctggacgttgcatcggctcataaggattgcatatacataaaagttggatttagccgatgacaacaaaggtttcactgtttaatctaatcttgtggatttcatgatatcagacctctagccgatgtgtgctttaaccctcggatcgatgcttatttatcatatcattgctagccgattggtttatacaggactatattgttattttattatatcatcatcaaccgattgcttaaaccctatcgctatcggctgatatcggcatcagctgttatcggctggaattactccatcggcttgtcagccgatcggctgttttgatctactatttgcatatcttgtcagttgcaggatcaaactgactggcacgcccgcatctcatcaatctttggacctgcacaggagctaagcagatctctcaggccggtgcgttcgattttttcgtcaacaaagtcattctagtattttttatatttatagtgatattaatgaatctacttacattgtgaaatggagggagtagtttgtgttgattgaccctaggaaccgcataccttgtaagctgatccggccgtatattcttcgtggtctgtaagcttttattttttatttcgtatgctgccgcttcatacgtatacgttatgaatggtgttcatggcttgatgcattcatattgatgaaaaacttgtgactagcagcctccattaaggtgtgaagctgtagggttaattcatgaaatttcatttccgggcagttcctattgaaaaattgaaacacgatgtgatgcaaatgcacatgaagatggaaatggtcagttggtgaataatggaacaacattgaggcgcacacggcacacacatcttcatataataaatcactaccagaccttctagtctacactggccgaagatgttgggggtcttccggctagctttacaagatggagggctagatgacttgggttcgaaacctcactccttttaattatttgatattaggtcatttcttaatattaacgtcttttttacacttgccaaaaaccatcgggaaaaatatgaattactgttagaaaatatttctgtgtggtacacaccatatacctataggaatagcgaccaccatatacctataggaatagccgagaccacagagaaatgtggtttttccgtcagtttgccgaaagaaattatttaagttatttccccgtgatctcaaaacaaccacacagtcaaacaaactggtgttagaaaacgaaacacatcacatgtatacgttggattgagatcctctattattgaagtcaccgtgcctttaatacttacatgtgggtccaaaatattctatcctattcacgtgccagcgacaaagtcatgtaatttcgaaactcgagattcctgaccggaatgatatatactcaactcaattactcaaatagttaaacagcacgcgcgatgcggtcatgctagcaagcagtagaaaagagagaggttgcaattttgcatcaggtggtggagtgagccaggatcagctgcgccaaggtggcaatggcgagcgcctcgccggcgctgcggatgccggcgcgcctcctcagcagctcggtgaacggccccgtcccacctcccggtgcgcctccaccggaggacctcgaacgacatggtgtcccagtgctcgatgtacggcaggtgctcggcggccgccacgcacgcgcctcgccgctctcccgccacccgttcgacacgggtctccccgatcggcttcagccgcatatggcttccacgagcatcaccgacaggcgccgccacgccccgcctgagcgccgccgccgccgcctcctcctcgccggcggcgtccgcgtcgtacgacgcgatcgcctcggtggcctccgccgcggccgctctccccagcggcaggctggggccgatgaggtcgcggtaggtgctgcggaacgggaggcggcgcctgcaggcgttcgggatggcgccctcgtcgccgcggaagacgtgccagtggccgctccggttggcgaagccggcgaaggagaggtcgtggcggtgcgccgccagcgtggcctcgccgccgtccaggtcgatgaggaacacgtcgtcgccggagatgccggcctgtcgcgccgccgagcgagccgccgccgctgccactgatcctcctcctccccggaggcgccggccgccgccgcggccggccgagaggtcgaggagatagacggcgagggcgaagaagaggaggaggaggagtccggagcgagagctctttcttcttcctcttcgccggcacgccgccgcgggatgatgagagctcgacttggacttggatagtggaatcgtcgtcgtcgatcgagcgacacgatcgagagcaaattgtgtacataattgtggtgatgatagtgtcgtggttgcatgcatgcggatgcgggtcgcgttggacaactgcaccatggtttgtgatgaatcgtcgtcgttgcgaccggcaagtacagcacgcacgcacgcacgggtgggagagaaaatggtaggtcacttgtttgattgaggcgggcatcgagctgcgtcgatacgaaatttcggaacttaaatttggatctatgcatttgtgtaccgtggggaaaatcgatctgctccgagatggattctaatagctcgagtggacatccacccgtttattacatgtcaactagatggttacgaaaaattttcaaaaaatttgataagatgtatccatatgtaatatatcactccacaaacatgcaagttaaattcaacttttacaatttgtaaaaaaataacaaatttaattgtaaatatacatattgtaatttgagttttgtttcttatttttgtaacaacttgtagaagttgaattttaacttacatgtttgcggattgatatattacatattgatctatcttgttcatatttttttaatttttttcataatcatttagatgacatgcaataaacgggtggacgtccactcgagctgttaaaacagtttccccgatctgctttgctcgcaacctttcttcttcgattgcgcgtgctggaaatgtgcgtgcagtgagcagtgttgcgacttgccatacggtcatcgcaatcgcaagtggtggcgtaaatgcgtaatacgttggaaaaagtacatcgaaggtccctcaacttgtcatcgagttacaaaatcgtcctccaaccacaaaaccagatatgatacatctgtcgtcccttaactaatcaaaactggttacaataagtccttaagtggttttgacaccggttttgtcctacgtggcaactaagtcaacgtgggacccacgtggaccacgcatatcaggatgccacgtcatctctcttacccctcctctctctctcgctcttctcttctatgggcaagccggctggcggttggggaggaggccactggggcgaggcgggagaggaggaggcggcgtggctagctcgtgccgcatcccgtccttaaagttcccgtcgctgtgggaatcgaagaggcagcgcggtggtgtcagaagttgcgcggtggagcggaaggcggcgttgatcgcgttgggagccgtgatggcgtcggagagggagcgcggcggcggcggggtggtgttgttgccggaggaggcgaggaggggcgccaacctgccgctgccgcatcctaacatgtggggtccatgtgggtcccacgctgactcagccgtcacgtagtacaaaaccggtgtcaaaaccaccaaaggatctattgtgaccggttttgattagttaagggacgccagatatctggttttgcgtggggggggggtgattttgtaacttgatgacaagttgagggaccttcagtatactttttcctaatatgttgggctcacgaatctttaaaggcccatgacttgtgggccttagtgggcttggcctaaaaatgcggcaacgcgtcttcctcgatgccagccgtctctgctcccggcggtcttttttttttttttaaaaccacttccatcggctgtttgtaatcagacatcagctgaccgcagacgccgccggccgccggccgccggcgaagtagaagccatttacagcgctggaagtggtaaaaatagcagataatttacgctttgtgcgtcaagaggagtaatgtattattgtatttctttccaacgaactgtctggtttttacttgttagtagagagtaacatccatttgcaaattactgcacttgttttttctaaacaaaagttataatactacgtatcttctctatctctactatattataaaaataaaaaatatttttgtcagtattttggtacgttatccgtatttgaatcggtttttagatttgttctttttggaaatacaaatccgtgtttgaatcggattttaagtttgattgcttaggagtcatataataaatctttttttttaaaaaaactcacatgctaatttaggatgaaagtcggactcctaattatagctcatgattttcttaaaaaaatatccaagcgaattccaatggtgaatttcaccctacctataccgtataacaataatataattaaaataatatttttctagtgtgtatatatatccaggagcattccctccataaaaaaactcaatttctagagtttaaatattgtccaaaaaaacaacttctacaatcctacagtcctacctaccctcagcaggtaaaacgagaagttttattatcacgtttactaatatattttttttcaataattaaagatattttagtcattctcactctccactaattccaccttagattgttaggaatggattttttttgacggaacgagtaacaaactcctacagtatgctcttgtttagatccaaactttttcttcaaacatctaacttttctatcccatcaaaacttttctacacacaaactttcaacttttccatcacattatttcaatttcaatgtgaagtaaacacacccaatatttgagaggaagtacttcaacacaaaggaagaaggctctagaacaaaggcccagggtgggtccaaagtccaagcggcacaccaccggtgaggaagtagcgagaggcggcaatggcaacaccgcttgaagattcgtgcaagccaatccgcccaaccagatgccctacccggcggcctctctctcctctcccccataaatctctctctcccacggcctccacccatcgcctcccacccgtctcgccgctccatctccaagcccgaatccccaaaaccctagcccaccccctgccgccatggccgcctcccccaccggctcctcctcctcggcccccgccgccgcggcggcggcggcggccgaggccaccgacgggccgaccctcagcgtcgtctcgaagcggctccgcgcgctgcggaagaagcacaaccggatcctccagatggaggagtcgctcgccggcgggaggaagctcaacaaggagcaggagggggtgctccgatccaagcccgccgtcgtcgcgctcatcgacgagctcgagcggatgcgcgcccctctcgccgccgccctcgccgaggagctctcctcccgccccgccccctcctcctccgccgcgccgccgccccccgcatcctcctccgccgcaggcgccgcggattcgtccgtcgtcgaggatctcctcgcgctcatctacttcggcaccctcttcgacctcaagccgcagaccgagttcgtcgccaccatggtcgcgcgcgcgcaggagcgggactgctgcatcacctacgactacgtcacggaggacgccgccgacctgctgcaccagtccgatctcgacaaggtgtctgctctggccgccctcgccgcctcgcgccctgccgcggcggtgggcgtctcgcaccgcgacgcgctccagtcctgcgcgcagcacgcccgcctctggcttcgccgtgccgatgagccaatccaccccgaatccagcatcacttgtaagtataggggttttgtttataatgttgtttgatttgggggatttgcaattatgacactgcaaacattaacttttgctataatgacactggacccacatttcatagacacagatggatccatttgtcatccacgcggagtgtcaaaacagcgaagccaccatgtttgcagtcctaatattgcaattttctcgtttgattttagctgctgattggatgatttatatatatccgtgatgctttatttggttacagatgcagcggttagggcgaagttggacaagatcatggcttcagactactacacagcgcaaccggagatgccggagatgggggctgcggtcgatttgtcggctgctgtgcaggagagcatggttgtgtcaccagaggcgccggctgtggaagagagccaggctgagggacacaaggtgaaaaaaatatttgttcttttcttgccaattaactttacttggcgtggcccaatgattgttgtcctgctaactttatcatgctgtggattgatgatggatttgatgcagtacaatatgttattattgctgctgcttgtactattatatctggtctgattttgttgtctagtgctattattatgatcaactgtggataattacttcatttgggggtagagattgtaaggcagatccgaattgtgtttatcaaaagcttgaagttagataacttgcatatggtttatttgatgacaaatgacagttagtgcctgtgtgtgagaattatgctggaaaaggttcatgtatcccatttaacttgccactctttgtttgtactacaccatgatatttgtattattctgggtctgatgtcacatatatctgaagtaaaaagcatgagtattccactatataggtgccaatgattttgccgctgttggaaattgatatgtttaacaatagtgtatctctaatcgattattttgtagtagacaaatatactactatgtttctcttgcctgctatcattttgaaagcatgatataagatgctgagggttcaaaattacaacttccatgaactttttatgcttaagatttttttatacggtccttaaaagatctattttttctgtacatgttcttctttttcgaccagttaagcctcatggatggatttgatctgcaaaatattctccttttcaatttgtgtaacttaagttttatatgctttgtctgcaataatatactccttatatattgttatgctgaagtattgcttctctgatgccttaatggcttaatgcatatattttcaagttttagacgtactcagtttttattttactgctttttgactctgaatatattatctattgtacagccatgcattcttgacaagcattttttaccaatttgcttggtgcctgcaatttgcatcttaaactttgagttgcctacttaatcttttataggttcatccaaaaacccaccgataaccactaacaagtactgacaatggtgattatatttattctaaaatcattataaggtgatgtaattcaatatggatatgtttataattgttttcatttgctctcagtcatgtgcaactaggtttacagtctactgatctagttcgcatgaatatcctgttctgatggatattatgaacacaccaaattgcatctgtgtctatatgatgtattcagatcaatttaatttactacataggattgctgattgctttctgtatgacccagttttccatgctgaacatgtgcccattattagctagtgctgctttcccatttacatattgttctgtctagagctcttgtttcgtcatatctgaagtcaccatcaacaaataaagactagaacttatcgcagacaacagtcataccatattagatttatcttattgtgatagttctggagttctgctatgaattttaggtagatttcttatgagcacatgttcaatgttcattgctgaaaaatgcttagataatattgaaccactgtgcaaatttattatagcaactaccattatggagttcattttgtccaaagaaaatactattaactcccttccggcagtatacaggcatgccaactcctttaatgggtgtctgtcatacatgttttcattcttcgagttgataacacctaagtgaagcaattagagaaaaggtagtgcatttataaaatggaaaaaaaatgctttgcacctaaaagttgtgtgtatcattgtcattcctatttgtaggaatagaacacaagctgaaagtaaggactatggttcaggcataaccctcctttttttattctaatgaggtaggttggataaccttgttgcatgtcaaatatcagatgtacccttaatatgcttatttccccattcacgcttgtaggatggttgataaattttgtatgattgagccttgaagtgtgattgagttttaaagatattttattttattatttgacattattcatttgagtaaacacctaatcagctcccttctggctatataagtgctactccctccgtttcatattataagactttctagcattgcccacattcatatatatgttaatatctgtaatcatttgtcactctgtagtatgtaatatcgaacaacttatagaattctattttgagctttaaagtgccaatgttgtccatgtttgtgcatgataattttttttgtgaatgaacatggcaaactgaagctctgttctttatggatgattgaacagattatagacaatcgtccatagggatggattaaccaaaagattagcttagaactagttatctaagcaatgttgatgtagaaagtttttcgagagattgtgttttgagaactgtggtactcataatccatattccataatgcatgacataacttgattgtgtctttttaaattaggaacagcaataacaaatggaggtctagagaaggataaagattagattattttgacgactacagactttgtacatgcgatttgtcgatgttgctagttaatatcagttcgtaggaagcaacaaaatgaaggatatattttcatcattgctaagactttgctttattatttcttacattattaatgcttatgcatcgatatccttttagtatgaccaaagtcgtgcctttaatgggcacttaacccaaaactgtctggctagccatatgtgtggatattttttttactgtgcctgtgtaatatagtactgttgaaattgctggcatattgagctcattatatattattatttgtagtatttgctagaagagtctgataaaagtttgtgatgtttgcaacatcttcggcattctaaagccaaatcttttggtttacgtgtgtatagactgagcaatatttagatagaacacactatattgtgaggttagaattgtgtccattatcgattgtgatggattttgtgtgggcataattgctccaaattgtcattatcttattttgcatctagtgcactgtagaggcatttctacaagagagatttttagtttggatgtgatttgacttaggaaacttgaaggtctattatcctgtgggcaaatgttgtgatcaatttgttttgttggcgtagtttgtttgttgcctagtcagttcttttgaggcacgggttatatcttgtttactgatatcttatattttgtttgttgacaggatgagaaggaggcttcggaggctacagaaatctacaacgataatcagcctaatgtagctgatgctcagaatgtggtatttaccaatgatttgttgatatttctatatgcaatatgtttcctcatactgactaaccacataacttcaggaggatgaagccccggtgaatccttctgaagagttctcagcagcagaggtggagcaggagaagtttgaagcagatgtggaggaacaagagaggaatgcagatcaacagttcacttctcgacggccttaccagaaccagcgcggtggtggtggtcgtggtggtggcaggaggggttaccagaatggaggtcgtggtggacgtggggggcgaggaatgggcggtggcgggtaccagaatggtcgtggtggtggcggcggcggtggctaccagaatggccgtggtgggggtgagggtggtgggtactactataatgagcctggttactaccagcagagggggtacagcaacagaggcaggggtggtcgctctggtggtggcaactcttattacaacaatcaaggtggaggttcgcagggaggtggccacgcccatcctgggagggttgagctgggcgcaaacgcttagcttcctaactattttgcttggaggagtgagtgttacgcgaggagaggacataatatgtgggagccattttgttattatagaactaacttagccctttattatgtcaacatttgcccccctcagagttcttttgtcactccaatgactttcatatggatggttggttgataatgcggaatactttggggaagtagtttaaggtcatattcgttctccttaattccatttcttgtgtttatgtgtggtggttgttttacttctcttctcattttctgcttatgagatttatcatgcatctactgtctacatatcacaacaacatgatacacataattggtgctgctcttttttttttcttcatgagttggcttcatagatgctgctaaatcgtgccaactcaactcccaagtttcccgtccgttactgtaccatatttttttgtgaggattgttttattagctgttgttctatgacgaccctgcaaatgtcaccaggtgcgaccgtgtgttgtttacctgagcaatccgagccgagagctgcggttatgtgctctatgtgcaacatttttgtttatgttttttgtcttatgtttgtctcttgcatacctaacccagtctgttgttttaatttgtttatgcatgcattcagctcgaggaaatgttctggtcggacttaatcagacagctgacctatagtttcttgtgttatgagaagacctagagtttctgctgagcgaatagacatggacaatgccacatcttaacactccacctaaattacttgaccatttcttaaccaccattccacctaacatttctgtctaccaaaaaaaataaacacacatgtaatcctgtttatcacgctgactttagcaaaccggacaggttgattagtgtctgtgtgtgtgtgagagagagtgtcgaatggcatggtaattagccgggcacttgctttccgaaggagcgaaatcatgggtactaatcatggccccggtgcacgtcgcttcatgccttaatcatgaccctgcatgttagctatctcctcccaaaacctttgaccattgcctttcttctaattagcacttgttta

SEQ ID NO: 74369 - DNA, 21886 bp, Oryza sativa
catattaacctatcttgtgaatttttttgaaattttttcataatcatctacctggagcgcagggaccaacgaccggcgaggctgatgaagaagatcggagagagggcacggcaggggaggcccatgtcatcatgcgcgtgtgccgccggtccgggagactgacgcggccgcggtggcctggttggtcgccgaccgatcttttgaccggaacttgccttaccggccggccggccaaaagctctctccaattcgtgcaccgtctcgctggacaccggacagatcgacgagcccggcctctggtccagactccagacatcgaaaagacaggaagtggctcgggctggcccgctagccccggtggtccatcgctatggcaatgggacgcgagatggcgagggatcattaggctagtggctaccatcagtcgagcagaacaatcatgccgtgacgacaacaacaacggaagcagttcaggcattagccaggcaccttcctgagtcgccgttcccgttttaatacgatcgagacgcaggaaatatgatttgggtccatctatctatctatagcctggtactgtcaatttccgcccccatggacaagatcccaagcagtatatacatagcagtagcatttatgctcactagaacaaacttaaaaaagagctttcaagtttcaactgctaagccgtcgtctagctgtagcctggagagaataaaatcgccgatcagtctctgcagtggtcctgcctatcgacggattcaggaaccgaagtactctgatccagcggcatcaattccacgctgtgccgcctgcttttgcgacatccatgtgtaccaagtcttaagctagagagactagagcgtgatcaagctgagtgatcgatcggctcagcacacaatagtataccattaccgtgtaatttaaagctaaagctcagctacatgatcacggcgatcttctttagcggcctagctaagctaaagcatcgcatcaacacaggctagcttaggcccaagcgatcatggccgctttcctttgccttttcgccctccccgttttttcttacacatccgatccaacatggccatcatcatggcttccctctccctagcttagctcaattcgccgaaacttaacgaaattttaggatagtttcgattgatctgcacttccgaagcatgtcaccaacaccatgagtgacatttttcttgtgtaggattaatcaatgcaacgcgtacgtgtggcaagtgttgcttcaaattaaacattttttcctgttcaaggaaaggagtactttagatttcagaaggctggcacaggcagatatatatatatatatatatatatatatatatatatatatatatatatatatatatgagctagtttatacttatcggtacaagggggcaaaaggaaaaacaaatgatcagtggtagttataaacctttattagcttttctgaagatgagaggagacatgacctcaatatatataaaagaaaatgttagtgttgtgaattggtaggtttggtagctccagattttgattaatcaatttcttcacttctcagcattctgaaccgcacgtatccatcatgtatatatacaggcgtacgtacatacgccacgaccgcaacaaggcgtgtcttttctattcctgccctgtctctgttctcaaccacctagtagctactatcaatcaccaacttggttgattatatgcataaacccatagaactttctgcccattgtcgatcaatcttttccgctctattagttgaccgatcctaaggaaaagaaaaaacaaaaactattctcggtgatcgatgtcgcacacccaaccctttttctagtactaccactgtaacataacaacatggtagtaccatgaattgaaaattcgaaatgtcttgaaattcactcttcatttcgttattaattcttcacgcgagtactagaagagatgcaggataaaaatgcagagacatcagtatcgtggccggccgtgtatgtactacgtacttagtacctaacctgatcgatttggccgacataagaaactataataaggctctgttttgtgatcttagccttaactacctccctatgtgcagcctggtagccatgtactttagtgcccgttggtggtttatactagtacatgcaaaagcgtcgcaccgcctttttgcctattgggagatttaaatgttggatcaattagcttgagaggaatgatggccaaagagaaagcatatgcgtgctgctaacatgcaaggatcaaagagaaaaggaagccatcaagcagtggaggaaacttgtcaaaagctaaggctggatggtttcctttccttatcttttcctttgagatgtagcgctggaattccgcagcatgtgttaagtctcccctgaaattaggggtgtagattatatagtatgtgtacaacattgtatatactatactggtaggaaatgaagtaatcctaaaactagcagaacattctatagcagtagctatctacaattaattaattaaacctctccattgcaagggttagtatcaagtatcacaagtatgtttgtcacccatgagtcatgactagcgtcatgttgtgttaccattaagcccattttgaacaagggattttaccgaaagctgtaaaattccaagggaaatgtatatatgcaataatgcaagtaggagtatgcaacacacatgcagagtgtacttcatatgcttcagtgttggaagggtcccaaaaaagcattccttgttgggtcatggacgcagccttattccctccagagaactttgacattgatcctagtatcctacggcccaaaaagcgacatgaccaaactgcccctcacccgccgcactgatgaccgacccccttaactaactccccagtgtacctccacgccatgggagctgagctgatctgaatgatcccttctcacttccaagtactccacgaatgtaacaacttgatgtgacctcagttcttctcccatctcctcttctccccaccacgcgcgcgccgccctgcccagatgtttctccactccctcttgatgcaaaacatggccaagaacacaacaacgcagcagcagcagcagacgaggtacgcacactttgcatgtgggatgatgatgattgcttcggttcgttctacgtgtttggctgacgtgatggttccatgcgcaggtcgtcgaaagaggcgggcggcggcggcgcggcgaggtcgagaggggtgtcgtcgaagaagtcgccgtggtaccagcgggcggttgaggtgttgctgctgatatggaagcagccgacgggggcggggacggggacgacgacgaaggccgcggcggcgtcggggatgggggctcggctgcggaagtcgtcgtcgctgaacgtggcggcgtcgttcacgcgggtctgcctgtgcgcgcctatctcgtcgtacaatgagcaggcgctctacttccaggcgggcgacgtggcgccgcgccggagctacagctacccgcgggcgtcgtcggcgtcggcgtccgggtgcagcggaggcggaaacagcaacccgctggtggcgccgccgcccgcggccgagcagagggcgctgatgaggacgcctggccccggcggggagagcgcgaggcggccggtgttccgcggcaagtcgctgacggacgacatcctgatgcggcggttcgtcgtcgacgaggaggccacgcggcggcgcaacgagatggaggtgatccggcgccgccacgcggccgccgccaagcggcggcgcctcggccccagcccgctccgccggatggccctggcggaatcggagtcggaggccgacgacgaggaggagacgacgacgacggaagcagccgagccgacgtcacggaggaaaccccaagccgtacccatcgcagcgtaacagcgaagcctccctgcttgtccctgtctcccctctcaattttttttccctcccttacacttcttctcccgttccttgtgctcttgtcgttgtctcgcaatgatgcaagaagaaaactccgagcaacacgcgcgttctcttcgactcttccatatcgaccgatgcggacgtcccgcccagcccagcgcccgccccgcacgccaaagtacgcgcgcgtcgtggagaaacccggcgaaaccgacgtgtttcccccgcgcggcgcggcgcggcgcgggggcgatcgaaacgcgacgccggaacgagcaaacgcggggcagagttaatgggcgggcagccgacgcaacggctaggcaaggcgcgcgcgcgggaccagcagcgggaagcggtggcactcgcggcgtcgcgcggggcacgcattcattgggcttttttctggggttcgtggttaaatgcgtgatcggtatgaagtccctgccggccgttggggtgattacattgattttaacccgcccgcgctttggcgaagcgaacggacgaacctgtactgccgaagcccagattaatgggcgcatcaacgtacggaaccaaacagcgccggtggtggtacgtcgcgtccgcgtccggcgatatctctggatttctcgccacagttcgtagatcgcggacggtgcggctagaatactagcgtgcagaaatgaccctactcaaaagcaacaggtgctactactaaggctgtgtttgagggtgaggggaccggaaagattgggaagatagacaaaacgaggtgagccattagcgcataattaattgagtattaactattttaaattttaaaaatgaactaatatgaatttttaaagcaacttttatatagaaattttttacaaaaaatacaccgtttagtagtttgggaagtgtgcgcgcggaaaacaagtgacaatcttcctaatctctccccaatctctttgaaaggacgcagcctaactcgatcgcggataacataatccctgctcgctaatactaaaaggtttggagtgccaagtaagggctccatgattgatgttccccttgctttcgggctggaaaagcaaaaggcaatgcaggcttgcaggttgcagctcaggccttcgttcgcagtagacttgtactggtacagacgtgtactacttgtactgtagcaaccctgtgccggtgaacatttgcatcgccggcacggggcccacaaggcttttggcgtcctgcagcctcacctatctcgcctcgagtaatcgggtggggggcttttgggattcgttggtacggctctttggtcttttattcgtgggccctcccgaagcgcccgtgggcttgttttgagcccggaatcggggcactctgcacccgctgctggacaaatcttgcttggcgccaatagccacgggccaacagcttaaattgggagtatgcctgtgattgatggatttgaaaaattatcccggttgatgaatagttgtcggtccaaattttgcctgattaggttctgaccagcaatgcttttaaaaccgtacaagccgtcctattgtgtttctaatcaatataaaaatgaatcattattctacatctagagctattcattcacctttgttgcataaaaaataaccgccagaattataagggctcctttgcaacaaaggttttattaaggatgtcttcgctacaacaagtttccatcggaacagtgatcacggaaaatgtagcggtccattagcacatgattaattaagtatttgctattttttaaaaaaaggattaatttgatttttttaagcaacttttgtatagaaacgttttgcaaaaaacacaccgtttagcagtttgaaaagcgtgcgcgcggaaaacgagagagatgggttgagaaaaggggcatccgaacacaacctaagtgtttttgtaggatgtgaatcttttggaacatttttctatatgctcctttgaatcaaaggaatggatctttcaaatttctatggaatgaccaaatccataggaatcttgaagtaaatctaacatgagctccaggctcttgaaaattttcgtgcgggtcattctctctccaattttatgtaccgtttcctgtgaagcattcaaacaacacaattgagcaattcatttttttttcatattccctagggttacattgtcactccaattcttatgtttttcctggttctgtgttttaaaattcctatgttccaaaggagccctagttgacaaatctaaaaccaagaccaacaaatattggtgaatagagtgagttcccctttgtcgcttaatataagcatgtcgcaagtttttcacgtagggggtgaaattaaatgagaaatgattgttgttggttgaaataagaaaaattgtgaagaaattaaatacgagatagcagtgattggttgagatgagaaaatagatggaaaagtagctatactccctccgtcggacggtgtattttataacaaaatttaaaagtcataagtagttatatttagggtggagggaatattgattatccaaaaactccgatttatcatctagcgaccattttcaccggcagtataaattctacacatggttagcatccaacttgaaaaaaagtgctcgtctggatcttctgggctttcaagagtactattcgtttcttccctgttgcaccaactgtttagttcgttaaaagaaaatttttgaatgtcacatcagatgtttgattggatgtcggaaggttttttttgacacgaatgaaaaaaataatttcataactcgcctggaaaccgcgagacgaatcttttgagcctaattaatccgtcattagcatatgtgggttactgtagcatttatggctaatcatggactatttaggctcagaagatttgtctcgtgatttcccttctaaccgtgcaattagttttttcatttatctatatttaatatttcatgcatatatctaaagattcgatgtgatatttttaggaaaaaaaattgggggactaaacggggcatactgtcctgactcctctgcactgaacatccatggcgccaaaaaaggagaaaagaagaacgaactcgttccttctctcgctaaacgttaacggtggaacgcacaacttcagaattcagacaagataggtaaggatagaataaagcggccgcgctaccgatttcgctctgctaatgttggatctgattctgaacatatattcagctggacggtcacacacctactaagtatacacagtaattgagctcgttgctgagaccgcgcggcacaggacggcgagggcgcgaggcgcttgtccgcacaattacaaaccgcaccgcactacacggatgcctcgcggctcgcgcggcgcggcggccgtcagagcttggagtagagctgcggcgtgcaccacttgaagaaggtgcccgtggggagctcgccgggcgggagcagggcgaggcgcgccccgatctcggcagcctcctccgcggtgcgcttcccccagccgcgggtcatgtccgtccgcgtgaacccggggcagaagcagttgacgctcacccggtcgccgcgcgcctgcagccgccgcgccagcacccgcgcgtacgcgttcagggccagcttggacaccgagtagtccgtccacaccttgggccacccctgcccgcgccacgtcccgtccttcacctgcgccaggaaccgcgacgccatcccctccacctccgcctccgtcagcctctcctcgtcctggagcagccgcttcagctccgggtcgctcaccttctgcagcacaaacacgcagccaatccatcatcacaacgagaaaaacatatctcgaatctcactttttgttttttttttgtgtgtgtgtgtgggtgcgcgcgaggatatctgctgcagatagagaaacttcgatgccgaaattccctttcaaaggcaggttagattcgtttgcaaaattagtcgtcgtgtacacattctgcgtttaatgatgccgttgcactacagatgctgacttgctgatgcactacagatgctgacttgctgatgccctgctgtaagtttaaccaactttcgtcgctgtaaaatactccctctgtttctcgtcgctgtaaactactccctctgtttcatattataaattattttattttttttctagtcaaactcatttaagtttgatcaagtttataaaaaaaatataatagcattttcaacatgaaacaaacacactatcaaaatatattaaatattagtttcgataaaaactaatttagtgttatagacgttgctaaatttttctatcaatttgatcagatttttaaaaaattgactaggaaaaaaaaatcaaaacgatttataatatgaaatggagggaatactgagaaaataagagtcagaaaataagagtcaatagattcctcgctcttttcccgttgctttcaaacctcttatcctcgtcccctttcgtgttttttaactttatggcccatgtatacagatcttttgtgagagaagatctctccagctttagttatatactaatagcatatgcatgtgacgacgaaagcgacgcaagcttagttttacaacctatacaaccatttataactggaaaattttaagggttcgtctctgtgcaagaaacataaattgcgcatgatagtacgtgattttcaaacttgcatataaagatcatctttcaacttctgctcaacactccaaatgtagttgggagtaaattagacggaagaacttctgtaaacttggagtttagctagaaaacaaacaagttgcggattctagtttatgctgtgtcagtgataatgaaagaaaagacttcaaaatgacatgtatttggccgtgtatttgtacagaccatagacaacgtattagccagcacattcatgatgagatatgcattatgccttaagataagcttcaaattataatttgtccaccactggtctcgtgcattcacacttcataatctcaagtctttatctactagctatttgtgtgctactacttgtcaagcttgcctcttgatatgtcaaaactactgttgttttaaaacatagtttgatttaatccaaaaacggttaggtcagtgacactatacttaaagagaattagttaattacaggctcaaagtttcaacgcacatacacttaacgtgactcatgatgtacaaggagaccactatggaattttttttcctaacaatttgagctacaaccagctattctttattaaaaacaaattagaggctagtctttattaaaaagaaaaaaaatctttcaatacgacaagcaacaaatattattttcctcatgaaaatatcatcatttattttccttgtcttgttatcgatcgatgatctatgaggtacacaacaatgaaggtaaaatagttgcgtgttccatcttagatttttttttttcaggagagtttcaaacaagttcatccactagttctataattttgggtgtgacgagatatatggacagggaagcaatactagattaacatgaattataaatatccatttgagcacttacattgagtagtccaagttgggagctgatattcagtattcggctggtggctggtgatcgccggaaaagtggcaggagtgcttcagtcagcatcttggccccatagaagttcgttctaaggaccgtctcggcgtgctccactgagttagtgtcaatttcattgaatgaaactgctgcattgttcacctacatcaacaaaatgtgcagatacaattcatttcatcatcgcagaaaaaagcaagtcatcatggattagagtggagctactgaacgaactggtttcagatagtaacaactcccttttattgcagctataatgttaggaggctggaaatgtactccactaaaccgcacttggtcactatatgtagatcatcttattgacataagttaagggtttgtcgtatcacgcttttttttttaatttcttttctgtttacttcagagactttttggttgtgtgcccacgggcagagaccggagatgtaatccattttcattatctaaaaaatgtggtgtactatgcctatcactccacaaagtctcaggcctcatcgtactctacaaaagctaccctcttaatgtcagttagattacttgatggtatggatgtgccaacaaacagatggagatcgattagatcaaacttaacacccgttatctgaaagtgccagctcaacatgaataaaccacgccatcattgtattcaggtaaggagtatggatcaccattttggtagattacaggtcacctagcttgaccatggcccaatgccccaatctgcctagctcggtttgcacagcctgaagatcatgtgtttgtttttgttcttctgttctggcagctgtcgttaagactggccgtaagcagtaacatactccagttcagtaaattacgcattacacaggagcagctccaagcatatataaacacaggccgggagctatggcttccaacgcctctgcaagtatgggtttgaactttgaacgaatgaaagggagagatatccgacttgtaacaaagtggcaatacggattaaccaatggacggatttgacttgaagaaaattaaacagcttgcagaattaagaacaagaccagccaacaagattgtaagttgttactccacctagatagtcaaaagtgctgcagccagagccaatcagcgggcagcggcacgttatcatgagctttttaatactccctatatttcatactctatccttccacaaaaattacactactccgtattacttttctcaccaagaccaaacacaaattaactatctaacatataacaaagatcaagtagtgtaagcactcatgcaaccaatgagtattaagatggctcattagtttctggttaaacatttaatttacctattcatttaagtctttgaatgcatagagacaaaatagaaacaacttatttggaaaaactaagatataaaataggtctaactctcgtggatggagtattataagacgggtttctaataaggatcaagtttatagaaaaataatagcatgtacaacaccaaattagtttcattaaatcgaacattgaatatatgttgatagtatatttgttttgtgttgaaaatgttactgtctttttagaaaaaacttacagaaatttaactttaaaaatatcaaaatcgtgagtgtataacatgacttttatatgtacatttaattattcatattattcatttttgaaaaaaaatgaaacaacataaaacatacttatttaaaataaaacaaaccacaacaaaataaatagtgataactttttttttcatatgacgaatgatcaaacgtgtgtctaaaaattaacgccatcatatatacttaagagagatgctctagtgctctatactagtagtattatactaccattattattaaggataaattagtaagttactaattcaatgaatatgagttactttgttatttattttttttctagctaaatcgatctatgatcatccatcacattggcatcgctcatatttcatcgacaaagccaaaaaagaagaaaaaaagttgtcactactaaatgatgattataccctccgcacttatttttttctgacaataatgcccctccaccttatagtataaatagatatgaaccatttgatcaaatgagatcaatgatttagatagatttctactgtcagtagagagcaccgtagcaagtctcgtatacttcttaaagaaacgcagcaagtatttgcgagctatcagaaccctgacttctttgagcgctcgagttggctccgggcgcaagcgaaacgaaacgcaacacgttggacgttaggaccaggttgcgggccgacgggccgtgtcgctgtccggcagcatgcacgagcacgactcagcctcggcgccgggagggagagggaagggagcccggaattccggatgcgacgccgaccgtctgctacgtgtcagtgacagagggggcccagccaaagcgaccgctcgcccagccatcgcccgcatgaggcggtggcggcggcggcttcggatttgccctttccttttccccacacgcgacaattttattcggttggtcgcccgccgcgcgcgcccctcgcccccttggggcctagcagggctagcactcatggcgggaggagcaataatgcagcctcgcaagaaccgatcttgacgggcgctccacttccgcctaaatacgcaatttgcccaatcgggcgtcgcatgcatacgaaaatcgttactgttctataccgatcgcgagcgcttactgtgcaggattaaagtggcagagcgtggcctaaactgttggcgataagatacgttgccatcatctggactgtggagaagacgtaataatgacgggcgagcggaaacctcggagaaggggaagggggtttgatttgacgtgatggctgactgactcaccaggatgtcgaggccgccgatggcgtcgcggagccaggcggcgaaggcctgcacggaggcagggtcggcgacgtcgaggcggtggaagacgacgtggaggccccgggcacggagcgccgcggcggcggcctcccctcgctcggcgtcccgcgcggtgagcaccacggtgatgccgtgctccccgagccgcgccgccagcgcgagcccgatgcccctgttcgcgccggtcaccacggccaccgtctccctcgtccaccacgccctgtattacgaacggaacgaaaaaaaacccagtcagatcgaacgacgcaaggacaggacaggaagccgagcgcgagcgggcgatggtggtggtcaccttgccgaggacggctccttggagctcgagtagtccatcaatggacggagcgagagatcgatcgatcgatctcctctcgttgagagctctgcttggggctagcttggcgcttggtaagggaaggaaagaaaggttgaggtgttcgtgccgggccacgcgcgggtggtggggagtggggggcactggatcgctgggcgtccggcagtgggcgaggtaggggagatatgtatacaggcggacagacaggccaggccacgccccgctttgggtggtcaaacggacgggacgtatcgcgtactggagtcctatgcaccagggagctgtcaagctcaagccgctgaaggggtgaggggaaccctgtggagagttccaacttccaagtaggggcatgtttaggcccctttgaatcatataggaataaaaaaacaaaggattaggaaaaatataggattctgacataaatacaattgtaaaatagaggattgcaaaacacagaaaaaatacaggaatggccgtttgatcggaccacaagaaaaacgcaggaatcagattagagagatagactcagaggaaatgttccaagaggttagacctcttgctaactttcctctaaaatatgcataggattacccattccataggaattttaaaggattggataggatgcaatcctttgtttcaaaggccttcataggatttttttttccatatgattgaaatcctccaaaatttctacatttttcctacaaatcaaaggggcccttagttcgcgaaataaaaatttttgggtgtcacatcggacgtttgaccggatgtcggaaggggttttcggacacgaatgaaaaaactaatttcataactcgcttgaaaaccgcgagacgaatcttctgagcctaattaatccgccattagcacatgtggattactgtagcttatggctaatcatgaactaattagactcaaaagatttgtctcgcgattttctccctaactgtgcaattagtttttcttttaatctttattaatgctctatgcatgtatccaaagattcgatgtgatgtttttgggaaaaactttttgggaactaaacggggctaggcgtcctactatgccgtgggccgtgcaatcgaccaatcgacggtcgcaccctatggtggtgtttggatagggactaaaaatttagtcccgtcatatcggatatttgatactaattataagtattaaatatagtctaataataaaattaattgtataagtgagagctaattcacgagataaattttttaaacctaattaatccataattagcacatgttcactgtagcatcacataggctaatcatagattaattaggcttaatagattcgtctcacgaattagtccagacttatggaatgagttttgtcattagtctacatttaatacttctaattagtgtcaaacatttgatgtgacagggactaatattttagtccctaatccaaacaggcctatatatttaggtgtggtaagggcattagcaatgtgtcgggtttatttcgtgtgactatatgctccacctagacaagaaaattgaatgaagccacacatatgacaaattctaatctcccacagtgcgctggcctccctttcttccccaggttgtgcccttcatctcctcaggctggcctgcctccttgccttcccccaccagcaccggcacagctccacttcccctgactgccagcgtagctctccctcctctccgctgttccccttccccatcggcgcctctcaatctcggatgctgctcgagcccaactcaatagctagcggcggctgtcgcctccgacctctccctccgtcatcccctccccgcctccaacctctccctccgccgtctcttccccgcctccagcctctccttccatcgaactctctagatctggcccgtggctcatggactcgggcggcggcaatggggaaggtggcggcggctcgacggcaatgctgacggaggctccatggaaggcccgtgtaacgctccgcttttcgtgagacgttaaaaactaattcagtaaaatcctaattgcgaaaatttccgttctttgagtgctgagtctaaagttgtgccaatatctcaatttaaatccgtcctcgatccctctcatcaccatcaaaatcatcctcctcaaaattccttttccaattcaagactccaaatcaaatcccgaaattcaaatcctctcttgaaatccttgcgaaatacctgttcccgattcccatttgagttccttccttgactccaccttgtgtccctaagaccaagcatccaattcgaaatccaaatccaaacccccaactcgaattctctccaaatatgtcttctctgtaaaagtctattttgcgtcctcataattttggatgggctggatcccctcccctcggcccatctccccctctcaacccgcacccctcgcacgtgcattgcatgcagccgagccgagaaggagggccgctctctccctctctgtctctctctcttctctcccggtgtcaacctcccgtcgccgccattcgattttcgccgccgcccgccggttcccgctaccgcggttttgtaacaccccgattttcgttcgggattaaaaatcaattaataatacatttctagaaattatattaaaggttaaatcaatttaatcaagtgaaattatagaggaaattaaaatttcctttaaaaaaatcattggccgggaatattttgcaatattctttgtgccccaaaaatactctccggatttttccgcaaattttcggagctcaagaaataattttaaagtcacaaagttcatttaaccaattagaataaaaagaaaagaaaataatcttcccctttcccccttttgggcttggcccaagccttcccctccactcccgtgggccgcgcgcctcctccctctctcggccggcccgcgccttgcgaaagtctactttacgtcccccggttttcctcccctccttcctaggccggcctcctccctcggcccgctcggctctctctccctcaagtctgctttacctccctctcccgttttcccctctctctctccccgacaggtgggacccgaggccccacctgtcatcttcatcccttacctcccgtcgccctaaccgccgccatggccgccaaatcctcccacgtcgccgcctctcccgcgcgactccctctcccgcgcgtgcgtggacgcggtcgtcgcccacgtcggcgccgttttcccccactctccccgcgaaaatcggcgccggttaacccctccaccaccccacgtcggcgcccacttcgccagccgattccgccacgtccggcctcgatcccgccttcccgagcccataaaaagcacccccgtgctcccctcgtccatttccccttgtttcccgggcccggcactctctccctcgctctccccacgtcgttcccgcgcgccgccacactccggcgaactccggccgccgtttcccgtcgctagggtcgccgccgcactactccgccgccaccgctggctttgccacctcaagggcacgctcggccgccgtttcttcctccccttccaccacgcgaaccacctctccaccgtgctcccgctctccatcggtccccggcgagctccggccacctctagccgccgccctagccactgccgcgccgcgccgtttgcaccaccggcttctccgtgcctcgccgcaccccggcctccgctccgtttccccatttaatcgccgcaaccacccttccaccgtgcatcccaagccacctccaccctacgccgccgggccgccgttccgccttcgtcccgaggagcgccgacgccgagctcccccgcctttccccgcccctcgtcgtcgcgtccttggtgagctcctcctctccctccttgcctccctcctctgtctcccatgcgtgctgccacgccggtggccgccgccggcgaccaccgggccatgtgccgccgccgttaggtcggccggccagcttgtcgccgccccgctcgcctaggccgcccggatccccttgccgcgccgcaccaccgctttcccgcgtgcgtcggcgtcgtcgcaggaggccgcgccgccgtgagccgtcgctcggccgggccggcctgagctgtgcccgtgctcagccgcgccaccccgtggccgcccgatcagctcgggctgatatgggccatcggttcccgtggaccagcggtggactaccccgtggtcccggtccacggtggaccggcgcccttgtgccgctgaccggtggggcccgcttgccggcgccgccctcccctttgatgacgtcagcaaccgtcttttcctttggaaaaataaataataattgcgtcataattcgttaataattctagaaattcatttaaatggctcaaaacttctaaaattcatatctaattcattcgaactccgaattgagccattcaacttgcaaaattcatctaaaattgagctctacatgtttgtttactttttatgtactgtttccttggtttttattagagtttttcctcattttgcgtgccagcgtgtagttcccgtcatttcggaagatcgcggtcgcaaggataagagttcggaagattgtttgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctgttctttgtcaaccttgggtaataaatcgactagctcatgttacttatgtgacctagctagaactatatgcttagccatgcttaattaccactagctcagttgatggggtaattacagttttagaccttttagtatcaggatgagctgcgtgctcgagacatctggccatgcttcatggtcgtaattatccaactaaaatgcgactgaatggtgggctgtgggtgcatggttttgctagtcgcacccatggcaattaaggaccggttcgcgggatgccctggaagaacttatcgtacttaccacaagccagcgtaggcaacggctgggcttgtagtgtagctttcctctagccgacgcatccaggcaagggtgggcgtgatggagtttggatgggccctgcgacggcctatgcggcttccggattcacctaggcatgagaggggactgcccgttgcccgctggggacgggggtgaaacctgaggtgtggtgtgcttggctagagggggttatgcgaagggtcctgtcacggcctctttccggtatatcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccatcttaataaatcgacccaatgcactgtagtccaggtgggttggttgggcctgttcaacgtggtgtagcattgatcagtggagatttaatgttactctaattactcaaccgttttactgttttgctcaataaaatgttttacaactgcctttatgcaaatagccacaaacccctccttgtatccccttgcacgtctgcatcgttggtgtggcttgctgagtacggtggttgtactcagtcttgctattattcccccttttcagaagtgtagtgcttctgagctgaagatggagttagaggaccaaggctcagaccccagttgagttttgcctgtggagtggagctgaagccccgctaggatcgcctttttccgctgctgtcgttctgtttcggtgcgaggactaagtgcctcttccataagtattttacgcttaatttacgtttggaactgtatattacttgtcgtcttgtgtaccctggctggtcctggacagggaattaatacgcaaaatagtctggaaatttgggttaaatttctgggcgtgacaggtttgaaccctcccaccaccgctgttcgattttggccctctcccgcgcgtcgtggtggctgaccgcccggtcaccgtccgccctggccatgcctgcgcccgctctgccgccctgccactcgctccaccttcgcgcgcgtgcgtccaagacgtggaggcagagcctcggctcccctctctcacgcgctctccctcctccctctgctcgcccaaatcggcaagaagccgagctcctttcccctcccctttttgctttttccctctcagcccggccgcccgtgaccacctcctgccgctccttgaccgcaagcgccgcgccacccgagcacccttgaccacctaagtcggtttcctcccccaaaaccgacttcccgtgcctataaaaccgcagccgagcccctcctctcaacccctcccgcttcactctccacgttgtcgcgccattgtcgcccctaccctgcagtcgccctcgccgtccgtcgccgaagcaccagggagaccggtgcgtgcggggacgcgagacaaggactccgggcacctcttcttccccttccccggcccaaggccggagagctcgccccgcgccatcggttaccgtcctgcgcccgccacagcacggtagtgcatctccccgttttcctccctcgctccacctccctccttagatttgggtagtagcttgagtagtgcccctgtagcaagctggcgccgccccaagcctcgccgccgctcgctgtaggctcgccgccgttgccgcccactcccggaggccgccgctcctcgtcggccctcctcggtgctcttccaccccatccaacgccagaaacgagtcccctgagtcctagatatgctcccactccgctgaatcgaactcccattgctccggtggattttccccttttgctcgccgccggccgccgccgtagcaatccgccaccgtcgatcttcctccggcgaatccaagccactggctcgcctcctatcgtgcccctcttcactccggtgtgctctcccttggccgaagaccgtcgcgccgtgctccggtgagacctccgccgctcaccgtccatcttggccggcctccttcttcttcctcccaccagcccgcgtggcaaccacgaaggcgccacgtcggcgccagctcggccgcaaccgggtcaaaagaccggtcagccgcctccctccgtcccatctttcgtgcgcctggtccacggagagccctagcggctgcgcgtgggcccgccatctcttggtccacccggtgctcaagccgtgagccgcgtccgccaaaccctcgcgccgccttgcgtgcgcccatccctccgtgagccgcgtcaccgacaagcggcccccacccgggaccctgcgaggtgcactcggtccaacggaccgccccctctctcttccgcgcgccctaatgggccgcctcaccatggccgcgcccggcccaatagccggccgagccatataaacccctcgggccgcgccctagccgccccgaggaagtctgatatctctccctcctccaatttcaaaaagggtttaataaattattaaatccttttttcctttagatagaaattccttaatccttagaaaatccatatcttctcaaccgttcatccgattgactccgttccatatccagtaattccgtaaaattgagatatatctaatggcactattatttagtctaaataggatctttattttgggtcttgtgtaggtttttaattgtttgcgtatagttgcggttaccggatttccgtcaatcgcgggttttctcgaagattcgtgaagcttcgtgaagaccttgagcaaggcaagtcacactttgatcaattgctcctataattagaaaatcattattattttgtttgcaactttcattattagaatcacacacttaacttgcttggcctcggtttgcgtgccaaaccgacggacctacccagtagttgcactaattcctgtaggctgtactaccctgattccttatcgctccacccttgtggtacttcggtatccgtgctctttgagcgcgcataccaaatatcccacatacaccgttgattgtcgaaaacttggaaaatgggtttgtgaagccttgaaaacccgacatgtggtgtcggtgtgtttgaaaataaaatgaattgcgaaaactcgcgatgcgggagccgtgcctacatggcgttgtcccgtattcgcatataaggaccgattcctgtgggaaactcatcgagcataatcaaagtgcaaccacaaggtggaatgggacaccctggctaagtaactagtcggttcagggaaacctcgcatgccaatagttgggaacaccggggcggggtcggacaaaccaggttcctggtaaggcaaggacaagaagtttgctcacttaccgatcaaggtggttggaattgatttgtgaatgcctaaaatggcctatacttacgtgaggatttgatccttctatgtggcatgaggtaaccctgggtcggcttgggaaaggctttgtcgcgaacctctgacaccggccagtgtctggagtaagttcgtgtcttgtgggtaaagtgtacccctctgtagaggttaactaactgttcgaacagccgtgcccacggtcatgggcggatgtgaggtggttcccgttgcgtagatttgtttgcgtgtgctttgtgaaaagttgttgtggtttgggaatcgtaactagaatcagcctacgtggcagatggatgacctgagtggtcagaaacgaatctgtgtgattcgggatgtctacgggcatcataaattaggcttcccgagtggaaacagattgttatgctgctgggcagctggactctgggagtccgagaaaatgaaaaaggctctgagagccgcctaatcaagtgaaatggctctgggagccgataagtaatgatctgaccccgggggtcggtacattaccatttgagttgttgaaaagcatctcttaagtcgaatcgagacgcaagtcaccttttcaacccaaacttaaaaagaaataaatcacttagtgatttcaaaaatgatttcaaacaaaggatttgcaaaacaatcttgcctctcttc

SEQ ID NO: 74370 - DNA, 13826 bp, Oryza sativa
atgtgtgctttgtgtaggtttgtgatgactgaattatttttgcttgcttgtgatgtgcatgcaggatgtgcatttccaggggatggatctcaaggatacgcctgccctgctcgattatcactgatgattaattttcaaaagaagattatcactgatgaaatcttgcggcggcttgtgtcctgctcagctctgcagttgttaccaggaaacacgagttgctgttgatctgttgtatcctccctcggcctccccaccaggcggacgcgcgacgggtgcagcatctcggcgacaaggttgcgccggaggatttgccacacgggcccgcatctgcagcgcgtgatggtgtagtcgttctcgccgaggagcgagcgcgccacctccaggcggttggctagagcggcgccgcgctccacaagggtggcgtgcgcgacgcagcagtcggccatgaaagaggaggaggagggcgacgaggcgaagcggcgccacagacagccatcgccatcgccatccactgctgccgccccgcaccaccgccatcgccatcgccgccgacggcagttgctctgctgttttttttttaaagatagagggagaagagggccctgacaagctggccctacgttttttatatttttccctaatcaattgcatgtgggccttatgactgggctgacacgtcagcataatgggccaagtcagcatgccacgtcagcaaaaccgccctccaaaaccgctgagggattcaatttgtactagttttaataattgggggagtcatcctgcccggttttgtagttaaggatcacgaattagattcggtgaacaattaagaaagtcaaagtggactttttcctttccccttttgtccatgactaccacactctacacacttacagcccaactcgtatgttggaataagttcactttaagtctctgaatttgtaaccaagtctgaaagtcatccctaaccaaaataccaatacaagaagtctctcaatgtacaaaaccgcatcacctgaaatctagtagtatcatcagtattagctaacgtgacaagctgagtcagggtaggaacactggtcccatatgtcagtggctagcactatattcttcctctctcccctcctctcttcccaatcccctccaaggtgacgagtggcatgaaggacagcacgacgagctgcagccggtgggaaacgaaggcagcgcccggcggagagacgggcggcataatgaaacctgattcgcttccctccatgagtttccaacggtgggccaagccaggagccgaaatgttgattggctggctcggctgagctgtttttcccttgacatttcttgaaaaggacgtcccgaagaaattaatgtctaagagtacaataaaatcgtgaatttttcgatctagggccggccctaggcctaggcgggttgtgcgaccgcctagggcccaggccagagggggcccatcacttaccccctcccaccccatcccggccaacaggcctagccacagcccagagccccagacgcgcgcctcaggtcgccctcaactgctcagcgaatcagcgatcagccagggagcagtgcgcgtgcgcgtcgcttcgcctgccgccctgcccaccggccccacaccatgagaaccgcagcgcaggcccaggccgagccgcgtcgcttcgtcacggtctcgccgatgtcctagtccgcgagaggccgccgtgagtgccgagaccgcatcggcgccactagcctatagcgcctgatcgccgtcgcccatcggccaagccgccaaggcggtatcgctgtcgacgcttcctatcggctgcctggatggtggctggtccctgccctgcccgcgtgatctgtgattgtcatcggctcatcggccatttcccattcgcccctcttcttcaggctgaaggtaggtcacagacctagaagtcaatcgacaagctttatgcagctatgcctctatcaatttactttgcaatttcactgcttcaggtgttacaatattacctagaaacatttgtcgggtgctatacataactcataaggtcgcgaaaaagctcttttttataagggacatgggatatttgtggtctcctattaaggtgttcatactaatttgtttctatggtatttttagttgtcaattatactattgatattatttattaaagattaaattgctctatcgcaacttgcaaactgcttgatttattatttaccgtgttaaaaatgtttatttgtgtcactctatggtatatgtgctttatagagtatactgtatgtattagaagtaaaaaaaatagatataactccttaagggctaactccaaggcccatagcgtcaagtctgcctagggcctccaaaatgtcaggactggccctgattcgatcttcctatcgaacaataagaaatcgatacatcctgatactgcccctgatctaccttggagacgagaagatagaacgtgctgtgcatccggatgagatgcaatggagaggcgtcctctgcatccgcctctcgtcttcttctcggcatggctgatgctgcttgtcaatggcgtaaggtcgctgcaattcaggagggacgacttacccgatgaccgtacgccgtcttcccgtcatccgtcgccgaggaggggattgggaagagaggagaggacaggagaaagaggagaagagatgggatgagagaaaggaggaagaaaatgctagtcactaacatgtggggtttgcgtgtcccacgctgattcaacttgccacgtcaactaaaatcagacgtaatactgcctaggatctcagatggtccggttttataaattgagatacttgttatatctggtatttcggtttaaggatgaatttcagactcggtgataaattgagggacataaagtgaacttattccctatatgtttgtgcacgtacgccagggtttgtagcggattttctatgtaatgagaaaaacataaagatttgtagtaacttttagggagaaaacagctctcttactcgatgggatggtaagaagaacaatttctcaagaattgaacgaaaaggaagaggaaaagaagccagcaaagcaggctgttaccctccccacagatggaactaatgggctaggtttactctatatctctgatgcaatcctctaatctgcaggcccatgtatactacgcaggcaacccaagacgtatacaggctattgctggcaaaaggtggccgaggggatcttctgatcctctgattaaaaataattactagatcaaaagactggccaaaacatacgcacattcaccccccattaacatctccaaaaatttcggtgcgtgttgtgcgcgcacaaatgttgagggtgggttgcgtacaacatgcatgttgtccaaaattagttgctcacatcatgcgtacgatcaccccttccaaaaaaaaaaactaaaactgagctgctatattttgagattgtcgaagtcaccatgagtgtctcactagtgagggtatgtcgcatgctactaaaagaataattagctataaatgcgagcacatgtgacaaatcaaagacttcaacccgttgaatcggttctaccacaagaaatctaattagttgaactacgcccatttcgttacttaaggtatattttactgcaacataatgcgagagaatgttgatttaatcttaatatagatttaattaatcatgccatgttgcgaacttgcgatgcccacatgcatgttgagcccattataggaaggagagagcatatgcatccatcatggcctttctcttctccgccagctgcccctctcatgtaacctgcaaaatgtgtagtagtagattcaaggtaaatgtggcactaaatataacttaaatttgtggtaaatctattcgatagttttgtttaaaagaataagtcattaataaacctgtaattttacgatagtgtatatgagccgtaaacatgtaattttgtggtaattttgtcaaagcatataaattattttttgagattctactcttaaggaaaattgactagatatattatcaaagacactggatgccaaaaatgtaaagtattctaggtagggcctattcactttgctaccatttttaaccataccatttttcggtaaaattgccaaaaaaaaaatctacgtttagtttgttgccaaatttaatcaatacataaaatatcctgctaaaattttggcaatattgtcatttgccaaaattttgacatttgccaaaattttgacattactcaaacttgataaggtttattttggctacaatcggaaaagacatgtaatgttgtcagggcctcaacataatctgttgcagtattatttccacaatttaatgcagcagatattctggagctccctgcccagatccactgagggcacccacaatggttatttataggctatctacaaaagatccatgtcagcatattttcctacttgaaagatattaaatgaagagagagagcaaagctatctactaacttagagatagtctatagagaaacacgaggcaatgcatgagagagctatagatacccatgtagacatactattgaggtggtttactattaatctagtctattgctgagatgtacatgttttatagagagcaccttactttaccattgcgggtgctctaacaggctgtctctgagcttgtccaagtgtaccacatgattcagctacttgggctgcttgtacactgccctactaattaaccaagttcagatcagctgcaaattaagagctaattaatttcaccatagttttttcaacgaatggttgttgccacagctgcaaattttcatcagatagctcaatggtacgaggaacatactgtccctcttgcacacgctacatgtatccttacctttaattttgtttttgccctccagctaccatggacaaacgaaaggttccaaatggaatggcaaacacaacaacttcagtcttggtcatttttaatgataatatggttagtttgcttccctagccaacagtatatgtctttatttctgtagcttatcgtttgtttaagagctgaagattctaagaagcgcaatgagctagagtttgataattcatttcactgctatgagaaactagtttatgaaatagttcagttcgagagtttggcttgcttggctagctacatatgcttttgccttccttcaaaaaaaaatgtgttggctggtggaatctgaattaggatgactagttttgtttttcgccctccagctaccatggacaaatgaaaagttccaaatgaaaatagcaaacacggaacttaaattttggtccttcttaatgataatatagtcaaaacatgcctttatttctgtagcttatgccttatggcatgtttacgagctgaagattccttgaataaacttacatggtcatgttaaagtagttttactgcataaatacaaaacaaatgtagcattttcgcaagaataaacttgcagaagtcgacatttctctattatacataattcaacaaaaatggtattttattttaaatagtgaatacccattgtaaataccaaaaccgcaaaccatatcatcacacaaagagataaatacgagaagcaatgcgcattttaataagattcaatttcacagtgattggaaacaaaatcaataatacgagttagctaacttaacatatttcatatgttttgttgttttagtagagaagaatatccttctagaaacaaaattaattgtacactggacaagtgaaaacaactacatgtgcaccggaggtatcagatcaaatcattctagtagcagtacatttctgtgtccgtagttgattgtctccatttaccctatccattatgcccccatttcatcatctgtttctgccctttcaacacctccattactgcctttagactcgtaggaccaaccatggacatggaggtaccatgaacagcccatgcttttttctactttcaaaacctttattaaatgcctttaggaacatgaacaacccaaccccaccctaattcaacccccataaaagcacttatccaacaggatttaggcaaaaagcaacccaaaaacatgccgcaatgtttttgtactaattatctttatttttataaaagagtgtaatagtcctcttaaccccaccatgactgcttggttaccccattctaaaaggatacctccatctttaactagtaaaaggcagatgtgtgtactgttgtgcatctatctctctaaacccaaaaaaaaaaaaccattggtcttaaattaaggtgaggttgagtagtggtacaatcttaatgtaagcgagaataatgcctatgaatctcaattcccgtttgaaatgtgggaattttccagaatcctaggagaattggactatttgtcctaaaaaatgcatagaagtcctatcaaattcatggtttcaaatggacattttgaagaacttttatataagttagtacaatttatgtagagacatggaaaaaagttctgcatatttcaaatggaacccttcatttcttacttacattgcattcgagaaactcatcacctcgtcatttgcccttcagctgttaatttttgaatttaaaaacttgattttgattttttttttatcaaagtttatttttttagcattggtttttaaaatcgccaaggaaatatacatacaacatacataagtttatccacaaatcatatttttttaacaagttatatggcttataatcagcattagaccaactaataaaagctgcatgttctaataaatagaacacgcatggatgataactagagctgtcactatatgcacgatcgatcagtacataacatttcttacaaaaaataatccttattccattttcacttggagcaaaggatcgccgctcctacgaattcaattgaaatggctcaagacaatgagattttggataaaaattagtattgaggttcaacctaatagtattactccctctgttttaaatacataagtcacattaacttttttttattagtcaaactatttcaagtttgattaaatttataaaaaaatacaacaacatttctaacataaaaaacatatttgatgttatatttaatgaaactaatttgatgttgtagatgttacaattttttctataaacttagtcagacctaaaacctaaagaaatttgattagaaaaaaaaatcaaaaacaacttacaggggcagttcagattgatgtcattttaaaccatacatttttggtaaagtttccaaaatgtacatacatttaactttttgccaaactttcataaatgcgtaagaaataatgccaaaatctttttgccaaactttcataaatgtgtaagaaataatgccaaaattttggtaatattgtcaacttactaaattttttgtattgccaaaatttagtgaggtttattttgactataatctgaacaaccccataatataaaatggtgggattagaaaattccaactagtcttcttttccttcttaaactcttaagctaatgtgttttgcaacttctgttttatacttctacttagtatcaaaatcctatatatttgctacttagtatcaaaatcctatatatttgctacttagtatcaaaatcctatatatttccccccattcaatgtaggggggagggggacctcaaaatccactcactctaccctaacccttgtcaatcccataacaaaatatacacagatggggaggataataaaaagtaaaaaaaaaaaaaaagaaagcctatgccccaggaacaatcaacaaccaaggcccattcccaagctcacttttacccaggaaacatgatcatacatgcatatgtacactcctgccccaaaagcaaggtaaaaaaaaaaaaagaaagccatttgcccccactctccctgtataaccttgtacccatccccaaagattcccctctcctccatccttgtgactctctcctctccatctccaagactcccaagtgctcttgtggtggctgtcccctacctctctctctctctctgcattagtgcactgcagaagtgaagtgaagtggagtaactccactgctctgctctgtgcctgaatctctgacaactgcacgcttcttgcattgcatttgcattgcatcaagaaaatggcgatggggtggttgccgagatctgccaccgccgttcttgtgctcttcttggtcttatggagaggtaggtaaatctgtgatgtttgatcttgttcttgttgttgttgttgtggatggttggtaatggcggcatggtttgttttgtgtgtgtgtgtgtgcgcagattggggggtggaggcggcgacgttcacgttcgtcaaccggtgcacggacacggtgtggccgggcgtgctgtcgaacgccgggagcgcgcggctggccaccacggggttcgagctcccgccgggcgtggcgcgggcggtgccggcgccggcggggtggtcggggaggatgtgggcgcgcacggggtgcgccgtcgtccaggacggcggcgcgggtgggggccggatggtgtgcgccaccggcgactgcggctcgggcggcgccgagtgcaacggcgcgggcgccgcgccgcccgcgacgctggccgagttcacgctcgacggcagcggcgggctcgacttctacgacgtcagcctcgtcgacggctacaacctgccggtgctggtggagccatcgtcctccggaggaggcggtggtggcggcgggtctctgacgtcggcggcgacgtgcgcggcggcggggtgcgcggcggacctgaacgcgatgtgccccgcggagctccgggcgggcggcggcgcggcgtgccggagcgcgtgcgacgcgttcgggcggccggagttctgctgcagcggcgcgttcgcgaacccgtcgacgtgccggccgacggcgtactcgcaggtgttcaagtcggcgtgcccccgctcctacagctacgccttcgacgaccccacctccaccttcacctgctccggcggccccgactacaccctcaccttctgccccgcctcctccccaaggttcacctctctcccgccattcatctgctctttccactgctgtctgctagctactgtcactcactcactgtcactgtcagagagtgatctgagctgcaaatctggatgcttagtgagctgttcatgttgtgagctagaaatggaaagaaagtgcaaggattgtagtgtagtagtaattaggtggaggagatcttggcattatctttagttaattagttgcagatagggtgaaaagaaaagtgcaaacccgagcttttgttttgtttcgcgcgattagtttactgttgattttgcttgcagccatggatttgattccagatgcatatacacacattgctcgtgagctgaccatgtgcgcttgttctttctctttccatgtcacgtggtgcgcagcggcagccagaagtcgacgacggcgacgccgacgccggcggcgatgatgccggggacggggacgccgacgacgccaacgacggcgacggcgatgcctggggcgacgatgcccgggacggcgacggcgacgacgatgccggggacgacgttcacggacgccgtcccggacaccagcatgccgatgccgatgggcggcgacgccggcggcggcggcgaagagggcgtggtgctgagcggcagcgagacgtggatcgccaacatggccaccggcgagctgacggcggcggcgtccctgtcccggccgtcgcccgccgcggcgctggcgctgttcttggtccacgccctgcggctgctcgtgctccggtgatgcccggcggccatgtcggcgccattgtagtagtaacaaaaacattttagtcatgagacgatgtgttgactagtgtgagtgggggtatttttgatgagctttgttgttgtactgtagggggtagtggtagactgtatcggttgtacgctgtagattgttgattaattacttgattaattaggatgttagttaattgcaggttttgaggcttttcacgatgagattagggcaagtaccaagggagagactcagtaaggcctctatgttaattagaggccatcatgttacaatagttaagataatacggtatctaaccattaatataacaaaatactttcttagtagtcatctttcctttattacactcaatgcaataaaaaaatttctaataaatactaagagtcgactctgtatcgttctcatactcatacggagcaatcatcttttatacgtagcaaacatttttctcttttttttttctctctagtccacatcaaccaatatgcttgtatgataataaagagagaccgttaataaaaatcattgtacatgccattagtcgtgtggttttgtttcttgtttaagggccggcagattcgtcgctcgagggagggcgacccggcacacgggcagccgggcacggcacgcactattacattatttttatactactaatctactactactatacttaattagcactactacagcatactaattatttacttaaccaattaacagtaaaatcgtgctaatagtacgactaaatcacttagctgaagtaactaatgttgatgctaatcgtaatgctaccggagtggagtaggaatgtacagaagcgatgggggtgtcgaggagaggggggcacatgcgatgtgattgttgagggcgcggacatcgaggcgcaaatgcggtgggggcccacgacgagagaggagatggacgtgacgggtccagtccggtccgtatgggtgggatgggcctagcctcctcggtcgctctttgccatggtatactagtactactggtaattgtgtaccgtgccaccgcattctgggtggatcgtcgattcgatctcctcaactcccagtgcggttattagtgcggtaatttttttagtttttaaaatggacaatttcgttttccccccaattttatctctaatattgattttgtctctacttttagggttttcgtttttgccccaccttttttcactgaaacagatatttacctctggtttggatagaagttagtgagaccgggtttatggcagaaataaagaatttccgaattagtgatttactttttacccctacgaaatgttaaccataaagagtctttctcctctcggcgacagacctagcccgtgtccaaaaaaactggagacctagccggcggcgagcgggcggcggcggaggagagcgggcgtaggctaggcgccgctcctcccggcgtgtgcaggagagtagccggggagagggtggcggccaagcggcacgctaggtggcggcggggagaggggtaggtgtaggcgctggtgctgcccctagtggaggtggaggtggtggtgttgctagtggtggtggtggtgagagaggaaggggaggaagaggagggaggctagctcaatggtttggacctcatatgtaatagctttatgagtgcttttgtttgaatgcatgatctggacagctacttgttactatgttggctatgatttgaacctgtaatatgtgatactatgttggttatgatgtgaacttgattatgttggtgcttgctatgaactaaactttgctattttggtgttggctattatgttgtcatgctttgagatacttgtaaggtacaatatgacttcatatgattatgtaaaatgttgttgaaattttgtcaaaatgctgccgaaattttgtcaaaattccttcaaatttaaattttgtccaaattgtaatgtcaaaatctgtcatttaattttaaacatattcaaaaaataaatttccaaagccattgcataatgggggcaaaaacacaattaataaatagatttgggggagggcataaatgtcctatttaacaccattaacttttccatccaaaacatgagcaaaattatctttcggtttaaaaagtgggggcgaaaaccctaaaaagtaggggcaaaatcaatattagagatgaaactatgggcataaacgaaattgtccctttttaaaaccacaatatacctcacgataatcgtatggtttttacgataagcatgcggttaacacaggaaccactaaatcctaggatgacggtaaccctaccttaaatgatttaagtaaaccctgactccaatgcacaacaccatggggcatgcggttggtgatcatcatattgcggtatcgacgatgagctccagccgagaagcacaggtttgtgaacataactaacacggactagtactctttttttttccgaggaatagtatacacgagctccatcattttttttaccgagttacaaaatgcaaaaccaaaagactctaaatccttaagcggttttgttcccggttttatttgacgtgacaactgactcaacatgagacccacgtgaacaccgcatgttagtgactacttatccgctccacctctcttcctctctcctccactcctccccatcttcttggcgatgaccgacggagaaaaggaccggtgtagctggtgacgggcggagagaacgggaggcacgacggccctcgcaggagaagcggaggcggccgaggcgatataacttcctcatttctgtcggtcatcatggtagagagggatctagtatggggtgctgaggtagcgacgtcttggcttcacaaccaccgcccgccctgtttacctcattcgctcccatccgctcgccctcctcatcctggagttggagacgaggagttggcttttcttcctccctcgaactcctcatcggtctaggatggcatttcagcatacacgattcagttgggtgtggtgttctagcaaaatctgtttaagtgatgatattaattccagcaaatctaatcttttgtgatagtagatacgcaattttctcatgcatatataggagagaccttttgggacgggagaagcgaccgtcgaattttggtggtttctcagctggcaaaacaatgtcatggggtcgatgtaaattacaatggtccttcgtatcacggcttcacgccgtgctttttttcccaacgatcttgtagtggtggtggttaaaatacaactatcatcttttcatctaaaaaaatcatcttaattaaccttttccccttcctttttgggaaagaatctgacggtatgatgcaaacgttgtatcatatgttaattgttaacgtgaatgttaacaatttttttgacaatataacatattttaccgttttgagctatatactttgacaaatataatatatttttaagtatttataaaatttccacaaataaaataaatgcttaaaaaaataggtttgaatggtgctagggtcgattatgagaaaatggagggacaaacatttcttttaaaagcccgaacttaaaaactagagagcgttcattagttagttgaataacacacgtccttgctactgcacttatgtatatctttacttctttcgttttaaaatagttttaagatataatgatcaatacttgattatagtactatgagtttaaaaattttcagaattgtattactgattagtatctactaattgattagtgatataagtatattttaagagagaggaagtactactaagggcacccacaatggttatctataagctatctacaagagatccatgtcagcatattttcctacttggaagatattaaatgaagagagagagcaaagctatctactagattagagatagtctatagagaaaaacgaggcaatgcatgagagagctatagatacctgtgtagacatactattgaggtggtttactattaa

SEQ ID NO: 74371 - DNA, 1962 bp, Oryza sativa
gcaccctactttaccattgcgggtgctctaataaccgaaataaacgcgaaagctatagttttgacattcctaccctttgcaaaacctcatttcacgatctgacatttgccagctgggaacatgtcatattactgtagtaaggctgggttactttgatgaaaaaaaaaccttaccaaatcatagctgtcaaaattttgagaggattttttatatagttaccaaaatttgacatcaaactaaatatagttattttttttaactttatcaaaatttggtaaggttaaaaatgatatcaaagtaaatatgctctaagtttgcccagagtattacttgtaagagagtcgcaataccaaaattccaggcatgaaaaaaaaaagaaagaaaaggagaggaaaaaaaagagacgatgtcctaccgaaaatggaccgtacagtggtgagcagtagtaaaagcgaatttcacagagaatcccatgtgggccagccagtggacacctttcacgtcttttcttgctgtttactccactgaccccaccctgccgggaaggaatctcacgcgtttcacacccgcacacatcatacgacagcgtggacccacacattctggtccactgtaagtgagacaaggtgctcattttgtagtcaagtcaggttaatctttgcaccgggatgggtagaaatcacggtgcattttttttaaccttttgttttttaccttgcaattttttaacggggaggtagaagtacccgcagataggacgatgtggtcagtggtgcacggggagacgagattgaccgcattaaatgagctagcaagtgtgatgtggtactacactgtagagtagggctgctgcttccgttggatgaactgcacacaaacatgtgctttgatctgagtagactttggcttttttatccgttcttaatacttcgtcataaattatagtataatgagatatattatagtgaaatgtatcttaatatatatatatatatatatatatatatatatatatatatatatataggacactcatatggggcaccatggtttcaaatgcacaaaatcactcaaaattttcaaaattttcaaattgtgagtatatacctagttataagaattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttcaactagttagtaaagtagttaatattaatacctaaataattgaaaaagtttcatgctcatttgaattgggtatatactcaatttcaacaatggtgcccgggcaccatggagcaccaaacaaatttacatatatatatatatatataatttaattttatagtattataattatgttacgatattttcagatggatggtatcagatttgttgtactaagaaatatctcattcatccaaaatctcttttattttaagacagagggagtactttactatacaatgttttaaaaggataaaactttttaaaccaaggtactctctctccgtccataaaaaaaactagaactgatatgatatattctactggacgtgacatattttaatacaacgaatctgaacagaagtagatctactccatccgtgccaaatataacaacttttagcacacataatttattctaaaatataataatttttttaccaacattctctgcccaacccattacaaccctccgtcatttatttttctcacctacctacctacttttttaataaccgtgtcaactataaaactttttatgttctgaaaaggaggtagatttatagtactagaatatatcacattcagtactagattgatttttaacgagacggatggagtagttcttccccgtacggttgctatct
